United States Patent 9,328,346 (POLYCOMB-ASSOCIATED NON-CODING RNAS) - sequence listing, part 13

SEQ ID NO: 1938 - RNA, 170073 nt, Mus musculus
uggaaaucagguuuuuuauuuuccagaaacauaauaguugucuccuuugggagauuaauaacuaagcaugcugaaaaugagaaucaauuauuuuccuuaaaauaucucauaugguagauaauucuaguauggguacuguagcugaugagaacuagcuuuucuucugaccaauacucugcuuuuuuguuuugcaguguucuguuuuguuguuguuguagacaucucucaggcuuguaaaaugacuaaagacagacaguuugggggacaauaauuucaggauguugugugagacuuauuuaguauuagcagcuucaaaaaucauacuucucagagcagaauaaugauggccagagucucgcccacccuuucaucucauaacuuucagaaaccagccaaaucagagagccaacugaagcagaaagggugccucagccucaacuucucaucagugccaugcuugccaacugccaccgaagcaaacuccauucccacaugucuccagugggaucuauggugguuucaggaauuuggaugcuggccucagauaucuuucuguauuaccaucaucuuggaugaggggaaaccaacuccagguggaacccauuccaacacccaggaaggaaguggcacaugaucagauucuccugacaaaguagaguccuucuccauguaacacacugagacaugugccuguugucauggagauuucauaaugcagcgcaaguaaaugcagacugaauagauuccauccaaaaugcccuuggaggcccacggcuuucauucccuuucaucagcaagccggaguccagcuggagccagaauuagugauggguaaagagcugaaaaggcuguuggucccuuuccagggcaccuccaacuucuguaaagcuucuuggacuuggaagacuucacuggcaagcugucccgugagagucucagcucuucuugguuuuuuucauucugguccauaaaccagcaucucacuuugcauuuaggaaagaaguguggaagcuaaucaccacagcuuuuaagacuuuaagacuuugcaaagagggaggaaaaaaaagggauguuuuggguagagaccagaacauuauuuugcuuccagccucuuuccucuuauuuaaguacacacauacugaacuagcuuccauagcacaagagaaaacaauguucgcauuauuaaacaugauuuuucuguuuuuuaaaaaacaacugcuauaugcaaaacauaaauccagaauaccuaguucucuucugaagauuuuauaauaauuaaaguaaaugaaauaguguuuucuuuuuaauucugccuucauacugauguguccaaucaaguuauaaaaagacuguacccauuugccccaucccauggacagagcugaacuguguugugaggacaaaacaaauaacuauacaaguggcagagaauacauaacaggaaaugucucaggacacuuuguugggcacagggaaugacauagcccucagggaagcagauaacuggacugagacaagucuaaaaacacuuuauauccauuuccuuaaauguuacuacauuccacauacaacacacaugcaugcacacauacacauguuacauauguguguauauauacauguauguuacacuuacauacacacauauacacaaacacacauuccaccucaauaagaacaagaaaguuauaccaaaaugacucagugacaucagaaaauuacaacccuuuucuuucucugaagaagucucagaaauccuaauuauaugugacaagcugggaagacagccuucacacgucucaugcagagccuggaguguggaaaaggagagggaaaccgugucuucucaugucguguugcgggagggguucuaaacuguugagcuccuuguagcucacagcuguccacucauaaaaucaagaggaacacaaaacggagcaggugugcagguguaaauuuuccagagccuucugacacagauagcaacguggauccaaaaggggagagggcguggggaaggcucaucacuuccauucagcaagccggaaguccaagcccuggauguaagagccucuccacaucagccaguuucucacucugcuucagcugcccaagaaugcagagcccaacacaaagcaugccucuccucucucuagaauguaaagagacaaguuauuuugcaauuuagauaguaaaguauuuacauuuucgaacaaguuaucauacuuauuuaaaguaauaaugaauauauuuugucaaugaguauucuuugaaaugcaaauuuucauaaacugauuuguaaaaaaacugacaucaggcugggcccauuucaagauaucccacaguuggccacaaacccagugucuucacauuuuucaacauggggaagcacugguugguuauauuauuauuaucauuauuauuaaucagccacaaaugcugauuucccuaacaaaaaaacucugcuuggucuuuuuuuuuucuuuuauguacauaacuuccuuuuuuucuucuuccuuccuucccugcuuucuucuuccuuccuuuauucuuuaucuuucccuuugucucucucccuuuauuuccugcuuuucaccuaaaauacauucugaacagguauguuuugaauuccguauuacagguagccaggaacaaugucauuacaagauauagcaacauuuugccuuuuuuuaaacuucauuuccucuuuauucaaauaaccucucuauauauccuacucucauauagauuuucauggauuuguggggauuuugcagauuacuuuuguuauuaaacagaaaagcaugaagaauuugagggugcacagcuuuaaucccagcacucaggauaggggcagacuaaucucugauuuuggagauagucuggucugcauaauaagaccuuaucucggaaacuaaaaaaaaagagcuggaggaauggauuagcaguuaagagcacuuuuuggucuauccaaggaccuggaaucaauuaccagaaccugcauggagacuuucaauaauuugcaacuucaauucaaggagaucugaugcccucuucuugucuccagggccaccaagcacgaacaagguacacaggcauacauguaggcaaaucaccuuuguaggcaaauauacauuaaaaauaauguaauaauaaugauaauacuacuaauaaagcaauugagaaauuauuaaaucuucuuaauguguguauuugauuacaaaauaaccccuuccuuaguaagcuugaauucuuuuggauauaaagacagauucuugcagggagccauaaucagcagggggaagggacugggcuucuuagagugaagagucagcaccauuacucaacaccuauaugaacuauauauuucuaaugaccaaggcaguaucuuaguuaucuuacucaaguccaagcauauauuugaaacagaacgaguucugcauacauuuugaggaagugagugauugaauaaaugaaggaaugaaugaacuacuccucaaaucauuaacauauugcucacacuugaaugaucuagaguauuguuuuaaaaucuaaauguacccaagucacuuucuucacuaauaggcacauuguuucuggugagagucccaccagaguguuacuuggguagaccaagaugauagcaucuucaaguucagguucaucauuucagucugcuacacaacaguaucaauuagugaaaaaccaguccaacacuuagugguauaguaaugguuugugaaggccagugccaagaauguggccugagaguuccugguuucacagacagcuccccuaggagaacaaagccuucuccugguucacugccaauuacaacccgccuucuagcccacaaaguuucugagaauucagucaucuccccccauacuagaacugguaccaucuauucaaaaucuacaguuguggcauuuccuuggcuuuacuguguaaugaaccauugcuaaguggagagaaaaugaacacauauagggcacgagacagaaaaggaagugaagagacacuugugaggauaaaacucccaucauugaaaccauugaaacccaagaaucugaaaagcuaaucugcauugagcugcugggaugcaaggcacagaggcaaagaggcauacacagaugacucuucucucaacagcaugagacagaguacagcacagugcuuuccaucacacuuucaguauauucacugacuacucaagaugcccuaccacugaaguaauuccugaaggacagaaagcuaacagggucuaccacauucccccaugcauccuuucagcuuucccccucauucugaauaucucuucugguccaggaucugguacuucagagauucccaauauauucaaguuuuguauuuuucuuugcauaaguguccaauccauauuuaauuuauagcacuuucagaaucaucaucaagagaccguaaaucuuuuaauaaucuagaguaggcuuggaaagcaugagaaugccuacuggagagauaacuuuuucuauguccucccaaacguuucaggauaacaauucauuuuaagguggcaucauauucacuccaagcucuagucucucccuuccucucucucguuuccuuuguacucacugugcacauuguacuuauguuauauaguugauugaaagcaucacaucacuuucuccccaaugugaccuaguguuccugaagacccacgaaaaucuugccagagugacuguaaguucaaaucaguuccaucuuacauuaaaauauuaggggaaauaagccaaugauucgauggcauucuugggacaccaauagauugaaucuuaaaccuccuuaacuugucauggcuuccaaacuguuuuccuuuucuuguuucucugcacacagaauuuuccuaaacaaaauaagaauguguagaaugaaugagagugaguuucaugaaauguaaaggguggugaugcuuccuuauaguaaaguuaaggauuuaacaaguguaucaagaagccuucaggaggaagggguccggauggagagguggcaaugggaacaugaaggaucuggugggaggaaauggaggaagggggugcugggagagacaagacaacuagaauuggggacaucucugggaugagcuacaaagugaguauaauggaaacuucaaggagccuaugagagugacccuaagacuccuagcaaugggggauauggaaccugaacugggcaucucuauaaacaggcaacauccccaguggagagacugagacaccaacccagccacaaaaccauugaccuacaauuuuuguauugccuuugauaugugcuaggauaaaaguggugcagaaauuguagguguggccaaccaaagauugauucagcuugagauucaugucaugagauggagcccacugcuaacacugccugcagagccaggauucagaggcuggauagcccagagugcugaaauuaaaccaaacaaaaaaaaauaguuaaugaaaugaauccuaaugauauucugcuaugugcauagauuggugccuaguccaguugucaucagagaggcuucacccagcaacugaugcaaacagauggagagacucacagccaaacacuaaucagagcuugggggaauccuuuggaaagggggaccaaaggauuguaggaaccagagaguuuaaaggcaucacaagaaaacucacagaaucaacuaaucuagccucaaagggccucacagagacugaaccaccacucagagagccuacaugggacugacccucuaugcauauguuagaguugaauagcuuggauaucuuuugggacucccaacagugggagcaucucugacucugcuaucuguuuuuaggacccuuuccccuuacaggguagccuuaccaagccuuuaugcaagaggagguaccuaguuuuacugcaacuugauaugccauggcugaucgauauccauggaggcuggcuuuucugaagagaaauggaggaggaguggauggggguagggaagagagaaagagggacuggaaggaaaggagggaggguaaacuacugucagaauguuuaaaaaauaauaaguaauuuuaaaaaagaagcuauagaggguaggcacaugaaaugacuauauaguaaguauucacuuuucuuugcauucugaaaauaaauggaagggucaagacuagaaggaaagcuagcaguuauucuugaacugggagguuauuagcacaauccaggcuguuagaacagcucagaucagcagcuguaagguuguuaucacaauccgggcauaagaacagugcugucaauauagguguuagcagcaaagauggagagacagacagaaccaggaaauacuuuagaaaugaaaacuggauguguuuugagauauuaaaugaagacgguguguauggaaaagauguucuucauacuuaagacuugauugacugaaaaugccaguuuauucagaaggacuuuuuggcgggaggguaaugugagugagaagagagagccaacaugaagggaaggauagauaguccugagugggccaucgaucgcuuauaacacccaggugacuugauagauuuaucuucccagaccugcuccagcucucaguaggguauaugguaguugaucagagagaaacagaugugggaauguugaugaauacagaccuuucagcuaagaaauaccaccuguucugucucgcauugaucugguuggauagaaaccaaacuugaacuuacugccaucugggcuccaugacaagccuuggugcuuccuggccauaugaucucgguaaguuuggcuccucucucugagccccagccuguucacauacaaaggagauuauuuuccugcucucauguuugcugauaagccuuuuaaaaucuguuauaaaugacagaagacuggauaccuguagaucagaguuauaaucauguuaauauacacacaggcaugaaauaaaaggaauccuuuaaaugaacaugagccauaggagagaaauuggcaacauuauuucuacagccuccaaggcuuugaaacaaccccaagaacaaccugagccuguuaggauccaugaaacguguuuccuacuuuguucuuuaaacuuccccaucacuacagcuaacuccucacagcuugucuccuuguggcugaugcugaaacauauuuaucccccuuuaugucuugguuuauccucgggcugaauucauuccauuuggcugaaaaaauaggccagacuguauccgucagagcuguccucccgccagccacaggggagcuuggagaucauuugaaguaauuugccaacaaaagacugaggacuaaaaccaccaccuguggaccaaacauugugagucuggggguuguucuuuuguaacagcagagcuugggaaugcccaggaagggagugaggucaucugucuggcuaugggcugcauguucugcaggucuucucauuccacauuacgucaugcuggaaaaagaaagugucuggacauuccuuacacaaucugcaggggugugaagugaggcagacauuggcuugcuggagcgucauggcacauugaucugcucacacauguauauacacaauuaaccucaccagcaacuauggaauucuuguggcaugacuugauucuuuguguguguguguguguguguguguguguguguguguguguguauccacauagcuuugugugauguauaacacauguauguauacagacaggugcaugugugugugugcucacauagaggcuagaagaaggauguuagauguccugcuuugugacugacucucugccuucuuccccuccaauaaucccagcuaucuccaccccuaggauggaucuuuugcaaaaccauguaugagugcuaagacuugaacccagguucucaagcucacagguucucagguuugcaaaggaaauguucuuacccacugagccaccucuccuggccugcuucugauuauugaguccaaacucagcuugccuuuuauuuaccaaugauuaagucuaaugcuuucuauauaaagucugugcauauacauacuaagcaaacaaaacaaagcucauaccuccuaaaucucucaagaaauagcaggagaugaacaacuaacaaaucaacaugcaagauaugacacaaaguccugugaguggucucaugagagaaucgagaaagaaguagaaaccauacaggggugauuuaggcuaagauaaucaagaaugguccuguuuugaagcugacacucuaauggaaaccauaacaaaucaaggaaugcagcaaugucugaggaaggaagcggucuggaagcagaaacagaaagugaaaagguccugaggcuagaaaauacugggauuuuuaaauacucaucuugcagcaucuguaaaagucccuacugagccuaagugugaauucucccagcauaaggugaggaaacuccccauucaaguggcagucaaucguauuagaaacaugccugauacuuauucuauaguuccuagugucauuacacuguguauuuaguucuuacgugugcuuucaauugugcuuucucuaccaaaggaacauugaaguaacaguuuuaugaucgaucccacugggaaagcaagggaagaugaaagaauuccccaccuccuaucugguuugcaugugagcauugaaugugggugcuggagcgauaguucaguguguagaguacagcacaugccaugaaaacaaaaggaccugaguuugaauacaagguacacacauaaagccaagacagugguaggugucuauagccccagugcuucaucacugagaugggaggcagaagaaaaagaauccccagaugcgcaugggucagccuagcugauccauacugugcauacaacaaaaggacucuaucucaaacaguuagaaauguaguugguacugcuauucgugguauuaugacaaacagcucccuacauguaacauauauguagaguggggcugggggcaacauugaauguguuauguuuggauuaaacagcucucagacacuccuguccaccuuguccuccuggucauguucaugcucccacauugagauuuaucacugugcagugccaaggaugucauaaagccaccauucugucugugcacugauguaacaagcagaguuugcucuuaaaaaggcucaacucagccuuuuuucugccuccccaguaacaugaauagaucuuauuacucaaguagucacucaaagcccccuuuucaucuggaaauucccaaacccauccauuucacccaucaguggggaccuaauuuugugagaauugaugugaugugacucuaguuaguaucuuuggacaaauaggaaaugacaaugaaaaguaaggagaauuacaaaugaaggagauugggaagagugagcacuaaggggguaucaggcccauuuagaagucacuguaaccuuguaagguagacaccugcacacccauucaccauaagugauauuagguauaaggagauucuagcaccacuggaaaccaaacagcuagcaaauaccucuccugggauucaaacccauguguugcuucucugugucuaucuaccucaguucccucaguuuuucucuauaaaagcagagucauucaaaaggccccugauuucucuucauuuuuuccaaccauuuagacuggaaaaaucuaacugacugaaaaucgacugaaauuuucagcugagcacccacagauaucuacugacacccaauucagcaguaucuuuuuaaagaaguccuccccaaaagugcuggcuucaaguuccuggcuucuacuuaaaguuacuuaacuggcaccauauaauagauauaaauaguguuggguaauccucaaggcuccgcuggaaugaaauugguguggucugagguuuggaugacacuaucacaggaauuguuggcaccaacccacugugcucccuguaauaaugguuucuuaacaaaagacgcacauggcuuuuacuaaaagaacuucauuaguuacuuugauuaauucuguaauuuuccacgccaugauuaauugcaacaugccugacuuucuauuuggaguaggacaucccuucagagcagggacuuuaacuuccuuugucuguguuuucauaacuugacaugagaauacucaauuccuuuucacugaggagauaucaguuauuugcugggaaaauaugcuccauauguuaaugacucggagucacaaucauucucagaacccccagaucuguggguccaugauuucaggaggacuuagcuggucagcacuucugguuucuucuaagagcccucacaagaaaggaguuagacugguuccacuagcagcucauauuuuuuguguuacugucgauguguuuugcacuccaccaguauuuugucuggauuguguucccauagcacaacauggauacaggaaaggguaagaaacagaagugcagaguugaaagacagcucaguuagugaagugcuugcuuuaugaguauaaguaccugauuucuaucauaagacgcuuuaaaaaaaaaaaggugggcauuauggugcauauguuuaaucccagcacuuggaaggcaggaacgcauagagcuguggaccauaccaacugagccagccuaggcuacuugguaagcuccagacuacuaaggucucuaaaaacaaggucgucaucaccugacccaugauagucacagaaaaaaauuauccucuggucacucuacauauacacaaacuauauucauacacacaugcauacacacagagggggguuagggaaaagaauccuuuacagacugcacacgcaggcauggaacuggcucacuuaucauuucugucacauggugucggacaagucuaaauacaaggacagaccagaggaaaaucaggguugaacacaauaccuuugaugaaaggcauauucugcgcuguuguacuggcuauagaauaaguagaaaauuacaccuaccccccacacaaacaugcaaagaaauguguggaauauuaagguauauuuucuuagcaaaacuaagucuuuuuucaucucuucuaacuuggaugagggagcuaaaagucaccaaacaccaagcaugguguguucuauuuacuuucuacaaugaaugucaaaaacccaaggggacuucagagauuaguugaucuuaaugcuuuagguuugcuucuccuugagugccuugaccuucugaccugauuuucuuuacacaugcaccuccacuuuguucugauaggcucuacagaaugauuugguggaaaauguauguuuugaaguagauugauuuucaaauucugaugacugaauacuaaucagacgaccuugaacaauaaaauuugcaguucugaauuguuuucuucaucuguacaacuggaacugcuaauagcaaguguguaggucugaugcuaugacuaaugagauauaacaacguaagugucaauaaauauguguccccuucacauuucccuucccuucauugaagauauucuuccaugauucugagaagaaugcuuccuuaucauagauacacaauguuucucucagaaauacucgagucaaugauaaaaacugaauauaccauuuuuacuugaauugggaguaaguuaagagaauuucucaaaaaaagaaaagaaaaagaaggagaagaaaaggaaaaagaaaaggaaaaaggaaaagaaaaaaaauuagcaagaugucaauuugaaccggcaaucugcauuacaacacaccuaaaugagaauucaucucugauagcugauucauuaaaaacaaaugguuuuaaagauccugacagugggaacaagucuacuuuuggcuauccacuuagugccuguuguuauagauucaggggcuuugcagcagagagccaauaaucccaaugagugguaauguagagcuaaccuuagcuugccuccugggaguccuccagaugcugauuucuuuauuaucgugucugaaauuaaagaaaaaucacuuccauuauguucgcacucccaguucuucauuccucaaaagaaaacuggcugacaccaacuuccccucuguucugcucaguacuccaucauccagcagagccuccuccaugccccuguugcuccccaagacuuauuguuucccucucccaacgucccagaagauuccagagugauuuguucaugcuucagauaagccuggccauaaaugauucugccaauaucuaugacaacacuucuugccaaacacagcacuugcuuucugacagaccugcauguuucuugcaggucaccucuugaugccauuugcauucagaccaaauucccaggcaucagugcccacccaucuccacuaacacugaaugcaucaauuccugucugcuccagccaaugaugucacaggaaaauaaaagaacuuggcugcauaagaugauuuuaaguucuaacaaguaaauguaugcccagagcaaagauauggagcauuaugaagcuaugguuaggauucuaaauuacuacacagggucaucaugauucuucucaucuagauuccacuaauagccauguggcuucaaguaaccccuucccuucauggugucuuugcacuuccuccuuuguuagccaugcacuuccuuccugugacuaagcacaaauauaggcaaguugaauggaauacuaucuaccugugcucagaguuucaaagguuucaauucaugggcaugguaggacaggacaggcaacuugccagcagucaggaagcagaaagagacuaucuaagccaacauccuuacaccucucuccuucucuaacaccaaguccuacagcuaauaggguuguucuauccauguuuagagcaggucuuccaagcucagguaaucuuguuuaggaauucucuuuuaaaccaacccagaggugagcaucacuacguuccuaagcauuuauuucuuaaucuaaucaauuugacaaucugacagucaacaucagccauugcuuauuugcacagugcaaacagaaacaauaucuaccaguaaagauugugaugagcuagagaaaauacccaaggagcuaaagggaucuacaacccuauagguggaacaacauuaugaacuaaccaguaccccggagcucuugacucuagcugcauauguaucaaaagauggccuagucggccaucacuggaaagagaggcccauuggacuugcaaaauuuguaugccccaguacaggggaaugccagggccaaaaagugggaguggguggguaggggguugggggacagggugugggggacuuuugggauagcaucggaaauguaaaugaagaaaauaucuaauuaaaaaaaagauugugaugggauugaacagagcuaaauaaaaccuuuaaauguauucucuccuuugcaaaaucauguuucaugcuagugccugaaguuccaaugaauuaacuacuacaugcucuuaagcaguugaucaaguuuucagcauucuagcauauuaguuuauugaucaaagagcagaaauuauaaccuuugucucuagaggugauuguaaauauuugaagacugugaagugcuugacauaauacccaaacaauagcaaguucccuuggcaguaguaaagcucucaccagaauaucaacuauuagaauaauagcugcccaggaugaaugagggauuguuuaaguaucaaauuacauuuaaaaauuaacucuuaugaaucucccagguugauagauaaacaccaaaaaugaaaacacuugauuuuuauagacuaaauuugcauaauguaucuaaaauaaaacagugguuucucuuuccucuguaagaaaagcuggaaaaagucuuaccuugcaagauuuguaggaugaauggaauacuauguaaaaaccuuuggcacauaguuagagcucagcaaaugguagcuauucuaaaucaaaggucugagacaggaaaaugaccuguaauuuuuauuaauaugaacuaaauucaggggagaacuugauuuauucuugcaagucuggcucuaguuaacuuaaugaaaaugaaagaucuaggaaaaaugaggguuccacgagauaaggaugcaggauauccagggaguuuuguugagguuaguucuaaugaaucucuaaaauuugauucaaaagacuucauuuuaugagguuugagagccaauuucaaauaggaaaccagauucaucaaggaaaagaucaugccaauaguacuaucuucagcaaaggcgguuuuugagcccaacucuguuacauuaaauagaguuggguaccauugauagagaugcugcuagcacagguaauagaucuaguguacauaugcauaucccugccucugucucugucucuguuucugucucgcucucucuuucuuucucccuuucucucucucccugucucucugucaugcucugucacucucucucucucucucucucucucucucucucucucucucucucucucucucucucucucugugugugugugugugugugugugugugugugugugugugcaugaaugcaagcuuuaaacccaauugaccuuguccuguagacuuccggugaguucaaauagaucauugagcuaguauugcaaggcaauguuucccagagacaugagcagaaaaaugcaucaaauauaacccaguaaacaguggugcuugccaucucaaacacccacuuuaagucuuggaagaaagccagguuuucuuccccacaaacccaucauuuccaaacucaaguuugucucaggacaaucgauugggagaaacuguuuguuuaggccacaugccacuaucuaaaugcuauagagguacaugauuaaaaagaucacgaggaaugcugaguuaaugugauugacugccuagauuaaaacaacucagaauauuuuaaugacuuuaucagaacaaaccaauggaccucaucaaaagauuuuacauuauuuuaaacauauaagaaaaaaucauuacaagcuuaacaaugaacaaauguguguguguguguguguguguguguguguguguguguguguguguguucacacuguagagcaggauaccugucaacuuccauagacuaugcagcugaauaauuguaagaaaguaagucgugucucucuauuuuggugaugaaaggaaggccuagggagagcugaugacuauagcaaucuagguuugaauauuucauuuuuguucuuguuaucacaccaguauauaucuguauguaguaucaugggugguuaugguuaggaagacauuaagugauauauggcagauauauuuccauuuaauaaauucuuacaauuuuguguguucaaaauguccaagcauaucagagucaugauuucugucaaaguaauuacuuaagaaaaggcauuuauucaugucuacuuaaggaaaaauauuaaauauauguuaagaauaauugauguguagaaggcaauguucaagauaaagccaucuucugcuuuaaaaagaauggcuucccaggagaauuuuccagaaacccuuuaugucaauaaccuccagaguguuuuccaaguccugcuaacucauccaucuuagucucucuagccaaagcucaaaaucagcuccuuccuguucuuacuauugucccaaugguuuuaguucauuguagucucuccucccccagcuugaaacccgacccacaguucauuuuccaccaaucuucugcaucccaaucccuucuacacuuacauucaaauuacauuucuaucaccauggcaacaggucuuccaaaguuuaaucuuagugucaguccaugaaagucaaauaacucugcuacaccuaugguaagcuaaauagcaacacacacacacacacacacacacacacagagagagagagagagagagagagagagagagagaaaugucuccacuaaacccuaacacacacagcugcccccuauccauacacacagcugccccaccacaaccacacaaagugagagagagagagagagagagggagagagagagagagagagagccaacaucuaugaacaucaauauauacuaucuuacacgugauaaaauuaagcauuuugagauaugcucugaauaagcuaggugugccaaguguagacucagguguccuuugaagagagaagcuguaaaaacagagucagagggggauggagcugugaaaaagaaaucaaaguaauguauggccaugagccauggaauguaggcagucauuacaaguuggaaaaaguaagguuuccuuacugauacagaaauucaucucuacuacccauuuuagauuucugaccuucagagccauaaauugauuuaaauuauuuuacuuguguuguuuaaauccacugacugugcuguagucuauuccagcagcugugggaagcuaauucuguccuaucugaagcucuucuucucuuuuugacaaagugagccuuuuucauaaaauagcuacuuguggugucucucucccaacuucccaaccaauuccaugccuuaagauuaauguuaaagauacuguauaacaaccacuguaucaaaaauauaaacauuaacagaaaugagccugacaagaacauaccugaucaguguuuuuuacuauuucccauuguuuagauaugaaaaagcugaagauccaaaugauguacccaagguucagaucuaauacuuguaaaggaaagagcuauauucagacaaauuugauuuuaucaucucugcucuucaauguauguuauaucacagccuuggaaauaauagguaauauccagugauucaaauccuuucuaaugcucuagccagggaugcauucacaauacagacccaagagaaacucaguagaauagacggugcgugauuuuaaagacagggcacaggcacaacagaggagaaaauggacagaaaacaaacauagguuuacugugagccaguaauagauaugugugagauuaucugucauucccggaacagauuuuuaccagaaguauacaaagagauacauggcaaggugaguauagucagagaccaagacuacacuuaaguuuagucuucuaucacuuaagaagacugugguaaccacuguuccccuuuacuucaaagugaagagcuugugggagagauaaaagucagagaggaucgccagagaguuugcaucacaagagguggccauauagcauuaugaagaacacuaacugaaaucugacauuccaggauaguuccagaggagagauuugaauuuaauuuguuuuggcucuagaacucacauuggcauaaauauugaacugauaaagaaccuucucucuggugaacaggaugagauacauagauacuuccucuuaguuacaguggcuugagagaaaaaucugaguaaauaaucuauucuaacuauuggaggucaaaaguacaaugaacaagcaaaguuuugucaaugaaggguauaguccaaaccaggugcauaccaucagcauauccagacaaguuugccaaauaaguaugacucauuuauuaaaauagacaccuaacuuccucugacucaguagugaagaaacaaagcagaaaucacuuuccuuaauuggacaaagccuaggugacuugaaaaggaaggcacaucccuagcaucagacuacuaucagcccuggguucccaucuucagucugucccuacuucuuugccuguuuguucauggguaguguaguagucagaguucucuagaguuauagaauuuauggaaugaaucucucucucucucucucucucucucucucucucucucucucucucucucucucuccacauauacauauaugcauauaucaaagggaauuuauuagaaugauuuauaggcugcagucuaacuaacccaacaaugacuaucugugaaugggaagcccaagaaucaaguugucgcccaaucccucagacuagguguuucaguaugcaauggccuucuguaugagcuggaauccugaagaacuagacuccaaccgauguguuggcaagaaagugcaaguagguaaagaaagaacccuuccuuuuuccauuguccuuaugaaggccuccagcagaagguaugacccagauuaaaugugugccucaaaaucuagacuaaaggcaugugucuuccagccucaagaucugggucacaggugucuccucuauuucuggacuguaguucauuccagauauagucaaguugacaacuaagaauagccaucacagcuagugaagccagcucuuuaaauuauaugacuacuguuuuuuaauaucuuuucucugauccuucuagaaaaucacaaugucauguguuuugaugggcccacaauugcccagaguaaagaugccuuucugcaagugccuuuauagcugcuauggacgugugacuaagucccaaggaaggggacaaagucagcacuacuuugcacaugucucugguaaccccuuugaaagaauauauuggcaccuaucuuuaaguaucuuauuguggcuuccaucuuguugcucugacuaucuuuggaauuugaguuuaaauguuacagccagggaugacuggaaaaaccuagaauuucucauuuauaucagugauagcuaugcaaaugcauacuuuucuuugaaaacuaaauaaacuauguucaagcuagucagauuuggaauuuuucaucauuagcugugaaccuaaccccaaguucuguguuggucaugucacacuuucauuucaaaaguuuucacaauuacccuuagagaacaguuucaaacccauuaacaaaacacucaaagcccuucagaauuguguauuuagucucacaauuuaagcuuccuuguugacauuuugagaaauuagcaauacuuauagucuguaauuccccaaguauucuuccuucccacaguuuguucaguuuccuuucuccauucauagugucaaugucugugcugaagcccaugcucugguaaugcaccaguccuuccaacacacauguggcuucuaacuguguuccauuugucuaucauccauuuagaaauugcuucaauauggaaguaaaaugugaggacuguaguaggagcauggcagacauggcucagguaggccuuacacuaaucccaugcccacuuccuuccuaaaugauuagauuacaucacuaaagcuauccacaaaggccuauucccuuacuugaucacuuacuccuccugaggcugacuaccaagguauagcaaaauauugaaguccaacaaucaaaagcuccccuuuggcugccuuauuuaacaugcccaaucaaaaucaaucaauucauccuaacaugggguuucaugucuauccagauguacuuccaguacaaauacacuugccuuguuccuuuucccuucucccucauucuccaugucuauuaucaucucuuauucucugcucauuguccaucugggguaauacacacacacacacacacacacacacacacacacacauauauauauauauauauguauguauauauauauauauauauauauauauauauauauauauauauauauccuuugugcugagaacacuugguguuuugugccaaauuugagacuacauuuguaugacugacuagacuauuacauuuuuccucaaaggaguugaauaauuuuccauuuuccuucuaagucauguauaccacuuugguagacuuacuacuuucuucuauuggaucauuguuggucaggagcuauucuacugcugauaaaucagauacuucgauguuauucccuaguuccuuuaaaccaaaucugcuuugauguauauucagacugccaacucuguccuauguccuuaggcaccuaaccauuucuaaguaucaauuuucuauuccuuuaauauggaaguuaaacauaauuauuuuauucaauauuaaguuuguaugaagaucugccuaauauuaauaccaaauggaauuaauuacaauauuuucuagagagguucuaguuuaaaaaaaaagucacccccaaucucuaggacuaaaaauauaggaaauaccagacaucucagaagccuugcauggcacagcaaguacuagacuaggcauuuugaccuuuaaugagucccugacugagccauuugauucaaauagaggcaugaggaagucaccuuaacuccuagacuuuauauucccuguguucaggauugaacgugcccuaguaauauuaaagaaccagucuuaauaucauaauucgcucaacacuuuagcccaacauuauauucuuacccucccaaaccaguuuucccugugauggacuacucugccuagugcuucacauuuuuauacuucuacuaccacauuaugagaagcaggauaaguugguuguaccuucagacuguggucugaugaugcauguuuguguagagugaaugauuaguuucauauggacccaugauccagcagcugggaccaucugcuuacacuuagcacaaagccaaacuuuccacaguccuggaguaaauguucuccugacugagcugcgcuggcugcucuggacuacauaagucagagucucauggccuguauccaugugucaggaagaauaacccagacaugaaacauuugagguaagaaucagcauucugguaucucuagauauagagaaauugucuauagaaauagaacagacaaacaaaaaggaagcuuguacaauuauaugauuaagaaagauucugaagcaugaguuuucccaaaagaaaagucauucuucaggaauauugaccugaguaagacgcuauaacugucauagauagcuuuagguugagaccuacacacucguuaaaagaaacaacucccaccaugcacaaaacugcccugcagaccaauguuuuucucccuugcaauagacaacaugccugugggaaggaucuuagaauuaauuauuugaucccaagcauuucuuccacucacucugaucaucuuugguccaguucuacugcucugggaaacaguagccucaucccaaaggaugcuacuugagaccacauaagauguuccaugaaaguguuuugucuaaugugaaauauuauccagaugucaaaacuauuauuacuaacuagagacuaucccaaggucauagauuuagaagugauuauguuuuauucuacccaacaggguagaaauuauucuacucugagauauaguauuccaguauuucauaucaacagagaauuuccugagauaaguggucauagcuuggaagaagagucaauaauaaugagaguguugaugguuauaaaaucuuguuaaguugucuuccauuccaucaaggcaagaccacaacuggucuauuuucucucuucuggaaucagggaacaguuauuucaaagaugaagaaagaaaaggcaaagauauugaugacaaauuguucuagguucauguucuaccuuuugauuucuuuauucuugaccaugaaaaugcugaauaaacucugucgaccucagugugaguggugcaagaggaagacagugaacuuagacagcaugugaguaugccaaguuagcaugaacaguauaguguuuuaacugcuucauagugccauuaguaacuggcauuuguaccuauugcaagaaauagguaccuguucucaagaaauucaaaaucuaguaauaggaaaagaaauagaggcuacuugaagaaacaagauaaguuuagggcauugguauagauuggacacacugggacugggggccccaucacaguucagaugaacauccuuaagacaauuucucugaaacauuggucauuacacacaucuuagagaggaggauuauggguaauuuuuaaggcaagaaagauagacugaagguuuucaacaaggaacucuaauuauacacaggaaaacagaaggauggaagagaaauggucacagaaguaaccacaggguaauaccacaacuagacucuagaccaaauauuuggccaaguuagaaguguagguauuuuagaggaaaagucuagcaguuagauacagacauauucauggaaaauauuaauaccaggugcgcaaggaucaccguagcaaacuugaauuuggcccugagcaaccaugaacauauuuuaaauuuaaaaugucuugcuaagauauuagaaauggcauggauuaauggccuuugugucaucauguuguucaggaaguauuaaagcaccaacagauucagaagcuauuucugaaaauguaaaccaaaggaaagucaucccugagacuccacccaccaucccuucccucuguagaagcuuggccuuugucauuaagagcacaaaguguuuggaguagaucugcaaauugccaaaguuagucuugaauaguuugcuucccuuaauaaucauuuuaaaagucaacccugccuucugagaccaaaaauauagcucagugggaaaggaacuugccaccaaaccugacaucuuaaguuuagucccuggauccuacaaggugaaaagaaagaaucaauuccacaagacccacacacacaaaaaaaaaaauagaugcauuuuucaaccaacccuacuauuucuuuuuuauucaagucuaaccauuccaaagacauuauaggacaaacggguacacuccugcuuacacuauaauaguuuaucuuagccagguucagaauucuguucugaauuaguucuuuccaagcuacauaguagauggcuucaauaccagucuuuuauggggacagaauacaguugccaggcccugguaauaaguuaagcuauagcacccacucuuccuuuaaauucuuuuuuuuaauuagguauuuucuucauuuacauuuccaaugcuaucccaaaagucccccauacccucccccccacuccccuacacacccacucccacuucuuggcccuggcauuccccuguacugaggcauauaaaguuugcaagaccaaugggccucucuuuccacugauggccgacuaggccaucuucugauacauaugcagcuagagacaagagcuccagggguuacugguuaguucauaauguuguuccaccuauaggguuggagaucccuuuagcuccuugggaacuuucucuagcuccuccauuuuaguggcuguugaugaucucaucaguccuccucucuuuaguagcauucugucuuugaccuagaccaaaaaagaucuacugaaaugugaaaucaucuauccagcugugacugauucugguacaauuaacagaggcucaugucccaaacacagacaaauuucccccuggcuggguccuuucuuuucauaaacacuacguccaagauucuccaauggcagcggaacuuuaacauguagccucaagauccucugaucauccuuguuuauacaacucagacagagcuuuguuuuuucugucucuugucuugaaaagauuugaugccucucuccacccuacucaccaccccccacauacacacaaacacacucgagauagugguggccuguuucauaccauuucaugaagaaaaucaugcuuuuaugaagcuaaaaaugcuaguuacagaccugucuucccuacagagcuuagagcugaaggcugcuucuucacuuccuucuucuuauaggauuccuucuaaaaaccaucuuaucuaaacaagccuccuuaaccuagccuaguuuuuuauuacaucacucauaggacaugcacaaaaguaggaacuuggcuuaaaguguuuaucuucauauccacccagccuacauaacuccuaccagauagguagauggaugaauagaugauagauaaauagauaauagauguaugaauaguagauaggugauagauagaugauacauagauagauagauagauagauagauagauagaugauagauagauagauagauagauagauagauagauagauagauagauaaauagauacauacauacauauauacauacauagauagauacauagauacauagauagauagagaugguagacaaauagauguugguagacugguaugaaaaaaauugauugacugaugauaguuagauagacauauaguugcugguagaugauagguaaauuauuacauggauaaauacugaaaaagugacucucacugucacacaucaaugucaccugcaaagucuuuacuccucucuuuccaagacaucaaccacaggggagaaacuuuuccuucccaugcggucugaagaucaccacuccuuacguuagcuuuguaauuacaucaacacuugguuuccuuccuaacaaaauuaauuguacaacaguauaacacuagauuggaaauaaguaucaaaacagaagaauguaugucuugucuaguuuuagagggacuucaagaaccaaaaaucauguuugauguauaauuaaaaaaauagaccucuguugaauuaguacauauauaugaacucuuucgucaaauuuuuauaaaaaauaaauccuuucagugauugaagauaaaggucuggcagcuaugaggaaugaaugucugagauguacggguggaauucagacuauuguauguuuuccugaauguuaucugcuuuaagcagaugaagcuucauauuccauuggcaucucuuugcauuuaucuguuuaguucaaauuacuucucaaaaucagagguuuuaaauacuacauuaaaaauagaacuaucaaaauuaugugcaagggaccauaguugaaauucauucuuauacuccacauggguaaggaacauuacaaggagcccacuaccucucaucuaucaccuccaaauaucaacacugaaaaagaaagaaaaaagaagcagaaacuccaaggucuuacccguggaguagacucugaauggcuccugcuccuggcuacuaaggcguugauucuaccucugcucuccauggcuacccacugccccaagccagcugcuuugcuuuugugauucacugggucugacaucuggcagaaaagacauaugugcugacauaagaaauaacaaggagccugcauugccucuaggaaagaccccugccuucugaugucagaaagaggcgaggagcuuagagugcuacauuuagcauuggacugcuucagccuuuccgccacuagaccagcucucagaacuuuacaagcaaguuguaaaaaguggacucaaaugugaaacaugaaguaaaucccuuauugccagaucucuaccuccuucaaauggaauugagccccagaccuaaugggagguaaagugaggaacuggaagagggggaucuaguuagcauuuuaaagcuaauaaaagaagaaaaagaaaucaaaaccaggcauuuguacuuucucugauugcagacaaagcaugacuucauuuacaagguugaagagucucugucugcuaugacucaauagcaucccuugagucaugccuugguucccucucugccccagucugugcucccucugugccucugauggauguaaaaaucucaacuuccaaaucucuuguuucaggaccuauaaaaaauaccaaagaaaauguuaucaauuuuaagauaacuguuuaaagcaaacaacugagaaacaggaguucauuuuuuuuucucaucuagaaauagccagcaaacuccuucuccaacaugguuggauauguuugauuuccaucuggucugaauguuuugucauucaacacucauaaaaauuuuacucuccucaaggaaagaaucacaaggcuccaugcauucuucuaccucucaaaauauacuuuccuguaauuaguccuugacaaauucaagauguacaugagcuaagagguauuuguaauauaguggggggggggcagaguuggagacuuggcugagaaacuagagaguguucauuugaauaccacaucugagcaucucacuggacgcugggaaauuuucugagaugcacuugauaucacauguggacuguagugugauuguguguguauguguguguguguuucugcuucuaugcauuuguguguuuucuuucauuugccaagcaacagacuuaaaugcugagcucagacuccgauaagcauagcaaugcagcuucucuaucugcauugggcacagcagcugcuuaacaagcuggucauccuucuguucucaggcucugggauucuuuacaugcuccccagaucagacugagaagaggaagcccugcuacgaguguccuccauuuugcaccaagcucaagaaagcuguccagacaugguaaacuacaacuucaguaguaaugugcaacagaucuucaagccauuccagucuuuucuucaagcucuggcauauucucccuggaucugucugggugcaaacuccagggaaguacauugaaugaagacccauuggggcccccaauuggaagaagcagcuauaaaaucagcucugcuaaggauggcuagguauuucccaucuccauguuucaguguacugcucuguauauguagaacuuauaauccuggugcaggccugauucagcaaugaauacaagaacccaaggaguaggguuaggcuuuaucaucugcacaucuuuuuauaugcgcaaugaauuauauuagcaacaguaauuuuaaaguugggugggccauuucaucgauuucacaagacaguguuacuuuauacaaacagaaauuacacuuccagcaaaaucuugguaguguaugcaauggugucagcauuuggaggcugauuaugggauggaucuagauggaucuacauggaucuggcacucucuagaugauccauucuuucgucucagcuccaaacuuugucucuguaacuccuuccauggguguucuguuuccacuucuaagaaggggcaaaguauccacacuuuggucuucauucuucuugaguuucauguguuuugcaaauuguaucuuauaucuuggguauucuaaguuucugggcuaauauccacuuaucagugaguacauaucaggugaguucuuuugugauuggguuaccucacucaggaugaugcccuccagcuccauccauuugccuaggaauuucauaaauucauucuuuuuaauagcugaguaguacuucauuaugacccugauauagcugucucuuuugaggcuauucuugggccuagcaaacacagaaguagaugcucacagucagcuauuggauggaucacagggcccccaauggaggagcuagagaaaauacccaaagagcuaaagggaucugcaacccuuuagguggaacaacaauaugaacuaaccaguaccccggagcucgugucucuagcugcauauguaucagaagauggccuaguuguccaucaguggaaaaagaggcacauuggucuugcaaaauuuauaugccucaguacagggaaacaccagggccaagaagugggaguggguggguaggggaguuggggaggaggguaugggggacuuuugggauagcauuggaaauguaaaugaagaaaauaccuaauaaaaaagaaaagaaauuacacuuccaacagauccaaguucaauuucaauucacaaaacucaugaggcauuuuauaaccaccuauaacucaauuuccaaggaguccaccaaaaagaaauuacaauuggucauuccuuaucacuggauuucuuuucuuagaauuaagucauuccaaaauauuuuuaaaauaaaauugugggacuaugaaucuagcuuaguugguagaggucuauuucuacauacauauauacauacauacaaacauacauacauacauacauacacacacacacaugaacaugagcauguguucgcaccccauaggacuauaugguauaccuuaaguauucacauuaccaacaaucuuuaaguaaaaaucguuaacaaaaugagaacaaagaaagugugaaauaguuuaugguagguagacaaagaaagaauaaugacuguguauuaguuaucuauuaccacauaauaaauuaacacaaacuaauaaugacaaccuaaagguaguacauacuaccauuaguacaaacaugggaauuacagccuucccaguggcauacacaguuguaagcauuuuuaucccucauggugccugaacauuaugaauuuggggugauucuggcuaaacauuuuaaaucagguuuguaguaaaauuuuguccaaaacuauaggccuucgcgacucaccuugggcuagauucuacugccaagaugcuucacucacgugguccaggagccauuguugacuguuccucucagcacugcuugaguguccucauggcaugugagcucuugaacucugaggcagaauuaucuaaaauacaaagguggaaauagcaaugccgugaugaauucuccucagaauugacacacuaucaauauguccuuccuaauuacucauauaacucagucugcuguagcauguauggagacugaacaucggggagaagaugaucaagcaagaguccccuuccagacugaccaucacauugugacacaacuaaugagagagguuuuagaagaugcugacuuaaucuagaguuccaguucuaccaagaaggcacuggaggaagaaagaguuacacacggggucaguuaagaugucucaacacugccaagguuagagagagagaggaugcacaauuucugguucuaggaagacugucauuuccaccuuuguaccaauagugguacuaccuuuagguugucaauuucaaggagaaauccagcuuucuuacuuuuucaugccaaagcauuauauaucccuagccuccaaggaaucugcugaggcuguuaccaggcacucagacucccuacuuaggguugaaggcaaacaauauggucaauucuaaagacaaauuaugaagcugauauuagaagucuucuacuccagaguuuacaaugacuauucaucugauagaugguauguacuaugaaauacacuauaacaguuuguaacuacuccuauuaauauauauuuguuuauauagauggauauguuauauauaaagccucugcuauaaaacaaauauaaauuuuuacuccaugggauucuggguucaucuggggacuacgugaacccugaauaucuguggcauuuuuagaguuuucucugugcauauuuugcuuugaguucuauucagagcauccuuaucuuuguguucuuacuaacaaaugauuaauuuuaaguaaugacaaaagauuuuugaacccucauuucuugacuuuuaugaaaucacuauguuggccuauacauaaauggcaaauguuuuuaacuacauugcaaauaaaauggugaauagcaaaguaggcaaaguaggauggacaaaaauuucagcacacaaaaaagcuuuccaugaaagaugauuuuaaaagccaggcuacacagcgguucucguggucaguaauuagacugugacuccuucagcauaaacuggcuauguccagggucacugccaguguccaaguauacucaaccagaacuucuucacagaggaaaaaggcagauuggauucucgagagccucugaguucagauaacauuuccuucuaccaaucuaagggacagacaagaucaagauggauggaaucaccauggacccacaaccacuccaggcuuagagagaccauguagcaugccacaccuauacuacaugauaaugcagaacucuggacauuaugauucuccuucuuuggaucacaucagcuccucugauggguacuguuguagcuaaaacaauguguucuccccuaccacauaaacgucagagugccaucugcacagcaagacaaaacagagcaaauggcauaucauauuuuucuucacucagucuccuacuauuugccugguguuuacaacgugcuaggugugaugucugaggacucaaugaguaagcuacaagucuucuuacagagaaaauuagucauguagaaagaaugaucaaaagcaauuaguaggaaauguuauaagauguuauauggaaguuggggugugaaaaagacaggucacggagugaugaauaaaggaaaggugacacugggggagauggcagccagauuauuugggaagaaggaauuaucagaaggggaggggaaaagagaaagaguauuggaagcaaauaaucaaaacaaauuaugaaaaucuuauaauaaacccauuaugcugcacugaagugguaauuucugguuuuguuggagacuguuguuucaugugauuuuuuucuggaaguugucuuaugagaugauaguuugaugaggcagagaugugagaggauauuuugcugaggcaaacacuugagaggaugcaugauguuuggaaaggguaucaguauaacccaacagacagugggcaaugcucuagcccugguucccauugcaacacguugaugaucuuuaccgaucuuugcuugucgugacuucuuuuuuuuuucccgaggaacuauuugagcauauauauuuaauguaugucuuacauauucauuuuuauaugugaaagccuauuucuuauacguaagugcacauacacauacauauuucccccacauaguauagaaggaaagauuuagucuccugaauuucugcuuaagucuaguaaaguaaggaaaaccucaguuugaaguguuucuguucacucccuugcauaccuagcacauggaauaaacaagucaugugcuuuuucaaaggccaaaagaacuuuccuugucaauccaaauauauuuuguaagacaauacaauuccucuaaagaaaauguauacugugccuuuaagaagccuguugcagccccugguuccaaugauaagcucuuaucccaacucuucuuugcgccaaacaauucuaauuuucauuuaaaccuuuuccuugcagaaguuggaaaacuagaucuuaugguguaauuuuuagcucauaucuauuuccucucuuuuguuaaaaaugaaaacauuuuuauuauuguuugacaaucuuacauuuagguaacaaguuuuagcacucuugaagccccauuucccuagcuuaucccugccucucucuuguuaaaacccuucuuccccacaaguccaacuccaugcucccuucuugucuaugaguuuaauuggagucuuugugacuucuuagagagaaaagcaccaaagaauuucucaugguauuguggcugcuucuugcucauuccauggacucauagcaauuuggcuugguggagacucaagguuucuucugaauugagccauugcuacugauuauuaguguuuguccauuuaaguggacugccauuacugauuuguguuuggaacugccccaaagaacuauuucaaaacacagauauaugcucccaguuuccuauuaaccuuuauuuucuccuaccucuaguaggugggcuagaagggauguugaagcauuuaggaacccuuauuaaaauugacuugaaaaaucuaagccuacacugcacaauuaauauaugaacauauguuuaaagacauaagugaacaaaauuaaaggauuaaauacaagcaauccagagaggaguggccauauaucagauggaaaaggacuugaauaaaagccuggugguagugaaaagaagcacggugugcuuggagaauuaagagcagcuuuguagaugugggaggcacagaugagugaguaaagaacagauaagacauuuucacuuauccuagguuuaacaggaagcaaggaaaucucauaacauggaggugacaugcauagcaaaguagucauacagggaacacuaccaagacugccaggugggaaacaaaggguaacauccaggcaugguagcauugcuccaacucauaauacuaauggaugguaaaugcaggaaaauucaaaucuuaauauuggcuucuaaccugggaucccaucucugagucugaaaggaggaaaacauaauaaagaaccugugguaagugaugggcuggaacuaaaagaugagggaugagcugucaagcucucuggauucccagcucaacagaauugcugcuucuacaggaacaguggcuugugguguucacgcaacaugaaguaggcugaagacuagaggauggcucccuccuguucaagagggacugaucauuaaauguucuucuuuuugaaaaugaagucaccaggugaaaaaaggucugaguguacaaagcuggcucagccucagaggucaaguugaaccaagccagaugugcucaaguaaacaacaucacuaccuccauggagcagggauuucaaacaguugacaugagucacaucucuggauagcagccucaaagcccaaugcaagaaaacacuucagaacuucucauaaaagaagaaauaaucagacuaaagaacacaucuuccacugagaaauaucauacaaaacaaaaauaaucaaacauacaacauaguuacuacuuaaggaagcucaccaucugaauaaaagaaaaaguggaauuacagucacgugaaaaucaaaguaauaaucaccugucuagucagcuaccaucagaggcugggucuaugaguuacaaauauaagaaagaagaaagugugcaucagaacuagggaaaagagaagaaaaacauaaugaguauacaaagaauauaauaaaaagcacaaguccuaacugugccccucaaacucucccaauuaaugcucacaauugcuuuaauaaguuauuuugauuaauauauuuguacaucuaucuauuuacuauguaucuaaucuaucuuucuaucauuacauauaucuaucuccauauauauacauauuacauauauacacaugcacacauacauacauacauauauauauauauauauauauauguugagauauauauaucaauauaccuucuuacuaguuuauuuuuucucauuuuuuaauuauuuuucuuuuauuuacauuucaaauguuauccccuuuccuaguuuccccucugaaaaucugcuauccccucuuccccccccccccuucuccccaacccacccacucucacucccuggcccuggcauuccccuauacuggggcauagauccuucacaggaccaagguccuauccucccauugaugaccaacuagaccauccucugcuacauauacagcuagagccaugacucccaucauguguuuuauuugauuugugguuuagucccagggagcucuggagggcacugguuaguacgcauuguuguucuuccuuuggggcugcaaaccccuucagcuccuuggguacuuucucuagcuccuucauuggggacccugugcucuguccaaugguuggcugucagcauccacuucuguauuugucaggcaauggcagagccucucaggagacagcuauaucaggcuccugucagcaagcucguguuggcaucugcaauagugucuggguuuggugguuguauaugggauggauccccagauggggcagucucuggauggucaucccuucagucucugcuccaaacuuugucucuguaacucuuuccauggguauuuuguucccccuccuaaggaagaucgaucuuacuaguuuucuuacagcaagacugcacaucaguaagcucauuuucauucauuuaaucacacguucuaaaagcucacaucaguauauauagaaaaauaucauauagauaagucuaaaauaucuuuuuugaauuuuauuuauuuauauccuaaaugcuggccucuccucauagagucccuacugcaaaaccccucucuuuguccuuugagaaggugggccccuccauggguaucccccacuuugguacaugaagccucugcaggguuaggcacauucuuucccacuguggccagacaaggcagcccuaugugcccggggugucaguccagucuguguaugcucuuugguugauagcucagucucugagaccugucaaguguccagguuaguugacucuguugaguuagucuuccuguggaguuccuauccccuucagggccuucaacucuucccacaacucucucauaaagucccuguccucucuccaauguuuagcugugggucucuacuucuguuucagucagcugcuggguacagccucucagaagagaguuaugcuaggcuccuuccuguaggcauaacagaguagcauuaacaguguccaagacuggugguugccugugggaugggucucaaauuggggcgguuauuggcugguuguccauuccuucagccucugcuccaucuuugugccugcauugcuuuuauacagaacaaauuuugggucauaaguuuugugugugaguuuguguccuuaucccucuacagggggccauccuuacuacagaagguaaccucuucuaguuucauguccucacuguuaggguucuuagauaagaucacccgaauugacuccuaagaaccuaucccaggucucuggagcuuccuagagauuccccgcacaccuagacccuaggcagcugcaguuaucccuguggcucucucucccuacaccuguuugugagccccccuuucccuuccuaucuccucucucacucaguuugcuuucuuucucugccuccuaugacuuuuuauauucccuucuaagugagauucaagcaucguuguuugugccuuccuuccugcuuaacuuccuugggucugugggguaugaguguucuaccucaaauuuauugauacaggagacaauuuccugaacaggacaccaguggaucugacucuaggaucaacaauugauaaaugggaccucaugaaacugaaaaacuucuguaauguaaaggacacugucaauaggacaaaauagcauucuauaggauggaaaaugaucuucacuuacccuacauacaacagagggcuuauauuccaaauacauaaagaacccaagaaauuaaacuccaacaaaccaaauaacccaauuuaaaaaugggguacagagcuaaaaagagaauucucaacaaaggaaucucaaacgauaaggaagcacuuaaagaaauauucaacauccuuagucaucagaaaagugcaaaucaaaauggcccugagguuccaccuuauaccaaucaaaaaaacuaagauuaaaugaaaaaaaaaaaaaaaaaccuccaggaacagcacuugcugggaggauguggaaaaaggagaaugcuccaccacugcugcugagauugcaaacuugaacaacugcucugaaaaucaaucuauaaaauuuucagaaaauuggaaauaguucuaccugaaaacccagcuauauagcuccugggcauaugcccagaagauacuccaccauaccaaaagaacacauguuccacuauguucauauuuauuuguaauagccagaaacuggaaauaacccagaugucccucaaccaaagaaugaauauagaaaaugugguucaacagcgccugccccaauccaaucgcgcggaaccugagacugggguacauagggaagcaggcuacccgggccugaucuggggcacaagucccuuccgcucgacucgagccccgggcuaccuugccagcagagucuugcccaacacccgcaagggcccacacgggacuccccacgagauccuaagaccucuggugaguggaacacagcgccugccccaauccaaucgcacauaagcugagacugcgguacauagggaagcaggcuacccgggucugaucuggggcacaagucccuuccgcuccacucgagccccgggauaccuugccagcggagucgccugacaccugcaagugcccacacaggauuccacacgagauccuaagaccucuagugaguggaacacaacuucugccaggagucugguucgaacaccagauaucuggguaccugcccugcaagaagagagcuugccugcagagaauacucugcccacugaaacuaaggagagugcuacccuccaggucugcuuauagaggcuaacagagucaccugaagaacaagcucuuaacagugacaacuaaaacagcuagcuucagagauuaccagauggcgaaaggcaaacguaagaauccuacuaacagaaaucaagaccacucaccaucaucagaacacagcacucccaccccaccuaguccugggcaccccaacacaacugaaaaucuagacccagauuuaaaaacauuucucaugaugaugauagaggacaucaagaaggacuuucauaagucacuuaaagaauuacaggagagcacugcuaaagaguuacaggcccuuacagaaaagcaggaaaacacagccaaacagguagaaaucauuaaagaaaaccaggaagacacauccaaacaggugauggaaaugaacaaaaccauauuagaacuaaaaggggaaguagacacaauaaagaaaacccaaagcgaggcaacgcuggagauagaaacccuaggaaagagaucuggaaccauagaugcgagcaucagcaacagaauacaagaaauggaagagagaaucucaggugcagaagauuccauagagaacaucgacacaacagucaaagaaaauacaaaaugcaaaaggauccuaacucaaaacauccagguaaugcaggacacaaugagaagaccaaaccuacggauaauaggaauugaugagaaugaagauuuucaacuuaaagggccagcuaauaucuucaacaaaauaauagaagaaaacuucccaaacauaaaaaaagagaugcccaugaucauacaagaagccuacagaacuccaaauagacuggaccagaaaagaaauuccucccgacgcauaauaaucagaacaacaaaugcacuaaauaaagauagaauauuaaaagcaguaagggagaaaggucaaguaacauauaaaggcaagccuaucagaauuacaccagauuuuucaccagagacuaugaaagccagaagagccuggacagauguuauacagacacuaagagaacacaaauuccagcccaggcuacuauacccggccaaacucucaauuaccauagauggagaaaccaaaguauuccacgacaaaaacaaauucacacauuaucuuuccacgaauccagcccuucaaaggauaauaacagaaaagaagcaauacaaggacggaaaucacgcccuagaacaaccaagaaaguaaucauucaacaaaccaaaaagaagacagccacaagaacagaaugccaacucuaacaacaaaaauaaaaggaagcaacaauuacuuuuccuuaauaucucuuaauaucaauggacucaauuccccaauaaaaagaaauagacuuacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaagaggaacucucaauucugaauaucuacgcaccaaaugcaagggcagccacauucauuagagacacuuuaguaaagcucaaagcauacauugcaccucacacaauaagagugggagacuucaacacaccacuuucuucaaaggacagaucauggaaacagaaacuaaacagggacacagugaaacuaacagaaguuaugaaacaaauggaccugacagauaucuacagaacauuuuauccuaaaacaaaaggauauaccuucuucucagcaccucacggaccuucuccaaaauugaccauauaauuggucacaaaacaggccucaauagauacaaaaauauagaaauugucccauguauccuaucagaccaccauggccuaagacugaucuucaauaaaaacauaaauaauggaaagccaacauucacguggaaacugaauaacacucuucucaaugauaccuuggucaaggaaggaauaaagaaggaaauuaaagacuuuuuagaguuuaaugaaaaugaagccacaacguacccaaaccuaugggacacaaugaaagcauuucuaagagggaaacucauagcucugagugccuccaagaagaaacgggagacagcacauacuagcagcuugacaacacaucuaaaagcccuagaaaaaaaggaaguaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccauaacaccaucagauccuucuacaaaaggcuauacucaacaaaacuggaaaaccuggacgaaauggacaaauuucuggacagauaccagguaccaaaguugaaucaggaucaaguugaucaucuaaacagucccauaucaccuaaagaaauagaagcaguuauuaauagucucccaaccaaaaaaagcccaggaccagauggguuuagugcagaguucuaucagaccuucaaagaagaucuaauuccaguucugcacaaacuauuucacaaaauagaaguagaagguacucuacccaacucauuuuaugaagccacuauuacucugauaccuaaaccacagaaagacccaacaaagauagagaacuucagaccaauuucucuuaugaauaucgaugcaaaaauccucaauaaaauucuugcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacaugauaaaagcaaucuacagcaaaccaguagccaacaucaaagaaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaacaugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaggaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugauaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaacaaccccauuaaaaaauggggcucagaacugaacaaagaauucucaccugaggaauaccgaaugguagagaagcaccugaaaaaauguucaacauccuuaaucaucagggaaauacaaaucaaaacaacccugagauuccaccucacaccagucagaauggcuaagauaaaaaauucaggugacagcagaugcuggcauggauguggagaaagaggaacacuccuccauuguuggugggagugcaugcuuguacaaccacucuggaaaucagucuggcaguuccucagaaaacuggacauaguacuaccggaggauccagcaauaccucuccugggcauauauccagaagaugccccaacugguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguacucacugauaaguggauauuagccccaaaccuaggauacccaagauauaagauauaauuugcuaaacacaugaaacucaagaagaaugaagacugaaguguggacacuaugccccuccuuagauuugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuauugaaaggacccagauguagcugucucuugugagacuaugccggggccuagcaaacacagaaguggaugcucacagucagcuaauggauggaucauagggcucccaauggaggagcuagagaauguagcaaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccauaaagggggagugggugggcaggggaguggggguggguggauaugggggacuuuugguauagcauuggaaauguaaaugagcuaaauaccuaauaaaaauggaaaaaaaaagaaaaugugguucacuuacacaguugaaucccauucagcuauuaaaaacaagaucaugacuuuuucaggcaaauagauggaaguagaaauuaucaucuugagugagguaacccagacccaaaaggacaugcaugauauguacucacuuuuaauuggauauuugcaucaucuuucuuuuuguauucagaacucuucccaugucuauugaguuuuaguucagaguuuauggccuguaauuuccaauagauaaugguaccugcuauguucaagggcaccauggccucccauguauguaaaugugaugucaauuccacgguuuucuaagucauugccuauccacuuacauuauugauacucuuuucaauggugaaucauucuaugaccuuacugaagauuuauagagguauauaguucacuuaaacaccuuagaauacauuuucagggcugauauuuagcacugaacaaccaaccggugugcuccucccugggguagaacaccucucccccucccagcuuucuucagauaccuauaauucuuugcauagggugaggccuccugggcuccucccaguacacuuugguaugucauugguaucauuacaaugucaaaaauaaauaaagcaagcaaguaagcaagccaacaaacacacaagagaucagagcaucagcaguuaauucuagacuccauaugcaguauuaucacaucugaaagcaauaugauagcugcaagaugcacagcaauuccaaagaaccacaaaauuaaaggacuguuaaccuuauaaugaugauaaauagugcaaauuggaaauuuuuccuaaaccugccauauuagaaguugaagauuaaaacagucauauguauaaauaaugauuaucaaaaauaugauccaaauauuguuccuuuauuuuuauuaaaacuuauugagcauuuaauauggaguaggcucuauuuuaacaacacacaugcacaugcacaugcacacaugcacauacacauuuauuuaaugcucacaacauuuuucugagaugagcauuauuaucaucauuuuauaaauauaauguuuaauuacagagggcuuaaaugaucuagcucaaaucauacagcuuugaaugaccgauagaguguggccuucugggcuucuccuaggacacuaaacuuaagccuacuguauuguuagccccuguucuucauggccuaucuagugaugugacacacuguaggaacaguuacuggguggaacccaguagaaucuggguggaaccaagaugcucacuuuccccccacucuucccuacuauuuuccuauguauuuuccaugaucuauggccaauuaauaaauacauacaaucaauuuuauaaaaacagggaaaugagguaaacuggcuuuaaaaaaaaagaccacaugacuaggaaguuuuuauuguaacuaaaaaagaaaaaaaaucauguuacuaguucaaauuuaaaucacuuacuaguuccagaaaauggaacuauauagaauaaaaguaaaaucccguuuguuacaguggaaaccuuccaaggccucucuaaauauuuagcaaacuuuuucucaaagaaaaguuuaagaauuguuaaaagacauaaaagaaauagagcaaauauaaauggaaaaaaaaaagaaacucauugaaaaagagauucuuguucuucaaugaaagaacagccaggguuuaguuuaguuuuccuuuucuugcaauuucagcuaaaaucccagaaaagguuuuauugaaagaccaaucaguauuucuguuuagcaaauagacuaaagcauaauagaaagauuugagaaaaaaguguaccaagacuagauaucaagucucaucauagcacuucauguaagauaauaugcuauugauauaaaaagaaagagaucaguauaauagaaucaagcacuuugaaagagacuuguggaaaacuggcauuaucuguuguucagugguaagucaacacugaaagaacaugcuuuuuuuuaaacaaauuggacaggggcaauugacuuuccauauggaaccaaaacacaguuagaacacagcuuuagugaaaaauaaauuccagaaaaauugaaggcuauaacauaaacauaaaaagucaguuuucuacuuuguucccccuucuaaguagaauugaagcauccucacuugggccuuccuucuuauuaaacuuuuuaugguagccaggcaaugguggcacaugccuuuaaucccagcaguugggaggcagaggcagguggauuucugaguucaaggccagccugguccagggcagucaaggcuacacagaggaacccugucucaaaaacaaaaagaaaaacaaacaaaaaaacauaaaacaauagguuaaucauaaaaucccuaaauucaugcuuuguuuuauaguuugaggugcagagguauccuuucaguuccaguguucuuucucugaaugccaauuuucguguguguguguguguguguguguguguguguguguguguguaugugugugugugcaugugcacauguguguaugcagauuaaauaggguggcuuauauccuggucaugaaaccagaggaguagaugcaauuuaaaaacuaacaagagcaucaaagugauuuuaaccuguaaaaaaaauaaaaauaaaaaacaaaacaaaaauacuucuuaaggucugugaguuguaucauggguauucuuuaaggucuguggguuguaucauggguauucuguacuuuuuggcuaauauccacuuaucagugaguacauaccaugcaugaccuuuggggucuggauuaacucacucaggaugauauuuucuagcugcauucauuugucugcaaaacuuaugauguccucauuuuuauuaucugaauaguauucuauuguguaaaugaaccauguuuucuguauccauucuuaaguugugggacaucugggaugccuccaccuucuggcaauuaugaauaaggcugcuaugaacauagugaagcauguguccuuguguuaugaugaagcauuuguguguguguguguguguguguguguguguguguauccccaggagcuguauagcugugucuucagguaaaacuauuuccaauuuucugaaaaacugccacauugauuuccagagugguuuuaucaguuuguaaucccaacaauggaggaguguucuccuuucucuacauccucccagcaugugcagacugccaguuagaccaguaccauuuguuaaagaugcuuucuuuuuuccauuguauggguuuuauuucuuuauuaaguguucuccuaagugugucaguuuauuucugggucuucaauucuaugccauugaucaaccugucugccuuuguaccaauaucaugugguuuuaucacuauuuuucuguaguagaguuugaggucagggauggugauucccccagaaauccuuugacuguugaaaguuguuuuggauacccuggggucuuuuugguuucucacaugaaguugagaauuucuuuuuccaugucugugaagaacuguguuguauuuugauggggauugcauugaaucugugaauuguuuuugauaaaauggccuuuuucacuguuaauccuacugaucaaugagcacgggagaucuuuccaucuucugaugucuucuuugauuucuuucuucagggauuugaaguucuugucauacagaucuuuuacuugcuugguuagaguuacacaaagauguuuuauauuauuugucgcuauucucagcucauuuaucauuuguauaaaggaggacaacagguuuguuugaguuaauuuuauaucuagccacuuugcugaaguuguuuaucaacuguaggaguucuuugauagacuccuuaguguugcuuauauauacuaucauaucaucuacaaauagugguaccuugauuucuuccuuuccaaucuauaaccacuugaucuccuuuuguugucuaauugcucuaacuagaacuucaagugcuauauugaauagauagggagugacugagcaggcaugucccuauuuuuagugggauugcuucaaguuucuuuccauuuaauuugauccgggcuguugguuuucuguauauugcuuuuauuauguuucauuguaugucaugaguccugaucauucaaagacuuuuaacaugaagguguguuagauuuugucaaaggcuuucuuggaaucuaauaagaugaucaugugacuuccuuuuuggagauuuuuauauaacggcuuguguugauggauuuucauacauugaaccaucccugcaucccugggauggagcuuacuugaucauggugaacaauauuuuuuauuuguuuuuggauucagcuugugaaauuuuuauugaguauuuuuguaucaauauucauaugugaaauuaaaguaaucagggaaggcagaggaaaugagacaucucggugggguuggugggaagaaaaggagaucauaaucagguauggaggaagaaaggagagaaacccagagggccaagagaaugaauggaaauauacaacugcucgggcaggggguaccucuagaaagcccuagaggccugggaugugacaugcucccaggacucagugggagugaccuuaguugaaaugcccaacaauggagagauggaaccugaagagaccaccuccaguagauagucagggccccaaguggagugaugggguuaccaauccauguucaaaauuuuugacccagaaucguuccugucuaaaagaaaugcagggacaaaaaaaaaaaauguggagcagaaacugaaggaaaagcugacuugugaccagcccaacuugggauuauccuaugggcuggccccaaacacugaugcuauuacuaaugcuauauugugcuugcagacagaagccuaacauggcuauccucuaagaggcucuaccaacagcugauugagacagaugcagauacuuucagccaaccacuggauugagguuaggaacccagugggagcugaagaagagugaaacuccauaggaagaacaaaaauaucaacuaacccagaccccucagaguucccagagacugagccaccaaccaaggagcauacaugggcugguucauggcccugacacauauguagcagaggacugcauugucugguuucagugggaaaguaugugcauaauucuguagaaauuuaaugacccagggaaaggggaaguggaaaaggggguacccucucagaagaggagagguaaagggaagggggaagggggaagaacuuugauagcagggaacuggguggggaggcaacauucuggguguaaauaaauaaaauaauuuaaaguuaauuuuaaaaagcuaauuuucuaaaauuuuuagaaaaaugacaaacaaaauccuuugaaaccagaaugaaggauuuauugaaucauguacuaaugauaaaacuaaaaacauaaacuucgcuuuuauauucuuuaauaguuuuguacauguuaacaaaaugaaauauaauuauaaacauauucauuuuacuauuccaacuccuccuguaaccucuaauucaucucuuaccaaacuucaucauccuuauuucuccuccuauuccuauucuucuuacuucucuuccucuucccccucuucuuuauucucuuuccuucucuccuccuccccuuccuucuguguauauacaauccccuauaucccacuuguguugucaauuauaagaaaaccaaaacauuauaaaaacacaagaaucaugaacuggaaacuaugggcuugaaaauuuauucaccauuuugaacucuuuuuguuggauuggucgcuuagucgauuuauagucaagcucuuaggucuucuugcuguauagaggcaaaguuaucccuaaacaucugaucuuccagucucuaucucucaaguuaaugaauuuucaugucuagccuauaccggcuuauuccaaacaguaguucuaaacaauaaauaauugccguugacuagacagguagaaaguguuccacagagcaagaagguauacccuaaaucucgagacaaaaaccaccaaagacucuaucagacaaaccacaagaaaaaaaaaucucaacacacaaugaauauacaaaaggaugauuacuucugcuaauagaugcaaauuaaaaugcaauaaauggacugaauacaucuuccaaaaacccaaaaaucuuaaaaaugagauacuuuguccuacacaucagacuaucuacuaucugauaauguuaauauuuuuauaaguuacaggaaauggaaacucacacagaguacuguugaauagaucaauugguagaaauuugaaauggaagugagauuauuucuaacaacagaauuugaagaagauuuuucaaggaaagucagcuaucaagugcagugugcuacaacuuauaccaagcguaacuaaaugcauguugauuuaugcggauauauauguaacaaaaacaauaauucacuaaaucacuugugcuuuuguauauguauguaucauuugauaaaauaaaaauuuaccaaugacauuagcaugaggaguagggaggcuugaggcagauagggaccauggugguaggugauggaagaugucucaucuuauggagcagagcaaauggugacuaaggaacuaaggaaugaaggccccauaugagcacauuuucagucugugaucauaccugaaguaacagacaaugcaugaguucauuuggaaacacaucuguuccucucuccauccaaccaugggaaacaaaagcuaaagagacauauguaagcaauuuuaaaccauccuaggacugaacugaacuaagaguuuccaaauacuaggucaaaaaugaaacucccuuugcagcaacagcugauagacagguaacuuucaaguagaucaguguugugccuuugggaagaugagauaauuacacaccgagagagaccagaagcaugcaggagcuuacugaacugaauauggcaucuucaauucagaaauaaaaaagagccuaagauagcucauguccaaaaggucauuugaucucuugcucagccuucaaaugcaucaauagccaaacacuucaccuucaaggccaucugcucccuuucacuguuucaccaaagaagucccauaucaaauagaccugcaccuaaguucucauuuuguauuugugaccuuugugguucugagcaacucuuaaaaggucuuugauccucaaacucuucuuuuuauaaaaagguauuacacaaucgucaacccaagagaaagguaccccacauauugcaacuacucuauaaauguauaaauauuacucccagugauccagauugaaugcaaugaaauccaaagaagauuccaaccauuucccccuacccugcccugcccugucaucucuguccaauacuuccucacuggccuuaaccuucugaauuuaugcaugcauauacaagacccaagaggugagccaaguccccugacaccuaaucuauuccuaaaguuagcccaggcaaccugaaggcccacagguuacuuugaccauccuuacccugccauucagcagguuucuauucaucccagcaucaaacaucauggguauaugcuuaaacaccauaugucuaaguccccaauguguauuuugaaauuuauagaagucuuucuggguucauccuuuuaacuuuucaaguuuaauguguaagaugcauuuggguggccagcuguaagaaggcucucugcauuaauuauuugcagauguugaggcugugggcugggaaauagggaugccagaaaaaaucuguaccccuuguucuacaucaggacacaguuuuauacacacauuuacaagagugugaucucaacagaaaggcuuaacucuguccaaaauaacaaauaaugucuccugacaccucagaaaauggaauucgacucagagcagacuauaaauguuaaagaauucugucccacaacaauaggauaccauccauagugagcaaacauauuccacaugccagacccuaugcuacaauccuuacauauauuguaacauugaacauccccacccccaugaagauauucuccuuguauccuuaguuucaagauuaaaagauuugcgaaucagacaguuaacuugccuaagauaacacaguugaugagucgaagagucuccucugaaagucaagugguucucauuccagaucugaaguuucuuucuccacuggugacucaagaagaaugaagagguuccauguauuaguauuuccacaugauuaaccaacuggauauccuaaugguuguucagccugcauggugcuaagauaacagguuuaaaaggugaggcuccaaugaccuggaaauuaggaacagagguaggauucuaauguaaggucccugggaaauguucuccaaacucaugucaucuaaagacagaaauaguuuauguaucgaaaauacuguucugacauaguauuucagaaacugcacucugaaagauccaacaagcagaugaaagagucagaugcagagaguugcacccaacaaauggacagaagcagcuggccccuguuguuaaauuagggaaaggcugaaagaagcugaggaggagagugaccuguagaagggccagcagucucaaauaaucuggacccccaagaacucucaaacacuggaccaccaaacaggcagcauacaacagcugauaugagguccccaacacauauauacagcagaggacuacagggucuguguucauucagagauaauguaccuaacccucaagagacuggaggccccagggaguuuagaggucagguggggugggaaguggggacauccacgugaagauaggggguaaagaggagguaugggauguggagcaguuggaggguaggcagggagggggaauaaaauauggaguguaaaaaguuaauuaauuaauuaauuaauuaauuaauuacuauucuggauaagcagugauacauuaggggcaaauacuucuuaaugaguaucauuacuaacaagcauucuagggagccauucagugguccaugcuuuucaccuuuauuaugauaccugccugaucuuaaaagaaaaagacagguuaggaauauacaucaauugguacagugcuugaauagcauuguaaagccuugugcuugaggcacagaacugcacaaacugggcacgauggugcauguaauccuaggacuagagaugcagaggcagaaggaucagaaguacaaggucauucugugcuacccaggaugcucgaggcuaacauaagacucuaguucaacggaagagucuuaaaaaguaaagaaacaugucuucuucucuccagcauggcuuuugcucuugaacugccacugcuauggauaccuuccuucugggcucuagauucacuuuugugacucugcucaucaccugagcacccauaucaacagcaagaaaucuguuaagcugucuuuuguucccuucauugacauaauauacagaguuuuggccacuguguugauaacaugguuguucauggcuccuacaaggaaacccaaggaaauuuagaacacuauacaagcuggaaagagaccaaagacauagugauuaauuuguaacaguagagagggaccaagaauguagaaaggacuggagacucggacauuagaccccaaugucagaggacuagucagaagcagugcugauggugucaucugggucccccaagcuccagcauagggcucucuaaacccaacagcucucuuauggcagcucacccagaugcccacaguucuguagucauggugagagggaucaaaagacagaauugcuguucucggcagaaauacuguaauggaaaccauuucacagacgggagcagccaaagacucccgccucaucauauuuuagcuccgggcagagccagugacucaugcagggcauuugggugugucucuucuacaaagccaggguauccugggcagagucuuaagaaaaugaaaaggaaacuggucuguucccugccuuaggggcaaagaaaauggcuagccaggagugcuggauuagguaucuagugugccucuguagucacuaagagaacaagggcccaagauuuuagagugucccaaucauuucaauaguguggauggugccuugaaguuggaauuugaaguuguaaagaaaaggugaguuuuuucagacagacuuauuacacuugauuuccccccaucucuuacaggcugaauuagucacuuaacuugggcaacccucaaucugcucauuuaugaauggauauuauaaaaauacuugucuugcagaguugugguagugguagucugaaauaaaugaugagagguuuccagcaaagucucucaaugggaguuuagugaaguuuguguuucacucaguugauaaagcugaacugaagccaaugaaaacuacuuggaaguuaugguaauaagaauaaagacacccaacacacaccgaggaaucaucauacauagccaaaugcacuuuacagauucuauugagcaaaaaugauugagguggagaaaucaucacaagggcuuuugugaaaugaaggccagagguuugaaggugaagguaauccgugaaccaagguaugaaggcagccaucagaaucuaagaaacuggaguacagacucccuuccagaaaacagaagcagauaacaccuugaucugaccuagccuaaacuacgaaucuccaaaaguguauggcaacguauuugugguguguguguguguguguguguguguguguguguguguguguguguguguagcaccacgaauggagcuaaauuuagcugggugagauccuaucccaaagucaccacucccuuuuauucaaauuaauaucauugaacacaggauucagcuccauuucacuuccuggugcccauuuaaugcucaaaccauauguuauauuuuccuuauguuuucauuuuguaagaauuuugcauuuucauuuuggaccaggaccccaaauuauauagcuaguuuguagaccacucuuuuaaaauaaaaaucuaucugucuaccuaccuaccuaccuaucuaucuaucuaucuaucuaucuaucuaucuaucuaucuaucuauacauuccacugccccauccaucugccuucucuguuucuuuucagaaaaggucagacauccauggauauagaccaaacauggcauaucaaguugcaguaagacuaggcacuucaccuuauacugaggcuggaugaggcaacccaguaggaggaaaggauccucuuuugagucuccuuuuuaugugaagaaaaguuuaaauccagucaugguuguacaugacuuuaaucccaggagacagagccaugcagaucucugaguucaaggucaaucuauagaacaaguuuuaagacagccaagcuuagacaguaugggaguuaaaaaacagaaagcaggaaauagaauaaggggggcaaguuucagccccaggaagcggcagaacaugacagcuucaggcagguggcuuggacuuuagaguccagaauagaaaggacuacugggacaauuggugcugguuagcuggagguaagaaauuagugaugauuaugcagagaccagcaucacugagagucacauaaccaacuggagcugaggcaacuaaagaagaggcuaaaugugaaguaugaagggaacuggcaaagggaugaagagccaaaggcaagggaagggccgcaauaagaagggaauuaaggagggcucuguggaugugugaacagccacagaaggugacuaccgaggccauaguguaauauacugauuuaagguaagcagacuagagaaagagaacaacauaauggaagagaauguuuccaggugagaagaguaacaugacuggauagauagguuuuucccauugauagaaauggaaaugaaacuaucaagacaugaacaaaaguuauaauaugcacugucaugacuaugccguccuucuuuuaauucuuuuaggaaucucaugaguccauaucaggaauccauuuuccagaucaggaaaaaaaaaaaagaagaagaagaaggagacucaaaagaggauccuuuccuccuacuggguugccucauccagccucaguauaaggugaaguuccuagucuuacugcaacuugauaugccauguuuggucuauacccauggaugucugaccuuuucugaaaagaaauagagaaggcagauggaugagguaguggaauguauagauagauagauagauagauagauagauagauagauagauagauagauaaauguauuuauauuuuuaaauuuuuauuuauuuuuaauuggguauuuauuucauuuacauuuccaaugcuaucccaaaauucacccacacacuucccuacccacuccccuacccacccacucccacuucuuggcccuggcguuccccuguacugaggcauauaaaguuugcacgaacagaacaaugggccucucuuuccacugauggccgacuaggccaucuucugauucauaugcagcuagagacacaagcuccagggggggugggggguauuguuuaguucauauuguugucccaccuauacaacugcagaucccuucagcuccuuggguacuuucucuagcuccuccauugggggcccugugauccauccaauagcugacugugagcauccacuucuguguuugcuaggccccggcauugucucauaagagacagcuauaucaggguccuuucagcaaaaucuugcuaguguaugcaauggugucagcguuuggaagcugauuaugggauggauccccagauauggcagucucuagaugguccauccuuuugucucagcuccaaacuuuuucucuguaacuccuuggaguauuuauauuuuaaaauaguggucuacauacuagcuacauaauuugggguccugguccaaaauuaaaaugcaaaauucuuacaaaauuaaaaccuaagaugucuuguuccaagaucauuauuucaagacugugauaguagaacaucgagucaagcacagagaucuucucaacaccagguugcugcaugaauccuaugcccaaaagaaaaucccaugacacagcugggagucaaauugcucugucaguagaucgggaaguaaggaugcuauccugacagcaccugcauucuggaugugugagucguuacaaaaacaugagccucaaacaggaugaguaugaagugaacucuaguuauuuuaagucucugaaauggccggacuguucauuacuaaagcauaaccuagcccaugcugacugacauacuacggcucaaaaaaacuucaugcagccacuaaaguugagcaguuaggaguugagccuggacaucgaaguccuauguucuuucuugaaaccugugucuucuaacuauagguuacagcuuguuugggauucauagaaucaacucaaggaaucacaagaagguguuugucaaugagauaaucuaacaaaugugaauugugcauauuacacaugguauuuucauaaaaucauuuuuucaguguguguucagagucacaauacaaaauguaccuguguauaugggucauuaucaaaaaauguuaaagguuacuguucuguaucauacuuucaacacaggaagaaaagaaugagucuacacaugucaacccaaugggcuacacacucaugauugucuuuuaaaugagcuuaauggaaggaaacuggggcacugcugucaagguaguuacuguguuagauuuuauaguuucccagauaggaaguacucccguucuuuacccaaugugaaacucaaucuuugcagugugcauuuuuaacuacauuaauucucuaucucucccugccagcuuuaaaaaggacuaugaagucaucauuucagauacugggaacaagccuucauugucuucugacagagcgggcaaauuuggggcacagaugugcccacuggggcaacuuuagaaaagcgggcaagaagccacugugucaccagcuccaggccucaugccaggcuuccugucuucaaacugcagugggaugaggaccucauaagcgagucauuaaggcauacaagcaucugcucagagggagacccaguuauucaacgggaaaaauacugugggaaaaauuugcauuuggcucuaccaacauuggucuguuacaucugucuuccucucauugcagcugggagucugaaccucuacauauaacaaaaaauaauaauuaauuaauuaccagaacuagaaauaguuuuccuauagugcuagugaugcuauaguacauuuuugguguaugaaaguggagguuugcucuacaugucucuuacuuccaagcaaacugacucagaaaugacauuaucaguuauuuugaugaagguaggguuuggacuucuguuaucuagaccuugcugguuugaagggcauuauucauuauuuguccuuguaaaagaaucaccuuccccugaugcaagaaguuggcuuugaucuuguaaauuuucugucuccagaauauuuggggguuauauaucucucuccccaucucccugucugucucccugucugucucucuauuucucccugucucccuaucucugucucugucccucucuccgacauacauacacacacacacacacacacacacacacacacacacacauacacacacacacacacacacacacacaugcacacucacacaaauaucuuucuauuuucuauuuuccuagaaacaagugacuaaaucugcuucccuguauuucuuuggauucuaggaaacagaagcauauguaaggcugaacuguaucgaucauguggaugcauguauuuuccuacuuguguuucucuggccuaggucuugguuuucuguuuccauugcaggaucacagagagguuuuugacauguuauuggugugaagaaugccacaagaucuaccaggaccuaggacuguaaagcuucaugggaaaagucaccagaaaagacuuguugaauucuuagaggcaugaagucacagauauaucucuagggcgucugaauauauuuugcauuggagacacgauaggggauugagaagcugcuucgagugucagaagaccugagccauguucaugugaugggauuuggcagguucuugcuaagccucagacucauggauggucuuacuugcugguaaaugagagagcuuugcugggauuaacauccaaggcuguugagccacuaaugaauguucuuuguagggugaaaagugaaagagggaaguaaauacauacauggaugagagcuggggagggggaagucugaugagaucaccuuuuauuucuuccuuccaggacaggcuugugggcaaguuuucaagugagucaaguuuuccaccauugggagucuucuccccaacucccacuuggaucuuacucauaaagcugcucgaugcacucaggcucaguggcccccacuaggguauagacagucugcucagacaguuccuuccaccuccuguuguccucuaccaacaccugccuguccuggaaacagcuucuaaaaacagucuccaaacauuaaauuugucuaaagccccauuucugauaaauuuaucugguaaauuaauuaaagcuaaagacugacagaggagguagagagagagagggagggagggagagagagagagagagagagagagagagagagagagagagagaaauauugaacaaugauucauaguacacugggaacaguggagaaaggcccagggaaagacaacugagaauacaaagguuucucauccaugagagaauaaugaugaaccauaaggguaccuagagucauaggagggcaggaggugaauucaaaagggcacggguaaaagggaaaacacagccaaauagugaguguuaacuuccccuuaaagcuaugcauacuaguuauaaaccaugcugaauucaguaucucucauugucucagacagauggcaggauguuaguagacugccaggaggcuacaaugaauccccugaaugucuuaguucacucaaguugcugaaacaaaaguugguuuaauaugcaacaaacauuacauuacuaagguguccgagaugaaagacucuaggauccaguaucugaugagcaauccuuucuuguuuacacaugaccauuccuucauugccuucacauaccagcagaugaaagaggaaacucucucucuccagucuucaaugagggcacuaauccauuaauaugggcuccacucucaugacugcauugggaucauuaaauaauuuucaaaggucucucuuccuaauaacccuaccauuggcauggauaggacauucacauacaaauugucuggcugaaggaaacaaagacacagauauagaacugagucaaggaccugucaggcuacauagggaaauaacacaggagauaugacaaggcaagaacauaggucccggcucauucuaaagcccugugggcaagaaccaaaaaagcaauucccagggcuacagcaaaguuggagacuuucucuuuuaauuauuuaauuaaaauuuuucuauuguugauauauauguguguguguguauauauauauauauauauguauauguauguauauauauauauaugguauauauauguguguauguauguguauauauauguauauauauauguguguguguguauguaccuaauacaaaaauacaauccucucagucuguauaacguuauuuguauguauguuuucaggcuaaccauuggguauuagauaaccaauugguguguucuuccuuggggauuacuucucuagcucuuagcaucccuguaguucuuaguguaggauuaaaucaucaugagcuuuucccuauucagguuaccaugccuauuauuguccuuguucagcucaugcauaggcagucauuuuguugaguuauggguguagccucugacuuuaguaggagacacagucccacaacaaauucucugauccuuuggcucuuacaacuuuucuaccccucuucuacaauauuccaugagacuuugggacagaacuauguuguagauguaucaacugagacugggcuauacagcucugcauuuuggucagcugugguuuucuguaauggucuccaucuauugcaaaaagaaguuuccuugauaauggguuaggacuauacuuaucuguguguauacaaacuaauacuuuagauauaguuagagauuauacagguuuaguaaagaggcaguuguagguuccccuccagaaucccugacuucauuagcccaagauagauggcuaaauuuccaguaccagguaugauucuuccccucuuguuaaauagucuuaagucuaacuagagaacuuuugguuaucacuaagguacaugugccacuacuacauucuuaggauuauccugcuaugcuggucucugcuaugguucauaggcaucaagacugggugagacaauugaaugcuucccuuuuauagaaguuuccaugacucguuuugguaccaugaaaacuagccuucaaggaggaagcuuaauaagucuuuccucugaaaucgaauccauuagccaucugcugaaaggcuuagaaacaucuccuccaggcauccaggaacucugccugagcaguggcauggguuccuuccugucugggcuggugcucugagcagacagucccacaacacccagaggaagcuccacucccaggaacucuaacaggcccgagaucauaggaucagaggugccuugagcagaccuugggcgcuaacuccacagccagucccacaauucccagaagaagcuccacuccuaggcacucuaacaugcccuggaucuauuaucaacaagcucagaauuagccaaggcccagcaacagaacauugagccuagaaaagugaugcaggaaauaccaccuggaaaccaaggaagaccucuuugacaaggagcuaccuucuaggggacuucaagggaauagacaagcaaggauuaauaagucauacucaguccauagcuaauuucuucaaucucccagaaucucuaacaagcauaaucagucacuucuuggagaauauuuuaaccagaaauuucugauccuaggagcauccauguuguacaaaauucucucaacuccuuuuauguaacuaaauacaugcuuggguacaacugucuaaguaguugaggauuaaaauugguugguuccaguuaguuaguuagugacaagggaaacaaugucucaucuauuuaauaucuuucaauggcaagacagucaguagaccucagcaucaaaaaaaggaaaaacugaaagcuugauuuaaauuccaucucuuugguucaguugugugacuuuuaaagguuaugugagcuugcuauaucucuuuguuuuuuacacucaguauuggaaucauaucuccucaguuuucagugauacccaaaugugaaaaugaacacaguagauugucaaugaaugguugcuccuaauggcaaugguaucaggaguagguagaucccuuacuacgcgucagccaaugggcuaaagaauuuuaugugacucaucucuuuuaguccuuacauuggcuuuuugcauuugaaucaaccaucauucugauuuacuagaggagaaugcagaaucuuagaaaauucagguaguguauucuauggcacacaacagucuccaggagagcuauacucucagcucacuuccccuagacaucaagccuaagcucuaccauagucccaaauucucacauguggucuccagauuuccccauagugagagaaguuaggaccaugaaaaguuauuggacuuaugcaacaucacuagucaccacaucaagcugagacacuuauucuggaaacagccuucucgucacaguuaagcaacaagacccucaaauccucugcuccuuuuuuucuaacuggaaaugauguguaaaaagaauauaugaaaauauucacgauuucugauaccacuauuucucuucuagugacuuagcuuuuccauucacauguggcaagaacaacaaacuccacgccugucauaccacccaccauggauucuccuccuuuagggaggguugaaaauaucagaaaacaaaacuugaacucugaaaaaagcaugugaacgaaguguugugugaucaguugccaguccuuacuauacucuauaaauauacaguuugcagaucaugaccaugggugucugaugauguaacguccaucuuccuaggaucuauacuaaucugaacaagcaguuaagaguuagagcagcccagaauuaacccaaagcuuaacugaccaaacugaugaggaugaagacagacaauauaauauuauugucauuaaaauuuaaaaacguuugccucuguuuggagaucuuccuugccucgcagaaaaaaaaacaucaauucuguauaugaaggucuggaucuuuaauauuuuuaaugguacuauaaaaacuuuucuuuaaccaaugauccuaaaucuauccuuucuuauugguauaauauccacacaauguauaagaucucccuacuuccucuuuagaacauuacccugaugggauggguauaaaagaacaggguuuuggagaacucauucuuugccaaaaacuauauuggcaaaaacuuacauuucacuucuuuuuaagcauccucacaagaucagacauuaccaucuccuuuagcaaaugagaacugugaaguuuauugaggcuaagcagcccauacaacaaacaucuuggauaugugaaugugcaggauuuuggauucaaugacccucauuuuuccaacuaauagaacaugaaauugaaaaaugccaaauaauaagccaagucaagaguuuggauguuucauaauuugaauaauauauuuuauaaaaacaugucagccuauugucacuacaauagagauuuuuaaugguauugauugauaggacuuuugagguggagugucucuaaaaucaaauggcuagcuaagcaaggccugaacaaagacaacaaaaguaagcaugcuaaugaaaagggaggaaaucacaucaagccucagcccuugacagagagcuauaggcaacuauggcaugcugaaaucaggagacacuaucuuccucaaugaagaaccucccccaagugaguuguccaauaccaagugauuaauccugaaaucauacauauaugaaccaagaaggguuuauauguauuagauagauagauagauagauagauagauagauagauagauagaugauagauagauugauagagauagagauagagauagagagauauaugaauuugaaagagaguaauaaaggguucaugugaagggauagauggagagaaaggaguaggaaaauuauguuuuauguauaauuuauauuuuaauauaaaaaaauaaaucauaauacaaagguguuaaucuccuugggccuccaaauggguuuagaugauagaggccccuaggcuugucugaacggaaccucugauucacuggcugagucauuucaugacucaugguuuguugcucuguuucccgcaccauaugagguccaaagacacaagcuucucaagacuaaugugucuaucccacauaaacaaauaaaguuucaucucaaacccugucuucaaagaacuacaaguuaauauuaaauggaaaauuaaacaguguaugauagcaguaauacaaaagaguagcugccauguuugauacagguuuagaauaucagcaacuuggaaaaggugacaauauaauuucaugauccaaaaauuaacguaaaucauuaagaacaguucaaauauugauaacaaaaauuauuguggucccacccauaagauguacauuuuuggauccaguuuuagcuuucacaaacauaauacauauaauaauauaaaaaaaucauucacugacuaaaagcucauaaguugugugcucucaccuuagccaaaaauuccuaucuggcagguauuuaauaaaagaaaguucucaugugauuuuuuuuccaccaaauuccuuaaaaucuaugagagaacauucuauuuuauaacagagagcauguugauguucaaaggaguugaguaccugagaauccaagaaaauuugaggaccuggaaugaagcuaaacaugauuugcucuuagccaaacauuuuuuucuauuugccucuacugaaaaccaggauguaauucuuagugucuggagacaaaaauuuaacuguguauuuuuaaaacaguuugucucaaauaguacgucaaaggaacauuugaauaugaguguacagacacaucccaggcaguagaaagacaaugagcuugaagugucugaaggagaaauaaagaugaauuuugugauagcuuuuuacucagugcuccaaauauccaagucacacugauucuuugugugcuaaaugcacaucugugcuuguuuauugccauugacaagugaggucucuuauuauugucccugucuuuaguccauucugccacuggccccugaauaaaugauggucuacaucugucaagaaccucacagcugguuaugugcugaaccaaugcugaaugacaguaagacuuucuuagaagucuggccacccaccuccauaucugguauaacuuuuguccaaaaaauguauuagaaaagauacaaauggugaaauccaucuuuuuaccuccugaaaagccacauccugccaagaugcucuuggcuuugaauccaaacccuucccucagucuccccuccuggaccagguggagaugaagucagacucuggcucccacagugcaucccuuacaagucaucccagccacaguucucccacaucaagggaugugggaggcugaucacuggaagaagggggaaaggaagaauagacuagaaagaacagaaaaaagauagcacagacagucaaacccuccauagcucuuuguaaaugacaguacuguguguccaucucuggaugauuacauggaggaguguacucugcaagagccauuaguucacucagaaagagccaugugaccuauuuugaccaaggauggagcagaagugauaagugcuaugugguugucuguucucugugccaucugcccagguuccagacugaggcuuuucauucacuuuggcucccaggcugagacagucacaaccuaaccacacagcuaaauugcacaauggagaaauaaaccuguggucacccacugacaguuaaguaacauuuguuacccaaguuuaaguuuaaacuguccgauaaccucccugagauagauucuucccuccaccccucucucauguguauacaugaguuuccuucccuguuuucaucucucucuggauuucuucuuuuuugaaaaaaaaaaacaccuauauguaacaugcaccauagcauauugaacacauaucuacugucagaccucaagcuugaucugugccuucauuuucuccagcagggaggucgugcuuaacaaauaaaugccugcugagaugaaacuugauuuguuuauucuuucagugaauguuuucuguuauuccucuuugagcaugacaggacauacuuggaaggaauaaagaaagaaaacaaauacaaaugcuaacuucauaauucucccagagcauaguucuuccacucacguggaaggugaucgcugacauggauaacacuaaaacacauacuuugugccauucucccuuccacacucucuguauagaagcucaagagggaaccaagaggacucacaugauuugauccaggggaauaaacagaagcaaguauucauuuaguagucucauagagaaacuccugauauucugauaaaauggacuacagaugguguagccuaacucuuccuucaguaucuucaugcaaaugagaugugcagacccacagcuauuaacaugaaaugguucuguuauuaacaaauauaaaagaauagacaaagaaaaagaaaucaagauggcggcuuuggcauuggggucauacuugacaaaugaguccaguuuccuuuguaguucccaccauaaaaugauaaaauaaaaugaaaaacagauuggcagugauaaccaaaaaaaaaaaaaaaaaaagaaaagaaaaauggguuguuuaguuuuggaacaucaacuuuuaccaucuucuuuuauuaucuaacuccucuuuguccuuuaagacaugggucauuccuuacauucauccuuaaaccucacucugaucauaaaaguaagauucccuucagccacaucaauaaagcaaaugacauuuauuuucuauaaauggcucauuacauuaugcccauacuuccuaaauucuggcauaugcucuguugagauauuugauuuucaaagauauaugguagcuauucaauuagaucuguauuuguguacauuuuaagcuuuaaaaugggggugaauguaaacauccaucauguagaauuucagccacagaucuucuggaucuagcauguauuucauucuguuggauaucuucacacccaagacacuccauaagaauaauuuguaguugaauaacacuggcaauuuucuaaaauaauuucaccaaaagucaccugcuaucucccauucuucaccuuggcauugaauuugaacuagacauuugccuugcuuggcuucugugaaggccuuuugcauaucugaacuguccuuaucccaguaagcccucuccuacccaagagcugggacauccaggaagccaaugcauauuucauuguaugaaaggaucuaagagagccagaccuggguuuaaagcccaaccauacagauguugaaugaagaaagaaggggcgcauagucucugaagaauggaaacugaaauaguaccuacuuuauaggaccaugaagguuggucaaaccaacacacacaacaugcauagcacauuagcugccauguucacaaagaaaaauacaaaaacagaaaacaaacaaacaaagccaugagcugucacuauaaagcuaaucaagaaagaagcaaauugguugaucccuccaucaaagcccguacucacugugaaauuucgcaaaguauaaacaguguuuuggcaacccagaauagaaaugagggauuauaaaaggcauaauguggaugaaaauuagguaagucaaaauucaaaucugaaagucaguuuguuaccucguggaacaugucucuguuggauaaucaaguaacuccauuuggagaaauaauugucccacagacuggaaccaaaagugacucacaggaaaugggggcggacucuacauugccgucaagagcacuuccuggucacacuaugagguuuucccugggaugagcucacaggaggacuaagaauuugcugccuaccacagacaagcugaacagcugcaguucauuuucaauuccugucaaggaaguuggaugaaagaacugggguaggaauuuaggaugugacauugagagaugccguguucacuagggggccauggaaaccaauuugguacagauucauucuugauucccaggaugaaacaugagguaggaauuccucgcuaugaagacagagauaagccaauccagaaaagcauuccuucucuuucaauuuggagcuggugaugagacaccugggcugugucugacauaugacuggguucuugcuaucuccagcuaacuuuccagguacguuuuuauaagugugucugccuucucuggucuuuacuugguaccaguucuaacaggaaugaauuugggcuacucucaggcucacucaggacuuaaaugcaucgucauaaagaaaaauaagugacuacuauuagggcuuuaaggaauccaaugaaugauauuccuuucuccuucuacccucaaaguuagaauauacuaugaaaguugaaauuagaguuacauuuaaacaaaaauaaguaaauugucaguaucauuagaaaaaaaauuuuuuuguaaaaucaugacuuuauagugcugcaccugaaacuaguguauaaaaacaccuugcaacagaguauccuuuccaaucuauaucucuauuccaaccacauggaaggaagcagaucagaacccagcuucuccuaaagcugauucagaaaagagaggugggccagcuagacaaugcuuauacagcuuaagucagaccagaaccaacugguaaugcucagauggcugagucuguccagaguguccuauucaguaagccuggguugggucucaaagucugcauuucuaauccauaggcugguuauagcaacucugacgacccuagaaacaugaaagacuucuucacagcuaaucaaacagcucaguaacuucccugcuaacuaaaucacuccuuucauguugggggcuaggguaagggugggagcacagaaaaagaucaaaaagcuccaaaaccuggagggacuuagaagggacaucuagccuacaucccuucaagaagagugagagauggguguacacgcccagccgccagcagcuauaacauuuuucaugggacuugcuuagucauaaauuacuuacugauuuauuggagaaaaucuuuuuuaaaaggauuuuaauugugcuucacugucucaacuguagcaauacaagcaauaguuuccaaaaauaggcauuuaguccuuccaauuaaaacaaagcuugcucguuuucaauauuucugccuaugauaaaaagaauaagggaaccauggagaucagucuuagcuuuaugauacaagcaauaucaccaugggacuuacacaugagauccuguuuuaagugaaucucaacaguuauuaaagaacaccaauaagauuaaggauggagcucaauuaguagaguguuucccuaagcuauggguucacuccacaguaccauaaaccacucccaguaugguggcucaauccuuuaaugcuagcacucugaagguaaagacaagaagacuggaaauucaagguuauccucaucaguauaguagguauugaggauaaccuguguuacaugagacccugucucaaaauauaaggaaauaggggaaggaaaggagagagagagggagggagggagggagggagggagggagggagggagggagggagggagggagggagggagggaggggggagggagggagggaagaaauucuuaccuccugguacaguuacuauuucuucuuaagaaggagcacaauagauguuacauuuuaggauuauaauccaucuguuuuugcuuuucuuuucccuaaguaaccuuaggcaugccacauugucucucugaauaucuuacuucaccucuaacucacagaugauauaguaucuguaaacagcuuaaaggucugugccccuucaccuuucucugaagagccuugcacacuuucuauuucuucaggcaccugaauguucuucgugccuguugauugagagcccuuagaaucaagaacugcaucuuacuuauaugguagaaaagaagagggaaaccguggaugcuuagaggcagaaugcuagugaaaugaugagugucaacuuggucuucuuuucagcuucuauugauuuuauuaaaggagaaguuaagaauuccucucaccccaagacuggaguugaaaucuuaaugcuaugcaggcagauggaaagaauuuaaacguuccuccagcuuaggaauucucucaagguugaaaaagcuagucaaacugugucaccaucaaacacuuuuuaaaaaguaauucccauaaugcaucuaacaagagagcacuguuucucugucuucuaaagaaauaucuaagaggaugaauaaggucaagaggaaacaucagacauaacuggaaugaaaauagaauauaucaaggaucacuuuaaaacucauuauucagccaagagugggagaugauugagacuuaacauuugaugucccuaggcgggagcuagcuauuggaucuacucaggacaacaaacaacagcagcuaugaaaagucaagucgaaaaauggauaagaauacaguggugaucucgagagacaaguguaaagaugcaacuugcaaaacguuauagauauaacgggcaggaaaugaaggaucagagugguucaagcaggaagaugauucacacaaaugcagugucagccaggaccaaugaacauagcccauuucagugaguauaacugcaagaaccagaaacaugggcucuagguuaaccugagugagcagaagcauaggagaggggugggauaggcagaaaccugaugauaaagaagugacaagugaaggagguacaaugagaugguuaauauagacuuugggguaaguuuaauagagccuggagcucuguaugugaucagaaacaggaaaaugaaaaagaaaaauucagaggaaauggagacacauaguuacaggggugagaagaaauugucaugcagggucuagcagguuucuggguaagggucuuucagguacaggaauaguuaugucuuauuccagaaugcauauucaugaauucagacacaagccuggaggaaacagcucacaggaagcucucuuuuccuucuggacauacucuuuguagcuuuggcacauuuucuguucagucuaaauauuuacgaagacagcuuugcuuggaguuggaugcaccccugccuugacaggauauuagcaacaaugaugaaggauuggagagaugaugaugacuguggcugugugguagagaggguaggaaugcugaggccaggggugaaggggacuccauugucuacaaaggugacuggauggaaucagauuugagaccaggaauacacacuucauaacucgucguagcaucuccagaugugcaaucagaauaguuugcacccagcuuaguuuuccucugggcuuugaugucacaggauugccagugaugcugaccaaggagaaaauggggaagcuuuccuccauuucacaccaaaaaaaugcucagaugcagugugugaccugcucucuuuuacguuucuuucuucauugguuaccuuggaaucccuugaauacucuauccagacauacuucaguaaauuuguaauugucucuguguaugucuguacaccaugugcauuauacaugcccauagaagccaggaaauggcacuaaauccucuagaauuagaguuacagaugguuguaagccacuauguaggugcugaaacucaaacauggcucuucuagaagagcaucaagugcuccuaacaguuuagccauguccucagcccaugugcugcaaucauuugaauuauacacacuaguuucugauuuaagacauugggucaauauuucuuuccacugagagaacaguaucagaaaaguucuuugucgucuucuuuaguuuucugauccgaagucauucccuaaaguaggcuuccuuggacacucuuuuguaaauaaauccucagccaaauauggugcauaucugaaauccuagcauuuaggaggcuaaaguaggauugugaguuccaggaagaacaaaauaaauacagcaagagcuucuacccccuucuucucauucucccucuucuucuaacucuccuuccccccccucucacaugcccauccaccacaaagcaaauccccagcuucauuccacuuucuagaucuuuucuucacuauaugcuccaucacuaauacuacuuugaauaaguuucuguuuaguuaugaauacuguaccucucaaauacagugagaacugcuucugauuuccacgugcaacagcuaaaggaguaucugacacaaagcagguacuacuaguugacuagauuaauuacuucuccucagaaguguauaucagcccucuggcuuugaacgauaccuuggucucuggcacuauaccuccugagagucugugacaucugacuuuauucuaaacuaaaauaaacuggguuccaugucucuagcuuguagaugaguucccauaguucacaacccaggacuguucuauguuugcauuccucauaccucagaucacacuguuguaugaacugacuguagaagucaaauucugauagccaggaaaucaagaguugauugcaagguggauuacuaggagauagaauuuauucuucuggaaaagaaaagagaaaguguuauaacacauuacauuuuuauuuguuuugaagauuuauauaucagaacaguuugcauaauuaucuuccucccaugcuccaacuugucuuauguuauccuuacuucucaauuucacgauuucuucuuuuuuaacuguaauuuauaaccacagguacacacacuauugaguccauguaguguuauugggaugcacauguauuuagugcuaacuacuucagauugaauaacccaucaaggagguuauuccuagagaaaacucguuccuccucucucagcagcuauugguuuccuguaguucuucaaauggagguacagcuuugcuuuugaucaaccaguaaaaugaacuugguaucuacucagagugacagaccuaauuggggauauugcaaacucuuuucagccaaguucuauucugggacuagccuuuguaugugcuucucuugguccauuccaaauaguacaacaacaguucuuauuacagugggaugcuuaaaauuucuuccaagcuucaugcaccaggauucuacacacguagauguagauaaugcaauggaggagaaaaguguauacauggaauaucccuguucuucagaaagacaacugugugaguuagggucacauacaguugaauuuccaccuauaacuuaaauuuaaauagcuucagaaaaucuccccagcuaugaaagacccuauaagauauuaauaauaauuccuugucauaugcuuagaaagaauuccucccucaugugucucauggcuggucuuuucagccaagccaacucaagcuuuagaaaauuaucuuacaaacaccacccuagcaaugugggcaucucaaaugcugcugcugcuucagccgcccuuaacacaggaguggacagccucucgcucuaggcugaaguuuuccaguacucugcuuuggugucucugagcaaagaugugugucauccaggaagucucucaagccuuuucuuuugcuagaauuccacaguaaacauucuuagagaugacuuacugccugucacaacuuucucuugcugccuuuccagaaagaauuccuacagaaugaggucagucacuuacucaccaugauuuccauuuuuuucaccccauuuggucuuucugaucagaugcugagcaacuguugccaacugcaucaaugggucacuuccaacagcugugagagcaacaucauccagcagucugagacaaagcccagaagaucacaggaugaagcauggacuccaaaucuaaucagagggccaauggggaaauuucaaucugguagauccuauaauugugugguggaguacuugaaaauuuagaugugauucaaaaagauuuucaaguagauaguaugcaaaggucaauccaaucccacugucuugauuaggguuuuacugcuaugaacagacaaaaugaccaagguaacuuauacggauaacauuugauuggggcuagcuuacagguucagaagcuaaguccauagcaaguucaaggccagccuaagcuaugugagagguugucccaaaaaauacauaacaugaagagucccugugacauuauuuaaguuaauuuuacuugucuguuggacagaccauuucuaugugccaagaauagcuauuaaacagccaacauuagccauacauuugguacauaucugucaacaugauuauuucacccuuuuucuucagaagcugacagaagaaaaaaguggauaaagguauagcuggcuacaguaguacaugacaaaugucaugaaacaaagagucauccaagaacacauaagaguacuaauuuugugugggagggagaugucuuggagauuggauguccuguuuggacuggaaucaugagaaaguuagagaaagaguuggaaguuguguaggguaaaaguguaaagaacauauuuaaccaugggagaagagcgcaggcaggagcacaggagaucucgaaaugaggugaucaucaguaaccgggaaaaagaccagcaaugauggcacacaagagagaagcacaaucagcggacagagaagugugcaagacacgugccucagccaaccagugcaaugaaccaugagcucuuugaggaugggguuuuaugugaccugccaguaccuucuucacauccaucgcuguguccaccauagaggaaauagcagucauaggccaaaugagggcaugcauaauagucauccaguaaauagcaauuccauuagggaaacccuuuccuugcuuucuaacuuuuucauuuuuuaagagucaggaugggacgggggagggggggaacuagcugcaacuacagauggauauuuccauccccaaauacuacaaaugccaccucuuuggggcuuauuaugcccaaauggcagucuguuugggaucuuucuagaaucaauugcuuccaauuuucaguuuucugauuucagauugaagacauguguuugguguugcacagaugauaggggaacaagcggauuccagagaggcaucaagcugaguccaagugauaagagaaaugccugggggaaggcauagcaacaaaacauuuuaaaguucucaaagugcauaaaucauccuguaaccaugcuguccugauucgaaacccaaaauagaaaaagaaagcucuucugugcuaacauuucaucauaaccagcagcccaaugcucaggggagccaguguuugugaaucuuugaguugggaucuggaaggacugacgcagaacauuacuaugcagccaguucucagggaagaaaaaaaaaaucucagcauggagugcgggcuuccagaauccuugugguaacuucucauuucaguugaauugcacagaagagacgagccuuccugggggguuggccaacaauagaaagaaacaacuaaaggauagacucauaccaggcgugaugccaaaccccaagcuaguucuugagcugucuaggcuguaagggaggcugucucucagccauggugcagcacacuccaugucugugaugguaugaggucauugagaccacaguccugaccagcauaugcacugggacaggaaaaagagaaauucuucagcaauauuggcauaaauucaaacauuguuccaaucuaagguauggauucaucaagcugagcuucaaaauuccuacuucagauuaaaaaguacaagaaaaaaauugcugucauaagaacuaagaaaaauuauucauguaaaauaaucuguaggcacaacauaaccauguuaaauuuuagucuccaguccuacuuuuucuugauauaaaauuaaaauucuuuuagauuuuuccuuauuauucuguucaaagagcucuaaaugugaacaaauguacaaaucuuagcuauacugacucuaaccagauaaaugaaaaguuauacauacuaguaauuuggagguuuguuucuuuggacuagggacagaauguaugcaucuguugguuguaucauguuuaccuuggcaugucaaugaucagucuucauguuuaaaaaauguuccaauauuuuagacuuugaauaaucaagaguccuguucaucuaugagauaagauuggaauacaccaagccaaaaugaaaaucccagaucaacccauuaucagaugaaugggucuagauguacugcuugcucugugacucucaauguucuuagccauaaaugaauacaauauuuauuuauuucagguuaugcaucaaguacacaggcuugaaauugcauaacacaggaguugcucaucaacgucauucauucugcaaugcacaucaaccccauccaagguaccaggagauauucuaaagacauaugaugaaucaugaacuaaagaauaucacuauauuguggagcccgugucuucuacaagagacaagcaauugaucaauaagcaaaaauaacugucucucuagugaaacaagugugaagaaaaugaacugagcaaugggaugaacaguacuuauacacagugcaacuagacaguugcauaagcuucuuuccccugguuuauucauuuuacuuuacuuuggagucccaaacccacugagcauggaccuccaguaaagaugaguaaggaguuauacucuguuaaauugagucaucugacaaacuuugaaugacauugagaauagcauaacaacaguacauguuuaucaaacaggauggacaaaaaaauggguguugcuuuggagacucuuggaaaagaauagcuacguugucuccaagcuugucacaguugaaacuacagaggagagucuuggggaauaagaugucuuccccaaagagggcaauccucaacaaugcaagcuuuguggcagaaguacauugcugaccuuguucugagcuugguccaagcugaggaagagaggagaauggccagcugugaaaagaucaauuugcuuccaaucuacuauucuuauagucagagaggcuggcucccuagaguggcugugucugucagggauauaugccaaguagggcacagauugaaguucccuguucccacuguagugagagcauucagccuugaguggagucuguuccccagcuauaaugcuuuguggagacccauauugagauagccaagaaggagacuucaagucuaagucuaauucaaagcuagaacuauccaaacucuucauucauucauaucugaaaaguacccaguguugaccagaugugggaaagcaggcauucccauauaucacagcaaagaguauaaauuagcaugaccucugcagagacccaguuggcagaauccauggaaacugaauguguauaguucuuuuguugcaaccagcccucuucuagaaauuuauucuucagaaaaguucucagagaugcccaaaggugaaaguucagggaauauguuuauuacaguaucauuuaugauaguguaggucuaggauagcugaacauuauauguuguaaauuaaauuuugagguacaugcagauguauauaaaaagacaaaaauaaaagggagauagauaguauuauuucuuaugcauggggaauuccacuuauauugaaaaagugugucauucuauuugugugcauaucuuacucuucucugcuuaauacuuguguguuuucacgcauaucucaagguuucugauaccgaaaugacaagaguaugacauagaccccuggagauaugcaagauucuaggacugaauggaaaucacagauauauaugaaaggaugaagcccacaagccccugucugcucuucucucuaaaucuguguucuuaaacuagagugagguauaagcaauagacagauguguacaaaguugcuuacaugucuuguggguuuuccugcccuuuauuugauaggcaguaagaccaugcugagcauuauccaucuuucacuaguuucauaaaauggauggcccauuuccucuauucaucaaauauuacagagaacaaaugcaaagaaagucgauaugcccccaaaagaaauaauaguucauauuuucacgacaaacaaaaaaaauuuacaaaacuauuugcuccuuccaaacucuaaaacauccccaaauuuuccauuuucaaauauuacaauguuuauuaaauaucuaagcucacaauguacaccaaauguugaaggacaaaagaaaaguaauucuauccaucccaccacugguuugcuguagaauuguggucaagcuuucugcucacacugggaaugcuucccuggcuguccugaugauaaggacuacauguccuucaggcagcuaagguuaacaaauggagagcacugagcauuccuuuuagcuucccgugauaggcauaacuaauugaucacugcauuuccaaucagucuaacaugaguccucuaaauccuucaugacacagaacucuaagcagucacuaacaauucaaguugacauaaaaaacaacccuuaauuucuuucuccagauuaggugagaucugaaguucauuucuugguauuccaagaauucaacucaacuguacuguaacuuauuuauaaagaccaucuagaucauuaaaauacagaguguuguaaccugguucugaaguuuagagacuggucuauguaaguccauuugaacauggcuucuagcuacucacaaaucuauuuguauauugucuaucugggugaaguaaucuuuuuucuucuauuagauauuuucuuuauuuacauuucaaaaauuauccccucuccaggucuccccucuggaaacccccuauaccaucucccucccccugccucuaugagggcaucccccccaccccccggcccugccuuccuacccugacauuccccuacacuagggcaucaaacuuccugggagaaguaauuuaaccacagaaaauuucaaaguguggugcuguacugauguacucucaaaugugggcccaguugagagaauuucaagagaaucuucuucauuuacauuuacacucuguaagguuagaacauauuuucauaauuuuuuuucuccucugacaaaauaaagccaacucucucauuuaucuugaguugccuuggggugaaaaacacaaauaaagauagaauguaaaccucuauuaaaauuuugagaaagagaaugaauguuauacaaccugcgaacagauuauuuugcaagucagaugacugccaagcucuuguuacuaugaaaaugaugugaaaacuaauuaaaauaucaguggagaaaccauuaggauguguaugaaauauguaacaauuguuguagaguauagccagccugcugugcugcuuaaccuucccuauguagcugcauuuggguacccauuaagucccugaagguucacaauacagagaaaugauaccuauuugagauagaaauaccagcuuaccauaauuuaauuaucacauauuuacauguaccaaguuauugucccagaccucaucaauguauuuaaauauguguuaauuuaaaacauuuuaaguagaaacugacagaaaacauuuuucaugaaaauuaauuaauaaaauauaacaucccacuuaauuuuugaaaugagcagaagaugguuuuuauaaucaucuaccccaugugauuuucagaccaugacaagcaaauuauaaucuuguuuuaacaaagauuccucuuacccauugacuuauuuuuguggauagauuuuguuuuucagugcuuacacacacacacacacacacacacacacacacacacacacacacaagaaagacuagaacucaauuaccauaaaacaauaacagucacuauauucaauucuaguguauugucuacacuuaaaaacccaaacauuuuauucagagaagcauuaccaaaauaaauuuauguuucauugcuauuuaucaaaaauuaauaaauguacaguagguuagcuaauuggguacaacuagcaauucuuuugaagacucagucuagaagaaauuauuuucuauuugaauguaauacuuaccauuacagaugcauugauauugacuuauaaauauguuuuguuucaguggaauacauuaaaaugaucagugaaagaacaucaaauaugaaaguaugcuguauuagcacaagccccuguggacauaaagggauacuuaaggggaaaaaauaagcuuaacguuuuuaauugcuaagaaagauauauucauauauuucucuuuauuuauuuuuuuuucaaauaaaucaugauaguagaaaggauugagacugaucuccauaaucuucaugagaaagugauaaggcaugguagggguagagaugauggagacaguaaucccuggggaagccagcuuaaccaucuugguaagaauccagugagagauccuauuucugaaauuuguuuuuaaauggugggaggugcucuagaggauugguacuugugguuucacucuugccuccaucacacacaugugcuugugugugaguauaugcacacaaaugaucccacucagauaccaacacauacagacacacacauauguauguguguguauguguguauguguguguguguguguauauauauauauauauauauauauauauauauauauauauaaucuauagcaguuuuucuggagaauacaacagagaauuccacaguuccaaaagagauccuuuccuucguugaucauuuucuggaacauuccagauagauuuagauugcugaauagcuaugaagauaagaauugagaaaacaaagagaaaaagaaacaacaacuaucaucuauuugcuauuccucccauuuugaggagaauuuacuuauguguuuauucguucugaaacccuuuucugaccacuggccccauuuuaaguucuaggcuggaauuggaagcuaccacgaccaggaaaacauaggcccuaccuuugaguucuaaucauggguuauuaaaauugaaaaauauuucauaaaaaaugacuaagauauccugaaguaagugguacauuagaaaaaucuauuaaggugcuagcaguaagagagaauggugaucaguucacuugagcaggaucuuuguuaggaagcaagaaagucaguaauacauucuaguauagagacauauaugguuugagauuuuuaugaauaaaaggucuagcauggaucaagaagacaauagaaucagcacaaaguaaguagagauaggaauuacagcuaaggaaauaaggugaccauagauugcaaaggaucuugaaagcugucguccucuauucaagcuauuacuagguaccagaggcucgauggcuuacacagcagaaaauaauuuuucaguauuauggaagcugagaaauccaagaccaaggcaucaguugaaucagugucuagugaagguccauauucuaguucuuagauuguaucucuuagcuuuguccccacaaugggacacacaaagagacagcucccuugagccauuuuuguaagaguugcuacuucugucugugaagccucaggucucauauccuaaucaucucccaaagaaucaaacucccaaaaccaucaaacaggcaauuauuuccaagucuggaauacagauagacauuuggacuauagcaaaaccuuugcccagccauuuauaauuugaauuugacuuuuugagaaaaaugaauaaguaaaacaauauaagaaccuuaagaugauaauuaaugagacugaagacaugauuaaaacacacuagcacuagcuacaaauggauuaaccuccucagaagaauaggucuaugaauucacaaaguacaaacauccaugaagaccauauauuuuaaagaggaagaaauuaaucaaaauaggcacaaaauauucacuuuuaaucaauauuuuucagauaucugcuccuuuacauaaaaguguauacaauugguguuuuccaagcaauuugucaaguaggaauuaaacuuccuacuuuuuauagauaccaaagcauagauggcuugaguaguucaccuaaguucagaaaauagaaugaagagaauucaauaauugauuaaccagagcaaaccagacagcauguuuuuagccacaauucugucucucuguagcuagugugauuacuaucauccuucuugaacucaagaauuaaauuaaaucaaaccaaaucaauucaaaucaaaaguguggguagacagcuccuagaccuugucuacaugugucucaaucucaaguaaaaguggacuauguauaggagcccacaagucccaucuagagaagaaugaagugccaacauggucuuucucuguagccagacccacagaggagcccuugggccaggaauagggaucuacuccucaguugagacuacugaaguaccuucacuuuuucuuuauacccuccacucaucuuagugaauggcaucacaauuauaaccucacagagaacauucucaaaacuucuacccugccgcaagccaacauucaugagagacuacaguggcccgcaucaguguccuugauuuuaagcucacccuuacuuuucauucuguuccacugcauccauugcagguagaaugauuuuucuaaagcaugaagcuacccuuauucaugaugcugacaccuuggaauggugucuuaaucuauuccuagcaaagaguucaugauccuucccaugccaccugccaggguaguguguaucaccagugagagcuccaacacuccucuauaauccaaggucaugacuccaaugcagaauguuccuuggacuuugggcauuauuugcuuucuucucuuugacacuaaauuaugcuuaaguuuaugcuucucuaacaauaucuucccacauuuaagccaccacugguuccuacacacucuauuuucuuugucauaauacuuaucacauuaguuuacaacugucaugugugcuugucuaucuucucuucugagccauuggcaccaugguucaucuaagucccucacuucugagcacaauguucaacacauagcacauaauaggagggugugcauuaaguaaauauaaauauauaaaucucauuauuacuguugagugacuauuauauacuucucuaaaagaugcagaauucauuugcagaaugguaaaaaccaaaguucaaugaauuuuaccauugcuacuaacucacuaggcccacucaguuuuccucuccugaaaaaugauaaagaugucuucacaacaccacugggaucacauuccuuucagcagaaaaaucaaugccucuaacucauaaggacuaacaaaugcucccugaaaucuuuaaacaucuaagcaggcauccuaaccauagaugaaaaaguugaauuuuucauauucaacuuuccaaaauaaaggacuguauucuaaacuguggaaaagaagaguuuagauaguguuuccuugagggaaauucuuccaguaguguaggcaaaagacuauagaauagaaaccauucucauguuuuccuuuuguuccgaaaaggaagaguuagauuuucacaugaaaaggcuguguuucauaagcugugccaucaagaaaagcucuaucauguucucuaaaugucaaaagaggagagaaauggaggcagaaaguggaauagcccagaugccuuagaugugcccacacaaugacacacaucuauuugggagcaaugucuugcaaauacaacccuggaauauucuauaacaucagcaaaauucuaucauagugauacacagaaaaauguacauuccuuauauugggauacaugcugagaacaagaacccgguauauuuaaauuucugauuccuaggauacauacaccauugcuaaauuuuucuaguacauuuuucuauuauaaaauaaaacuuggauggauaguguacuacuugagccagaaaaaaagaaaaaaaggaagcaaaagauuucagugaaaguuacccuauuccuacuguaauugguagaacauaagacaagaaagagacuuuuuuugguccuccaggugcucaaaaccuacaaucugccauugacucaauuuuaauauggggccauuaacaucuguucauugucuuuuaaagaagauucagugaauuccaacauauaaaacaauuaucucaguaccugacacauaaaagcuuguaauaaaaguuuuucuacucauuuuuauaaucacaugagaggaugcauauggaagcuauuauauaggauccaggcacagugggguaaucaaggaguagaacuacaaauaaagcauuuggagucgaagauugaggaaugauuuaaagagcaggugacgguuagguugcacaccggaaggggagguugcauuucagacagcacgagaaggcuuucuucccagaauuguaaacuacuaaaaugcaucacuggaguguggaaagaagcacuuccuggcuccacucacuguuacugugucauuuguuaacauuaucaaaucucuuccauguggcucugcuuccuagccaaaaauagauuacaaaggagcaacugccguucuagugcccgcugcaucauuuucccauccccgucacugcucucagaaacuaauagguagagggcaccaagccuucaaagaacaacaaugccacaauccaaacuucucugaaaauuagagacagucaucagucuccuuggggauagaagaaggaaagacauaguuguacuggagaguccuuggccaaugagagaauggcugagaaguuuucagugcccauuuggcauucacuguagcugcugaagauuagaacugguagcagagaucauauguggaguacaacuuugagaagaagaugguaguggaauucuuuuacauauugguaaaagaugucaccaaugaugccaaaaucacuacaaaagggcaacaauuucucaucaggcccaacuauggguaguuacacaaagcaaugcucucugaaaauuucccaauaugacauugucaucuggagaagguucaaaaugccgcaugaaugcaaguuacucccuaugaaaugucauaagcuucugugucaccugaguucugaacacggcuccugauuuucucccaugccugccugucuuuggacacucuagaacgcccuccagggcauccuucccaaacuguuuuugcuuugagcauuucugcaacuuauacagagguaaaccagauaauccuugucacagcggagggucaguuugggugacuccuaccuccuaucucucuuggcucuaggacuucuucuggauuauuagagaguuaucccauuuuacacgcuuaaccaagauugugaagaguaauuacagcuaguguagguuccugguaccuagcuuuagaaccauaagcagaaagugacagccucggguauguaaucaggcagucauguacagauacuuaggugccauggaagaccuuugaaacuaacuuguauuugcuaaaguuagaugccaagaggacucacagagggguaguagcaugccugcagcugggagcucugggguuauuuauguuuucuacagauuaguucucuccucagcagaaaagaaggaaacgaccuuguaagaggcaucuuaugaaguauuaaaaacuagaucuggaagggagugagacucaagcuggaaagcuaguucuucuacuggaagcuacccucuccuuaguuaagccuacuucacuggacugccaugauaucgacucuggaauuuuagcagucuauagcugcugcuuguggguugcagaagagaugcaauacuagauguauuauagcugcucagaguuuuaagauccaguguuagccuguauaaaccacauuaaauuacauuucuguuguccccuucugaauguauaucugaaaacaucaucuccagugugcuaucagaauguggggcacgugaguggugacuaggucaugagggcaggucuuuugugaaugggauuagaaccccugucauugaagccucaaggaauguauuggcuccuuuggccacugugaaagcaagugaagaggugauugugugaaccaggaaaugggguccucaacagacccucuaucagcauuuagaucuugaacucuguaaccgccaaaaguuuuuuaaaaaaaaaaaaucuuuuuuccaaaagcuaucaagacccugauauucucuugucgcaaaaagcauuaagauacacaugccauacgacuccauggagauugcuaucauuuguauacuucauuuagaaaguugcugaauauucauuaccucuagcgauaagaacaaagaagcaugaacuccaggcucugcucucaacacaggaucuaggcauccuuuuugcuuugcguguuucucagccucuuuccuuaggauagaaaacuacaaacaagccuugcccaguggccaauccacauccuggaagguaaagagccaacccagaucacuccagucaaagugagcagcucagcaccagagcccuuggccauguaacccgaucuggcuguagggagagugacuaagugaaacuccaucugcuccgaggucucccugagcucccaggagggaccugagcaggauaugaggaggcggugguggugaggugaggggucugcacggaaauggcgagaucuuuggacagagaaugucucgccacagcaggcgugggucuccccagcaugacaucauccuggcacucaguccugcucuaaucucuguacgcugcuccuuucuuggaagccgagaacugaaaguguaccuaugugcauguggaugugaaggucauucguguaggugcacauccauacaugcaugguguacaugcaagugcacauuaugucaugacagagaguauaggccaggguugcaagaucuuggcacuaugaacuuuuuuuuuucagcugggaaagugaaugaggcuguucuguuaauuguagguggacaucagcaacucugauccauccauucuauuugguaguggcaccucuguucacuccuaccuauuacagauuaaaacauuuccaguucacucugaguucuccuugugugggugauaaaaaucauagccaguuaagaauccccagagugggacaaauuagaauaccuucuuaucaaaagaucaggggaaauuuugaagacacagugagucuacaguuucuuauacuauuuuagacauaaauuaaaaaacagagcaggggcagggcagacaagguaguuccuggaaucucagcccuggggaaacugaggcaagaagagugccaaaauguuugaugucagccugcuuuccauagcaaguuccuggcuagucuauaaugcacauaguaagauccuaucucaauaaaccuagcugagugacuuugauuugugggucaaauggcacuaguuaaagaagaacaaagccagaggcaauguggacagugcuccucagaccacagcaggagggacugcacacuuaucucuacuucauacaugaagacuggggcucagcugaucgacauucuugcccaggacauacagcugauaagugucugagcuuuaacuuggauucugaucuuagaccuguggagauagcuuuucagguaaggcaguuugcucuguuuguaugaggaccugaguuugaauccccaagugcccacauaaaguguugggcauggcuagaaguaccugcaaccccagugugaugaggggcagagaugaucuugcuggccacugacauagguccagguucaaugagaaccugauucaagagaauaaggaagaguauugagaacugcccauccauuauccuccucuggccucuguacaugcauguaugugcaugugcgcacaugcacguguacacacaccccacaaauaaacaagauaaauaaaauacaaauaaacaugaaaccugaucuucaugauucaaguggcagaauucugagccacuggguucucuuagccuuuuacuuugguguccauaaccaaugcaauaaaaauagcaaagcuuauucaacuaaguauuuuaccaaggacuuuggcauuuaauaucaucuucaauugaaguggaugggcuucagugugcaaaucgggcuuucuaagcucucaucuagacaggauuaacccacacuuaugaaucaacaugagauagcacaaaauuaaccccugugugagugacacauauuggauggauaaaaaaaagcauacuuuaaaacaaguguuucuaguaauuuaagcuuccccugcauggggguaggagaacuguguaccaugaaauucagcacacagauuuauugagcuugacaguauagacuuggcuuuggacaacccuggguucuaauccccagccuaccacucucccuguuguauaacacugaaaaggcaauuuauagugaggaguuuccguuaauuccucagcgaacuguagauuuaaagcuccgcuucuuaggguugacuggaauaacuaaaaccagguccugagaauuaacaugaaguguuccaugcugacuuggccuuuucucuuagauacuuuccucacggcugugaccuaaugccuaaccagaaacaaacucagaaaggguuucucgugccucccaguucuauagauucagacuaucauggcagggaaggcaugucagcaggaggaagauguugcugaccacauugugucugcagucaggaagcagagaacacacagaaaguggagccaggcaaaagauuucaggguccaccacagugacucaccuucuccaacuggacccuaccucaagacccagcaccaacuggggaccaagaaaguguucauacacgugaguccaugugggauagggcuagucuacauucaaauagcagcacuccucuaauuacauucaucauucugcaaucacaugugugcuuauguagcuauguauaugugugugugugugugugugugugugugugugugugcuucuguaucuguuucacagucgugucauuucugagucugaaguucuaugaauaagagacccuaccucuucuaaugugacaagucuucugugguuccuggcucagcuaaaguaugcuguuaauauuuuuaaaaaguguuuuuacacucucucuucccccauucucacccaauauagugagcuuccagauaguaaaccauuuaagcaaagaaaaaaaauuagauucucuauuguucuauacuccucucagccucuaaggauuauuuucacuauugcaccuaucacauuguuuugugucaccauuucuaugguaauaaacuucuucauagcuaaauggcucacuuaucaaucccuauaauuucauuuuauuacauguacucaagguaugauacaugucugacuccaauaaguuuuuguaaaauuaaaaacauugaugccuuaagggguaccuguccacuaaguuagaucuuagacaaaauuauucuucucaugucucaugacucauaaauucuaacugcuaccaaaucuauccagaccacuucugacgaacaggaaccaaugggaggaaauggaauuguuuaugcuauccuugaaaaaaaacucacaacuaaucaauaauucucuauuaaauuaaaugugaugcuuuuaaaaagaacuaugagccauauuuccauaucuaacuaguaccugaagauuuaucacucucaaucacucguacauacaacaaauaccuacagggugguuguucagaguugugagauguucaagauucuacuuaaagcuuccugggucuuugaagacuuaaagauuguagcuggaaagaugguucaguaguuaauagcaguggcuaaucuucaaaaggacccagguucaauuccagcacucacaccauugcucacaaccaucuguaaguccagcccuacaacauccaaugcccuuuucugacugguacccuagacaugcaugugacacacauauauacaaggaggcagagcauccauauacauucaguaaauuuuuaaagaaugauuuuuaaagggggaauauaagagcaauaaucuuauuuaccaaaauaaaauuucaacuguuuguauuggcuuacuuggggcagcgaguaguaguaaaguccucaagaguaucuaugacaaauuccuuuccacugaucucagcacuauuggugaagggaaacucugauacacagaggaaauggucaguaaaugaaguccagaauagaaugcuuaagggcuggaaaguuugguacaccuguggacaucaucuccccaccaccaggaacaucuccaaaaacaggaagagcuacuauuucaucugucauuguucuccacaggaaagaagagggaagcuagcuauuguuacugccgucuagcuguaguuaggaauguucugcauguagcccugucacggauucuuuccaacacuaaggacaagauggaucuagauucuuugcuucccucaucgugccauuuuucagaguuuccuucuaagugaugcacagugaauucacuuucauuuguguugugaguuguuccucuugucugaugguuuauuugggaacccaagaaucucagacgguccaggaaauuugggacucauuugcugccuucuucuuccuuugccaugucaagaauccucauugccuggcuuuugaaucuagaaucaagcaguucuauuuccucuaugcccaacucugaugcuaggagugcagcaaggccugggaaugucaggaugcauuucacacugaaaaauaauaauaauaauaaacuauucaucuaucaugguacuugauauugcaagaagguaguauuuguuccacauuucacaaaauccuacaguuucucaugccauaaugucucauggaaagucuaugcuuaaauuuugcccaugauacuguauguuacaauaugauauuaacuucaggucaucccgauaugaacuaucugauaauugucacgaucuuuaucucucuguuugcuagaucagcauuauucaaauuuggaacuaaucucauuuuugugccagauaguucuuuuucaugagauaucauccuguacacugcaaacuuucagcagagucccugacuuuuguccacuugaugcuaauagcaacucaaaauuguggcagcuaaaauauccauaagcaucauuaaauaucacugaggaucaaauucaccccuugaugagaaauguccuggaagaaaagagauugugucugcccugccugcagcuguguucucaacauuuacugggaccuguguguauagacugaacaagcaaguaagugaaaaaaaaaaagaaucagaaaaaguauuauuguguccucuccugguaucccucgcuguguguguguguguguguguguguguguguguguguguguaugugugugcauguguguguguguguuguaauuaauaaaauggaaacauauauaauaacauuuacaaagccauaaaaaauaaaaucuggcacaaaacuaauaggaucuuggguccuaaccacaccucugacaccagcuacgguuauuacuuuugcucaaguaacuucucuuccucagguguccauuuaaaauuguaacaaugcuuauucauaaauuugcuaugaauauuaaauuaguuuuguaaaaauaaaguccuaaagauaaaaccaacauauaacaaaugauaacuaaaaacagaauauaagaaaugaugaagaaaaacuacuuuuccuugugaaagucucuuucuuuuuuuaauuacuuuuuaaauuauuauuauuagauauuuucuuuauuuacauuucaaauguuauccccuuuccucauuugcccuccaaaaacucccuaucccauccccucucucccuguucacuaauccacccacuccugcuucccuguccuggcauuucccuauacuagggcauggagccuucacaggaccaaaggccucuccucucauugaugucccacaaggccauccucugcuacacaugcagcuggaguuuaagucccuccauaaagacauuauccuuacacauuuccuacugcuugguccaaagacaccacaccuccuuccucuuccuccaagcucaucgcccuggcuuccuauggucaauguauauccuauaauguucauaucaccuuuuaaaaucuccuugauacaguccugacacagacuauucauaauacaaaaagauauuuaucuugauuaauauuuauagaaguuugagcccaaggcuaacaaucucauugguuuggacguauacccaagguggauaagaugauagaaaugugugacagagagagaaugcuuauauuuuagguaggaaacauagauagaagccagagaguccaauuccuuuugagggcauacuccccagcaaccuaaagaaauuauauaagacucuaugccuuaaagauccauagcaucaaccaacacugccacacugagaaccaagccuuuacuuacagaccauggaagcccuuaccugaaccaguucagucaccuuccuguucuuccugcuuucugcaggcagguugggcaccagagaauacagucaauuagccacgguuaucaaaacaguaugagcuggggcaccucaaugcccuucaugucuuccaugacaagacagacagugggaaaagucuuaaaacuuagucagaguccaacugugaacuaucuuugucaccgauuuguaaauauagaucagaaugucccauguuuaacuauguucuuaugggucaaauauacugcucaagggcaauuuauuaugggauacuuauuagaaagaugucaauaagaucacagcuuucaaaagaaccaaagcauccccauggcaucaaaagcaaucauugacuacugacuccagcacucuacaccaggcucucagcaagucucgccuggcaauguuuuccacuuaaaugagccccugauggaauccacuucaaagcaagcccccuucaguugcucuuagcaugcagcugucucccugauucauccuggccccuaucccugccuuuccacagggauuaucgaggcuuugcugucauuuccuuauaaagcguuucuacuaagagaagcuucuaucaucugucucaaacggugagucaucuuucuauccccacuucggagcacucccauguacuguucaaccauaagucaaguccgacccuggccuagacaggugauccugaggaucuggaaagucuuuaaacuccuuggauggaggcugcucugcaugaugguuucugaaaagcuuacugggggggucucccuaagcagaucuccaguccccagauaccacagccacaucugccaugauugcugaucucaguggaaacuagagagaaacuggagagaaagaucagaccugugggcuguuuucagaaguucuaaaggaacagagagucuggcaucauuccacucgcuccucucagaucccucuuaauguuuacccuguccacguagaagcaaccagaugugcgaaaagaguuuagaagcaaucuauggcagaguuuguauagcucuuaugaaaaucuagacuagguccuuuccccacauaggaugcugagucagaauaagcacacauggacgcaggccuaggcugucccacagugggugggacaugcagacaaagcucugugccucacuuucuuaucucuggcuugagcauaauccucucuuagcuuuucaguuugacaaaguguacuguggacgaauccuuagaguuaucgaugagcagccaugcagauaaagcccgacacuuccuggcgucaggcugccccugggaugauaaggaagaaaugugucagaccagauuucaucuuccuuucuggccuaaaucacucaacacugcaaagcucccacaucaacggacugacggcaaaaacugucaggcugagggugaagguugcaauucccaggcaaagcuucuguucuucucuguccuccgacccaccccaugaaauuagguuaaaggagacgcaauaaaagaauguagaaaugccauuccaaauuucaaaggagacuaacaccaucucucacagauaaucucauuuaaucaaaacccaaaaaauuguaaaacccugcugugcagaauauagaaauaauaccucagagauacuauccuuagauucauuucuauucauguuuuaucaaauuauucccagaguuagugaauuagcacuaaugaaauguauucucuugcaacuaugaaucacugagcaugaagugaguuuaauuaauuaacuucaaaauauuaauaggacuaaagucuuucuagagacuccauagagaaucucucuugccacuucuggugaucacuggcaugaccuagccugucgccacaaugcuauauaguuauauacccuggccguaucauauuuuucucucauguagucaauacccaccaugacuuccucuaaugagacacaugcaauuacauccagggcaauuuucaauucucaagaucccucacucuucuacaacuacacacuauccuuugucaugcaaagacauacucacaggucucauggguuaguaugcagacauccaccaucuucuauucaggcuauuaguccauuuaaugacaacacauacauuuagggcaaggcuuuuuccccuagacagcauccuccacaacugugcagaagugcacuugcaaaaaugguuagcuuuucuccagugggcaugcuguuaacccugugacauaaauauuuucacucuauuguuacagagauagaaacaaaaugagggggcuugaaaggggcuacccaauacuaagacacaaagaugacagcaauguaagucugacucaucucaaacagugagugcauuaccaauuacaaguagagaaccaagggaguaguuguauauaugauaaaacaagaauuauuuuuggauuggcuuacacaaaaaaaaaauaauaauaacaagauuuuucccaguggccacuggagaagcagcgaauguaggggcugcucaguccaagcugaaagccgggaagcucuguggagaguugaugauguugcacuccauguuaacaggacaaagaaguugggacuuuaaucgucuaacaucagaggacaauaauggcagccauacauacaugugcuauaaaaaacugguguauacacacauacacacacacacacacacagagagagagagagagagagagagagagagagagacugcuuuuuuucuucguacuuuuuucccaugcagacccaccaaccucacacauucagaauuggucuuuauccacccaucacuuucuuagcuauuacuccuuucuaaagcagcuccccacagacaaaucaaaaacccuucaccaguccuaucaaaaugacaauccaggcaaaccauuaaaguauacuuuuaauauauauugaacccacaaaauuaauaaaaaauacauuccuuacagauagaugcuucagugguaauucccacauggagagcuuccaguuaaaccacaggcugggcaacuuuaaccaaauggguugacuuauucccacuuuagggaagaagucacuuauaacauagaggacuucccaugugaaagcugagaucacagcaaaguuauguaauacaaacugaaggggauuuguuugccacaaaucaucuagcacuaggguggaaggugacaucuuaaccuauuucauugcuauaacaaauaugagacuggguaaccuagaaagggcacuuacuuugacuugugauuccacaggcugaaaagauuaagaacuuguuuuuucuuguuagagcuuugugauugugauacuuccaacaaagugaaaggcagggggccaaguagcccugggaaaggggaaaggcugaccucucccaauggcucaccuaucaccauguuaaaaaaacaaagcaaaacaacaaaacaaaacaaaacaaacaaacaaacaaacacuugaaucaauuuaugaagucuuaacccccaugucccaaacaccugccaacacuggcacaguacaaucagauuucaacaugaguuugaggacaggagugaagaaagcaucuucagaccauagcagguggggaacagguaaggaugcuuagugggaacagagaaccagccuaggaugcuccccacagggaaaagaggugauuuaagaggugauuuuuugaggcuaguccaccaagccccagguccugcugagggcaauucucuuucuggguuaggugaaaucagcugacucugaaugggggaaaucauccuacuuagaaaacaaugaaagagcagugaucuugaucuugaaucucugcuaguucuguugcuguuggagggcaggcaaagggaguuuuaguuuuugaaggcaauucauaauauuucucucagauauuaaucucucagaauaacauugaacaucccugcagggaggcauucauuuuuucuugccuuugguaaauuccaugaguguguguguguguguguguguguguguguguguguguuguauauguguaguaaacaauagagguaauucaugaaaucuguguaaaaagagugauuacgagugauuacuacgaauuugccaagcagcagaucuuuguagccucucugaaaagaaaauauguauauuucauuuucuuguuauuuauuaaucuuucauauuuaaauaugcacauuacuagaaugugggaccaagauuauguuuuccaaauacaaauaaggaaaaaagaaaaggaaaaacgggaaacauuugaaauguaaauuuaaaaaucuaauuaaaaaaaaagacccuaugaacaucuugacuucagauuucuacuugagagaauuguaagauaauaaauuuauguugucaucuaaaaagagagagagagagagacagagacagagauaaagaaagaaaaaagaaagagugcuugacugucucuugugaggcuaugccagugccuggcaaauuuagaaguggauacucacagucagcucuucaauggaacacagugcccccauguaggagcuagagaaagcacccaaggagcugaaucggucugcaaaccuauaggaggaacagcaauaugaacuaaccaguaaccccagagcuugugucucuagcugcauauguagcagaagauggccucgucggccaucauugggaggagaagcccuuggucuugcaaagauuauaugccccauuacaagggaaugucagggccaggaagcaggagugaaugaauuggggagcaggguggggggaguguauaugggacuuuugggauagcauuugaaauguaaaugaagaaaauaucuaauuaaaaaauuguuuaaaaaaaaaaaaagagugcuugacagagggaacauguuuuucuuuaagaugaguuaccuucuaaauauucaagcugaauggaacccaagacugacuugccaaacuuaugucuuuaccauaguuguuaucaugaagccagccaaugggugugccagucauuuuuguggaaacaugaauggacuuccugugguuugggcauguacaguaggaaaaugcuaccugccuucaaggugcugucacagaauggcugagaaaacggacaaggaaaucagugauaauauucagcauuguaagcaucaacaaaagaauuuaaacaaugguuuugucauuuaucuccaaaauauauauauaugcuacucuaaacaugaaugauauacaaaauuauuaacaaauuauuaauaaauaucaagacauuggccauaaacagaugcuaguuauaaacaucccugccaauaaacagacaucaagacccagugccugucaggugucugugguuuaguagagcaaggagccaaaggagagacuacacgcauaaugugcuaacaaagaaaaaugguaguguaaaugaguguagaggaggaguccuccuaucugggugcaagagcucuggaaacagucucagaagaaagaaacacuacaaaauaaaacuuaaaauauaauuuaucauaaagguaaaacauuguuccaccuagcaaauuggauggacaaaagugcucaggcuucuaaauuauuucuuuaaauuuuaacuuaaaauauuugagcuucuaauguccuuagcaagugcccauuugauaccaaggcauagaaagcuaguuggugcaaaggacauucccaaagucacacagucaauaaaacaccccuggaacuagaacucaauaccaagccaaguucuuuucaugcuguucaaccccacaacugacaucuugguuacuuguguaccugaccuaaccuuuucuuucagccaagcacccaucugucuugcuucccauucaggaacaucuuugaguuuugaauuuuugaugauugguugguaguuuccuuuguugugugggagagugaaaagaggugaaauagagaagccaaugaagaugauguguagauaagauggggaaaguuuauauuaagcgaugauuuuaauugaauaacugacagucugcauuggaucuaagcuuuauccaauuguuugagaagacuucuggccacugaagaguugcaugagacuuugaggugaguuuuggcaugcuaaaucaccauacucagacuccauaaccguucaucauaauccacuugagucuagaauguggacagggcuaggggcagcagaggggaacuuuaccagaguuggaagccagagauccucacaggaggugaucacuugauuuccucaaguaaacuaguccuggccaauauucuacucacugucuaguccaucuggaaaaaaauguaauagaccauuaagaaaaugagagggaucucaccugaggcaauccuccauacucccuuuggccuccaaccacaggcuccaccagcaacucaugaaugagaagagcaagcaagaacaaagucaguccuuggcagguauugaugugcagaggugguguuuacaagccuucucucuacccucucacauggaaaagaaauucucacaguacugaaaaggauauacccaugcaagaucagaugccaaaagguauccuugccaaaucagaagauuaguggcuauuaauuuccauaaguguccucugccuuaaugacugguagauuuuggaggcucgguucugacuaaaaugacgaugggcugcagccauaguggccuauggcuagucauuucuccuugcuaaguccccuuucuucauguguacaacgaauguguuugacauuauaauacaguucccccuuauguucuguagcuagaacaaaagacuaauuauaaaacauaguaugucaaauauucauguaucccuccaucacaucauauauucaacaacuacuuucugagcuucuguaauguccaagucuguuuacuagacacagggagaaagcccuggucacagacccagaggaagcugagggucugaggggaauaguggacauacacauguagaacuacagcaugugaaaguggugccuaugcugacagaacugagcuauguguguggaagcauuuuuguuguuauguauauuuugucuguuucagagcaguuaguuaucauuucuugacauaaaccuacacauaucuaggaggaaagaaucuuaaucgagaaaaugccuccaugagaugggucuauagacaaaucuuugagauauucucuuaauuauugaugugggaagacccauaccacuggaggcagugcuacuccugugugcugggugcaaaaaaaagcagguuacugccuuuggauccugccuuuggauccuuucacugggcuaccuugucuggccucagugggagaggaugccccuaguccugcagugacuugaugugccaggguggguugauaugagagggagaggggaaucccccuucucagaggagaaggggagggggauggagggaggggcugugugggugguacacugagaggagaggggaagcugcaauagggagguaaaaugaauaaagaaagaaaugaaagguagaauaagaaagcaggcuacuaggcacugaugaagacuaagagccuugccugguuauggaagauggccaguucacucucuuuaugccccauuauuaggggcuucacuagcaucacucucacagauucuagggaguuuccacugcaguagguuucaacaucaccacccaaaugcccccaaauuccagucaucuuucccaauacucucccuccaucccuccuauccaccucacccucagccugauccuuccuguucccaucauggccuauucccagucuaccugcaaaaucaauuccauuucuuuuucccagggagauccaugugucuccccuugagcuauucuuguuguuuagccugccugggucugagaauugugguaugauuaucuuuuauuuaaaagcuaauguccacuuaugcaugaauacauaccauauuuuccuuuuugaguuaggguuaccucacucaggauaauauuuucuaguuccauucacuugccuauaaauuucaugaugucauuguuuuuaacagcguaccacauucucuuuauccauucuuggguugagggaaauaucagagggguaucagccagcaacugaugggggcagaugcagaaacccacagccaaacacuagacagagccagaggaacccagcagaagacagagaggaaggauuguaagaaccagagggguaaaaaaggaugccaugagaaaagaaucaacuaaacaggauucauagguacucacaggaacugaaggaacaaacacagaccccguacaagucugagcuagguucucugcauaugccuuaugguugaguagcuugguguucuuguggaacucccaagagugagaguugagggugguuuugacuuguuugucugcacucgggaccccuuuccuccuucuagguugcuugucaagucuugacaugaggguuuguaccuaggcuuacuguaauuuauugggccguguuugguggauagcccuaggaggccugccuguucuuuuauaugaaggaaaauagaggaguggaucgaggagagauaggaggugggggaggggcugggaggaguagaaggagggguaacugugauuggggauuaauaaacgagggaagaauaaaagagaauuaaaaggcaggcugagcaagccauggaaaguaaaccaguaguguucacccauggccucugcuucaaguccuaccucuaagcuucuaccuugaauuucugccuugacuuuccucagugauaagagugugaccugacaauuguaaaacgaaaucaacccuuuauuccauuuagccauuguguuuuauuaaaugaauugggaaguaacuaagauagauaacgucuuauugcauagcccaaaccggccuggaacuugcuauguagaugagcuucuaacucacaaaggcuggcaugcuucugccuccugagugcuagggucaaaggaaugagauaccacaccuggaguggaagcauuuuuaauuaaauaaauauauagggaaauuuccaagugaagcuggaucagaaucagauggcaaaugguggugagagguggaaauaaagggauuaaguuaauuucagcacaaguaaaggcuuaugucuugaggagcacgugaucuacacagaccuaccugcacagaauggaagcucugaaaggaauucaguggccauuagaugaccaugaggaacuccugcauagcaaauagaaguguuaguugcccaagggaauaaacaaccuguggcaagggagaaaauccucacuauuuauucaucuuauaggaauuaauauccaugguauauaaaaauauuuuuuuaaaaauccaaaagagcaaauucauucagcauaugggcaaaagagcuaaauggacaguucccaaaagauuaaauaacuagcaauaaauacaugggaacugcuuaggcuacuucucgaucagggaaacaaacauccaaacugcuagaaggauccaucugaccccagucagaaaagcuguccugaagaaaacaaaguccaaccaacaguuauuggcaagggugucuuuugcugcuaaugggaaugugaauucaauucacccaauaacuaugaaaaucucuguggaggaaguucaauagguugaaacuagggcuauggcaguuagccugaaauaucggagucaguuuacuguggagauucuggaguagccacauugaucauggcaccacucacaauccaucuaccugucaucugcagacgagaggaggaggaggaggaggaagagaaggcacuagauacacccagagaaguuuuauucagccauaaagaaaaauacagcuacgccauuugcagaaaaauaaacagaacuggagaucaccuugcuaagucaaauaagcuaaacucaugcaggaagacaagcacugcacguuucucuuacauaugcaaauuaggagcgagaaacaagcaaauggagcaggacagucagggguauggagggcaaggguaggcaaggcauuagaagacugauuaucacaguauuaugugcacuauggaaacagcacaacaaaugcaaucacucaguauuauuacucuauguaaaguauaaagaguccagggggacagaacagugucuagucugagcaguccuccucacuguaaggcugaaguauagcuagaauuaugauguuucucagcacuuugggagaaaacuuuuuuuguuagugaaagggucucuuguuuguucuuggagguuuugguugguugguucuguuuguuugucuucuagagaagguuucagucuaggcuggcccagacucaugcugacucccaggcuugaaccucucaaaugccaugaucacgacaggaugagccuccauaaccugcugaacauucauuuuacaaguagauugcaguacagcagaggcugaaccuccagccaaggggauagcaugggcuaggccgaggcuccucacauauauguagcagaugugcagcuuggucuucacguggccccccaccuccucacaacuggagcaggggcugucucugaaucuguuucuugucuguggaucccacuccucuagcugggccaccuugucuggccuccgugggagaaaauucaccugcagagagauuugcuaugucaggguggggugacaccuagggccuggcccccuucccagguaaaagggaugggggaaaugggggaaagagcuguagggcaggcacugggaggagagggaggcuggauacugggauguggagugaauaaauaaauuaauggaaaaaaagauagaucucaggugucaugugacacauuucugugaccacugaugguuauagucuuaugugucaggaucaccauccucagggccucccaucugacuucgcuuuccaguaauagguuaagcaguuugugguagcugugaauucaugauugacuauagaacacuaagaauuguuggggaccagggaugucaagucuggaacauucuuagaagcccuauuaaucacacggcuuuuagcagacucucucagcuuaccuuguucagacauaagaaaaugguuacaaauaaauugauuauauauuuauuguauauaaacauagcucauaggacacauggaguaaagacaugucuaacacuuucucugcuaacugagaagagguagccugggucugcuuaggaaagccuagaggcguggaagcauucacuacugguggaaagacaggcuugugccacugaaauauguuuuggcuaacacgcagaaugaaaaaauucccaaagcaaccaacaucugaaucagcccaaaugguuuaaaaguucaaaugagucguuuuacgacaugacuauuuauggcuguuccugaugucugagcggugugugugugugugugugugggggggggggggauagggaacacuuaagcaggcagucuucgaguccuggaaucggugccacccuagggauagccuaauuuugucuugcuuuauucucccagggagauugaaacuaaauguuaugagaaaggcugaaggaugguaucaaucaguaaguggaugguugaaauuuccgauaauaguuguuaauuaaaacaucagaagucucuucuaaauuacagaacaaagagaugcauuuuccacaguccagcaaagcagcugugucuguugucaugggugacaguuuccuacuuaagcaucacucacuguuucuggucaccaaugugucauggagccaugaauucuaagugcuucccaggcacaauuccuugauggcauuaaacugcuucucuaaauugcaggguauaagcacugucccaaacaagcccagaaguaccgugagcugagcuuggccccaggugccuuggggauacuuuaacaugcuaaaugaggacuucaaccuaaauaguguuaccuuuugaaauauauuagugcuucucuaagaaaaaaaaaaaaaagucuucacucagcaccuagguacacugagagcucaggaguacacccugagcuaaguacuacacccuacuuaguagacccuacuaaguagaaagcacuuaguauguggcauaaacaaugucaaaaagugacuccugaggggacauugggaucuggauaaagauuccuccaggcagcugggcaccgcuggguccugcuucagaaaagcucacuuuucuaagcucccaguaugguucccaccugcugagaacuaaucuuggguuaucuccaagcuggccaagagaaaccugaacugccccgggcuugcucaacucuccucgaucuccucuuuccaggaacucagguucagcccucaggcuuucuccgaggugccaccccgcagcugcugcccagagccugagggaacccaggucguguuuccagcuugcucuaguccaggagcagcgccaggauccaguucccucauaucccaguucccaaggcuucuguuucacaauuagaauacucauuuguggagcaaugcaaaaaucacacuucacuaacaacuacucugcgggggcggagggagcugaaauuccuacuuuuuuuuuucuucacuauaaauuguaugcaaaugguccguuagcuggcggcgcgccuggagugagugcgucuuucaugagcuaacccuguuccgcugggagggcugugccuuuaacucaccaacugaaaaaaaaaaaagugggaaaggaugucuggaggcgaggcgucccauuacagaggaaggagcucccuauauaagccugccaaagcuggcugcuccggccacagccugccuacugucacgcgucucucccgcgcgcagacacacacccuagccucuggugggcacagacaguggcugggaagacgcuagggaccgcgcgcuugggaacucguuguggcuuaacccagguacuucuucacggagcuggugcacccagagacuuugcuuuucccgaccuggaaaaggugagucuguugaucccaucacccaggaucuuucuggugugcuccuggcauucccgguacccaguaagauguggguuuguaacuauaaaacuuuuguuuaauuuccaagcccggugugaucagaugcggcccgauuauucugugcuugcccuccugcggucauguauuugguauggaucugucaauagucagaggaacucagggaacuuuugguaaaguuuugucucugccuuucuuuggaggaaaugucuuacuuuaacucuuacccuuuuaccucguugauucucaccuguggauuuuccccuuuuggagcguuagagaaguugcauuuuaaaguggcauucacucacagcacuugggugggaugaguaccacguacccguaguagggagaacacaaccgugcaucuacacagucucagcacuugacaguuuucguuccccucuugucccauuugauccucaguguccacucuggggaaagauaagagcuggauaccagagcuaggagaugaguucugggcacggaugaaaagcccacaggcuguaagaugaaacuggugggcacgucuguggguucuugaagcagggugccauccuccugauucagagaccucagguggggcauguguagaagguuuggaggcaucugaaccccauauugcucccaaaucggccucccuccugacacuuuaucccagaaccccaguaacauauucccuucccuggugaacuuuggaaagagcacagagauuccucuaugccaucguugugacagggggaauaagagguugggguuugacccuagaaguggcuugggcauucccacuagugccacuacaacauaaaugugucaggaaaauauguaacuucuauggaccuuaguuuccacuucucuaaaguggggacagcagcuccccuuauaaugaggagcgaaugaggaacaaaaaagaucaaaucagcaacugggcaaucucugucauggcccaaagcugccaacacccuggacgugaaaagcggggccucuuaacccaguuuuucagugugucugcuuacccccaaagccucugccuucuuaucuugcccaaucugagacagccugcuagccuggcacguaguguuuuacaagcaagggguguguuggcaccauuaggagaaaagguggcagccucgggcuugaugugaaucuggaguucugacuccagaauguccucaggcauuuacaggcugaagugcuuggcuauggagugcuguguggcugguggucuuuggaaucagauucuuugccucagaggaugagccagacugggagcucucuuuaagagugaaugccucuuuuucguguguuuucguggaaucuuuuuuuuucuuuguuuuauagagcuuucccuauaugcaccuuagaaaugaaagcugcuccccaccccacugccuuuccugagaugcaacaaagcucaccagggcuggugagaggcaugcucugucuaaauaagcugauggaaaguucuccuguccuaugaaccaaggcuuucgaagggcaugggggauggggguagugugccuuggccugguacauuccaagaaugugaccacaucuagggaaagaagggggugcagugugugaauauucucuggguuacucaaauggggugagcacgagagagagagagagagagagagagagagagacagagacagagacagagacagagacagagacagagagaaugggugaagccaagcuugguaaucacccacucccucauuuguucaaaacaccuagcuucgcgcucuuggccucucuuuccccugucucaagaggugacaaggcuuccauccaucaguuuugucacucauacaaagagggugaggaguuaccucuccuggggcucugugacauacacaccagaagaguucaauagacagagguguuucuguuuaccuuguuacuagaucacagauacuuucaagauuaauguccuaaacaaauguuugucaaguuuaacaauagaagcaguuauuaauaaauuaugaacaacccuccucccugaguuucugacagauaaaaaugagguugcaugggcuaacaugggguuaaggggugcaaacacacuauucauaccccuggaacauuuuuaccacauugcaaacaaugggacacacagcuccagaucucacagcuaggcagugcuuacucagaucaguguucugaaauccagcagcuaugggaguaaggacaguuccccaaaugaaacaggagacaggaauuuuagaggcuuaagaaagguugguuacuucaaucaaugucaguaaucacuauagccagcauagaauuaaccaguguaugagcuauaggcucuugaugcuucccugggcaucaugguaucaaauggccacagcaggucucuggagcauggguguacuuauaagacagagagacucacagagcagagagauugggucuuggaacucaagugauagggccagaaucuaagcucauaucuuucuuuggaggcugugcuucuuuucaacgugucagcuucuuguauagcccucagagggaaagcacuucccuucugacaaaauaugccccaccaggcagacuguggccacccauaaauacagcaauagccugaucauauaaccagaauagaauuuggaaagggaacucaggcugacagaaugaaaaacauacucccugaauccuauccguucucauguucgcugugaacuaaaaccaccucucaucucucuucccgcaguuucaugaacuuacaaacuggcuuucacaaagcauaaaggcuccuccauacugaggcuguauggguuugaaaaguagaacuugagaaacaaauauuuaguugguucuccauauacaguuccucuaugguagucagacacugacauaaaauagcuaauagucagggaugaagugugacacagugauggggaagacugucuacuuaguuuucuaauacugcaaauuaugaaucaacagcuccauuuaauagauggagaaacugaggcucaaggaagcugaguagcucagcccaggaucuucucacaagagucagaacuggcugcaaacccaaacuuucuaaguaaaacgccaccguuuugucucuugugucacgcugccucuugaugucagacuuggcuacccaagugcagaacugugcacgguguccuuuggggaauggccagaagagcacacaagacuccagcuggcauuggugccucuugauuucacagaggagcccugcagcuaucguuuuucauggugcacaagaaagguuagcuggugguagugcaacccaaugcuuagaaacggaaacauuccaauuucagcugagggacagggugagugagggagaaaggagagagagagagagagacagagacagagacacagagacagagacggagggacagacagagacagacagagacagacagacagacauagacagacagagacagcagagagaaacagagacaggaagauagagacagaaacacaaagagaaagacagagaggaagacagagugagcagaaagagagaaaaaucacacacacacacacgagagagagagagagagagagagagagagagagagagagagagagagagagaaaggggguggcaagguugcagucauguccuuccuagugauuuucauggcaucagcccacacuucccauggcugugcaggugggagcuacaaaagggagaaaagggagacagccauaccugcaucuucuaagguguaggagagcuaaaugugugguuuuaagggggcugcuggggagauaaaaauggggcucucccaggucucuaacagaagucagggaacagcuauagccuccaugccacugauucugccgaagccucaaagaggaagauugugauucaaacaccucucaccacacaaagauagcugggaauccccuugaaucccgucccagaccaguccaaacaccuucaacauguggaaaacauuacaugaaggccccuuuccaagaaggaaaaccccuuaauguauagugagacgagccuccuaaaaaucccaauccuuuacaacacaaagcacacuggugacuuugccuucuaugaaaucugcacacacccuaugacuucuuguggaggagaaaccacugcauaguucucuugauuccgagccuggcgcucagacuuuuguucaguuauacccuuaaaucuaaucaucuuuguucuuucuccuuuucugccauauauacuuccuagagcagugguucucgacuauccucaugcugugauccuuuaauacaguuucucauguugugaugacguccccccccccgaaauaaaauuauuuuuguuccuucauaacuuuaauucucuacgauuaugaauagcaauguaaauuugcuguuuucugauggucuuagacaacuccugugaaagaguccuucaacucccaaagaggucacaagccacauauuaaaaaacacucuccuagacaguaagagccaccuggaguucagugcucucugccauucuugauucuccaccauggaacaaaaucagaaugcccacacucaaagcagguugugaacggaaaauccuuuccauguguccuuucacucuauuugugaguggaaauuuuuaaaagauuauuucauuccaagucaucucagauguuugaaauuuccugaaguucacagguccugaaaugugggcacuuaaacucagauggcuuuggcugguccuuuaaccuuccucaaacagacugccaagagacaaagguguuucauaagcccugaaagcagauagcuugcuucagaaucagccaaaggucaccucuuacccuaaaagaggaaaggugguuucuguuaacaucucuaaagaaucguccaaacuauccuugaugcggggagaugaaggguaacugugaaaguaacugcauuuguuacuuuguccauugucaaggcuuucauuuggguuacaguuugcagggacauaaucuguccuggcagaggaggcaaaauggcaggagcuggggguggcuggucaucccgcauccaugcucagggaacagugauugagagcugguacucagucggcuuucuccuuuguauggaguccagaacccccacugcauggauugaugccacccacacuuagggugaggcuucucacgucaauuaaugcaaucuagaaaaugacuaacagacacguccagagguuuguuucuagacccguauuuuuucaaaucuuaucaaaaaaacaaucaacauuaaccagcccacuaaauguugucaccuacucgaucaauacugugccauuuuaccauuguuauuauuugcaauaucauugccauucuaauguuggggaccuggggugaauuauguauguagccuguugaauaucaugcagguagaugauaggggaaaccuuaacauaaacccgggccaagucccuagaaggagguaaugaccaucaggcuaccugagccaugcuaggcaccaugcuucugcuccuccugucguggggaggucauuguccccagagucugccugccuucugcaggcaucagacccucagaauguaaugucugugaaguucucugcuguucccaauacaacaggguuugacuucuguaggugugcucugcagcucuuucagguuucaggacugagcaaguuucucaugugcaggacggaucuucccaacgugguaugcucaugaaccagugcauuaaugaaacacuccuauguacaucaccuugacaugcucccagaauauauacauaaaggcuuugcaggaagguaaaaugaggccuuuguuacuugcuuaaaguagaagguaaaggcauucagagcuccuucauaggaucaacaccaucgaguuuguuucccucgauaugccacaggauuguaaagaauugacucaagugucuacauaacaaaacagcuuagagaugacaggcuauuugcucgauaaacauuuauauuuuaagauuuguuuugaguuaugcauauggaugugcgucucuguugagguaggugcacagaaggacaguuucucuagggggucagaggagagugucagaucucuggagcuggaguuccaggcgguugugagcauuccuacuuagauccucagaccuggacucauccucgcugaaaggacagcacaagccaucuccacagccucacauuugcauuuuggaaagguaguuagguaaagcaggcaaugcuuaaaugggugaaugaaauaucaaugaggggcuuuagacaagucuguggauucugugcacuggaagagucauauaagacaguuaagguaaccguugcugaguuaaaaaguggaagagaaucaagacuguugggaaaagcauuaguuuuauucaaaauguuaaagcuauaguacuaggucugggaauguuggauaaaaguacaguguucagggaucccgagcagccauacaacaggacgccacugcaugucaccugaaggagcaacagacugagaucaaaagaagauaguccagaacuccauuagaccaucugccagcccuugcaacacacugaguguaagugccaguauaugaaaugguguaucuuuuuaaaaaaagauuuauuuauuuuaugugugagugcacuguagcugucuucagacacaccagaagagggcaucagaucccauuacagaugguugugagccacuaugugguugcugggaauugaacucaggaccucuggaagagcagucagugcucuuaaccacugagccaucucuccagcccugaaauaauaauaucuuaaaaauuuaaaaaaaaauguauacaucuaauacuaaagccaccuauggugauagaagucugguggagguaaccacagaaggagcuccggcacagcaggggagccugcuugcuggggaaagacaggaagccagacagcucccucccgcagugggcaguggcaucauggauagccuuugucauugacaaucauacagaaguagcuggaagcagggaugcuauagaagaacguucuuacagagguugcucucacuagaacuuagaauguuaaugcugaggaggcugauugauggguacccucaaagccaggagcuuacagaucagauucaaaaagaaauccagagguaauucaggagaugccauggagagaagggugagguaaaagucacuuucaaccucauuucaucuaaagccccucucuguuuauguuuugugcacggaacuuucacaugagauagaaaggaagguuucuguggcacaaaaagaagaagaaaggaggagagggaggaggaggaggaggaggaggaggaggaggaggaggagaaggagaagaaaaauguuuguacaaaucacuggccgacuuuaacaucuucauuuuaaagaugcugaaacugagacauggggaagagagauauuuuccuaagaugucaugccagcuggcagcgggucagggcagaaucuuggguauccugacucugcucuuagaauccagggacaacauaaaagucugcaguuaauauauccucuuacaaaagaaaaaugaacugucuuauucucuaaauaguauagcacauguggauugagcuaauaauucuauuaguuacuuacccaccacaaaaacauagucauuaaaaacaucacaggugcugggcaugguggcgcacaccuuuaaucccagcacuugggaggcagaggcaggugaauuucugaguucgaggccagccugguccacagagugaguuccauuacagccagggcuacacagagaaacccugucucaaaaacaacaacaacaacaaacaaaaaauaaaacaucacagguugugucuuauggcuucuauaggucuagaaucaaagcauagcugagcagaguuaggcuggaauuucuaggaucaguugucauuggccuggguuuagaucauaucugaagacuugaguggggaucagccuucuuccaggcuguaccuguugacuggacgccauuucucaggagguucuagacugaagcuugucaguuccaugcugccuuaauaacugcucacauggggcauuucaacaaagccauuuaucucauccaagccaaucacacacacacacacacacacacacacacacacacacagagagagagagagagagagagagagagagagagacagagacagagacagagacagagacagagacagagacagagacagagacagacagacaaagacauucgauaaauggaauuugcuugacaauaaucgcccaaaguaggauuuuaguuuuuuuuaaacucuucuaacuuucuaauuuuuuaacuuucuaauuuuuuuuuucauuuuugcagcacuggccuugaugcccggccagcaagcacucugccaguuuagcuacacuuucuguauucugagaucagguccuagguaauugauguuagucuugaacuuucucuguggccaaguuuucuuggccaacucaaugaccuugaguuuucuccagccuccugcuuccuagggcugggaugacuugcacacaccaccacaccugguuucggaaguaauccauugaacuaauuugaucaugaugauacguguguuauucauuugggggucuagcugugguucugugauacagcacacaaucuacaggauggagcagaguuugaaaugacuaggguucugcaggaucccaggcuggcugguugacucucucucucucucucucucucucucucucucuguguguguguguguguguguguguguguguguguguguguguguguagugggcuggucuuaauguuacagaucuuuuagacgaagaccuucuccaauggucuucaaugaaacagcugagaggacuuuagcuuaugcacguaucuuuauuugggcuggguuuguaugcauuuauucagggugaaccagagcuauauaugggccuuggagagcgggaaggaauuuucaggguaaauaaaaucauuggcuagaguuuaaaguucugugaaugccucauuuguguggagaggcauuccaggaaucucagguacuuauggugaggcuucuuauuggggguggggagaggaaguugaacuuguaggucugccaaggacuacucaccuuucccaagauagaaggugugagaaguuggguuccccaaacaaagucagagaaggggaagcccugcugcuaaugggaguccuccauuuucugcugaguucuguugauuuaaccagucauaguagacauuuacccuaaauuagcaggauuuccucacagacaaggagccaaagaaacaaguuuccuuguuuuacgaucuuucaugugagcugccaucagaaggugcuauccagauuuaagauugaccauccugcuucaaauaaucugaucgagaaaacccucacaggagugcccaguagcuuagauuccagauucagucaaacugaccaucaagauuagccaucacacaaaauauauuuuacugaacguucaagcagugaaaaugaaaaguaccugcuucuuaucacccaucuagguaugauaauuaauuuauaggcuucccagcauauaaauuaagacuaaacuuuagaauuucauuuucuuucuuucuucuauaccauaugcaguaugguguguccucuacugcuguuaugguguguuaggauauccacugcuaugaagagacaccaugaccaaggcaacucuuauaaaggacaauauuuaauugggucuggcuuacagguucagagguucaguccauuauuauugagaugggagaacggcagugucuaggcagacauggcauuggagaagcaccugagaguucuacaucuuguuccaaagggaaccaagggaagacuggucaaucccaccccuuacagugacacauuuccuccaccaaggccacgucuacuccaacagggccacacuuucuaguagugccacucccugggccaagcauauucaaaccaccacauuugguuuaaauauaaaaugcugcugaagguuuguucuuucagugcuuaauucucaacuggagauguuguuccagggacuauagauucuauagucaaagaauuuucaagggcaaggucuggguggcagaauguuacauccaucccugcucccuguuuuuaucucuggcuuugugcuuccuggcuugcaauaugugaguggcuucugacacaugcuucagucaccacaucuucuauauuagucauggcucucaagaaacaagacgaauaggaugaauauauauuaaagaagauuuacuagguuggcuuaccauauuaagauauugucuguaguauaacacugacuguugucauaauggagagccagagaacagguggcuacucugucuacaaggcuagaugccccagaagauccaaugugauguuuaaugucuggaagaauccugaagcaccccuaaucuuuaguccauauugggaagcuaaagaaucugaguccucaugucagugaaagauggcagcaacagagguaauagcggcaacagaguagauacacucaccagugggagaauaaugcaaacagacagaagagaaaucgcuuuccccuuggaucuucucauauacugucaucaaaggaaguucccacacacucugagggagauugcuucccuccuuaauuuuccuaguaaauaaccuuacagaccugccuugaacuucugagcuaauuccauauccauucaagcugacaacaaaaagcaaucaucacaacuccaucccuuguuaaacugauacccaaccacaucuccuuauguuaugcuucaauuccaaaaugguacugccaagcaugcuguaauuaucuguaaaugugcuauaccaccccacccacuacuccccagaauaggugacaaagucuuuugaggagaucuuaguauuuuacugucucacaaauuuaaaauauucucugucaugauggacuacaauucucugaaacagugagccaaaauuaaacuuuuccuucccuaaguugguucuuuuuaggggauuuugaucugaucaaugacaaaguaaguaucacaagucaagcacuucucugccuccccaugcccucuguuagcaaccuccauacucgauucucagugucuuauaaacgagccaauacaagagauuccuacuggggccccaucacaccuuugaucuaaaugacaaguuagaauuauagaggccagaaugucuaugcccaaauauuuccaaguaguuauuuucuacaaagaaaauucgcaucaccuaguuguuauuuaugguuuccuaucguccagaccccuggcccccaagcagacgcugggccucagcuagcaucaugcuuuccacacacagcuuucaugcuuauuuuuuucuuguaaaugucauuuucuauuacauaaaauggcauucucuguuuuauaucuaaaugaucuucuuucuuuaguugucuguucugaugccaccuccuccagguacaacagauacucccauagugugcccuuuugcaccaucccuuauaucaaacuguaauuauuauacaauagacaaacccuucugacacagcaguucucaagaggauauuuguaccugguucaccugaaaaucagcaugauucaaaauuaaucuuaaauaccugauaaagucuuuauuuccaagacucaaaaauccauuucucaugagucuugcuuagaaaaacuagaguuagaaguuauuuauguguuuccagcacuggacaggaaaccauguaggaagcagacuucaaggauuaucuuugcuuucaaggccaguccuaaaaauaacugccaucauuacuugggauuugggaaaagccaguaccaaggacagaggacaucugucaggggauuugagaaugagucagagauggcuguuguaacaagauugaucaaucaccaacuagugggaggaaugaauggucucagggaagagaugaagacaaggaucucuuuguguuuggauauguggaaaaucacaacccauagaaagaaaugaaucgugauuaagaguguggcuucgguaucugagggcucuggguucaaaauauuuuuguuugcuauguaagcuugacuaaauaacugcucuaacuuuaauauguaauauauaacguauaauuuauaauguauaauguaugauauaugauauauaugacacacuuagcaaugccuaucuuagaagaucaugaugguuauuaaauaguauuguguauuacauugcuuccaaaaaacugguaugugacacaaauagugauggucauucauguugaugcugcuuuugagacaguucuugguaauaagaccccacuuggucagcuguucucaaauuguauccuauaaaacagauccuuacugaaagucacuuaaagaggguucuguggcugcuaagucuggaaacacuugacaauaucuuggaaauucaggguucauauagucuuuucagcucuaguuccaaaggcugacaacacaguagcagaaacaauaagguaauauccuagaauucauuauaaaacuauuuuucuucuaugugggcuucuauggcaaaauuuugugugcuggguaguauggaaagaacagaaauccacuugccuggagaauuugaucuuaagaauaaagcaccaauagauuccaugucuuggaaguguccacauacugguucauagauuaagauucacagcugugccuacacagguuggaagagacaaggaggggaggguccauggggcaucacucugaaggacagugaucccauuauagaaagcccuauccacaugaacaguuacuuucuaacaaguaauacuacaauauuguuagguuccaauacaugaguguugggaggauccacaaauauccagaucaugccaugagggaagagaaguuauagaaaggagccagauuaacuccuaaaaccuucagaauggaauaugggacugaggucuuuagacauugguuaggaaucugaauaucccuguuugauuagaaacuaauggaauguuugaugcgaucaaauucagaaucugagaaauucuguccagcucuggugaauccauauccccaaucugaugagaccacugacacccuuauccauaugaaagcugccuuaaaauguguuggaccaugaucuuggaaacgauaccagagcaccaggcuccccagaugcuuaagggaacaguaaauuugcccucacacauuuaagcugacaguaaaaagggcaaacauccuacuugagccaaaacaggcaugcccaggucaggaaaccuagcuggagaggcagagacauguagagugucaucccaauuagcaacucuuucuggcuagggaacccagugagcaaagccagagucuggcagauucuggaacccugucugagccaaagagaacuugccaacauguacccaggagcuaauaaccacuugcaaacagugcaccuuggcuucagugcucuccagagaaaaagugcacgaaguaggagagccagccagagcucaaugaggaaggcagaggucgaauacuuccagaguuacauguggagacuacuuagacagcugcuaggggucugggaagcagaagaugaaggaacuguuucugcacuccuuaucuugucccuuacugagcaguucaacuuguaagguggcacuuuuuuucagaacugaagaaaguguuugaggagccaucccaguguggcacaauaugauugaaaugucccacaugagagucacagugcaagcuccaaaggcugcuucugucucauguucugucucaugacuuaguccuuaugcuucccugugucuuaguuuaacuuccaaacagguagaguaauuugcuccucacuagcguuuuaugucaguaauaaaaucaaugaaaaaccugaagcauaacauuaggcacaagacaaguuuguuuuaaugugugugugugugugugugugugcgugcgcgcgugcgcgcacacacacacacacacacaagcaggcaaacauauuuguggaagucagaggacaauuugacaacuuaggggaguuaguucucucuuuauuucacauuggucucagggauugaucucaaucacguggcuugacaacgggugccuuuauccacugaacuauuccacaggcucacaaaacagauuuauaaacaguaaauaagaaaauguugguuuuauugccaauccagcucuauuugaauauauaacaaaaacuguaauaaucacuauauuccuccaggggucagcaaaaugugauguagaagccuauuuuuguacauuuuuuuguauuagaaaaaagccauguuuguuuucauauuuucuauaacagugccuacuacaauaguaaauuuagauacuuaugaaguugugucuaugcgaccaaaauaccucacagaagcaacauagaggaaaaaggguuuguuugggcucggaauuucagagucuuacuccaggauggcaggggagggcagcucaggacucagccugaggugucagaagcaugcagcccuggcuugcuuaccuggauggcagggagcauaguaaauuagacuggaaagagauuggcucuaaacccacaaugcccaccacccaccuuucuggccuccuucuacccaccuggcccacauucccaaagacuccacagcauccaaauuauucccacagcugaagaccaaguguucaaacugggaacucagauucaaacccuaggagaaagaggugaucugacagcacauguauucucaggucauuuaagaaaauguuaacugacccuuccaaugaguaugccagauuuucaugcaguuuccaguuacugugaccuuggcaagccauauguuauuauacacauaauaagacaaagacagaaaugaaaguuuguuuaauaagucuucccagcacagguagaggcacaaugccaaacucuauacaagaaggaaguguagaagacugauagucacgacugugccccauccucccuuuauuuauuuugcacuuucucacucucuuacucuuuccucuuuccucccccuccaucccucccuccauuaucagcucccuuucccuccccaccuucuucuucucccuuuccuucuccuauggucuuuccuaacccuguucccucagguggaauauucugauuaucccaccauaugcugaaauaaauaacucugcugagaaggaauuuaauucucuuuccuucuuugaagauuugcuuguuuagacauaaaauucugccuccuucugaucacggccacugugauaaaaaauacucggagaaaaacaugaaaggguuuauuuuguucacaacuugggauccauuauuuugggacaguauagcacaaugacgugaagcagcuaguaacuacauuauauucaacaucaaaagaauuggguguugaauuaagggaugcauaucuuguguucaaauuacuuucuuuguucuuauauaguccaggauaccaugccuagggaaugguaccacccaugaugagcaggucuuucugccucaauuaacguaaucaaaacaagcaaacccacaaaccaccucaucuagacaauucauuauugagguuuuucucccccaggugacucaguugugucaaguuaacaaucccaauguaaaauuccaaaagaaaguuugaagugucagggucucugaaauuuucuuauguucugacugauuucuuggcuauacauaguaugaggcccaauuuuccaggacccauugauguuuaaacuccccugucugcuacaucuugcuuuaucauccucucauuuauuaacauucucucuuggccaagcuggaggggagcaggguguucucuuccagcucuagagaccugcuggagauacagacauuaguucacuuggcuucaggcccucuccucaagcccaaaaugguaaauaaaaucgccgugcgcaccccaguuuuccaauuucauucucccucuaugacuccaacaacuucauucacauuaaugaaacugaguguuccccuggcguuuaacuauuacauaaauguuaauuucugagaccaagcaauaaauccuguuucaaaaagaaaaaaaaaacacucaauaggacaaaaggaaccuaaacuuccacagaauaagacagagacaguauccuuuuuuucagauucaaguuguacugacuagauaacuugcugaacugucucaagccugugcuuuugauggcaggaaaauaugaacaguguucucugauugccuaagcuuggaucgugaugaaaaggcauuuguaaucgccaagaaccaaauaaauauacugauuugucucacccuaggcucuaguugcuugagcucuuccauccuggggcuucacccuuuuaugaaagacagguccuggccagguauagcaucauuucuauuguguaaggacugaaaagagagaggaucaaggguuuguccggugccaguacuuacugccccuugugugccaucaaacccaaccugugacguacuucaaacacaaaagaaucaaguaaguuugggaaacacacauaaacgaucuucuuggagguuuccacaaacacauaaaagacccuggaaaaucuugaaauaaaguaagauacguaauuuguuuggcuuaaaauaacauuggcuuuaaaaauagccuucuccaaacaugauuaacuaggaaauaacucuuugcucagcauuaauaccucucaacaugccacagacuacacauuaggaaauagcuuccugcauuuguauggcuaaauuaagccuaauucugaguuuaggcuuaucuuuaucucuauuuucuggcucuuguguaacuucauaaaguuguuuuacacuguuaauagggguuuuuuugggggggagguggcaaacucaagcuuauuuugaaguuaauccuuugaacuuagucaugcaaaccagccuuuggcuucacuaaauugcuggaagaaagcugaggguuaagaaugcugccucuaacugaugagucagaccaccugaauuaaacucuccucuccucuucuagcuaugugaccccaguuuccccauccucagggagaggaaaauaaaggaagaaaugucagggaucuucgagaagaagcaaugaaauaauccauacaaggcacagacaguacagauguuuucaaucaggacugguuauuauuguagcuuuuaggugaucccuuuuugagaaaggaaaaguagacaccaugugucugcaugccuuuucuaggcacacuaguuaauuacuggaguggacucaguuuuccauagugucugguuucuugcuaccaaucuuagagauccauuuuuauuucagaggucagguccuaucaaaguguaucaaggcuggcugaucuucaugccuccuggguuugguaacugccagugucucuaucuggcugcaucuaagagcaaaccucaggccagcagaauuccacucauuugaaugccaagacuguuauuucagaaaagguuuccgaacacucuaguccccaaaugccaaauauuuagcacaugcauucacaguguccugcuccuguguugcucucuaucuauaaccugucccuccugaauaaauagcucuaauucuuuaaccuuggcucaaucguuugagaccuaggaaagagccaacugcauuucuuaaaauucugauggaaauucaaaauagaggaggcuauuguuccaggagaaaugaauucaaauuuguuuuugaaaugauuuucaagaauuucauaggaaucuauaguguugccauuuggucaaacccacuuuuuauuuuuucuuuuaugucuaggcaaggagcagaagagggaaaacuacugcucugcagaaauuuuauuucaaaaauugaaaccagaccaucaggagguagcuuguggucugaauguaucaaugggccuagucauuuuucaucagagcugcucuuagguauacuaaaccacaaauaugaaucucauuauugugucuagauggaaauauuuuauggauuaaaauuuggggacuuaauuugguuagcaaugaaacuucuguucaagaagagggaggaggggagccacaaaauaccauucauccaaacaccugaaaggaaaaaaaaucaauauaauaucuggaucccuuuguauuuaauauuagccauuuugcuuguguuuaaguggaaggcuaaauuugguuugacagaacuauugccaaauugcaacaggucguuacaaccaagaacauucuaaaacuuugguugguuguaucuuagguacaguuuuuaguguuggguauacaccucgauaccacacauaacuugccuuccacauauaacaugaaacccaaaucccuauauagucuauagucuaacuaugcauaacuaaaucaaccuagcauaaguauaaaauagaacugaaacauuucuagacaucaaaaggcaauucaaaagacagaaaggaaaauaacuaacuuccaauaauggauggcauuuuaguuucacugggaggacagauuaagccuguccauucaaguggagcaaaugggcuuucaagacaccaagaccucucuccaauaauaagucagauucugcagcaucucagagguacccaacagcuugcuucacuccacagcagcaccaucagguucugaucaaacagaacagauagacuccccuucagccugcuguuugaaggucagauaggcagagcagcaacugcucucaaaugcuaacuccuuucauugacuuccagugcaaagggcagugaaugaucauggacucagagggacuuggguucacauccuuacuccuuagugacacuucaauuugcacauaugacauaauaauuauaugucucaguuucuuuaucuucaaaaugaagauaaaaaacuuuaucucgcaacuuggaaagaauuugaaaucauguguuuaaaauucuuagcacaagcucuagaaaaauacaagcaaugaaucacucaguaucuucuucacuucuauuaucauuguugguauccuucuccuugaacucucaagaacucuucaaccaguauuugguuccccugggccuuuccuccuucaguaauaccucggugagcuccuuggccaagaguacuacuuccauuccuuaacucuuucacugaggcuggcacugcuacuacucuugugcauguauaaucuccacaugcauuuccauaaugaccucugggaaaaggacacagcucuucacucagucgcuccuccccaguguccuucacacugugaagcccacagugaguaagaagcaauuaucucuggaaagaauuucagcauuccucccccuuucuguugggauagaaccauguaacaugcucuaguuuguaguggcacuugagaguagguugaaaaacaguuacguuuuggacugucuaggagguaguuuuaaguuuuauuacuguagaguucacauuuguuuuggcuacuguuguaucauucauacuuaacuagaggcuugacacacgguagguauuuaauaaggauggauggauggauggauggauggauggauggauaaaagaaaggaggaugaauggaggccagguagaugaauggauggauggauagauggauggauaaauggauggaggucagguagaugaauggauggauugauggauggaugaauggaacaaagacauacagaaucaagaauuguagaaagcucuuagcacaagaguccucucaguuccuuucuggaguacacuucucucuggagaccauuauaauggacucaaguuaagcauuaauggaaacuuuucauauguacuuccuucuauuauuuuuauuuuacuuuugagauuauaauauaauuaugacacuucuuucuuccccuucuuuucuccaggccuucccacauaccccaccucccugcuauccuucaaauccaaggccucuuuuuucacuaauugguauugcaagcauagauauaacauguccaguacuuagcauuauaaacuuacauguauguuucagggcugacauuuuagcacugaacaaccauuucucuggagaggaccaccucuuucauugccagugcauugcuugauuaccuagaguucuuuguguaggguuuaggccucgugggcuuuccauauuaacuuucucaugucuguuguuggcauccuuaguuagcucagauuugguuagccauuguuggugagacuuugugaggauagccguggauauuacuaggaaacacagauuuauaucagacuccucaauucucugauucuuacacucuuuuauccuaucuucuauaacauccccugaaauuuaugugugguugcauuuuacagauauauccauuagggcugagcuccauaacucuacaucuugauugguuaugguuuucuguagugcucuccaucuguugcagagacauauucuuggccuuauuuuuauuauuuuuucuagcuuuacugagguagaauuuaaaagcauugguguaguaguagacagacagauugauucuuaguagacagacagauagaaauguuaccacuuucaagaucauaacuaacauaucuaacaccacacaaaguuacuuuguuuguauaggaugagacuaacaaauaucuucagucuugguaaauuccaaauauacaauguaauauuauagauccauuuuaccauaaugguuuccauauauaaauauauguuaugaugaaugcauauggcuguuugggguaaucuaugcagcauaaguguacaguaggacuuucucagaacugugucauuauuugucugcauguacaaaguauguggguagcacuaauuuaccacuucuggacucagugauccucuccuguugguuguauucccugcucaguuaugauuuugauuuuauaaucugauuucugacugcauacggaaagcacugcgaggcugggccaaguguuuuccauuaagagaacaguuuugaaagacuaaaccacagacagucuguucugaagaaaucgcuggccggguaucauggacaaccaucccaguagcagcucucggccucagaaaagucuuggccaaaguucugaccucccagaaaagagcuccacccaacucauucacucccuuguuccugcuacugaauuagaugaaggcuaagggaauccugggucugcagccacagccuuuucgaucuccuaaggauuucagaaugcccugauaucagacuaacugaaacacugaggacuguaggcucccacagagaaagccacagugggaacuagaaagaugguucaguaggugauggugcuuacagagcaagccugaugacccgaguucagaucccuaggauccauguaaauaaccagauggaaucccaacaguguguaaucccgacauuccuacagcaggaagagaaucagggacagaaucaccuagaaguucauggaccugcuagcaaacugggcucagugcaacagagaagcaaaagagaccuugcuuccaacaagguggaaggugacaauuggcucccagaagcuggccucugcccacucccuguguacacaugcaugcacacagacccacgugcacaauuaaauaaaaccuaaugggaaaaaaggaaggagggagaagagaaagaggaggaaagagaaagaaacaaugagcuuaaggaaaacugaauacguuuggagaaaaggaaggacuucucgacaguaccuuaagaauuuauuuuuggucacaaaguagccuucugcuaaccgccuucuccaaacaagacaaagcaaucaugccuacuagacuuaaggucuaucuucuuuuaaguguuagcuaagaaaguguuuugcauaaauuaucucauuucuucucacaugcagcugguauugauguugucauuauacagauguuagcacagaggccuagacaagcaauauuuuauauccacuuccauagcaacaagguggaauuguguggaauugcugccacccaucguuuuuuaccuaaagauaauuugcaacuugcugugguucauacuaauaagaagaacagagucaagcauauuugucugccucuagagcagguggucccaaacaucacauagucucuucuaggauauuuauucacuuuagcaauuaugauuugucccaguaaauaucuguuucuaugacugccuccuugacugaccugugaccucaguacaaacacagagcuguccaucacuggucucugaaacucucuaccagccuaagucuaucccaagaccuauagcacaucauucaacucaucucuagugggaaaaaaaagaacaaaucguuuuuaagugacaagucucugaggcaaucagcagucccauugauaugcuacuggacaccaaucaagggucuaugauccuaucucaaauagauaaugacuugccgauacuaaaauucagacccucauggcucaggagggucuuuggcuugucaguuuaaguuuuuucugucuauuuuuucacccagaguguccuggauucacucaacugaggggaucagauguccuuggaaaacacaucuacacuuaaggcuauuuccuggcuccuggcucuuccugacacauuccaagaaggaauuuauggcuguugggagggacgaggagugaggaauuuguagaccauuuuagaagccuguguuagcagccccaugcuugacugaccuagcacaauaaaauuuucuccucuguuagccagaagaaaaauuugccguaauaccuuagaguugccaaaaugauguggaaacaaguucauccgcauuugaaaaaguagagucauuguugucuauccgaguccaggauauuccauguauguaccuaagucaaaaagauaaacacauuccaugagcuacuaaucacgaugucacaaguaacuaacacaaagugugucuccagccacauaaggcuauccagauaaaguugauacuugucuaaaacugaaaucauguauugcuuauucuccaacuaugaccagggaaaauauucaaagaaugacuccuuuaucucauaauggucuccagccugugaagagauaacuaaagauaaucuuuaguauaucucaugcuucuuauaggcguugaaguguccaaacuagucaccaacccagucauccauaaagagcaucuacagcagcacuuguucuuuuggguacaugaagacaaccccacaucuccuucucugggauugauauaugguaauacugauacacuccauguuggcuuccucagcuaugaaugaaggagcacaagucaucaguuuccuauaacacauucucuggacucuucauuucuagucacuucccauagauauaagaguccagggcacuggagagaugaaucuaugguuaagagcaucugcugcacuuccagaggaccugggugugauuccuagcaccuacaugguagcucacauccaucuauaacuugaguucuagauuagggguuauuauucacucuucuggccuccacaggcagcaggcaugcaugugguacauagauauacacacaggcagcaggcaugcauaugauauccauaaagauauacauguaggcaaaaacauucacacacaaaauauguuuuuuuaaugauaaucauuuaucuguacuuuuuaucaucuuuguaaauuaacuuguucauccugaaauuauaaaagcacaagcuaucugaacuugacuccccaugucuaaccucuaucucucaaacugcaaucucaacuaauuuccccaaagucuacccuagacauaaaccagccaguuaucugcguguagcagaauauuuuugcauugcuaaugucauuauuucucuccaguucuacacucucuagaguacacauuucuauuucuagcaaauugaucgucacaagguuuaguuucucauacaccagugauuucuacagcuucucugauccagauccaaguugccacugaauuugggacuggauucaacuaaggccaaguucugacuuaaacaaaaagugcuauuggcauagacucuugcuagugugugaucccaagagugcaccacaaugucaugaccuguugauugacuaccuauaaagcaccaaaguucugaagcuccaguacagaccucuaauccauaauucccccuggugugugugugugugugugugugugugugugugugugugugugugugugguguuuguguggguggugguggugccacagaagccagaagucaaccuuaagugucuuuccucaauuuccuccagagccaucaaccuuguuugggggguuuggguuucuuggggguaaggaggugagacugggccuaucccuuggucuggagcuugcagauuccaccuugaagccucggagaucuacaagcauguacuccuaugcccacccuuuuacauagauucaaagaaccaaacucaaguccucaugcuuucaugacaaacacuuuacuaacugagccaucuuugaaauuuuuucugagccuuauuuuauaaacaaggccaggguuguggauugaaugacaaguaucuugcccaaguuauggaaccagaaagggcuuagauguuccacaacacagaagauguggaugaucuuucccaaagcaccacccccaauccucagacaccaugagcugaugugaaagaaaacucucaaaaaugucauuccuccccucuuaacuacacuaugaaauagugucucucuucccacauuauccuuaagucuuccuuuggggucucaaccaacagcucagguguuugucauaaugagagaagaccuuagguaacuuucugucaaguauuuauuucucacauauaagccauuguuuuguaggucuuaaaaugagccagaauuuagcuaggcucucauguuuucacucaguaauuucucaagcaucuuugacagcuccucuacccuaccugaaugucugugcauaugaauggcaucgugacugaugaauaguuagcucagcagucaaaagaacuucaagguacaucuuccuccacauucugucucauuuaauccuccucacuaugucacauccucaauugcuuccuucccacuaagccauacuuugcuauucguuagacaauuccugugauuuucaaagccauaagcaguugacucuauucucagaaaacaaaucaucuacauucuuguuuuucuuuguucucuaaauacugaaaggauuguucuguuuucuuuuuaguuuuguuguuagaagaguccaugccugaucuuauauuuauuucuaccacccacagaacuuugguugcuauagaacauucgguauaaauuuucucgguaccagucaauuuaagaagucacuagaaacuaguggacaacucuuaauuuggguaccugauuccgaagugcauugucacguccuucuaaagcuuagauugcgcaauguucuggauagauaaaucaaggaaaagggaaucugagguacaaagaaaggaugcuacgcaagagccucaugacuagaaagaagcaauguaggaccuaaaaccucauuuuccccugaguacugugcuuccccccucugucuccagugacagagaaacagaagcacuuauuucagcuugaagaauuuauaauuacagucaggagucauugaacaucuccugcagcuacacuucacaggaccagaaaaauucccucagaaggcguggcuuguaaauacugagggacaaggaaugaucucaucgggucagccuucuaacccugccauuggccaggauuuucacuguaaaaagugaaacaagggacaaaguuaaguaacuucccuaagugcucagauccgaagcugcgauacaagccccugccuaccuuuuccuaauguucugccaggucuuucuuuucucuauugucucuuuacauuuucaaagguugagugaguaaugucaaucuuucaaaauugcaagauuuuucuagagaccauuuuauguccucauuaccauauauaguaaagggauaucaagaaaguuucagacccagggggcaagaaggcaaaaaucacucggaauuguggccacuccacaguguauuagggacagugccuaauaacuauuguuuuccuuuauuuauagauccuucuuccaagaagauuggggacauccaacuguauuccuuugaguacaucuaaauaccaaacucuacugggaguucaggcacccuacagaucuagagacaccuagccaguccaaccuccaccaugggggccgugaccuggcuacugccaggcaucuuucuagcuuuguuugcccucacucccgaaggugggguccucaagaaaaucaucaggcacaagcgagagagugggcuaaacaugacccugccagaagagaaucagccagugguguucaaccauaucuacaacaucaaguugcccauggguucccaaugcucaguggaucuggagucagcgaguggggagaaagaccugacccccacgccagaguccagugggagcuuccaggaacauacaguggauggggaaaaccaaauuguauucacacaccgcaucaacaucccccgccgggccuguggcugugcugcagcuccagaugugaaggagcuccugagcaggcuggaggagcuggaguugcugguaucgucucuaagggagcagugcaccauggguacaggcuguugccuccaaccugcagaagguaggcuucccagaaggcaacaggguucguugacccugucucugcaccaaugagaagauggugagcuuaaaggacuccaugagugauuuuuuaaagcugguuuccugggaaacuagacagacaagguagugauuucaaagagagacagagggagagauuuuaaggucaaggaaagguagagauuggagccauuucucuucuguucuuggaagaguugugcuaauaauagcucucacacuaauuuccuagcauuugaaaaaucuguuucauaaagcucuguuucacuuaauuauaucuguuggauuuauuggucugaagagugagcucagcaguuaagagcacuugcucucccagaggauacagauuccaucaccuacaugggcacucaaaacaucuguaauuccacucucagggaucaacacccuuuuagauccucagcguacaccagccauacaugcaaagaacucagaccuaugaaaugauaaaauaaauaaaucuaaauguucuaagauuuauuuauuugauuacuuuuguguauauauguuugugugugaguguguacacauguguggguauucagucaaacacucuuauaaacgugcacuaagggcagaagaaggccuggacauccucuaucacugccucucaauuccucugaggcagcauccuccuugaaccuggggcucacauuuucucggcuaaacuagaaaccagcaagccccagugaugccccugucucuacucacaugcaagaugaagauacaggcauacagucauaggagcugggauuggaacucugcuucucaugauugcacagcaagcacccucaucucucuagucccuacuuuaauuuuaucuuggucaaacauguuuggcucugaaauauaauuuguaguuacccuaaaacaucugagaauaacacagugucccuccucccaaaggcaucucucaaagagacugcuguguagccuuaucaacucacuguacaaauagggaaacaaaggcccagaggggagugagguucuccagguccuguugaguuagguguuaacacagucuuccacaguccuguguucuuacaauggcccauuucugccugggugguacugagccugugagaucaggaggagaguauucuaacgugauggaacaaacacagcgugauaaugggaagguggucaggucagagcugcccacacagccaccuguauguaccagacacaguaacuuucuucugugauccucccaacaacccuuuaagguaaaguuuaacaucucuaugugaaucuaaaaacugagguuuuaaaagucgaccaaauuucacaggaugauucagugauaaaggagaacacgcauagacuuuggaugugcccgggaacuucacucucucuggaggacacucgggacccuugcacaucuauuccaguaauccugcugcuuaggaguucauuauauccccccgccccaccucccagaauuccagaggaauacaaaagcauuaacuucaagucagaaaugaguaucuguuuccaccacuuagaaaauacuaucagaaagggcauugauaaugauguugagaguggaccugacuaccauaugcagggaguacugugggacucuaggcuucuaaggcaauuuucaaaaguuuaucuuuauuaauaaaucaauucauuuucucucugucaacccccuugaggaaacaugugucugagaagaccugguggguuuaaugucaguguggcuuaaaugugacugaauuccaucucauuuuuuccacuaagccucugcucuccacccaguugaugccuaggcaugcagcugaauuugagugagggcuuuuucaugugaguaccaaaagccagcucugauguacccagcuaaauaccuauuaucuucaaugcaggucgucuggacaccaggcccuucugcagcggacggggcaacuucagugcagaaggcugcggcugugucugugaaccaggcuggaaaggccccaacugcucugagccugacugcccugggaacuguaaucucagaggccagugccuugacggccaguguaucugugacgaggguuucacuggggaagacugcagccagcuggccuguccgaacgacugcaaugaccagggcaggugugugaacggggucugugugugcuucgaaggcuaugccggcccugacuguggccuggaagucugcccagugcccugcagcgaggaacacgggauguguguggauggcaggugugugugcaaagauggcuuugcgggugaggacugcaacgagccccuuugccucaacaacugcuacaaucgugggcgguguguggagaacgagugugucugcgacgagggcuucacuggcgaggacugcagugagcucauuugccccaacgacugcuucgaccgcggucgcugcaucaauggcaccugcuacugugaagaagguuucacgggcgaagacugcggugagcucaccugccccaacgacugucagggccguggccagugugaggagggacaguguguuugcaacgagggcuuugcaggagcagacugcagugaaaagcggugucccgccgauugucaccaccguggccgcugccucaacgggcagugugagugugacgauggguucacaggggcugacuguggggaucuccagugucccaauggcugcagugggcauggccguugugucaacgggcagugcgugugugacgagggcuauaccggagaagacuguagccagcggcgaugccccaaugacugucacaaccggggucucugcguacagggcaagugcauaugugaacaaggcuucaagggcuuugacuguagugagaugagcugucccaaugacugccaccaacauggccgcugugugaauggcauguguaucugugaugacgacuacacuggggaagacugcagagaccggcgcuguccccgggacuguagccagcgggggcgcuguguagacggacagugcaucugugaggauggcuucacuggcccugacugugcugagcuuuccugccccagugacugccacggccauggccgcugugugaauggccaaugcaucugccacgagggcuucacuggcaaagacugcaaagagcaaaggugccccagugauugccauggccaaggccgcugugaggacggccaguguaucugccaugagggcuuuacgggccuggacugugggcagcgcuccugucccaaugacugcagcaaccaaggacaaugugugucaggccgcugcaucugcaaugaagguuacacagggauagacugcucugagggugaguaucagcaagcuggccugcaaguggucaugaugguguauauacgcaaugccuaucagagacagauagugggauuuaucaacauaccaauucuuuuaaugugcccuguuaguauauuccuguuaaacacacacucuuuuucugacccuaugagggguuuauacucagucucuuggcacugggcaacuuagaucaaaggcucagagaaguaauacuguuguccaaaagacucaaaugauacuuaaauauuaucuaccucaacuguauugaaucagccauucauuguccuuuacuucguaucaguuuccuuucuuucucuacucuggcuaugaaccaacagcaaacaaaguucuuccauuugaauggaaaugauaauucccugggcucaacagacauuucuauuaaauaagauuaacuuauuaaugcagucaacuaaagaauggucucugguuaccugggaaccagaccugaugcguuuggugcuauccuuauccaaggacugugagcaucucccagaauacuguuuccaggaguuaucauaagcauaggcauauaguauguguucaagaaacauugacuaaaugaguacacagcaaagaacaaaaacaaacaaaaaaaaaaaccacucaugcucaaugaccguuuucucuucauuuuucucgcccucauaucaugauaaagaacaucuuacaaagguaggcaggaacaaauaaauagccccacuguuuaguaugucugaacugugcaagcuuaguaaagacauguggguucuaaaccugauguaggcaaccacagggaaaccucuugcccuuagucacagcuaaggaacaagagagucugguuagacaaacccuauaggacuaagucacaggggccaggcugaggugauaguuuucuauacccugguauaacucugagcuaagacccagaaaguggaaaagugucgaacacaguguugaaagcaacacuauuggccagggacuucaacauaaaggcaaugggcuaauagauuacaaagcuacuucuggugguaaaggucuguaaacccagcuccuacagaggcugaggcaagaagaucaaguucaaugccugccugggucacauucaagauaagccuaggccagguggucaaaauagauuggauggcauucucagagaacuaaugaaaauguuuuuaaaguaaaaagaaauagaggaggagaauuuucuuauagggaaagugacagaccucuuuuaaauacuuuuuagaguauuuuauuuuauuuuauuuuauuuuauuuuauguguguuagaguuuaccuugaauguauguguaugaaccaccuguaccugcagauguuaaaaaagggcaucagagucccuggaacuggaguuacaggugguugugagucauuacuuggauacugggaauggaacccugguccucugcaagaacaaaagugcucuuagccacugcguaaucucucuagccccuugacugacagaacuuguaucuaguacacucaguagagcucuggcugaguccagaagguugggaacaauguguuuuaagaacagacaacuucagaucucuauuguaaauagcagaagagacuuaucaagggaguuaagccuauaggguacuacacgaauacucuugaccuccaauauccuuucuuauuccucucaguguccccucccaaagaccuuauugugacagaaguaacagaggagacuguaaaucuggcaugggacaaugagaugcgggucacugaguaccucauuauguacacacccacccaugcugauggccuagagaugcaguuccgugugccuggggaccagacauccaccaccauucgggagcuggaaccagggguggaguacuucauucguguguucgccaucuuggaaaacaagaggagcaucccugucagugccaggguugccaccugugaguaggcagaggauucuggguagacucaccuagccuuggccaagcuguguagcacuaugcauacuuuaagugcccaauauauacuaacacacuucacccaaugagacagaagcaauuguuaaccccaugugcagaugaggaaacugagaccagacaguucaucaucuccucucaauccccacagcuaacaaagauggaguugggcuuuacccuggaaagucuuaggagauuagaucuuaaucuucuuaucaccauuguguggaguucuccucuauugaccucacugucucagguuauuccuuuaagagucaguacaauuaccuucaugccugagaagcaaacuguggcuagaaacuggcccuuacuugcuaagcaauaacagcauuggccuuuccuuacugagugugcacugcaugccaagagcuaggccagcagacuucacggaauguauuacucaguccuuggugcauaccugagggaagacacaguuaccaccuucucccaggaaaagcaaugaucucagagcuuuguauaaaucuuguccaaagucacaguguuaucggugguggguuagaugcugauccagguccaucugauuccaaauccuauguaugcuuugcuaauucaacaauaugaaaucauaaauaagcagucauaugauuggucauaauaggggcauucacauuuucucacaguagacugcaugccagaaaagccuuuaaguagaccccagauuugguuacuagccucaaagacagcugucugucacagguuuaguguaucccuagcuguguggcuaccuaggaucuugccuuuccuuauauccuauuugugcuguuacuuacagauuugccugcaccugaaggucuaaaauucaagucuaucaaggagacaucuguggaaguagagugggauccucuagacauugcuuucgaaacaugggagaucauuuuccgaaauaugguaaggggcucccuggaggaagucuuugauauaggagauucacaagguggucaaaggccccugcugcuucuuauguuacuugguuuccuuagcuuuggguggaagacugggcacuaucacuuugugugaucauuauguauuuaagugauguuaauuucuucccugcuguuaauaaauagaaaaguauagcauuuagagaugagaguccggacaaacacaaguuaaaucaucgauagguaccaacuugcaaaucucuauuugggauaacagaaacagaaccagucugcccuauacaguauuuccuggcacaucucaaguaugaguagaucuuccuaggacacaaagauuagguaaaucgguuuucugguuauaacccaggcccuguccccaauuaucugggaaagcauugggcaagccaccaacuuaaaacugcugacuuacagaaggaagggcugaguuacggaucucacagggugccguuugacaggaacaggauaagugcaggugucuacaggaggaauaaacaaacucgagaagcagcguucucaucucuguuuucucagcaucuaaccucccaaucugcugggcuacauaggaggguaccuaaugaauaaauuaaacaagaagcagaaacaagugaagcauaaagaugcauggcugucccugccucugaaucuuagcccuuuguuguuuccauccugcagaacaaagaagaugagggagagaucacaaaaagucugaggagaccagagaccuccuaccgccaaacuggccuugcuccuggccaagaguaugaaauaucucugcacauugugaaaaacaacacccgaggccccggcuugaagaaaguaaccacaacccgugaguaccagccaagaccugugauagagcugauugugucucuuugcaacuucuggcuuauagcauacccucugacacagcaucugcaucagugagaauuugcuuaccaauacaaaguccauauggagugccuuaagugauaauucugcagguuugcgauuuggacuugggcucagcugugugaugcuuguccuugacugggaucacuugugcaucuuugugaacugagacuguuuggccuagaaugguuccaguuaagacagucaccuguaauccuugcacucuagaagcugagacaggguauuagcaugagucauggccauccuggacuccauggugacuucuaggaugauauaagcuauggaaggagacacugucacaauaaaacaaaagcaaagcauaaugagauggcaauuuuuuuuuuuuauccuuggagccuccuugucauuggguuagccggggcaugguggcauggcuguugaguagacucaaaauugacauuucugucacugcugucagaggaaauucucaggccaggacacaugggagagacagagaaacagaugcauccccucucugaagcuccucaaagguauauucucaggacuguagaugcagaaaagguaaccauggagacgaucacaagucaucuaccacacgagcucauuuaauccuaacaccaagucucccaugacagaggugagguguauacggaugguacuguguaugaaaacgagugaauacgccuuggggaaguugagucacuuuaacaugauguaggccagacagucaugacucaagcacagcugagaaauggagaaaagaggauccccaaggcuugcugaucaggucaaggcuagccagggacccuggcucaaggaguaaguuggacaguccaaggaaagaugccuaagguugaucucuggccuacagauacauucacacauacauauacacucacauacaaucuuucacacauacacacacacacguacaucaaacacauacucucauacaugcacauauaaacauguauacucacauauaaacacaugcucacauauacacucacacacacugucacagucacacagauacucacaaacacacacaacuuucaaaaauacacauauacucaaacaaagucucauagauaauuucaaauacacacacacacucacacucauacaucuuucacuugacacuaauguccuuagaaauucguggggucaaguaggauuuaauaaacuagagacuucuaugggauauaacugaauuuagaauuguucuaacaguuuuguucuuuuuaaaaaacaagauacaggagaaauggagaaagagauccugcauuggcauuuagaaggaaaaugucucauuuucuucaagagaacagaggugccagcucuuuaagaaaucaacucugguuggcagggggugcugggaaaguuaaaucuguugacacaugacaaaaaggaacaucuugcacuuagaugcuugcacguuuugcauagcucagggccaguacgcaggacugucuccuucauaagcaaauguuuuccaucauccugacaacagcucucugugguagguaggaggcagguacugacaggaaaaaaaucauuagaucaccagcaaggcagagaaaagaucaaggaaaugcuuauccacuguagggaaaguacacugaagaggcaggugacuuuuaccugcccuuuccucuuuaauccaaauuauuuaaggcuuggcugcuuuguauucugcuuauuaagggacaaacccccagccuuugaaguuccagaauauguaaauaccaacguugauggacgugcacuucucuguuccuuuugugaccauuuuugagcauuuuugcagaguuaaaggaccuuaauuuuuuggugcaaaucauguuugaucccuucucccuggcaccucauugagguuuacugugaucauucuagacacaaaaaaaugcugacaagauccaucauccugugaugaugaagggauguggugguccugaguuuaaaucccuuccuugccauucucuuucacuuuggaacauccuacuucuuuaagccuuagauccaacguuuggaaaacuggguucauagcaucuuucucaucaaguugucuuaagcucaaggcacagauggcacaacaccaugggauguggucagcagagaguuaugucagucuucacuauuccgaacacagaguugggguuaucaguaucccuagccauacccuuagcaguguaaguggguuuguggcugacagcucugagaauggaagacagugucacugucuagguaauagcaucauuuucaugauguguuuuguggauucauuaaauacuagcugacacauaaccacuuagacuucaaaaaugaacaacacagcauccucacaaucuaucaaaaacuugguccuuuucccauacucugcaugaauccuggcuacuuccauuuaaaaacacuuaguggauggaugcuaaaagcauagacuaaacugcuuuuaaagauaaaaauaaacuuauacauuaaaugcccaggaugaccugaggaucgugaaggccaaacauccauuuucugaaugaaugaaugaaugaaugaaugacccagucuaaauguaaccuguaaggguccaugauuugcugaagaaugacaccccagacucaaauaguauguaaagcaaagaguguuuuauucugcagaaguacagcaugauggggucucccauuaccaaauuagagagacaaccaagugagcuugcaggcucaauuuaaaacacauuggaguuccagggcagaugagcuuugucuuacgcugucuuuaggcauucuggagacauuaucagggagugaagcuuggccauuuuucuucccucuuaguaauugacuggcuugggcuugccuggacuugcccaguucuuaggccuagucaacucaucugccaauuuggagucugucaugcaaucagccuagccuucucaaccaaacuguaaaaacaucugugacaagacaaugagcagcaguagcuacaaggaagaggauguauguacccuacagggaagaggaucuguguacuguacagggaagaggauguguguacccuacagggaagaggauguauguacccuacagggaagaggauguguguacccuacagagaagaggauguguguacccuacagggaagaggauguguguacccuacagggaagaggauguguguacccuacagggaagaggauguguguacccuacagggaagaggauguguguacccuacagggaagaggauguguguacccuacagggaagaggaugugugcacccuacagggaagaggaucuguguacccuacagggaagaggauauauguaccugguugacaugaaaggcaaagaggaaaaggaaaucucaauagauggaacaaaagaauagccuugucgagaccaggaggugaggaagcaugaaauccagguguauggggcaggaagugaguuuaacaggaugacacaggaauccccagaaugaggacaaaacaggccaugcuugaaacagaaauuacucuugcccugguuccuuucaucaaaaacauuuuuugaggcuggcucgguggcucaguuaggguaagggagcaugucaagccugauaaucugaauccaaucaucaggucccuccugcuaggaaagaaccaaccccagaagacguuuuccucuaaauuccacacgugggcuauacaaagacaugcagcacucacauacagacacacucagaaauacaugcacaaagagagacauguaugcauaagcaacacauauauagacacacucacacacacacacacacacacacacacacacacacacacacacacacagacauacacaacaccagcaaaggaaaggcuuucaucacccaucaccuguaugccagguuccguucucgaugcuuuauaagcuuucucuguuuuacuauuggaaaaaugagggcaaaagcccuccauguagaucuuacagucccuccuuucagcuugccagacagaaacugcagcucccaagggcaaaagaaaguaaggggucauuaugagucaaaugucuacuguggucugcugcaaaguccccacuacucucaaccccuucugccggcauugacccuuugguuccuuuguuggucucaggccuggaugcccccagccauauugaggugaaagaugucacagacaccacagcacugaucaccugguucaagcccuuggcugaaauugauagcauugagcucuccuauggcaucaaggauguaccuggagaccguaccaccaucgaccucacacacgaagacaaccaguacuccaucgggaaccugagaccugacacggaguaugaggugucccucaucucccgcagaguggacauggcaagcaacccugccaaagagaccuucaucacaggugaggaaagggcagaguaccaauucugccccacuccauccaugaguccuccaggcccauauagcacuaaagauggucgagggccuuuucaucucugugcauucauuuuagauaauaauuagugacuuuuucaaagaaagggggauuaaauaaccuuccaaacauacccaggcacaggcaaacaugugugcauaugugugcauguaugugugcaugcaugauagagagagaaaugggggaaagagggagagaaaagagaaaaaggaagggcuggucugauauucuuagacaacauuucugguuaaaguuuaauggcucaguggguaaaggcauuugccugacaucuuagcaaauggcauuacuucaaaggucaauuauauaucccauacacauuuugcaggaguuugguagcaccaggugaucaacacuaaguuauuaaaaauacauugauucaacagaacaguuuucauauccacagucuuauguugggggcuuuguauuauuccucagacacagaaaaugaaaucaauguagccaauugaaauuaccaccuaccaauccucaagaaaggaacugggacugugcucuuuaacuuugugaaucaguuaccaagacaggggcuucgggggaauucugacauuucuguccauuggcgggugccuuuugaaucucugauugaaaugucaaguucuccugcacucaucaaaccuggcauaaugcccaucuucccuuucccuccuaaacaggccuggaugcucccaggaaucuccgccgugucucacagacagacaacagcaucaccuuggaguggaggaacgucaaggcagacaucgacaguuacagaauuaaguaugccccuaucucuggaggugaccaugcugagauagauguuccaaagagccagcaagccacaaccaaaaccacacucacaggugagccgugacccagcggugcugugccacaggggcccucgaaaggacaggagcauaugucccuauuuugcaacccuguagagauuaugaaauaggcccagcuucuguccauuccucucacugucacugcaucaugugaugagcauauacaauucacaguggccagaagccagucuggggucacuuuuaaagucuucugggagccugccuucuacuagugcccaaccuucacauucucuuccaggucuaaggcccggaacugaauaugggauugguguuucugcugucaagggagacaaggagagugauccagcaaccaucaaugcggccacaggugaggugcauggcaaugcuaccguugcugaaguagacugaacaggaaaggcaggacuggugagaaaagucuaucuacaaauucaaagaaugagauuagaggagaaaugggccucuagugccauggagcccagaugucuacauuuaaaagaacgaaagcagaacucauaagcucacuccuaagggaacuacccuagcacaacucucuacagaggaaagagaagaaaggaaaauuggaagcaaauauuauaguaugccuguuuuuaguugucaacuuauucucuuaaaauaagccuguuuaauugguacauaugugaaguuuuuuuccccuuagcuucugagaaaauaccucccuagggcagauaguuaaguaaccauauagauuaacuacagcaucuacuacagcauccugguucccguagcauccuguagugccagccuugggugaagauuaccuagggcuggauuggagacuguuguuuccauccugaaguguuuuucugaaaaaaaucuacuacuagauacaucacagcuuuagauuucaguaguguugcacaguguguauguguguguuucugugugugugucuguguguaaaugugucuguguauaugucucucuguguguauguuugugugucugugugugugucuauaaaccacugcacauuauuuuuaauuuucuccaaaucccaaaagguaguguguaacaucuccugucuauaaaaggugaggucagucaggugacugcccugcaguuacaggucuccucagggcacacucagcuccagaagucccugugccuggcagccuaaagaugucucaucauucucucuccagaaauugaugcacccaaggacuuacgggugucugaaaccacacaagacagucugacguuuuucuggacgacaccccuggccaaguuugaucguuaccgccucaacuacagccuccccacaggccagucgauggaaguccagcugccaaaggaugccaccucccauguccugacagaccuggagccagggcaagaauacacuguucuccucauugcugagaagggcagacacaagagcaagccugcacgugugaaggcauccacggguaagucacccugagcucuaagcccucugcuaacucuggguggcagcuuugagucugccaggcuugucaggaaugugaugcccagaggagaaauaagcuccuuucucuccuccuggagcucucugccacacugaaauggcagcuuccuugucuuucgugaagauugacguuuuucuccugucagucaacugauugaaccaaauugccucauggagaaacgcugacuucuaagcaacacuaacuaggagaauguaaauagggagcugugauugucugucuugucucuuguugcuguuucauuugugcuccaugguauucuagaaauuucccauuucuccccuuuaaucuaaugacagcuuuacuuuucauuguuuuaaagaugcccaggauguuggacgucauuauuugaacaucuuccuaggaguguuuuuauuacagcucucuugcccuccucaggauagcccaggagaacggcacuuggucugaaaccugccacgcugccuucucacuuuauuucuagucaugaagcgucuucuggcucuccuugguugaucccaggucccuuuuaguccuauuagccagcuaaccuaccgacuuucucuccugucacuuuaauucacggacugaacugcagagagaaucuggagauaaaaaugguucuuccuguaugaaaaaugacacauccaauuucagccaugaaguuuucaagaucguuugaguuuucacaagugacagacuuagcuucccauuucauuagcaugcaugcaggcaugcagcuaccucaucuacugcagugugcugcuguuugaagaacgcugugucacaugaccaucauagccugauugacucccacacuccguagagucuuuggagaaaacuagaagcugggacuaucagagaucaggauguucaggggucacuagcgcuggucauguaacacagaagucacccagcugacccucagccaucugaaagagaaugacaaugaggcaauuuagaaaugucaugcagggcccaaguuaucuauuaauaucuucaacugaauacaacagaauuuucaaaugucagucuccuccauuaaauugaucugccaccaggcaguacaagagaaaguaaaauuguuucaaauuguucaggauccagacuccuucacucuuucucuuccaccauuuuuuuaggguuuagcuccgauucucaaaauggggucaguaucacuacauggcugcugcaauccuccaucauccagguucuaggcaguaggacggagauagagucaaagcuccaacccauggcucuuucuagagauuguaucaauaauuucccuguauaucucauuggcuguucuuacauaacacgagaaggcuagucuccuaucagaauagccacuguaaaguccacaggcauuuugaaggaaaacagagaaauuugugagacaaaaggacagucuaagcaaguaagaaaugagugcagugguuaauucugggaacagugcagacugcucccuccugagcuguagggugcugaggcuguccgagaagcuuagaaggaaaaguucaucaaagauagggaaauagaauugaaacgaguuagcuugaauaacuuguauaaucuacccuugcaugaguuuauuauugugugccaaaggcauuaaaaaaagggagaaccagaaauguaagaagaaaaagaacucucuccuuguuccuccucucccucuucuacucuuuccucuuucacaaagcuccagaaggagggaccccacccccaucuccccgcaucuccagaaucaaaggcagauguugcaagauuaacauuucuuaugcugguccuccugcauuuucuccaaggaagccccaugcuccagccacagcaguggcccaaguccagaccuccuccaugagguggcaccauauugaaagcagaguuaaucuucuuacccuucauuccugugcuccauaaaaaaaaccaaacuuguacauaacagcaccuuuccaagggcuggguggccuccagagucuggcuucucuggcuuagcuuccacuauucauguccuuggccaacacaugacuguccccuuguauguuugcugagccugccuccuccaccaggccugugcucccuuuguuauauuccuauucuguccccuguuuuccacuuaucauuugcucuagucucguccauuucaagugcuauucaaaccaagggcauucucugagcaagcugugaaacauacacccccccccagcccaccccugaugcugcuccaaggcuucguggcuacuuaccaacuugagaaugggcaguaaccaccucauugucccugaccuccacccacccgugagcagauuguagggacaaucuccuuugucuacugcugccugcagugccuggaacacauccaaagccagagugagggucaggaacaucugcagagauccagcugcucuggggacagcauugccacauuuuguuuucuccuuuuuguccuucucugcuguagcagcugucuagcacccuucaggagcaaggggcaagguaguuauucccuaggaauucuuuaaguuagugcaauauggaugacaaaaggagagagcaugaaagggggagggagagagggagagacauaaaaggggggggguagaggcaaggccugcucccauccagcacagaaggccuguguguuucagccuuguucucuucugcucccuccuccuaacucucccauacucuucucuccuccuucaguuuuuccuuuucucuuucugcuuuuacauuccuguuagcuaaacucugccuaaagccaaggcuacaaauucacuggaagcaauacaagacauaaaggaggacaauaggcaagagccaagggccaugaggcauauuuucacagcaaccuaagaacccaauugugucucgcaugaauuugggaggcggaaaaaugaaauuuuguuucuaaccacagcuucaagcguuaaacaacacuucgcucugauuuaccauuuuacuuuucuauggaguaaacugaaguggauucaaauaguuauccuuucaauguacauuuauuuauauaauauaugaugaccacaugcuaagaaucagacagaagagggggacauucgggacaaagagaaugagaaagagugcacugcagugggaaagauagaaccaacaugggaagaacguaguucugcuguuacagaggcauggggagucacaggaggacagaccugauccucaucacacaccugaaaaagagaacaaaaggcucugaggagucucaaaagaagagcuaccuagaugaguccuugaggagcaagaggaggcaagguucggggagagugcaguguccuucccagcagggggaauagcaucugagaggcuuagagucaagggauguucuguagucaucaaacaagcuuagcccugcugugugucuaaguagaaggacaguauuucuaaggcuucaggccuucuggaacaggugcaaagcacagauguucagggauuuuagcuuuauucuucauagcuacuaagaaccaccagaaagcuccaaggcagccaagacuucauauuucagguauuucauucucuagaaaaugaguuuggugccauuugaaguauucuuguagucuuccagcuugcauugaauucucugcuugcugugggagaaucacucucucacauacaaagcacaaaaagagcuucgggcucugcauccugccagccuaugguaaccaccaucuauacaauggugggaaucugaagggaugacgacauggccagaaauuccuuccugcagcugcuuggcccaccaugaguucagaugacaggagauuuggaaauucugacuuccugggcccacuggcauuacucagaggguaaauuccaaagcccagcuggaagagaaugacaauagccuuuucacuguggccuguaggaaagcuagggugcacacagacaaugcagugagcccacaaggaugucauucacccugaaaaugaggacucagcacuuauacacagcuuugcaguccacaacugccugcucugucuuuauucagagcaccccuccaucccucuaaguucaucgguggaaguuucaucuuucauauaugugagcauguguuuagggucagcuuagugugaguggugugccaacagcauccaguguagauaugaguacacaccacuuacauaaaggaaagcccuaucuguauccuucuugaucugccugugaaaagaaagggggaaagguggaggacuagagacccaaacaggauggaaucugagucccaauggagacagcauugugggauaguucucucaacugagggaagagguguggggggucaugaagcagaagcaccagagacacaggcaaaaacugaagugcagagaugaaaugagucucagaagagcucagucuaaugugcugucccuccacucuuuguaccugugagcauuuuaacagcuuucccugugaugaucuauaguacccuccucccuccuccgcauuaggcaagucuccuuacuuuaugcagccucaaaucuaagcucuuuucauggggaacaauaugauuaaugucaccauuagagauaaggcuuaagauaaauuccuggaaagaaaagauaguuacuuccucuucaccaugguauaaauucucaaugucagugaaguuucugauuagugguuuuagacagcaggagaaggaaauuuuuuucuguuuuuuuuuuuuuuguuuguuuguuuguuuuauuuucggccugaccaguacuuuccccuuaucccuacucuacugaagugguuuguuaaaaccugaccugaaacucaggaacugaaaaguccaaauuaaacuauaaugaccuucuaggaaaggccaaggcagcacaaagagaaaagaaaccuaagcagaucuaggaggcugcaaaaugcagagcgcuggaaaaagacccaagaccaagcugagguuauuccguguagugaaaaaccacucugccaacuggaaacugaggcauggagccucguuaacagaugagaauagucuucucuaggauacuuguaaacaaguaaacauauuuccaaaaggaaauucaacuguauaaaggcaagauuaaugcuacacuaaccaguuuauugcauuuugugggacagcaucgcugggcauacagugacagcauccugguacuggacucuaugggccuuggccaauggauuugcuggguucuuaaaaggcaagcauuugaugaauaguguaacugaccuugucucuguuauuguuuagaagaagugccuucccuggaaaaucucacugugacugaggccggcugggauggccucagacucaacuggacugcagaugaccuggccuaugaguacuuugucauucagguacaggaagccaacaauguggagacugcucacaacuucacaguaccugguaaccuccgggcugcagacaucccaggccucaagguugccacuucuuauagagucuccaucuaugggguagcccggggcuauagaacaccagugcucucugccgagaccuccacagguacuuucuuccuucauaucuaaagcuucuguuuuucucaacaggaaacugaccaaggauaaucacgcaucauugauuuuagaauggccuuguucagccacaagcugaagugacaugggggucugaugguggauagccaggccaucgcgugacauaguucuaaggccauguuaacauuucacauaaacaacacauugcugcuguauggaauccaucaucugagacaguccaaauaaaccaaggauggugaccccacauuaaggacugauuaugugcuagaguccaaaggaaauuagccacagaaggaauuccugaauucucugaaauugauaaacuaagaaagcaaauauuuccccgcccccuucuucugcucuuuccaagguuuaagauguuacaugaagcauguuuaucuaacaaaugucguguuuucaggggauguaaagccugcccuuggguucaggauuuccuauaucuuacaaugacuuuuaaacgcauucuuuguccuucucuagggacaacucccaaucugggagaggucacuguggccgaggugggcugggaugcccucacgcucaacuggacugcuccagaaggagccuauaagaacuuuuucauucaggugcuagaggcugacacgacccagacuguccagaaccucacagucccaggaggacugaggucaguggaccugccugggcucaaagcagccacccgcuacuacaucacccuucgaggggucacccaggacuucggcacggccccucucucuguugaggucuugacagguauuuuagaccgguucacuccuuuucuccucucccugucucugcuuaagaggaaucccaucucuaaaugagacuuagacccuuccauguuggggaaauccuagugaaucacuucuacuucaauaucuuaucccuuauuugggcagguccugcucuuagucuaguagacagcuccagacaaaauuccaccuacucuucuuuuucaaaagugagaggugacuucucucgaaaaguauguuucaaauuauaauaucuaagaaacuugaaagcaaaauuuguaagugaaaaauaaaaucacucugagcucauuuuacaaauacucaagagcuucccauaaaccuagugguauaucaagaauggaaguuuugagcuccuccaaaaacuaccuucuauucccaaaggcugaaagaaagccuuggcuuuaauucuaacaauuggagugugcucaguacugcaguaaaucacacaucuguagucaauacaaaccaaagagcucaucucaacuuuagucaaaccccaucucaccugaaccccagagagcaguucccuuuauaguaacgucaucccuguguauucucaugcagagaagguuccaagucugggaaauuucacagugacuggacugagaugggauguucucaaacuggacuggaacauaccagacagaacuuaugaccaguuuaucacuugaauccaguagaauagccaggcagaaugggcuggccuuauuauuccuggucgccuguguuccuuugaagucccaggccucagggcugguacucccuacacagucacccugcacugcaaaguaaggggccuccauacuaaugcaccugcuguagaguucaucacagguacaugaccauucuggacuggauuuuuauauaugccagucuggcuguucccagaauagcaaaacucccucauagguaggucuugccugaauaugguuugcaggcaacaugaaacugugacuuagcaggucuggauuagaauucuguaguacuggcuggauguuuuccuuugcaucucugagccuuuuuuucuugccauugaaucaaaaaugauacccugcuuuaguauccuuccaugagcaauggauggacuaagaaaugaaagggcuugacaaaauguucaucaucuagccaguguugaacagcuaagugaguaguuguauuauucagggucuucuagagaaacaaauuauagaaugaauauauaugagauuuauuacggaauacauaugggauuuauuaugaauauaaauauugaauuuauuaaaauggcuuacaaacuguagucuagcuaauccaaaaauggcugucuaccaacagaaaguccaagaauacaacaauuauucagucaugagacugggugucucaccuguucuuuaguaugcacugcaauccugaauacacaggcccucaugccagaaaaagaauggacucaccagcaagagugagaguagacagacagagagggagccucauucuucuguguguuuuguaaaggcugccaguuucauagagguuaccagcagaagguguggcccaguuaaaaagugcuucuuccuaccucaaaaaaaaaaaaaaaaaaaaaaaaaaaaaaaaaaaaaaagcuggauuaaagauauaucuuccugucucaagagagcuggauuacaagugggucuucccacuucaaaugauuucaugaagaaaaaaaucccgacagguguguccagcugguuagguuuuaguucauuccaaauguagucaaguugacaaucaagaaucgccuucacaguugucaacccaaccaugggaagacaaagcacaggaaguggguauuuuuuuggugcaggagagcagaacuuuucagagaaaucuuuucaauacugcccucagagacauuaaguaauacccaauuccgagucggaucccuucagaucuggaaacugaucuagucaucuuaugccgaagucaucuaagcccauuucugaagugcacuuaaaguaagaaccuuucuaagaaaagaugguauguuuaaguuccauguuuuccauuuaagcugaagagaaaaacaaauucaucucaguccuuggaaugccccuugaaauaugcuguuccaucuaucacacagagcuuuaugcuauuccaaggaggauggaaugaaugguaaaauuuguggugauaaaguuuugaugcuguaccccucuccauuugccuuguauccuuguauuuugauaaugccaucaaauuaccuaauucaaaccaucaauuuuccuacuuguuuauauauauauaaaguaaacuuguccauugcugugauguacacacauaccagauauaaggaagaugauuauguucauuuaccuaagucagccagguuaucauguugccuuauuccuggacuggguugagauaaacaaaggucgucugggaugucugcucuaggucagggaugcugaugagcuacguguacagucugcaagcccugcugcagcugccuagcuccuuuaguaaauggaauguucuggugaagucuuucgugcaguagauaaacaguucucagcaagugcacuucuguccccagaccucucagaaaacccugggucaguguugggacaucuuccccaaaggauccugggacacuuaggaacaagaauuauacacuucuuaaaaaaaaaggcuaagaucucuaacuucuaauucauggccacuucugccuuaggaagauggauaaggguauacuucaguuuguaaagggcuugccucucauccuugaggaccaggguuugauccucagauccucauaaggguauagaaguauaaauacuuagaaucucaacugagaaaaugggggcaagaggauuauauugaugauuucuggagagccaaucuaguugaaaugguguguuccagauucagucaaagacccugccugaaacuaaaguuaggagugauugaggaagacauuugaugccaaccucuggccuccugcacacaacugcauacauauaaacacucucucucucucucucucucucucucucucucccucucucucucugucucucucucucucucauacacacacacacacacacacacacacacacacacacaaauuagagcugagacuguacugaaucccaaacagugaauuuuuccauaccccaaaguuagacuuucuuaaucagcaauaacugaagaucguucuuacacaguuaaaaagaacaacuaacagugggcccugcuuugcacauguacuaagcaauacagacucacucuuaauuaaaaguaagcaagcugacuucacacagccuugcuuugugaugcagccaugcuucaugccaaggguuaagacagugggagagugcaagccaagccaggaaucuauuacguaacaucauguccuugaaaguugcagaaaaagcucagagauaaaccagaccaccugucaaaacuugggaacacgaguucuucagaagcccaaauacagagcagguagccagccacaagaugucccuucaccucaaguaauaaaaugaggcauggcuucgcauaugacuaagauauuccaaaacacaucaacaggcucuauguuuuauguugccauuuaucagacaguuucugugccuuguguaugacaugaagaugcuaauaaauaucagguaaucacagaacccaaugagaugguacugucacuucuacuuaaaacugaggcucagagagaaagccagacucccaagaugauacagcuugccaggucuguggaccuccaacuccugugcuuugacuacuccuacuuccuuaccccucuacaaucccacauuguccuggugccucuagccacugccugugcauucccagagauuuccaugcuucggccuuucaaggaggaaugaugcaaaguuuccuuuucugccuguuucaacucuucuccaaaaccauaaccagaguagcaaaaaucugaauacagaaauacccggagaucaggagcuacagaaacaaaacacucuuucucuccccuucugcuuuucuggaguaggguuguggggcauucggcugccuugcuugguuugcagcacuaacagcaaauucucugccuucuucagaggaucucccucagcugggaggcuugucugugacugaggucagcugggacggccucacacucaacuggaccacagaugaccuggccuauaagcacuuugucguucaggugcaggaggccaacaauguggaggccgcucagaaccucacgguacccggcagccucagagcuguggacaucccaggccucaaggccgacaccccuuauagagucuccaucuacggggucauccagggcuauagaacaccgaugcucucuacugacgucuccacagguaucaucuccacugcccaugcuuaggguucucucuugcgcucgcucuugcgcucucucucucucucucucucucucuuucucucucucucucucuucacucccccuucucucuccccacuccucucucucucucucugagauggcaagggaacuagcuuuucuuccuggcuaauuccuuucuacgcaugacgcaugcucagagcccuuucggugagcuguuccaucauuccaaugccuucgccacagcagugacgagccauguaagauacucacacuucuggccuccgacauccacuuucuugauucaccuagucaguaccacaauggcaccuuugcacggcggccucuguuuggagaaccagccuguuugguuuuaacuuccaucuguaguccuggcagagaaucaaaagcccacccuccccacaugugaguuugauggagcacagaccauuuauuuuagagacucuuuugcuguuugagcauuauuucaaaauuucucguggagauguguccuacagugcuuacacuuacacagugauucuuugaaaugaagugagcacaacaggagaacugaauuacccuccaguaggcaaaauucucucagcugcagagucauugcuagaacaucaaacuaucaagcuauccgucaaagagagaaaacauacaauucugaauggauaauauaccaaaguuacuguuguucuguagcaggacacucaguagcucucagagcaagaaguauuucaggcuauaaacggaacagaguugcuacccccuuuuugcucugugaaucaagaguuauuucccgaagcaagcucccaauuccuacaccagggaugcguucugguuuacucguuacacuguuacaguuauaaagcuuucaaugggacucuucccaagugaacggccuuuccuaacccuguuuucuguggcucgucuuuauggugugcccugaugaguucuuucucaugaaaaugccucccuuuuuuuauacagucacugugucucauagcaaaccauuacaucuuuguugauucaaaaggauaacucugugauuuugccucaguuguuacagaaacugucacugaugcauacauaaaacguaagcaaccccaggguggacagugaccucaggcugaccagagauuacaguugaggaucugcugacuuuucuccaggguucuugucugacauccacaaacuauucugucccagaaggcagagcaaucaaucacccgccacuucugaucuuuccugcagaucucgugguuuggaugccaucuguauucuuuuuuaugguagcaacauucuugucucugaggaguuggcccacggaggggaagggcuauaauuaaucugugaaucugggauuaagggucuuucuccucgcuacauagauuguacuggcuucacaaaugccucccaugugcacacacugcuugcuauaucaccacuucucaggaaaguaaaagcucuggcaggacaucuccccagaaaaauauuauuucuuagcuaaaaaggguugucugaacgguuuggcugagcugucuuggcugccaauacaggaccaaccuucuuggccuacauagacauaaguaaaagagaacaugcuauuuuaacagaugaugagaacagcuggcucucccuuaucuaaaguauggaaaaaaauaaucaagaguuacccugagaggugggaggaucuuuucaagugacaaaaucagaagccuccaggucccacucagggaggcccaugcugucagcauuauuuagcacucauuuagauagauaggcauucucucaaagcuaaugcaggaauccacauaaucuuggucccugagccugaaagcugucagcccucauaucuuuugacugauugccaauggcccugaggcagggcucucagagacagauccagcuaagaugaagccaauuccacugagacuagccagcccgucuucugugcugagguaucuugccaggccugaucaucaguggcaaaugcaggggagaaaagucuaacagcuauccccuccuuugcucagcuuccucuuaacaaaaccaguuucuccuucccuggcacugauuaguaguggcagcaucacuuugccuugcuauaacccugaacuaucagaccuuacuccccgggcaugauucuauuaaccaccuccaccuugaaacacagccaaauaacuaaaucauuugauuuuuucucucucucuccuucccucucaucuuucagccagagaaccugaaauuggaaacuuaaauguuucugauguaacuccuaagagcuucaaucucuccuggacagcuaccgacgggaucuucgacauguuuacuauugaaauuauugauucuaauagguugcugcaaacagcagaacauaauauaucuggugcugaacggacugcccacaucucagggcuuccaccuaguacugauuucauugucuaccucucuggaauugcucccagcauccguaccaaaaccaucaguaccacggcuaccacagguacaugagcguucucuaguuucugacgcuuucucuccacagucucucucagcaggaugaagccacuugauuucauuggccaaugagguauaaaccauugaauaucaacuuuccuagguugcugggcugcaucauugucuaacaaaauuuucuucugacagccaccuaaaugguacauuugcaugaauccauaucucugauuaucauaagcagaccauucuaaguaucauaugaaauuuuguccagguggccacaaauaaggaccucccuccuuugguaacuuuaaaaucaucaugauaauuguccuaggcuugcaaagaugucucuucuaaucaaauuuacguuucuuuuuuuuugauuauccuaauaucugucucucuguaaagucuugaauauccucauacccaaauauccuagugauuuaagauaauugucaacggugcccuguuuugcuuuuuuuuuuuuuucuccagcugggaaaauggcaagaaagagcaaugauaguuaacucaucagcuaagcaagagguacccacgucauccauauuaccucaaccugaaagccagcucaggaaaagauguccccugucuagaaugcugagagacacauagcaaaaagaugauaauaguccuucucagauaagaaaccuggguccaaagggagcaaacuguucuugcucugcauaugcaguccuguggcauguguucugugccagaugauuucuuuagugccuugaggaagacuccagagaggagagcauugcccacucaagcaacauucuuagcacauuuggggcaauaucuucacuuuacagauaaauuaacaugguccagacuagaaaaaaaauguaaggaaugcaguuuuuccuuauaguucacaaaagaagguccauauucuagggaacacaagaaaaggauugauauuauagcaucaaaauuaccuucugcuuagaucaccaaugguugauggagaccuaauuuauaugcuguuuuagacuguuaucaggguaguccuggaaaaaaaggagcuagggauacuugguuccuagucuauucauguuaaaguauaguaacacagaggggacaaaaguaaguugaccauguguacuuggguugaauugguuuucaacaaagaauaauuucuugccugaaaggcagagucuaaaaccuuauggacuuagucuucuguguuuuaaauuuuuucucuaauggugaauuugaugauuauacuuuuauauguaaucuuauugcugucauagacagcucuccucuuagccacaucucugccucaaauaugaccucaggagcuugccuuaaauagcuuucuuauagaaguuaguugguuugauugucaccaaacagugguauacucuaucaucagucaaccugaaacucugccaucuccagccucaaacaaggcaucuucuaauuacagcacuuagcugcccagacugauaggcagauagcguccucagacccugaugguccaugcagucacaaauacuacccauuagagguucuucggucuccauugagcucccuuugagcaacauuuuaaaaaucagccacugcuccuuuuucauccucuuacuucuaccagauccuuuuuaauuuaauguaggcaucuaaucaaagcuuuaaagcuuuaaaguacacuccaugccaaauaagggaccuucauagucuguuucucccauauaccccuugcaaucuggaguugcucugugaugaguuaauaugucuugcuuuuguuugaaguccuaaaucaucuuuuccucuucucuuuaacaauauccccucacagaacccauucucaccugucuguaguccuucuaaucaaagcuugccugugucccauucaaaggaaugucuacaugcuguucaaagucaaacaugaucuauagucucuuuucauuugccuggauuuuauauauugauugcuacccuugggaugcuaagaaagaacccuaaauugcaagcaauaagucucaugagaaaacccaguggugcccaucuuguucuugagauuuucguuuucuggauuccugacagauaggcauccugauagaugucucuuuugacaucuacucuguugagcaugcacugucaucugcuguugucuguuccaaagcacuagaacucucuucccauccaucaucuugucaaaguugcaaugcauguggugaauacucagagcauuaaaucuuuaaauaugucuaucuuucuuggaaguagacagcaugucaaggaaguguucguaagggaagugauaggagaaaaaugucccuugccugcauggaacacugaccaaauccuaacuagcauucuauuucuggguuuugucuuauaucucacaauucaccaugguugcauccucugagaguucacugaagguaaugcuaaccucuggaaccaaggccucccucccuccaucugcaugaugaauguguuagcacugccagacucccuacuguagcaugagaagaauuauagacuguaucuuuaauucaagagauagcuucuaaagcagaagacagugaagagcugaguuccaucuggaggacuuuauccuuugugugguuguaaaaacacugccaaagugguagcaaaacuacagcuuuaucagcaccucagaaugacaagacagaaaaggcaugccagcgcuaugacuguaagcuguuucugagccagauuggugggauccuuagagacuuuagagcauccaugccauggaguuuuguaguuaaauauugcucaaaugagccuauucuuaucucuaaauauuggagcugagacaaaacaacucccagguuggaaaaauacuuugccucuuuccaacucuaaauccuaucaauagcucaguccucuagggcuacugauucucuuuagaaucaaccugguuugacauacuucacauuuguauccuuuacuaaaugacuaggaguauggaccuacguacaucucaguugauacuagcuaugaaagccuauuauguuaaaugaguuucucauauuacuauuuaagaaacaagacuauuuuuuuuuugauuuuccgagauaggguuucucuguauagcccuggcuguccuggaacucauuuuguagaccaggcuggccucgaacucagaaauccaccugccccugccuccugagugcugaacaaaacauuuuuuuaccucaacagaauuuucucuuuacaaagguucuauuaagcaaacucccuaaucaaggaauuugauguuuaacuucaaguuuuccuacaucuuacauaucuacuagacauuuuuaauauaauccaucuucacuuguauagcauuuggggugagguauagauuuuccuauuaugcaggcauuuaaguuuccaauguccuugaagaaauuucacauagaugcagaugcuagccuuuaauuugugcauccauauagaucaaaugaacacuaagaaaacccuccagaagcacuuucuaaagacuacucagugggauaccaucucacugaggcauuuagagacauuccuaagauaugggauccauagccuagcaauguuggagucaacaagacugcauagauuuaguuauagaacaagcuuuucaaagccuuugaagggauaugugcucugugaaucuuauugguaaaagaaaaugguugcuguuuaugauggaugcuucaacaugaagcugucuuuaccugggacaucuugaccucagagauuuuggcaaauguagucacaauauauuuuauucguccuaucuguacuucugauggcuggcuaacuuaccuuuacaaauggcuccaaauguguuuacacuuuaaaagaacacaaauaaaugacugcagaaaaaucaguaacuucuuugucauauaguaaauguaggcauagauacugccugacauucaauuuuuucugcaaguauuugguuaaauacagacauuccucuuuuucucucuuucucucuuucuguuucugcccauguucuuucccuucagagccagaaccauaguugggcaugcuaaucuuuagcaauauuacuccugacagcuucaauaugucauggaccacacaagcugggcuuuuugcaaagauuguuaucacugugagcgauacucauucacuucaugagucucagcaacucacagucccaggagaugcgcagcaagcucacaucacaggcuugguagagaacacugccuaugaugucagugugacagggaccaccugggcuggugaccccagaggaccccuccccucacaccccucacugucuuugucauuacagguauucaaagguucucucugucaguuuaggaaucuggaaaaaggagauaggcacucuaaagaaaacuccaaucccaaacauagucuugacuccaaauauaaaggccuuugguuuuaaccuauaggaaaugaauauauauguauucaugucauauauaugucauauauacauauauauucauuaggauacauaugguacaaagugauauuuuaacauauguauuuauugaagaaucaccaaaucagaucaaauuaauuuaucaaucaugucaccuaccuuuugugauaauacuuaaaaucuaaucuuucggcuguuuggaacaucggcuacuauuaguuauuauuaacugaggcaacuauucugcgccuugguuagcuuauucugcaccucacugaagcguauuccuacuggccaguugaacuuugugccucuugaccaauggcaagcggccaaccccacuucuggugaccaguauucuucuuucuacuccuaucaguucaauuugucaagauucuccauaaaagggagauggugaaaugguuucucuuccucuucuuggcuuauuucacuuaauguucuccaggcuuacuugugacaucaagaaugauagaauucccuucuuuuauggcuauauaguauucuucuacauguacucagcaaauguuguuacuaauguagccauugagggaaacggauugcuaugcaauguuauuucuaauagcagagaggccaaauguaaauuucuagccacuaaaagcaauggcacuccugaaaggaggaggacccuuacagacccucuuggaagcucuuuagacauguauagagcuucgaguaucuuuuggccuguuuucuagaaugcuuaauccaugcagagagucugaagaaagugaaauuuaaauuagcgaugaucuagagcaggaauuauguccauaaauugagguauguacgguguaaagugccuaguguccuagaggguccccaaauccuauaauuugcaauuuaaaaaaaaaaaaaacaacccaaagccaaacaaaaaaacaaaacaaaaaccuuacucuuaaaacagucaagcacagaaacggacauguucaaccuaggaagauagauacaugcuaaacuuuauacacuuauuaaauuugagcugugauguuucuauggaucauauaaagagauacugccuauuuucuuuccuaaucuuaccuuaagucgaugguaaaggcugugcaugguuucauaaaaguaaaucucuagcuugacaaaccucuaaaaaaugcuuagaaauucucuucuacuaaacucucaggagauagacguagucaugacccuuaaacuaagcuagucccucccagagucuaaauuacuauaaaugagcuguguuaauaaguacagcuaacuaauugugguagcugagaucaaaucugguugauuucuaaaccuaucccacaucaucuuaccuacacauagcccuggcaaauuuguuuggagccugauguccuuauguuagggaagagggcacucacuggugcugcuggccaucuacauuaggaaucuagcagacacagugaaaaguaaccgccuagccuccacuggauccucuacuaguguuauguccuccuguugcuucccaacaguauaaggagagugggcuucuuaaaagucaauugggguguaggucaaaguuaaguccacaugucuggcaugaguaagaccuuagauuuguuccccauccacaagcccaagggaaacaauggaaacaugccucacaacuuacucuuagaacccuggguauguuuuagucuaagauuuuaaauauuuuuuuccuuucaauuaucaaauguaaauauaagcuggguuuuuuuuuuaaguacagcagaaagaauggggugagaggaagacucuuucuacccugagcacccagagcucaucaggcccuuacaugucaccuucugaaggaccucccacaagucagagagaagccagggaagcugaaagagcagcccucaggagggaaacagagauccaguuacagaauuguuucugcuaaucccuggugugaaaagacucuacauuuugaaagaggcauaccaaagaagaaaugaaaaugaauaggaaagacugugggaggaaaaaaacaagcccuugauugacuaauuagccugaaaguaccuguuuucucuggaauucacugcuuuaauagcauggaguuaacagaggccagcuaucaaagaagggcaccacuucucuaaacaaaaccaacauuugagaaccuuguuuuacaaaucaagacuguuugcaugguaaaaaaaaaauuucauauuugcuuugauagaguuacagcucuugggaaaucuuaugagaaaaauaaacucuaaaaauaaacauuaacuguuacaaaaucagcacaggaaguccaagccacaacaaagucuaauucucuacuuauggaugcauucacuuagccauccaggugccaagaacuucuuuuuaaacauugucuuuauauccuagggaaauuugaccauaagcauuaguacaaggucauuuaucacuuugaaaauucucaguuagaugcaacaacaugagcgagugagcaagggaaggggagaagagaagagaagagaagagaagagaagagaagagaagagaagagaagagaagagaagagaagagaagagaagagagagaagagaagagaggcucuaaauuacauguugcuaaagcagacuugggcaugggauuuucacccuucuccccuaagugcugaaugaguaugcaucggucuucucucucuuuucuauuagcgcuguguccccacucugagugugucagagcacuugauagcauuuacuaauuuuagcauuguguuaggaugugcaaagaauaccaagcuugcagcaagaaggccuuggaaaagucagagacuuucucucccaguugauguccuggaggccagcagacagauagcaacaccuaccuuacagcaucguuguguuagacuggaucaacauucuguagccuccucuacugggacuuguuuuggccaccauaaggucacuuuuuggaaagcucaaguaugugaaaagaucccuccacaacuagggaauaagugggcugggacacagauagacaaaacauaaaaccaagauaacaaaauauguucuugcuuucuaacuuaaccuagaaaaaccaaacaacuuaagaauugccaaacuuagaauuccuuccugguuuaagaacauaaaucguuaauuuggauaaguaacaacacaacaaaucuuauuacuccuguuauccaaguuuaugaacucaauaguuggcccaaauaauuguauucaaaauaugaaccagauuaagauaugaaauauaccagaaaaguaugcuugcaacaaccaauuuuuuuuaaaaaucugauuuguuucaaaacaagaaacagcaagaaguagauuaagguuccaaagugacacaagguguccuauuuguauagugagauauggauggcccaaguuaggcucagcuagaggccuugcucuaucauaccuugcuaaggugagacuugggcuaaaucaguuaaucauuuagaaacuuuucuuuugaccuaugauugggaaugauaguuacuguacagucuuguuaagaaauuuacucuauguaacaauaucaggcacccaagacauuauuacuaaauauuccuuuucugagcauuuaacucaugggaugcuugacucagaaucuaucaguguucuugguauuugagcauuuacucagaaucuaucaguguucuugguauuugagcauuuuaacucaugggaugcuugacucagaaucuaucaguguucuuaguauuugagcauuuaacuuauggggugauugucagggaaucuaucaguguucuuggagucaggagcauugaacucacaggaugguugacugggaaucuaucuguguucuuggggcugcacgcugccuuagucaaaucagugcugcuaaccugagucauuuucacuccucccuucuuucagaggccuugccccuucuggaaaauuuaaccauuuccgacacuaaucccuacggguucacaguuuccuggacggcaucggagaaugccuuugacagcuuucuaguaacggugguggauucugggaagcugcuggacccccaggaauucacacuuucaggaacccagaggaagcuggagcuuagaggccucauaacuggcauuggcuaugagguccuggucucuggcuucacucaagggcaccaaacaaagcccuugagggcugagaccauuacagguauuucaauucaagagagccaucugcuccucuuccuggucccuuuuccuguguagucugucuucggaucccugugguuucuaacauugucuguauucuccacuuaauccacacacguaccuuguucucucauguccuccacauuuucccuuuuuucagaaucuauugagugcucacacacaccccauccuagaaaggagaagauggaaacgugucucuuuaaugucccaaacccuuuaguccacgucuugccuguagcucucacgugcucacuacagucaccuucguuuguguucauccuggcugguugccagcuacauuucagcuuucucaaaagaaauaugccaaugaguauauuuugaaaaaguauuuuaaaaucuuuacuauuucagagucucaaccugugaucuuaaccaacuuacccaguggucuuaugauugggaacugaaugaaacuuacuauacaggccuuuaaaaaaaaaaaaaaacaacuaauaccagagagauucuucaacccagacuaaauccauaauguucucaagacuaauacuuccuauagaaauaucacauuaauaauuuuaacagucagaaaacuguguuucccaaaguauuucuagagaaaacaagcgcugauggcuguuuaaagaucucauuugauaacauuucauguucaguuaaauuuggaacuaggaucuuugaccacacaggcuuuucagaaucucuuauuaugcagagggcaguaguucccaaacuuguuugacaaggaaugcuuuguaaaggauggagccauacaacaggaagaguuugcuuugagcacacacacuuugggaaacucagcuucaaauuuauuuugacacugaguuuugucuaguuaccaaaaugaaacucuggaguacaaaguauauauaaugauaucucaagagguucuaagccucauccuaccaucuaaaugguaaacuagcaaggaaauaaaauuaaacaggauauacuaggagcccucuucuggauagcagcuccggagaacaaagccaaaagaccauaacauucuaaaucauuuugcucaggcucgagggaaauauaaucaucagaaucgucauggacagcuccacagaucauuaaagucgguuuauuugucuuuucaaaaggaaaagaaaaggagcucccagcagaccagcacucagccacuggaagacaaagagcaaauguaaacaaguuauggcuuugaacuuguuuaauaaugcacgggaggggccaaggccgaguccagauguggacugauacaguuacuuuuagacaaaacucacagaugcaagcgaaugcuuggcuuguauugaaugugucagcuccguguuuuccuucuccucccccuacuagacuuuuuuaauguggaaugauuuucuuuccugguaucucaggacacucugucucugaaaaccgaggcagcacugcauucugauacuccaccagaaggaagacugcauggauggcuaauuaaugcucugucuccuccuucuuccaccaucuucucucccucuagaagcugaaccggaaguugacaaccuucuaguuucagaugccacuccagacgguuuccgucuguccuggacugcugaugaagggauauucgacaguuuuguuaucaggaucagagauaccaaaaagcaaucugagccacaagaaauaucccucccuucccccgaacguaccagggacauaacaggucucagagaggccacugaguacgaaauugaacucuauggaauaagccgcggaaggcgaucccagccagucagugccauagcaacaacagguacuguaaacaagcaggugccauagcaacagugggaucuauacacaaacaggagaggaaaacggaaauccaagacuggaauucuucuuccuauaggguugcauaaucacaagagcucuggagcacagagaggcuucuguuuagauccugguuccuuuaagcauagacuguguucuccuggacuguguggacaaaucucugcaccauaaaaagaguaugauuuccuuagcaggguggugaggauuuagugaucugauucauguaaaaguaacaacauaagaccugggauguaguaagggcgucauagugucucuccuagaucaucaacuauuagacauuuaaauuccaaaaacuuccuucuauugaauaguauguaucggagaauaugaucccuuguucuuuggucagauguuacagucacacuagaugagugagggacaguggagacauggaaccgagaccugaaaggauuaugacauguuuauaaaaugucccacgugagccaucaguacugugguuagcaaacugaaggauggagcugguaaggcuagcaggacggucuucuugggcucacaaauacaagccgacacugcguguaagagcccuccacgggggaaauaagacccuuuuuccuaucagcuaugcuaaggagaaaggcaaagauacccagacacaucauuacuauggucauaaaacuuaugugacucuuuagagggagaaacaaagaccugaaaaugcaguacuuuaaaaaaaaaaaaaaaaccuggaggaauagucaagauggcauugcauagagacaacccccugaaaggaaucugaggaagaaucagaaaaucacaaggaaaggagaagcacugagaagugaugagccacacaccaaagaucuuggccuugucuauugauacaucaagaauccgaggcccagaaagcugaaguacugugccuaaggucaggcugcuauaaugggcuuauugugacagugugacuguaauuauuuuaauagucaaaccagaugacagguaaccagugaacagauauacuagcuaugucugacagauacagggaauauuaguccaagcucccuaagacauguuaagacauguuuuauuguauggguauguaggagcuggugugugugucuguguguguuugugugccugggcuucucuaugucuguguaucuguguguguguguguguguguucacuugcauguagaagccugaagucaacuucagguaucauucucagaagccaucgacuacucugucaucugucugucuguuuuucuguguguguguguguguguguguguguguguguguguuugugugugugugugugugugacagacaaagagacauacagagacauuguguauguccauuuauauaugguacauaugcaugugcaaaagucugagucuacagguacucaugccuacaugugcacagaggccaggggagaaaguaggguguccugcucuaucauuaucuaucuuguucuauugagacgaaguaucucacugacccuggagcugggcuuucagccagcaagcuccagggauuuccccucacauacacacacauaacuagcacuggaguuauacacacaaggccacugugccuagcuucuuauguaggugcaagagacuuccacccagcaccucauacuucccacugagccaucuccccagcccaccuuacuuuuuuauacuguaccucugacugacacccagggcuuaccaguccagguagacugacaggccagcaacacccagggauccagucacuguguccccaaugauuagaaagugugacaccauguccagcauuuugcauggcugcugggguuguggucagucaggccaucaugcuuaugcaguaagcaugcugcauacagaacuauugucugagcagcauggcaagauaauaguauugugacaagaggcaggaugcuacaaccugcaagaaucuacccauagaaacuauagccagugcuuguagacauggagacagugcauuagugugucgagaggaaaggcacugcucuuucugcuuacaguaccccccaguucacacacugguugcacagugcuuagcauagcugugcuccagaguaucccaccccaacauugaucuccaucccccauggcugccaaagaauggcuucagaucagaagcagagacugaucuugguuuauaaacacugcucuucaaagcucugaucacugauuuuguuuugcugauuuuuuuccuucuucuauaaucccuguaguucuaaagcaaaaacaaaaagaauaaucaugaguugauuugccuuuuuaagaacaaaagaaaaaccagagccuguuuuguuaggaagaacccccucuugggcuucucucugugggggucuuaaauucacagccaaagagaaaagcacauaugugucugugcagcguguguaagcaaugugucuaugugugccugcacacccaugcuccaggaccaggagaggccagaagacauguuguaagcagcacagcaaggacaugccuaccucaucuucaguccccagcuucaagugucccuuuuaucuguuuccacccccacauacacuucucucucuucccccaaagcaccuugagcucuccucaacaacagcaaccucucccucuuaccuccugguaauggucugcugugauuccuccuuguaacauauuucugucuggcuauaagcugcccacccuugagaauccagagcagcaaggaaggcagugcaagcaaguggcuagccaaugaucugggcaaacuccug

SEQ ID NO: 1939 - RNA, 11257 nt, Mus musculus
ggaaggacgugcuagcgcaugcgcagaaggcagcgggcgggugggcuggcagcgguggacucgcgucggagcugcgggcggucagguagggggcgggaaggagggucugcgaccagggacuguggugggucgcggggauccaagauugaauggcaggauuuggggacuggaucggaguggcaggaucggauucggaagggacgggcucaggagcgauucggcggagaugagaugcagcugggggaggggagcaaaggggcugaggaaauuugcaguugcagcaugucgggagguaugagguaaugugggggccaugcggagagacggggugcagcaugugggagaugggaggaucugacgucccuggagguaucugggugcagaauaucagaaagcauaaaggaauuuggcaggccuggaugagguuggguguuggcgggcagaaucuuaggggcuuugaggagaucgguguaaugauagcaagaucugagaucaaaacagccaaggucuuggaagauccuaauugcugaagagaaagggauuucuguagcggaaucugggaaagacugaggggugaguucccgagggaaucaguacccaguuagaaaaucgcagcaaagguuugaaggcaacacgugaggcaggacgggggcggagguggggggcggggguuggagguggcccaguacaagauggggaugaugggcagaugagcgaucagauugaaggagggcagaaaucugagguacaggauuggaguuuggagauggcauacaggggugauagaugugggaauuugaaaauagauuaaaggauguauuggagggaugagggacacauaagagcuauuggugaauugcaaggcugcagcauacagucuaaaagguugaaugauagauuugggauuuagcguugagaaugagguuuguggagaaugaaugguggggagugaaugcuguaacuagauuauagaauucaaaaccaaaugaaauuugugaguagguucuuaggagguuuuuguuuguuuuuguuuuuguuuuggucuuggcauaacugaacccagagggucuucuggagacccagggaccugaaaguaauuuauaaauaaacuauguauaaaugaauggaauuuaggagaauguaaggguuugggaauaaagacaccagucuucagaaauccugaaggagaguuugacauucuuugaagggcagauucuuccucacuuacuaacuaaaggcccuuuaauccugaggcaggcauguauucugacuauacccacucugaccacccccaccuccucaucacagacccgauauuauaggccuuggggaagaagcagugaacuaccuaagggcuucugcuaccuagccuuuucccuguccaagguaugagccaaaaugaucuucaaccuaauauuaucuuauaggagguccauuauagcucacagagacaaugguucugggugagaaacaaaacaagguuggaacaaggcggagccuccugucuacugaguauuuagccugugccauuaccuaaagccaggguucucagacagggugcuuuuguucugccaggaaacauuugaccgugucuggauggaggcauugucaguugucauaguugagggguuguguguguguggggggggggauacuuggggggggggauacugguuucuagugaacaaccccuacaauaaacuaucauuuagcuagaaauggcagucaugccaaaauggguccuggcaucagagucaagaaugcucugguuagauccuggcauuauuuauuuauuuauuuguuuauuuauuuauuuauuuauuuuucucuuucugcuuuguaaccuuuaaagagucaauugaccucucagugcacaagcucuucagggaccuacgucauagaauggcugugaggacucaguguacuaaaucagggugcuuacuguuuggugcccaguaaaagugcucagaauuuacuacuuuugaaaauaugugugcuuucuucucaugauauuccuucuaaauauacauucacuguucaguguuacccacgaaacuaaggcuuaggaggucacuugucuaaagccacauuccugccauguagcuccccgccacauccucucuuccauugcugguuugcugcggucggcuuggucuucccuuugcagccucuccuaaggaaagggaggcuugccccguagucagaagcugggugacuucucuugauuaagagaagcccuggacuuuguucuugcuuugcucuuagaccagagccaauggggagauagugcaaggagcuuggagcuacacggcugagauaaggagggcucaggcucaagggcagugcuagacggaaggaaacugcucugaauguucuccuuugugcaucuugucucuggcacagaagggcagcauugucuuuaucaacuccaauccuagcuacgcuacagaaggcaguuuagagaacaaaauuagacuggagcugagggcagaacacuuagcugcgaugacaucaacucagaucgcuuaggaaaacaccugacggagguugaguuggccguggaaucggcuguuuuacugcuugcuugguggucaagcacuugccagccucugucugaaaacacagcgagcucggcugagugcugauuaaugugcauucucuccauaaggcccacaaucuaaauguuacuccugauucuacaaggcagaaagugaagagccacuuguuaaaugacauauccuggguuacagagcaaguggcuaauuugggcauauaaaucagaagucacaugcuggcaagccuccuagagugcacccuccuguaugcagaugguguuaccuuugggagacuucuuccauugugccuuucugauagaaagguauguuuuaaaagucauuccuggaugaauuuaccaaccucuaagccaacucuuaccugcagguaaaaguagucuuuuggucuguguuuucgagacaggguuucucuguguagcccuggcugcccuggacucaauucuuagaccaggcugcccuagaacucagaaauccaccugccucugccucccaagugcugggauucaaggcgugagccaccacugcccggcacaguagucuccgcuucuauaaaaguacauguuuugggugagcccuuuuguggcccaguucacagaugagcaacugggggacaacucuacuacauaccacggugggagaacaugaacagguuacuuguuucuuaaugauguuuaggauguggacuaacacuuccuucacacaguuaagagaagacaugcaguguguagaggguuccuggcacucguuacuccagauggccauuagaagacaugguuuuagcuaucagcaggcaccauaagugcccucaaucugaaguucacacuugucuccccagccagaacuagggugaauagucagucuguuagugaguggccuuuguggcaccgagucagguucacacuugguucgaauugaguuaaagugcauaaggaguaaaugcagcuugagugcuggccugaauaggggugauaagucucaacaacaucaaaacccuacaggccaugugagaagcagaguaauuguagaaugguucuucaugucaaguuuuuagaugauuuuuuuuuucacaucucuuucuaaacguugucuccaucuccauccaucguggcaggacuacacuagugguaauugcuuaggaaagaucugcuucguuaauugcuuaagguucgacagguuugcuuauggccuaaccccccccccccccaagaaacaaagaggggcgugggaaagcuugaggucaaauagcaaucuuccagaaggcccugaguuuagauuauuucaauguauggcugcugccuuaggcaucugccuuccgacaggagccuguucauuucauaucacaggcuggccaauggcuauggcaagcaguagcaauuguagucacuguuccugauaauuauaauaaaggcucuguacacaguuaguucugugccuaguuuggugcuguccaaagugcuuuuugcucaaucucuucuaaucucugcuagugagaaagcaucaccuugaaaggcuauuucauaccuaaguugagguguuaggaaaccuuucaaaucuccacuggaagugauagagcuggaaucuaaagccggaaugcccagguccugcaaguacuuucuuaguccuuguagcaccguuagcuuccaacccaugccccuuugccuuaggaugugggaguugcuaauuucccucucuuagucucgguuucuucaucaguguuacucugaggucauugcucacucuaccuuuccauacuuagucucugcuagaaggggcuccagcaguugauguguugauuggaagugauggguucauucacucauugcuucguggccugggugaccacauucucaacccaaucccucccaaguuaacuauuccuuuuaguaaucuuuacgugccuuugcuguccaggagaggacaauucuucauuccuuucaaaacuuggauuguaaaccgaauuauuuugcuaauaccaguacugguucugauucuuguuuuguuuugguuuuuguuuuggguuuuuuuuuuuuuuuuuuuuuuuuuuuuuuuuuuuuuuuugagacaggguuucucuguguaucccuggcuguccuggaacucacucuguagaccaggcuggccucgaacucagaaauccgccugccucugccucugcuucccaaaugcugggauuaaaggcgugagccacgacugcccugcucugguucugauucuugaugcucuugauugcuaacagaauuaaguuaaacagucauugccaucaacuaugaaaaagucauugcuugccuaccaauuauuagcuuaaguaucuacauucauuauccuuaguucucaugguaauuuucucucucucucucucucucucucucucucucucucucucuuucucucucucuuucuuucuuuuuucuuaacuaagaaaauagguaaagagaaauuaaagaauuugugaggccuagaaucucugaauagcuugccaggcauggaaaacuuaaguaacuugccaggccuggagagauuagguaauuugccauuugccccacauucuguaagugaaggcacaacaaugcugucuuguucugucucccuucaagguuuauguuaucugcuuacucuugguucuuucaacucccuggcuaccuauuucacagacuggacaaauucaguggugucaggagaggaugaggcugucuuagaucuaucugugagaacacaugcaacuuuaagagauacaguaucuggagucaaagaguugugcuggggucagggugggcuguacacugucaaucguguggagugggugagcgaaccagguaaauggagguuauguaaaauggaagggcaagacuugggaguacagccugaacaaugggaaauguguucaagggaauguggaggcagccaagguuguaaauggcguguugacuuuuccuucugcucgguuacugauuguucuagcuggcaggagaugggcagcagcacaucugaaggcuuggcauagggaggcaguuccuuucacugcaacagccuuuccagggaaguugaagucaaauugagcuucuguuugauucaaucuugauauuaaugggaguggucaggcaugccugucuggaggagcugggucugccagacuggugggucugucuuaggcuaagugaacgcuguguacugggaugguggugguaacagaaauaaguccaggcauuuuucagagcuacacuucuccaaagccagaaucuuuagugcauggauuuuugacaucuuuuuggagaaccugguaaaacuguagacuggagaaauaguuugccauuggaugugggcauaaucaauucauuucauaagcugauagcuuacacaggcaggaagccuuugaauugagagaagucuggggaaagaauuugcuaguauuuuuauaaauuggcagacuuguuuaacaagcuggucugcagugccagcuccaggaagaacagaugucccagcacaauguaagguaacaugcuugggacccaaacaccaaaugcugcugcccucagucuguucucacagaugacaggagacagaagaaagcuauugguuaggauugagugguucucgcagaucuugggucagggcuucuauugguguuuccgcggggcugccccacgcccacagcguuugagaauugaacauucacuguuguaauauccacaggagaccauuuaaaguucaugcugcccgguaauuuguuguuuugucaaggcauggauuugaguuguaaugguuguaaagccagaguguuggacuaggucacccagcuaauaaaaucgauucgcuccacucuguuggcugacucagcuagaugauuguucauucuuuuagggagaaaaguauguuuuaaaggcagugcguccuagagcagagucgagagcacucuuuaauaaauaacugaaagacauuuaaaaaaaaaaaaagaaaacuuggaaguaauguugggguaaaaauaagucaaaguacuauguuugaccgcugagaccuugagcucguuuuuucaaaacuucaaugcucucauugccaaagugggacaguaaaauucuuaccacguuuccacaaugaggauuaagcgagaauaagcaugcacaguauuguguaucacauaguagguacuaggauaccagagcaauuuucugccuauagagggacguccuagagguaaaugugaccccuucccuucacacacacacacacacacacacacacacacacacacacacacacacacacacacacauacacagaguccuuuucauccuuaagcauaccaguuccuugcugcuaagcgcuugcuugcccuagcauacccuucacaaagaaugucccacguuacuugcacaugaaagucacuuuguccuuaagcucucuaaucauccucaaaugguuagaucucugugcaucuccuagccccugcucuguuuuccuacaguuuucacauaaggcuaagagggaaccgaaguucacuaaggaccuuucuggugcagaugugauccuucgguaaacccaggaaaggauaugcugucuccauuuuacagaugcagaauuuuagauagaccaagcguccccuguucuucgucccaauugacagaacucugugcuugccaucugcuuucucggcuguauucaggcuaugcccuccgccuaguguuucguucucccgucucauuucugugcccuugcaggcugaaaugagugcuccagccucuccgaaauuccauuuuucuuuaaguaaaaaugagucuacuuuccuaucuaucagaaugggucugccuugauuccuaacuuacauacucgccuugcuaaagcagagcaggcuggguaugcugaaauguaaugucuugguucuuucugaugccuagacugcuauggguggcuagguuggaagaugaacaaaugaaaaauguguaacacgccccaccccccgccccccaucugaugguuugcagguugcuuaaaggcaaucaucagaauuuucucucugagugaaacaucagaggccaucaacugugauggaaugaaaaggcuuggaccccaaacuuacacaguguucuuugcguacaguuccuguaugugucaucgccucuaagauuuguaagacuucucuuacaaggagcaccauuuaugaguagccuuacccaguugucaggcuccaucccucuucccacuguaccucacaguguagaccuucaugugacauucucugaucggcaggguuauucucugcuuuccugcuuguaugucauauuauuuaacccuuccaguaaugguauaagauaggcaauuuaggcucuucccugaauuccuccauaacauaaugcauuaaucauuuguguguguguguguguguguguguguguguguguauguaaggggaggggggugggagagacacuauuuccuaagucauaaucacugcaauaaaaugcuuauaaauaaguaaaugauucaauggaugauuauagcuauucucuaaguguuucuagacugaaauaacuuauaugggaguagaaaaaugaauaaugguuuguuuuuucucuuuagcaggaaucugacacuggggcaugaauauuaagcuguguggcucuaagcuguguuagcaggaaccuucacuggaagagcaauggcugcggcugcagcagcuucucaccugaaccuggaugcccuccgggaagugcuagaaugucccaucugcauggaguccuucacugaagagcagcugcgacccaagcugcugcacuguggccauaccaucugccgccagugucuggagaagcuccuggccagcagcaucaauggcguccgcugccccuuuugcagcaagauuacucgcaucaccagccugacccagcugaccgacaaccugacggugcugaagaucauugacacagcugggcucagugaggccgucggccugcucaugugccgaggcuguggccggcggcugccucggcaguucugccgaagcuguggugugguguugugugaacccugccgggaggcagaucaccaacccccuggccacugcacacuuccggucaaggaggcagcugaggagcggcggagggacuucggggagaaguugacucgucuaagggaacuuacuggagagcugcagaggaggaaggcagccuuggagggcgucuccagggaucuucaggcaagguauaaggcuguucuucaagaauauggccaugaggaacgccgcauccaggaagagcuagcccgcucucggaaguucuucacaggcuccuuggcugagguugagaaguccaacagucaagugguagaggagcagagcuaccuacucaacauugcugaggugcaggccgugucucgcugugacuacuuucuagcgaagaucaagcaagcugauguagcccuccuggaggagacagcggaugaggaggagcccgagcucacugccagccuaccccgggagcuuacccugcaagauguggagcuccuuaagguaggacacguugguccucugcaaauuggccaggcuguuaagaagccccggacaguuaacauggaagauuccugggcaggggaggagggagcagcaucuucugccucagccucgguaaccuuuagagagauggacaugagcccugaggaaguagcucccagcccuagggcuucccccgcgaaacagcggaguucugaggcagcuuccgguauccagcagugucuguuucucaagaagaugggggcgaaaggcagcacucccggcauguucaaucuuccagucagucucuaugugaccagucagagugaggugcugguugccgaccggggcaacuaucguauccaaguguucaaccgcaaaggcuuuuugaaggagauccgccgcagccccagcggcauugauagcuucgugcuaagcuuccuuggagccgacuugcccaaucucacuccacuuucaguggccaugaacugccaugggcugauuggugucacugauagcuacgacaacucccuuaaagucuauaccauggauggccacuguguggccugucacaggagccagcugagcaaaccauggggcaucacagcccuaccaucuggccaguuuguggugacugacguggaaggcgggaagcucugguguuucacuguagaccgaggagcaggaguggucaaauacagcugccucugcagugcugugaggcccaaguuugucaccugugaugcugaaggcacagucuacuucacccaaggcuuggggcucaauguggaaaaccgacagaaugaacaccaccuggaggguggcuucuccaucgguucuguuggccccgaugggcagcugggccggcaaaucagccacuucuucucugagaaugaagauuuccgcugcaucgcuggcauguguguagaugcucggggcgaccucauuguggcagauagcagccgcaaggaaauucuccauuuucccaagggcgguggcuacagcguccuuauucgagagggccuuaccuguccagugggcaucgcccucacacccaaggggcagcugcuggucuuggacuguugggaucacugcgucaagaucuacagcuaucaucugagaagauauuccaccccuuaaaagaugaggagaaauaccacuuucuucuuucccucaauagaguuuccuucccuuuccuuccuucguuguugauggugccguagaguagauguggccuguggccugauucuaguaggguugcucuagaaucguagaagcucuaguuuucagugauuuuguuuguuaugccccucuucccccccccccuccccuuuucuccuucuaacuuuagagcuuagagcuuuaccagguaccuuaucccaaguagaauagaugaugcucuuagcagaaguugcuuagaaguuagguacuuccaaggcuuuaguaaagagaaccacuuuaguccuuugcccuuguguuugaaauuuguauugguauugaauagucauugauauuucccuuuggacuaugaggucccuagucuacugucuccuuccuguuacagugugcuucgucuguggcuuuaaaucuggcugcauucugugugcaugcuccagugggaucugcuugacccuucagugauauuauauucuguagcaugaugucuccuuugaucaccuuuaccagugugagaguauaucauuaagugccaccaaaggugacacauagucccuuugaaagcaggaccucuugacgggaauuucugccaccauagauugucuucucauugaagaugugccagaggaugguuugacugacccuaguuggauaguguugaacacuucaguccagaaaucacuugccuuuuaaaggaguuuauagguuagaauuaugccauggccaaggcagacgggaacauauaagcagaugcuaacauauccagcaaaugugggauauuuucuagggcucaaagcguuuuguacuccuuccacugaccuaugcuaagaguuauugaaagaauuguguaaugugagcuucgaccaacaaugugaggagguugacacauccauuuucauuacuaaagaacaaacuguuagguagcuagcucuguauuuucuucaagugagugcauauuguuugacuuugagauuuagcucuguucuaucaagcauuaaacuaauaaaaguaauaacuuucuucaucacug

SEQ ID NO: 1940 - RNA, 1087 nt, Mus musculus
gaaccugcaaugcaaaugugcuauuguuagaggcucuuagaagcugucuugagaguuaacaauuaccagguauuccuugugacucuuguaacuuuacacuuccuugugacucuuaacugguaucuuugguaucuuccaacaacgcccuccccacuuccuuaaguuucgguuucuuccuuuaaauacccccuuacccagcuacucggggcaccacgguccucuaccccugcgugguguaugaccaugggcccgagagcgcucuugaauaaaaauccucuugcaauuugcagcaagacccguuucuugugggugauuuuggggugucgccucuccugagucagaacgugggggagcccucacauugugggucuuucauuuggugcguuggccgggaaacgcgaccaccccucacacccgagaaccgacuuggagguauggggaucccccucuugcgugcgugugugccggccggugucucuguuuugagugucuguuuucugaaacgaacauuggaacaugugcuuguuguguuggguuguuugugucuuguccuauguuucugaaguacggcgaagucugaguuuggauccgucugaguuuauugaacuugugccuugguuuuccgguugcgagaucguggguucgagucccaccucaugcuuugguuuuacaccuggcagagugagaaacaagugagauucucugguuuugguugucuagguagaaguggacgacgguguuuguagacgauggggugaugggguuuucugaaaugcgcgcgucuguauuugcagcuguccuuuugggccguaaggaccggaggacuguggucggcagacgugcuaagaggaccacaggcuguggcccugggggacgcccugggagguagggagagucagggacgccuggcugucuccggagaucggucagagggaccgaguucuguugaagcggaagcuucccccuccaacaucgucuaauucuuuugccugcuuguggaggacaagaaagggucgagugugucuggaucuguugguuucuguuuuguguguuuuuguguauguguuuagagcuauguaaaaaucua

SEQ ID NO: 1941 - RNA, 717 nt, Mus musculus
ccuaauuucuuuuuuuuuuaaaucagaaaauguauuuaauuaacugacaagagagagaugguccaagaauggcaggcagaaucuguggagugagaauuagaagcgaggggcugcauaaucaucuggcauccgcuagauguuauaucugugguuagauaaguacaugauagggacgccagggaucuuccggauucuucguuugaggucacggucaacuguggccacaauguaacacuugugcugaguuacucucuguaucaagcaguccucagcguagguuccuuugugugugcacggcaaucggucaaaccguggauccuuggcgauucuuagugccacacuauacuucugucccaauuucucaguuucagucauuacacaaucaguuauacaagggauacacuuggcauacagacaguccaucauugacugcacuaaguccaguuuggccuuaauggaaaaguugaugaaguugguaccgacaaggaugugguaagguggacccagcuguguauuauacuggaagaacaagcaggaaggaugcugggggacuucucuuuccuucagcgcgcucggaucuuucuucucuuucuucuuaggcuucaaccuauccuuuucuuuaagucgcucgucucucagacugagcauucgcuucauagucacauauuuccuuguuuucuuuugcuuccccauguucacgcugcacuccuguuucug

SEQ ID NO: 1942 - RNA, 1062 nt, Mus musculus
uguuggaagcaccgggaagauggcggaggaaggggaaagaaagaagaucccuuugguucgagaaaaucuccugaaaaagaggaaggcuuaucaagcccucaaagccacucaggccaagcaggcacuuuuggcaaagagagagagaaaagggaaacaauucagguucagacgacuagaaucuuucgugcaugauuccuggcggcagcaacgugacaaggugcguguccagcggcuggaggugaagccucgugcuuuggaggggccugaucaacauuccuuggccuugguuauacgcauggaaaggauugaaggagugaguuuauugguaaagagcaccaucaugaaacuuggucugaagaaauuguucaguggugucuuugucaaggucaccccucagaguguaagaaugcugcucacgguggagccuuaugugaccuggggauuuccaaaucugaagucugucuguccgggaacucaucuugaaacgugggcaagcaaagauaagacagucccucugacggacaacacggugaucgaggagcaccuggggagauuuggugucauuggccuggaagaccuccuccaugaaauugccuucccugggaagcauuuccaggaggucucuucauuccugugcccuuuccuccucucuguggcccgccaugcuaccaggaacagagugggcuuccgcaaagagaugggcuccccgggcuaccggggagaucggaucaaucagcucauucggcagcucaacuagagcaggagcagguuuuccaaaaguaccccucggaaguguuuuugucguuuaaaauuaucaaguaucuucagagaagauuauuuucugccuucagaaacugaaggaaggggccuagagaacgacaguaaggugcgagcacuggagacacuuaacacagcucaguccauggaaggggacgaguucccucacuggcugccugucucgaaauccaugcaagcuguggaggaaagaauuauccugcucauccugccuucuaucuugguguuuaauguugggugggcaacaagcgcaaaccucccucccac

SEQ ID NO: 1943 - RNA, 3726 nt, Mus musculus
uaguuuauuuuuaguuauuuauucauagaauuuguauguuggggccaaacaucauuuucauauuuucuauagacacauuaucugcugccacagcugggaaaacuaaaaguugguccaaaagcuucucuugucauugucacauuguuguaguguccgauaacauuucaugcacagcuuccugaaacccuaugauuguuacuccacauacucagcugauuuuauggaugugaaaccauccaggaggcggguugcugagugcuccugugaggcguuuucuuccucagauuauuuaaaguguggagaugcacuuucacauuuucugguggcaacccagauaaaauaugaaagaagaaaguuuuaauuuuugccugcuugccuuuacucucauuggaaaguuaauccauccugcugcugcugcugauauaagcacucagcuuuauguguuucccagcauggacagaagaacugacacucuucagaaauccucugggccuucaguaccagacuggaacugcuuaaauauccagccccguggaaugagcaacuaccagauucucugccuuucucauaugagacagccauuguuugacuacccaaaccauaucauucaagccaaucugauaaaucauccuuuaauacauaucuguguuaucaguuauguuucucuagagaauccuggcuaauacgaaaccugagccucaacuagaaagagugcuaugcagagcugacauaugcaggugguuuauaucacuacaauuucacuuuuaaauuaauauuaacuuaagagagcacagggauguggcucaguugguugugccauaggcuagcaugaaugacacccuaaauuccaccaaguaucacauaaacaugacaugguagcauaugcuuguaauaucagcauuuggaaauuaaaggucugauaauuagaauuucuaagccaccacuggguacauaguaagucugaaaguaaccuggucuacaugagacccugucugaagaaggagaagaaggagaaggagaaggagaaggagaaggagaaggagaaggagaaggagaaggagaaggagaaggagaaggagaaggagaaggagaaggagaaggagaaggagaaggcugguaacucaacaguggcuaaaacacuaaagguccaugaauuguauacaaauagacaauaggaguccugccuuuuucuccuggaaccuuacaggauaucaauacuaaaguaggugcauccacuucacuguguucuaagguagugaagaucaaaguuggcccccagcagcuggaugcucagugaugccagcuauaggccaagaugaugggugcauucuggguagcaucugagcccacagccucauagaggucuuauggcccuuuaguuguugguauugguuguucucacagaugggguuuuauacuagguaguaaaacaacgcucugagaucagugacauauggggcuuuguauggacucaucccccuguauggcugagggcucccugcccauagcccauccagcuuuauauuuccauacaacaguugcauauucagaaagagcagauggaaccucucuugauuggcguugccugaucaaaacccauaaaaugaaaagagagacagagaaauacaaaagagacucaaagauuuuuucaaaaggacuaggagauugcuucuuccacagccuguaccuucucucagugcucucugacccagcaucaaacucuucccugcugaguccaagccuggcuucacagcucucaucaauacugcauaccagcuacaugugagagguagcaacaaaacaggcuucaaaaaaaugcacagagguaucauggcaguagcaauuagaauguaaggugauaggacuccucuucgaugcuuuuucugcagaccagaaucagugaucuagaauauaaauguuaaaugaggugagagaaggugguguggaaugcucuucuaugaaaacaacacugcuuaggcagaugacaucccugcauguaguacuuaggugcucucuguccuugagcacuuggcuucacugucucugguccuaaguuuccagauccauaagauggggaccaugauuucuucuuuguagaguccugugguggucagaugagauagugccuagcacaguguccuaacaaacuauaaauugaaauauucccucuuugauuauggggcuacugaggccuuaugcuuuaugcuuaucuuuuuccugugcuguuccugcuguugacuggauugacaaagaugauagaugacauuuugguuucuaugguugaacagacauguuuauugaacagaugauuucuucugcccucagaucucaguaagcaguuggugagaucugggacugugggagcuacaucagcagagaaucugcacgcccaaugcaggagagcacucgggaaagugcucagaacaugaaggugcccuccguccauuccugguaaggguaguaaguuucucagaaaaguaugcaaauagccaauaucaaguuccuaaagggagaaauaguccugagacuccagaggcucuuuuggcccuucuaacagcucauaagccaggucucauucaguuuuucaucucuggguacacauguguuggcaugcaguaggugcucuccaauucuaucacauccuucccuuauaauuuucuuuuuuuuuuuuuuuuuuuuuuaacagcacugugcaguuuauuaaccauucaaguacaguagcaucuggugagauugggacagaauugggaucgcaaaguggacagauauucagcaucuaauggguuggaagaagccacuacauacucuucacaaacgucuuccacagucaauacaguacuagccauuaacccagcacaccgauugugcccgaguggaaaagaugcaacgagaaaaauagcuacauuagaaagaccaacacuuuaaaaaagaguaaaacacuuucaguuucuccccuugagccccuaaaacaucucacggucuggaucuaccuauacgguccuacaucggcuucuagacuaucugucaggagggaaaguaaaggacacuggccaguacagucuuuggauauuuaggacggggucggggagaaagucaguucucgggacaacuuagucagccucagucucauccgcggggucuuuggauucuuuguucuuccgcaccucuuccacgugcuuguccuucucucgcaagcgcuccagcuuggccgccaucugcgccucccgguucucuuuguuagccuccauuuugugggucagcuucuccuccgccaucuugcugaagucguuguucuccucgauggcuuucuggagcaccuccuucucaugcucccgcuucuccgcgagcugcuucaagacuuccgccucaugagacuugcgucuuucuucugcagcuucuaauuucuucuggauuuccuccagggaaagguccuucuucuuugggggggaaagggggaaaucggggacagauucuuuugaccgagggcugagaaucagcucaaaagccuggccugaagcgcgcuucuccagcucuuucaccugaauaucagaagaugccaugucgaacagaagacaagagacuggcuguauacucuacacaauccacuggcaaggaaagcccugcucgguccgagccgccuggccacacucucccuuauaauuuucuaaagcucuuuuaaaauaaggcagguauaacaucuuacccuaggccuggacauuuaugcua

SEQ ID NO: 1944 - RNA, 996 nt, Mus musculus
uuuuuuuuuuuuuuuuuuuuuuaacagcacugugcaguuuauuaaccauucaaguacaguagcaucuggugagauugggacagaauugggaucgcaaaguggacagauauucagcaucuaauggguuggaagaagccacuacauacucuucacaaacgucuuccacagucaauacaguacuagccauuaacccagcacaccgauugugcccgaguggaaaagaugcaacgagaaaaauagcuacauuagaaagaccaacacuuuaaaaaagaguaaaacacuuucaguuucuccccuugagccccuaaaacaucucacggucuggaucuaccuauacgguccuacaucggcuucuagacuaucugucaggagggaaaguaaaggacacuggccaguacagucuuuggauauuuaggacggggucggggagaaagucaguucucgggacaacuuagucagccucagucucauccgcggggucuuuggauucuuuguucuuccgcaccucuuccacgugcuuguccuucucucgcaagcgcuccagcuuggccgccaucugcgccucccgguucucuuuguuagccuccauuuugugggucagcuucuccuccgccaucuugcugaagucguuguucuccucgauggcuuucuggagcaccuccuucucaugcucccgcuucuccgcgagcugcuucaagacuuccgccucaugagacuugcgucuuucuucugcagcuucuaauuucuucuggauuuccuccagggaaagguccuucuucuuugggggggaaagggggaaaucggggacagauucuuuugaccgagggcugagaaucagcucaaaagccuggccugaagcgcgcuucuccagcucuuucaccugaauaucagaagaugccaugucgaacagaagacaagagacuggcuguauacucuacacaauccacuggcaaggaaagcccugcucgguccgagccgccuggccacacucucccu

SEQ ID NO: 1945 - RNA, 1153 nt, Mus musculus
cauggcagccuccuuggaguucuggggagcagcccccggccucugguaguacuggagcagucggcggcggcucauggacagccuuucagcgguguguucuaggucagugacuucuaagauuccaguuggauucauuggacugggaaacaugggcaauccaauggcaaaaaaaaaaaaauaaaaaaaaaaaaaaaaauaaaaaucucaugaaacauggcuauccacucauccucugugauguguucccugguguaugcaaagaguuuaaagaggcuggggaacagguaguguccuccccaucagaaguagacggaaaggcugacagcauuaucacaaugcugcccuccaguaugaauucaguagaaguuuauucuggagcaaauagaauucuaaaaaaaaaaaaaaaagugaagaacgguucauuauuaauagauuccaguacuauugauccuucaguuucaaaagaauuggcaaaagaaguugagaaaaugggagcuguuuucauggacuccccugucuccaguaguguaggagcuguucggucuggaaaccuaacauuuauggugggaagaguugaagaugaauuugcagcuucccaagaguugcuggagugugugggcuccaaugugcuacacuguggagcuguugggacugggcagucugcagagauaugcaacaacaugcuguuggcucuaagcauaauuggaaccacugaagcuaugaaccuuggaaucaggucaggccuuggcccaaaacuauuggcuaaaauccuaaauaugaccucuggacaaugcugguccagggacacuuacaacccuguaccuggaguuauucauggaauccccucaccuaauagcuaccaagguggauuugaaacaacacuaauggcuaaggaucugggauuggcucaagacucugccaccagcaccaagaccccaauucucuuaggaagccuggcccaucagauauacagaaugauguguucaaagggcuacucaaagaaagacuucucaucuguuucaguaucuacuggaggaggagcccuacugacugugccuuguggauguggacacuguuaggaaccaaacucuguccugagcuuccucuagcucacucuagaaguaauggucuaaucaaagguggucugucugcu

SEQ ID NO: 1946 - RNA, 585 nt, Mus musculus
augagaaugaagauuuucuuuuuuuuuuccauagguauauaaacuauuuauuaacagcaaaggcccagagacucauuucuucuuggauacacccacaguucggccccugcggccaguagucuuggugugcugaccgcggacacgaaggccccaaaaguggcgcagcccucuaugggcucuaauuuucuucagccacuccagguccucacgcagcuuguugucuagaccguuggccagaaccuggcuguacuucccauccuucacauccuucugucuguucaggaaccagucugggaucuuguacuguuguggguucugcaugauggggaucacucgcuccaccucauccuccgugaguucuccagcccucuuggugaggucgaugucugcuuuccucaacaccacaugagcauaucucugccccacgcccuuaauggcagugauggcgaaggcuauuuuccaccgcccaucgauguugguguugaguacuugcaaaaugugcuggaacuucucagggaucacuagagacauggcggcggcacagacggcggcguguaggccuccuguggaagcaagauuuucaac

SEQ ID NO: 1947 - RNA, 91331 nt, Mus musculus
gccgccugggugcuugcagcccccgccacacggcucgggcggggugcugguuugcuagcgagugugaaaccgcguguuaauguaagcggcgcaagaggcgcgggcggcggcaggagcagcggcggggaccccgcgucccggggcagaagccgggacucgccuucgacguggcccgccgcggagggagacagagcggcagcgcgcucucagucgcguggacguuugccuccgggucgugagaacuuugcgguggcaggagcuggucagcccuuugcuaagagccgaggaggggaaggcaggcgcagggagcgcccgagccgcggagagcgaccggcggccugaugcccgggguagaggcgcggcgggcggccaaagagcugcaccgggaucacuagccaucgacuggagggaggacgcauacuggcgugacccugccaggaccccgcuaggcuucgaagcuccacgccccgccggagacucggcaacgccgguggagagccgccggugacccggagcuuaccgucgugggagcgggugaccucccgacccgagacgcggcucucgccgcuggcugucuacguggguuuuagccaaggcgccaccugcacgaccgccgacgcagggaggagacacacagccuuccugcauuugugagccgcagaagggagcgcgccgggggcaccggguggagggccaccggagguccgggcgcccccgcugcgcagacucgcaagcgcggggccggccgagccgcccgcaauguggcccugagggcgggggccgcacccgucgcgcccuggccuugcaucccgagugccccgugcgccggccugcugcgcugcuucacguuccucggcgggauucaaguuggaaguggcgcggaggauagagcuaucccggaacagagccgcggcugccgccagagcgauguucccgcagagccggcacccagugagucgccggcgugggugggaccuugccccgcgcgggagcccacgaagccccauuuccccuugcccggcccccucccacuggaugucuagacgggcggacgggcgucgcgcagucacggcccgcuuaucccgaggccgaagugagcccucuucucgccuguuuacgcguagucagugcggcccggacugggggccgagagggaguuggcauuucaucuccaggucccgggucauucucgaaccaguuggggaggggcggccuggacaucgaaacucugauuugggccuuuucagccuccuccgggccgggugaccccagagcuccgggcacgcgcuguccacacuggaggcagacuuauuccugagccuccugagaaauuagggccccaggaagauccgcuuucucccucucuaaagugaaccgaggguucuaguuugggccucuguuuuccaccacuucuaacuuuauguauuuauuuauuuuuuuuguuuaugucccauccgcuucucccucuuacuuuucugcuuuaugcccucauccucauaucuccucccuuggucccucaugcuggucaccugcagacgccgcaccaagcugcaggccagcccuuuaaguucacuaucccggagucucuggaccggauuaaagaggaauuccaguuccugcaggcgcaguaucacaggugcgugucgaccuacucagggugguggucaccuggggcggggggugucccuucucacacacugccaggcugcuagggcugcuguacuuagggcuuguguccaggcgguggcguguggagucaccguuaagcccugucauucacguuaccccccuuucgucgcucuuccugggccgucccuucuguugucuccuccuccucccauuguuuccccuuugcgcauuuguggcuguuccagggagucccuuuucguguauuuuggaguugcaugagaaccgucaauauuugcgcuucguuuauuuauuuugcaacaggcugaacugaaacauggguucaaucaauggcucggucccggaguguguguucaggaaagcaaagccauguugcaauagcuguuugccauacaagaaaauuggguugucugagacaaaguccauuaggggaugcuagaugccguuagcuggggccaucaaggguuauuuaggugguaagguguagauaaugugcguguuugaguagaccaggagacuagagucacguucaccucuguucuggguucuuauguaaggauaccuucuauggaucguuuaguggaaauucuagcuaaagcccccaucuauagauaauagaaaagcuaacuauuuuccuacgaugagguuuugacucauuguugcuaagcaauaacuucgaaggcgauuuuuacuuuugucaagccugaggaaaaagaccaaagaaaagcuugguggcuugggucugaguuuucuuaaguuagucagaggcuuucugauuuuugaccuuuuaucuacuuuuauaucauaucucgagaacuuggggcauacuuggacacacuguuuacugaacagggacaggagaacuucaacccacuucauugcuguagcugcuugucauagcuuggcagcgauucaaacgguuuugaaaggcacuagucacuguacggagugacuuuaccaggaaaguuuucaaaccugaagacugccugugcuggagaguggggcuugugggaaggauggauuuuggugcaggcaagagaagauuggugaggauagcugaggaaucuguuuugauagguuuuuccucucacaggugugccccaaggaacaaaaagaacaguaguugcuggauaguccccauuguucaccaccuuugccagcauugaauacaaagacagcuuuuaggauguuuucccagcuuacaacuuuuccaaauuguuuuugcuugaagugcaaaucugugaggcagauguuaaaacaagugacauaauguuuaccuuaagcugccuguuuuguuuuccuagucuuaaauuggagugugagaaacuggcaagugaaaagacagaaaugcagaggcacuacgugaugguagguaucaaagccagggagacgucucucucugugugugauagugugugcccuggcuacagacgggaguuaacgacaugcuugguucuucucuuugcaguauuaugaaaugucauauggauuaaacauugaaaugcacaaacagguaagcuggagcuaagucuuaagccgugagaucaguuuauaggauuuuacaauaccgacuuuguccucgggcacugcauguuacgggggugggcgcuugugggcuauuuuucugccccucuuugaguuggugucagugcucugcaguaaggauugcuucuucauggcuacaggacuagguaggggggaugcuuuggacgugcuuauggguagacaggaacugagcuccguuuacuuuuccacauggauggauuccuccuguaaagaucucagauaucuugugguuccugcaguuuagaacagcuaauguuuucauauguuugcguauaaaauguggaaaguacuuggaaguuucuuuaauuggauuuaauaaagcauaugacuugagagugcucuuaggcuuugggguuccauaaagugacacucaggauuaguggcuuauuagcaaacauguuuuugaaaaauuucucaguugaugcagauuuggagguggaaaaaaaaauguccuuuuacugccaaugaacguguuggaaggugcuucagccuuagugguuuuaaaagcaugaaaagauuagugacuggaaagcuuuagcaaugacuugcguuugcaaguucccauaaaauucacacuuaugguuacuauaaugguguauaaaaagaguauugagcuggaacaagacacuaaggaccucguaagagaagaaaagcuaaaugauugcuuagcccagaggacccucaauugaguagucauugucugccaaagaaagcauuaauggcagggugcaaguguucuggagauaugcugacauucacuuuaucaaaaugcugguacaauaagucucuuagaaaucgauugacucuuaaaaaauuaucaucagaugaaguugcacaguuggacacguuucaaagugcaacaauacauuucuuacuugauguauaugugcuauuucaucucagacucuuguuucauuaaauuaaagagcauggcuggcuggcuggggcaugguggagaaauugauuaguucggccuucagaucuuccuuauauucaaagauuuucauuaagcaaguuuguuucagaguugaauucugcuuuuguaacucuguacucuuugauuuuuuuuuuaauucgucguagauuucauagucuucuauguuagauuuauucucagauaaauguuuucagagcacaaaguucagagccuuuccuuaguaauguaaugauccuuuugaaaacuguuuguuuuacugauuugcaaauucuuuauggggagguuguuuuucuguguuuuuguggcuaguacuaugcugagguuuuaagucaaugguagugagcuagaauaucuuugggcauuuaaauuaaguauguaaauaaacuugguguagguguuuaauuuguaucuuuuaaguuacucuguuggguacuuuguuuuuucuguuaaguauucugagcacuuagcuuuuucuuaaggauugaaugacuccucucuacaauggaacugcaagcaacucucaguccugugauaugguuggucuuaauggggaagcaggaagguguguaguucuggguucugguggcuuuuuugcuauguagagagaaggaguaaggagccagaaggggagggugaacucuggggugaacaguuuucucuuggcuucuguacuguucuguguugggcauauaugguuauauacugucucuuuguauggcaauauacauuaauaauacacuguguguaauuuggccaguaauuugaaacaagugggaagcugagagagaccauauucuucauaguaagaguauuaagcccccugaaauuaaugucuuacugaaaaugcugacagauccuucacuagaaugcugugcaaagucgugcuguaauuuaguuuaaagugaucuuacguuugaaaaacauccuucugaaugucacauguuaauaguaaguuuugaggaggcauuuggugcgguuggugaucauaauucuuauuaaaacuagugacgccuggcccccaggguguagccaggcucaaauugaugcuuuuugccgccugaucaccagcauggucuaagugcucauuauauuguagagagggccuuuggagcucucauuagauuugacaggaauucucucuagggggaaacugggcauuagcaagacuccugacaggcugaaauuauuccugcuuuauggcuuauaaccaaaugcuagcaaggcaucaucaggggacacaaaaaauugucauuucugacaacaucuuuguuacugaagaaaggguagcacugagaaaaggguagcaauggggaauuuuucagggagagcacuugaaugcuguuaagauuugucucuaguacaguuccugcuuuuccuuccuagcucucaacagcuuugucaagaucucaccacugacuuuucugucugggaguuuuaaaguggaaguacauccaaaucaagagugguauaauugugguuuccuuccuuggugcggugcccacaguccaugcuuauguugugucaacacuuccugaucuaaucuucccaugacuguuucuccuccauucugcggcugguuacagaaaaggcaguuuauugagacauuuuuuuuuucccuuagugauuuuuaauagguuuuugaugccuuucucuuucccgugugggugguaaauuuuuuuuucugaucagcagagaggugggaccuauuugugagaaagcaaggcaauucuaagaacacugaacuguugaaaauuacauugaaaauaacaagcuggugugagucuggguucaagagcugauccccaguguauguacuguaauuuuuuuguuguguccuaagucccauaauaguuugggaaagaagaugcauugugucaccucuauaucuuuucuacaugaugauagagccaaggauauaauaagcguugugcgguagcaaguaccuguaccaguguggcaguaaagcaggaggauuucgaaucugaggaucagccaggguugagaccaccccucaaagaaaagauagauguagcuguaaaugguuguccucaacuuugacuguaucauuuuuagugguagucugccuccuaucucacacauugagagucucuggguaccuuauucuaccuugacagagcaccuggagaugagugcucagcaucauggaaacuugaccugagauugcuugauucaggaguuaccagagcugcaucccaucucauucaggcugccuugggaauaugaagccaguugcagaaucacuuuuggacuuguguccugaccuauaucuccugcugugugucuuuccaggucacucgcucuguguugaucacauuaaauuuuauaauuaaaagcagguggccagaugaauguucugcaaguuaggaaagugaccagugcugguuuucauuuauuugcuauuuguggggauccagccaguggaagguagaacgcugugucccaucgagcaggacuguugucauccuaaauuguauucaagagcaaaauaaacauggcaggaauauguuggagacuggcagccaagcagucaagguuuauaacugcuuucuguuagaguggguaggaugaguucuugggacuucagccugacacaaggaaggaaagaugaucauuuuucccaggucugacuuuggugggugaagaagucacaugauauuucaguacaaacacaguauuuuacauugaaugaauuuuggagugaagguacaauucacaauuuagauacaugcuuuuaaacuuugccuagaaaacagauuuuucuuuggugugugcaugcuuguaaauaacugguagggaugcauuccuuaggugaggcguucccuauuuuccuauaaaacuucccuuguuccuuccauucugcugcugaggaauggcuuuuauuccucaugagccucugcugcccagugcccccagguucuacuuuuuuagcugugugaguuguuuguuuucaguuucuuguuuugagaaucuuaaaauaucuaucauauuuuauuuauuuugccuguguauauauguauauguugugugugcacaccaugugcauuugcaucuuaauuggcuccaagauguuuucaaggauggaacccaagaccaccacccaugucagauaucucaucuacuacugagcuauuaaaacccuacaucucugagagacuccccuccccucccaauaacaggcccaggagugacuagccagagggcagcacuuagauuuaagcucuaccagguuuuaaucaccuuguaguacaaagaggguagcugucaucaagauuggagugucccuuaacuugguuuucaugagccaggcuuguccuuugcaagcauaaguucaaugagauaaagcugguguauuuaaagcuuggagucuggaguacaagauuagcuaacaggguuuuuuuuguuuuuuuguuuuuuuuuaaagcaaacaggcuugauuuccuacuaccuaacaguuuuuucccagcccuugucuaucgucuaggggcccauguacccaggcaagggacgugcagaaucuggcuugaaaauuaaggaggcaucagaaaacaaguuauuauaauuacuaucuuuaaaaacagauuuauauucaguuauguguauguugaggguuucuacagcacagcaaguuauguggcagguucaugaggaggugagaaaaaggaguuggaaccccuggagcuggaguugcagggguuugugguccauccuguaugggugcaggggacugggaagagucuucugcaagcgcugcugcuguuguguagaugggaucucugcucuguauauccaagcuggccucagacaaagaauuggaccugggaagcucucagugccauagucgccucucccaccugacuauacugccugagacagaccuugagaucuauggauuugcuucggauacuuaggggcugggcaucucaggacuaagguucccuggcccucagcuuaugucuuuauaaacugaaagugcgaaugaauuuaagucuguuacccagugcaugagccacaccagcacuuguuuacagauccagcacucuguguacagacggaggggagcucuuuacuggagcacuuaagauguucuaccaaauaguguuuaucaagaaccacaaacagaaacaccuuucuucaguaaauaaaucaccucgagugguuuugaaagauagcuuuaguuacuggguuaugaccacuuuacauuucuguacaguuggguuuuuguucuuuuccuacugugguuucuagaagugaauuaaauaagaagaaacagaagcagcagcccaggagacuuugacucagccaacccguccaucuccauugcuuguggauauuguuugggaggguacuacagcuggagcccagcuggccuugaacugugacaaaauugaauguuuauaccuuuagaguagccauuauaauaguguuaaggaauucucuauuaguguauaguacaauacuucuguggaaaaccacuccccgcaaccccacauccaugccuugaaacuuuguaguacuugggauggaacccaaggccucacacauucuuaggcaaguauuuuacauacccagcccaacucguuauuuuaaagauugcugggguauguguguuaggaggcuaaggguaggugggugcauaaguaggagaaagguuuucuguuuuuucuggggcaggguuugauaggauuuucaaauauuguuuauagaacuuuucauuguguuuuguauguaauaacagaaaaaaacuacaaagagugauaguuucauaauuucucagcuuaugcacuuuugaugucuuuuuaaaaugaugcuacaauuaccuaguaaccuguguuuuagcacaauuauuucaaauuuuaacguuuaaaauaugaguuguuuuauuaauuugaccuacuuugaagcaaccacaggaucauuagcguugacuucuuucccauguauauuuucauagugguuuucuuagguuagggucagugguacuuuggcauuuuugacaaagauuggguacugauccuuuuugauauaggaaaaaauauagaaaauuccuaauuuuuuauuaaugaaacuuuguuaagaacugcggaaacagccccacccaggaacaguauaacuuaucggaggaugcuauguuugauuauccuuuagaggagguaagagcagcucgugcuaauguguacacagccaugcuauucuguuagcucgugggagcgcaugcaguauuugacuggguucgcuuuagcagcauauggauccagccaggguauuuacacgaugccuugugcauccuggucacuaggaaguuugagcacaaaucacuggagucauuuucuaccuacuugcagucccuguguuauacugcuguguuaugguauuguauaccucuugagugagcuggacauuuugcauauagggaugaaguuauacgugcuaauauaucagucucucuuuuuggcuuucccaguguaucgcugguuaaacacaccuuagcucugucagagaacugauuucuaggucugucaguacacuuggaaaugucagaccuuucacauagggaaugcuucaggagcuucaggcuccuuuaagguuuaauugccauucugccugucagucgucuccuucuauagcugcucugaguauuuucccaauuauuguuacuuucuguucugccuuuguuuucuguccugcagcucucuuaauccagacaaauggaucgcuuuauguuaauaaauaguuuuggacuuuuccucaaacuuuuuuuuuaacauuaugaaaaagauuacuuuuuauuuaucacuuuugacuucccaaauaguaguuuaaaguaaaauuugcuugccuuuugaaauagaaucuaaaaccuuaaccaaaacacucaucuuccucaaacuuaacaugacucccucagcuuccuuccaguuccuucuaccucagggcuuucugagacuuagcucacagcagguugucacaccaaguauuacuucaaaucugagcuuugucuuaggccuuguuuauuauuccagcucuugucuucagucugcuggcaggcagcucauugaucuauauucccaggacuugaguuauacaucacaaacuugaugugguuaguauacuccgauauucugugguggcuguggugguugaaaauauuuuggagugccauucuuugagauuuggugagaaguccuuuaccaagaacaccaaaagaaagccagccaguucugcccauuuuaauguacagauacaauaaguagcccuacccaacaaggcagagccaucaguaagucgaugggacccagguuaaaauccugacuuaagaguagcaacaaucauccucuugcuaaaauuuaaaaugaaaucuguucacauugagcacuuacaauguuauguuuauuuucuaaaacucuaauucgagacuagcucuguuuggccuagaacuugcugugcauaccagacuggcuucaaacucagauccucuggccucugcuucuugauuaaagacacguuguuaugccuggcuccauuucuucucacaaguaauuuaugguuugaaaauccccaaggcuuccaaacuucaggagcacacagcugucugaccuauuacauagaaccuuuuuaaaaaaugugucuuauuuuuauuuauauuuauguguguauuguugaugaagucaaguacuuucaagaacauuuagcugcugaguaucucucuaccucucaccccuacccuguguucuuuagacagggacucauggauccuaggcuagagacaaacucaccauguacuugccuccaccuugauugcugaaauuauuuauagguauaugccaucauuccugguuuuccacucggguuucuuaguaagaagacuugucacaauaauauauuuacauuuggauuuuaaaaaggacaaacuaucuuguuguugcugaagccuggaauucagagugaacugaguggauauugauugucacuuauggacaggcgagcugcuaguagaaauggugauuaaggucaaucagucuucaugauuauugccacuguuuuauuuuuauuuuuuaacuuucaaguuuauacauuguuacacccuuuaucauguaaaaguaaauauucagaaagggaggaaggccuuggaaagauggcuuagcaguuaaaggacagguucacagcuaugcagagaaaaggagagagaaacgcacagugaaaacucauuaacagucacucauauguauggugucugaagucuguaaauuaaaacauuuuaugauccuugucuguuguugguuuuggugucuaucaggggguuagggguggaauggucuuaccuacccaaggcuggccuuauuuugccaaggaugucuuugaacuccugaccuacuugcuucaucucuuaagagcuuggcuuacccgauugaagaaagaguggaucuggaauauagguaugggcuugguaaaugacggggacuuuguuuuuccgccuauguuagucagguuugaugugaagaaggggucuucauuuauauauuaggaguucuaucuuaaaggauccuuccuuuuuucaacuaaaauuaucuuugugcuucagcauguugaaauuacugacuuacauaguguuaaggcacuuuucuuccccaaagcauagacugaugcuuaaauagaaaggcccauuugggaagaugguccagugcaugagaaaccugauuuuggaucuccagcaguaaccacuguucuaugcugugccucuguagccuuaaugguguguggaguggggcaagcuguaggcaauuaguaggguguggguggagaaccggggagggagcuuuuuagccuagucagugaguucuggguucagugcaagacuuuauauccaaaaaaaagaaaaaaugaagaaugacugaugaaaacacucaacaucaaccugcuuuccccaucccacaugcauaaagggcaucuucuucaccccccaccuccaaaccccuacacaaaggaaaugccagacuaugccaucuuagaccuccagcccccugcuuuuggccccuuaaugacucuuuaaggaaccuuggaaaucugccuacaguguuugcuagggagacauuguuuuauuauuaauugucaguaaaaguguguucugucauacuuuugcaaaaugaagcuaauuuugaaauuuguauguauguggaaagugcccuagucaagaauuucaguucuagaggaugaaaggagcauaaaaugcuaaggagacucccuguaugggggagcacaguggucuccccaaggcuagguucccagacagcagauuggcucuucaggagccaagcuuuuguuuauuccagcacccuccuaugcuuugagcaaauacugagucagacuacuuagaagugugguguccaguggcgucuugacacgcucgauuauagaagaaacugcaucagggagguaaaccauugggauuuucaguaaauauauuacagcacgcaagugacuugccgauacugcuuguuuagcaguuugcgagggcaauggcaguauggauuuucgaauuagaagggaagggcuguucuuucucugugcaggaacaucuacgugaugucuggggaggaaauugauuuggagaacaaaaauguagcugccuuuaugccauuugaaaggcuucuguagauucaugagugaaaauaaaaagguugcuuuagggguuaggaaagggugucuuagcacuaauaagcaucuuaguacagaauggaaagggauggauggaagguauucuguccacauauagccuacaauuaaggugcuugcuccacucagggugguggugguggugguguuuuugugguuguugcuguuguuuggcacauggcgcccuaguacccccaguuuacuaugaaggcuggaguuuaacuccugauccccuguuuccaccuuaaaagauugggauuguagggauguggcaucauucacaacuauuucuuucuucucuucuuuucuuuucuaucuaucuaccuauuuaucuuaucuaucuacuaucuauuuauuuuuaaugauuuuucugagaugagcuguaccauuguaacugagcuaacuggagaucgcuucguccuccccaggcaguuuacuggaguaagccauugugccgaguucagauaguuguucuuaauauuuugguuaucaaagguucuuauuucauuacuuaauacuuggaguaggcuuuauuggcauuaggguauauguugagucuuuuagccagguagauucuugggaauuacuuugcaaaaauuuccuaucaguucccucuucuuugugggugguuauuaauugcaucacuuccaauuaugaauucaauaaguaagaauacggacaaguaaaauuaguggugaccaaagcagcuccccacagguaguuauuugcagggggagggauguuaucaaaauuguuagcaguccuuauaaacuccauucacacucuuggccuugcacaucuugcuccauuuauauuuccaucuuguuucuguuuuucaauccuggcauucuuuucucucugucugauuucacuucauuuuuuuuuucauuguaauuguaaagucuuauugauuuccucuuuagaucauaagcauuaaaaaccaaaauacagccauuguugacugccuccacucuuuaaaaaauauaaaaucauuaaacugacaaauauaggccagucagcaguguggcucucaaguauuuaguauaucuaccaggggaaauaaaguggguuagguuuuuguuuuguuuuguuuuguuuugcuucccauuuaugaagauggauaaacaauaaauaagacuugguucauuuuuauagaagugagauucagcaggauaaaugguaaaacagguguguaaguguguuuuagauugguuuuaauguaacaaaacugaaauugaaaaaaacuguccuccugaagauaaagagguuuguuuacauaguuacuagaguaaguugugugguuagagaaaguuucaaaccuugaaacagggaugugugggcauuguguguuuguguaggggguacugucugcaugugguuuuguuuuuucuauggcaucuguaaguugcuguguagaagacuuguauaauugcuuuucuguaucuaguacaggccuggagauguugguugacuugagagcuguggccuaaauguuguuaauacugggagaagcaaaaacaagaaaaguguuaccuuugagacaagggcauagcauaggacuguucucaaggacuaaagaguaaguagcccagcugucuguauaggaagaacugguuguugacagcugcuuugaccugccaguuggcugggguuucagagccuuuccacuuguaaacaggcuuacucucuuauguuuugggaccaugagcuuccuuggagccagugucuacacaacuguaaagacuggaauugccacacugaaguuuauccacuucccauacauuuuagcuugccaaacgccaaaaucauacugcuagauucaagaggggaaaugcuaacuaguaagaaucugguaagaaaccuguuccuuauuggcagacaaccuugggugugggguacuguugaaguacaugaaggauaauuugacuauugcuuucucuaagggcaccuagaguuuuccugcugguuguuacaguuguauucauuuguauuuguugacugauuuacaaagaacuugacucaguucccuuaaaagcccugaguucccuggcaguguuuuuaaacaauacuuuuagcuauuguuuuggccauauguaucaugggcucaaccuguaaaagugauuuaaaguaaguuuuucucaucagcuucugggauugcucuugucaguuuucuugugcugagauugacauugcucauugguuuuuauggaaugagugccauuauugcuucucagacucaggcagugucagugaagagcuuucugaguagacuuugcauugugagaauauuaguauugacacuguuuauaaucuggaguacaguuggaagaccagauucugcuguucguccccuacuaguuaauauggcugcacaggggagaugaauguggcuccuuuuccaagucuauuacucaggaggacuguaaauuugauuggcuguuacaauucuagcagaaucauucgauuugagagcaauagaaagauaagauauccaauuacucaaaugauuugcaggguuagccaacguugucauggagacaugaguuggaacaaauuaaauuuuaagcaauaaaauaaucuuaaagcccgucugggaacaagaaaauuuggcaguagcacuuaccugaauugaaucuuagcuugacacgauguuguuugacauugauauacugugggggccuaaacuuauauuugauacauuaucuuuaaaaaauagcuagcuaaaccagggaaggaaaacauugauauaaaaccaaggggcaugaacauuuauucugugacuuaaaggauaauuggccuuagguuccuaagauguuuuauacuuaaggauuuaaaugccuuaaagauaaaguagcuuuaguuggacauuuuaagaaaagauugauuuuagcagccacaugaguuucagggcuguucugcucauguguguuugcaaaugcaguagaaauccugugguugccucucagugaggguggaggugugagcaugcauaugucuguaugcacaacugaaauuuuggcauauacugugcuaaagguacauauuuguauuugcuaaguuuccuacuuuguggugucacuugcagacuggagaacuguuccaaacuugagcugaugacuuaaaaccggagcaaggacuggcuggaggucuagauguuauuccccuuauuauuacauuguuuaacugguuccugguugugccuuggauuugaaaccagcgaaaugcccagaagcaagguggcaaggggacacccacaugccuguuagguagauggagaugaaaacuggucugagguugagccauuugccacauucucacagccuucgauuuuccucucauccuaaccacagaucaucucaaaugauucaguaaugaccaaagugcaauauugaccuuuauucccugguggauuacuguguuucacaguccaaaugacaggaagucuauucaguucuguagaaugagugcagcauuauugagucagccuggcccugugggaacacacaagugcagacccguguaacagaauacguggguuaaauuugguuucugaugcucugggaaaugagagcuggcauguccuggaacccacacgguuagugagagaguaucugggauguuuucugaaaacacccacaagcauugauuugucugcuuuuaaaguaacuugugacuugggucuggcccuguuguaaauuucucucauuucugucaccugacuugcuguuauuccuguuguacuucuaugaacccuagggugaaaauauaauaccauguuucauaauuacaaauggaccugacugugcauuuggggacuguuuucuuuggcauaauuauucuuacguauauuuugguuaaucuguguagccaaauaucucauuucuucuauacaacaucuaguuuuucuuaagagugcaggugggguguuguuaccuuggaagacugauaauugcuuuuuaaagauugguuuucucuauagguuauauuucaguguuguaacuccugcucgcauaaaacacugauuuaauuuguaguuaaaguauaauucucgauugcuugccuuaagaaaaguugcaucaguauccaguaggucuguauauacccacaccauugugcggacugucuucuaaguagagaagcuauucuggggguuaugccuugaaaauuuguaguguuuaaaauuuguucuaaaaugcuuuggagaguuuuuuaucuuggacaguugucuguucaaauuggcuucuaacuugcagccuuuguacuggcugaguauagcugguacuaguccguagacccugaugccagcauggagauaaguccccugcucccucccucccuacaguucucucuucuggacacucuggagcuuugccuguuuccugauggugauuggaaagagauuuaagccugccuaccugggaaaccaggaccacugaccuccuuccugagggacugacuauuccugucugggagcucagccugggaauggaaagagaguucagggguggguuuuuccagcuaaaauuaaguaaaacauauacgugucacaugcacuaccacucugcuaggccaugacuguccuuggucugggucuugagucauagucggaguagcagcuuuuccugagaugcaucuugggaagagcagcugcuaccaugucuguacagguaauuuaguuauacagagcaugcuuauaaaguuagggaaucgcuggcccacaguugcauccaccauccaagauuucaguguguuaaggaagcacacaugcaaaacuguuuuuccauugauggccaagauguaaaccacagggguaaagagccuuugcuugugucacaguagacaguacaaaacagaggccacagcugucuggagguuagaaccaaccaaauauaagugacuugugucucaguaauagcugaaguaaagggaguguuguuuguaucauugcaguguaccccaccuuguccaagagauccuucuguuuuucagccaguguuacacuuuguguccucguguggaauuuuaguuggcaggucauguuuugguuuugcaguugugauucuaaucuggggaugaugauggugauggugaugucgucgauuagguuuuuccuucuacuaaucuuucuguagguauuuugcuuugagggcaccagaaacugucuguauuuccauucuguaacaagucaauaugauuucuugugaacaggcccuuugugaacucuguaacaaggguuucugaauaauagaaaugagccaguuacaagccuaaacagcugugaugcuuuugugaaagaugcagcuuuaccaaagugacaaauuaaagcccaaauguucugcuuggcaacaguugggucaaaacauuuaaaucauuaauuagaaggagcugaaaggggggagggggugcaacuuacacaaauacaucacaggcucagaccucaucuuagaaaaugcaacuagaagaauucuuuggggggaaaauuagggcagcccucaaguggggccugacaagcuugucauuugcaaauaaaucaaaagaccaucauugcaggaaggagacccagugacuagaguugcuuugucauccuuugaugagccccacacucaagccuguuauuaaaaaugaaugcauucaagaggcucugcauuaagaacauaaacaauuaagggcacuugagcuggucugcugagagcuccugaauugauggcagaguuuucugcauucugccuccagagccagaaaaugggagcaauuaguguugcuaucuccacucaggcagcccucacacuuuuucccuuuuuuuuuccuccuuccuuucuuccuuucugugaaccccuccuuguuuuuagagaggcugaguauaaagaugagcagggaaagcgauugcugagcccaguggaaaggcucagguuuaccaagugacagggagagagggaccgcaaauguugucauccacagugacuguggugaguucugcuuggcugucccaccaaagcuuucuagccuucggugcuucuguugguuugguuuuaguuaaaaguuuuaagaagguacauuuauauugccacgggaguuaggggcaguauuugaauaguaccugacauuauacaagagacagaugugacccugggccuuggguuuguguucuugucuugaucuuguuucauggaacuguaaagaaggcugcucaugccacgcaguggugaugcacaccuuuaaucccagcacuugggaggcagaggcaggcggauuucuaaguucaaggcgaggcuggucuacagagugaguuccaggacagccagggcuacacagagaaacccugucucaaaaaaaaaaaaaaaaaaaaaaagcaaaaaaccccaaaacaaacaaacagacaaaaaaaaaaaccaaaacaaaaagaaggcugcucauauguuauaacaaggcuuuggagagaauucugaaugugcuacagguuguucugaccuuaggcugauuuuauauauauauauguauauaauguguguguguauauauauauauauauauauauauacacacacaugauuuuauauauauacauguauaugauuauauacauauauuauuauauauacauauauaugauuauauacauauauuauuauauauacauauauauaugacuguauacauguauauguguauaauuuuaaguuauaacgaguuccaaauggaccaccuuacuuaaaaaaaaaaaucuuacaaacacuucauuuacuguuuuucucuaggucucaagauugggucagggaaaccaaaaccaaaucaaaccaaauggaggaaaaaaaaaccuguaauagcuuugucagccuuuaguguaaacacuacuuuuuaggauccuucccuuaguaauuuaauccugguggaguuuccccacccuaaacugacucugggcagagugcuacaagacugagacccuugggcaauuacucuugcacaguccuuacccugcuuugagcuucaaauggcacucauuaugcauuaaguuuggguguagaggggaaguguaugagccccggggagugggcucuuuaguccuuguaauugaacaaagugugaggaguaugagaagaaaaugcugaucuuuugggaauagaauccugaaauugucacacacacacacauucccuaaugacauacuuuaguuuaaaagccuuguagaguauuucuaguuuccauccauugcuggguuucaagguaucuuuugguuuuagcuccuugaaaguaugccugcaccucuacaucauuguuauuuugguagacuuaggaauuaaaccuagggcuuugugcauggagaguaugucucgcuuuucuucuguuguuguuguuaaaucucuuuuuacaguccaguuguuacaaccucucagucugcucucucacuguuccucauccauuccugcucugcuccagucuccaagaagauguccccacccucacccuaccagaccucuccacucccugagaucucaagucucucaaggauuagguacaucuucucucacaggcaguccucugcuguauauguguugagggccuuauaucagcugguguaugcugccugauugauggcuaagugucugagaggacucagguccagguuaauugugacugcugaccuuccuauagggucgcacuccuccucagcuucuuacagcuuuucccuaauucaaccacagggguccccaacuuuuguccauugguugguuguaaauaucugcaccugacucuuucugcugcuuguugggccucucagagggcagccaugcuaggcuccuaucuguaagcacaucaaguaauagugucagaccuugcagccucccguugagcuagaucccaauuugggccggucacugaaccuccuuuccucaguuuuucucucaauuuuguuccugcaguucuuuuagacagaaacaauucugggucagcguuuuugacugggauggcagccccaucccuccacuugaugcccagucuucuacuagaggugaacuccaucuccucacucuuggguauuucaucuauggucucucccuuugaguccugagcaucucucacuacccaggucucugguacaucuagaggcucccccgaccuccuaugugccccccucccagauuuucuguuucuauucuuucugcuggacuucagggcuuuacuccuguuucccuacccucaauacugaucauguuccccuuuuccaucccugucccuucucucccuuugccacccucccccacacugugauugcuuucuucucccucccaagugggauugaaacauccucacuuggacccuuuggcuugugguuuuguuguuuaguuuguguguguguguguguguguguguguguguguaucaaucauacauucaccuuuauuuuuauauaacuaucaucugauuaaguauuaauccuugaaaauuuccccaaauuucuuugucuaucaccagcuacaagaaagacuguacauacucuuuuuuucugcauuuuuaauucuuuauuuacauuucaaauauccccuuuccuaguuaccccucugaaaauccccuauccucucuccccucccccugcucaccaacccacccacuccugcuuccugguccugcagaccccuauacuggggcauagaaucuucacaggaccaagggccucuccucccauugauggccuacuaggccauucucugcuacauaugcagcuagagccuucagucccaccauguguuuucuuugauuggucauuuagucucugggagcuuuggggguacugguuagguuauauuguuguuccuccuauagggcugcaaaccccuccagcuccuuggguucuuucucuagcuccuucauuagggacccugugcucaguccaguggauggcugugagcauccacuucuguauuuguuagacacuggcagaggcucucagaagacagcuauaucaggcuccugucagcaagcucuuguuggcauccacaauagugucuggguuuggugguuguuuaugggauguuuccccaggugggacagucucuguuuggucauuccuucaguuucugcuccauacuuugucucuguaacuccuucaauagguauuuuguucccccuucuaagaaggaucgaaguauccacaauuuuggucuuccuucuucuugaguuucaucuguuuugcaaauuguaucuuggguacucugagcuucugggcuaauauccacuuaucagugaguguauaucauguguguucauuugugauuaccucacuuaggaugauaaccuccagaucuauucauuugucuaagaaauucauaaauucauuguuuuuaauagaaacguaguacuccauuguguaaauguaccacauuuucuguauccauuccucuguugaaggacaucuggguucuuuccagcuucuggcuauuauaaauaaggcugcuaugaacauaguggagcauguguccuuaugacauguuggagcaucuucugaguauaugcccaggagugguauugcuggaucuuccggcaguacuauguccaauuuucaaaggaaccgccaaacugauuuccagagugguuguacaaguuugcaaucccaccaguaauggaagaguguuccucuuucuccacauccuuaccagcaucugcugucaccugaguuuuuuauuuuagccauucugacugguaugauaucgaaacucagggcuguuuugauuugcauuucccugaugauuaaggauguugaacauuuuuuuagaugucucucagcccuucaguacuccucaguugaaaauucuuuguuuagcucuguaccccauucuuuaauaggguuauuugguuuucuggaguuuuaaguuuuugaguucuuuguauaaauuggauauuagcccuguaucagauuuaggauugguaaagaucuuuuuccaaucuguugcuugccuuuuugucuuauugacaguguccuuugccucacagaagcuuugcaguuauaugaggucccauuuguuaauucuugaucuuacagcacaagucauuuguguucuguucaggaauauuuccccugugccuaaguguucaaggcucuuccccacuuucuccuauauaaguuucacugucucugguuuuauguggaguuccuugauccuccuagacuugagcuuuauaagaggaucucagaagauggaaagaucucccauacucauggauugacaggauuaguauaguaaaaauggcuaccuugagucuacagauucaguguaauccucaucaaaauucuaacucaguuuuucacggaguuaaaaagggcaauuuucaaauucaucuugaauaaccuagguuagcaaaaauuauucucaaaaauaaaagaacaucugguggaaucaccaucccugaccucaagcuguacuacagagcaauugugauaaaaacugcaugguacugguacaguguuagacaaguaaaucaauuuaauagaauugaagacccagaaaugaauccacacaucuaugguuacuugaucuuugguaaaggcacucaaaccguccaguggaaaaaagacagcauuuuuaacaaauggugcugccacaacuggcuguuauguagaagaaugugaauuggcuuguuaaccuucuugaguucuguggauuauauccuguguauucuguacucuuuuugcuaauguccucuuauaagugacuacauaccaugcaugucauguccuuuuggggucugaguuaccucacucagaauauuuucuaguuccaucuauuugccuguaaaacucugucccaaauuccuacuuacugaauucauugggaggcagagguagucagauuuuucugaguuugaggcuagccuggucuuaacagacucgucuggacaaaaagaaaaagaaggaucacaaguacuggauuacaggcauaugguaucauucucagcgaacaucugcgccugguauccuguucacagucucuauagggucccauggaacaggaguuacaagaaauuccaccauguagauguuagaaacugaacaccagacuucuguaagcaaccagugcuuuuucaccacugaaacaucucuuuagucucauguauaucaugucuacaacuggaaacuucaagugcauuugaaagagaaugaacagaaugaugcuaggauguuuggaaguuggguuaugaguacuacaccuggcaugucucuacuccugugugcauuugcuaguguguucccuacacgaaucauacccucugccuguacaugcccuuuauaaugugcucuguaaugcuauuccauugguugucaggagaauuggguuuauauaaauuuaauccuaugaaaccaaagagcuggucugcucauggaaccagaauccaguuggaagacaaaagacaacuccugcauauaccuuacuguaaaguucuuggaguucuugcuuucucaugggcaugaccuguucaucuuauaauuuucugcucuugauccuuuccccaacuucuaucuucauucuucuuaguauuaaauaccuuugauuggccuugaaaucauuauguaguagaagaccuugaauuucuccaacucccuuauauauggucauaucuagucauuaacccuuagagguucuuguauccauucccucaauugagcuacaucucuuguacucuagauccuuucuauuaccuaaucuaguaauaaaggcagcauuaaguauuaaguauuaagcauagacagaaaacgaugaaauaauaaaggcuucuuuacagaugacuuuauugccuccuucccuccuaauuugccuuucucccuuccacuuuugcucuccucuucuuuuucuuuguuuccagguuuuaaguuugcuuuagcuaagcagggacuuucccugcuuuauuuacauagagacuauacagcuauucagggcuccuaugugcuuagccuagccaaggucuuuucagcaagggcuuggcauuuggugacacugcauuuucucaacaugucaugacuugucacacccuagacagaguucuguaauuacuaauauguuucaugguuuauguacauuuuugagaugaugaauguuaaagucuuuggggaauuaaguaaaaccauuuuauuuuaaacaucgauucucugugaagacuguacuuagcaggaaaaauauuuuaggccauuguaacuggcuuaaacacaaugaacuuuuugagcagguuuuuuaaucuauaauuuucauuuucuuaaaaaaugcaguuuauuuugguauuuuuuuuccuccccuagcuucucucagaucuuccuuguucuccuauccauccaacuucauggucucucuuucaaagaaaaaauaacaacaaaacaagcacaagaccaaccaaagaagcaccaucaugauguccauuugauguuaaacaacugcuucugaauauggggccuaaccuggaauauaguugauaaagugucauuccauugaagaaaacugauuuuccuuccccagcaucuuuucuucuucuuguuguuguuguugauaaaaaaaauuaguagauacagggauacuugaaccccuagauuugaugacuggguaugaucauauaucagggagucuagaaguuugaggccuucuuugucaggguugggacuuuuuuuugcucacugcugcuucucuuuguucugaguuuuugucuggcuugcacuuguucaggucuugugcauguugucagaguucgcacgugcaccauucuuguccugucuagaagguacuguuuccuuggagugguccuccaacuuuggcuauucgacuuuuuccacucugcacuucuucugcauugaucccucagccuggaggggagagauuuaaugaagauauaccauguaaggcugagugcuccaaggucucucacuuuuugcaguuuguccaguugugggucccuguguuaauucccauccacugcaugaagcuucguacgcucugauccauggauuuagcaguaugucauuaagaguuguguuauuccuauguucauuuaguggaauaugaaguacuuggcucauuaacagugucaggcuuggguucuaucucaaggaacaggcaauacaauacaauauaauacaagaguuguuggucaugcucuuaggguuucuauugcuguucauaaaacaccaggaccaaaagcaaccuagagaagaaaggcuuuauuucagcucacagcacuauaucauaguacagaauggagagaagugaggguagaaacucaaacuggguagacaccuggaggcaggaacugaagcaaagagaaaugcugcuuacuggcuugauuacuguggcuuguucagccugcuucuuacagcacucaggaacaaaagcccccaagguuaacacugcacacaaugaacugagccuuuccacaccaaucaucaaucaagaaaauguaucauagguuuuuccauagguagucugguugggacaguuuucccaguugagguuuccucuuccaaaauguguugacauaaagguaucaaauuguaucaacuuuggaacuucaaaccuccagaguggacccaaaaguauccaagaugguugcuccuguugaauuugcaccacucuuguaccugugggucuguuuuauaggcaggucucuauuguaggcugcuagauuuguagcuggaugagauugauaauuccuuuucacccuaccaguguguauaguacuuugaacacuauacuggucaauaggacugcuuuacgugggcaucaauuucccuucuccauguuugaugacauaauuaaauuauaucuucagcaacaggguauuacugucagguuguguaguauagccagcagucuuggcagcaguguguaauguuuggaggacaucugcugggaccccuuuagugaacuuaaaaaagauguaacccauuuuugguacugggaguuuuauugguaacauaugaugucuaguaauagguaauguucccccaccauaugauaacuucauuuagauuccaucuauacaugccuauauuuuaugaagcuucuacuguagcaggucucuaugaggccuuuuaaaaaggccuuuaguguugauuauuaccccugucuuccaucuucuacccugccuuccuuaccguuucucuccauuuaauccuguucgaguuuccucauuauuccuuuauggcacuauucuaauuucccuuccuucgaagaucuccuccucuguuucucccuggucccuuucuagcuaaccucuguggguauugaaauucacaaaccuaaaacuuaaagguuaacauucauaugcaagagaaaacauacaggaaacauccaauuaccugcaaauuucccugcuuuuucaagagcuuaauuguauuccauuguguaaaaguagcaaauuuuuauuauccauucaucacuuaauaggcauugaggcucuuuccagcuucuggauacuaagaauauagcaguaauaaacaugaacagcuaucucuguaguaguauauaguuuggguguaugcccuagaguaguauagguggaucuugagguagagguuugcaguauucugacaaaccuccucacugauguccauaguggaucuacaaguuuguacucugaggaacaguguucuccuuucuacaaauuuucacuacuauuuccuaucauuuuggauuuuuuagucuuggccauucagacuggaguaugaugaaaucucaaaguaguuuuauuugcauucucccgauggauaaggaaauugaugguuuuauaaguguuucucagccauuuguguuucaucguuugagaacucuguuuaguucuagacccuauuuuaaaacuguguuguuuucuugacauucacuuuguugaguucuuuguauauuguaaauacuagauaucucugccauuguauaauuugcaagaauuuuauucuuuagucgaugugucucuuguucaguuaaugguaucuuuaacuauuuagaagcuuuucagauucaugaggucuuauuaauuguuguuuuuaaugcuugcacugucaggaucuuguucagaaagucuuuuccugugccaagaauuucaagccuacuuccuacuuucucuuuuaucagauugagggucuggccuuacguucagaacuuugauccccuuagaguuuuuuauaggaugauacuuuuugguucuauuuucauucuucuguacacaauuugaauaucaccauuuguuaagauacucuuuuuuucuccaguauguauuuuuggguucuuuggucgagguauuaaguucuauuucauugaucaacuuguuuuuuagguuuuuuuuuuuuccuuacuauugcuauuggucugcaauacaauguuauaccugaaaugauaucucuggcaguuuuguuaaacagcacucuuuuagcacuguugcugucucugucucucucugugugugucuguguguuugugugucugugucucucucuguguguccauaugauuuaagguuauuuuuuaauauuugugaagaauguugcugagaauugcauugaaucuauagaaaagcaauguuaauccuaugaugaaccuuaagugucuuuaguuuucuccuucaguaucauacacuuuuuaauauauaagucuuuuacuuaauuugguuagagguauuacaagauauuuuuugaggcuaucaugaaagguacuauuucucugauuucuuuccuaguauguuuguuauuuguauauaagguuacugauuuguauguagcaauuuuguauccccacuacuugcugaaaauauuuuuaaacuauagaaaauuccuguagguaucuuuagaaucuuuuauguauaaaauguuauugucuauaaguaaggacuucuccccacccccuugaucucuuuuaguugucuuuguaacuaagacuuugcacacuguauugaacagguauggagagaauggacuuccuugucugguuugugauuuuaguagacuuuggguuucugucuguuuagaauguuggcugagggcuugguguaauuugucuuugucauguuucaauaugucucuuguauaccuuguuacucuagggccuuuuauuaugcaggaauguaugauuuuaucaaaggccuuugaugaguggaggauauaaguuaacauacaaaguaauggguuguguggcauuuucuugcauauguguuauuauacuuaguaaauccauccccuuaacuacucuuagucaucccugccuccucuuuccccuuaaaauagccagccccuaauucugcuuuacugucacagguuccauuagcgucuccacccucugcaaaaucuuuuccuuuuggaucaugauucuguuuguauuuuugucacacacacacacacacacacacacacacacacacacacacacuuuccugcagauguugugauuucauuuaucaucauggcuguauaagauuguauuguguuuauggaccacguuuucuuuuugccuguuccuuugcugauggacgccuaggcugauucuacuuccugacaguugugaauggugaaauuggauguggugcaugcauugacuuauccaagaguaauaucgcuggcuuaugcaguaguucuauuuucagauuuuugcagaaucucuacacuucuauaaugguuucgccaguuuacauuugcaccagcaguuuauagugaacagaaacaagcgaggcugugucaguaccccuuuucuucuacuuuuguccuuuaugucuuugaaagccagauugcauugacaugguuuuugauaccacauugaaugaacuugcuguaacuguaaaauguccccauagugauaacauugagaguucucaaugagaagguauuagggcuuucaaacuccagauuaaagugacaguauaaucuaaaccauguagauuuuucugacucaaauacuguauuuuuauuuauuuuuuaauuaagaauuguguaugauauuuccccacuacgugugccugugcaucauguguauaccugguacccacagaggcuaaacgagggcuugggagcuggaguugcaacuccuugugagccauuaugugggugccaggaguggaaccuggguccucugggagagcagccauuucucuaacucuaucauuaucuuuuaagggaacaauaaaauuugcacuuaugccuauucuguagggaguucugguaucuacaguguauuuccagguaauuauugguaacauggcuuaaggaacaauuuucugucuccaggagugagauuucaagacucaaguuucaccuucugaucugacugggagguguucuaaacauguguguggcuuugucuuuguagacugaaaucgccaagagauugaacaccauuugugcccaagucaucccauuucugucucaggaaguaaguaaaauguucagcuguuaaagugcaauuauguugcuucuguuugcaaauuagccaguuuuaagauguuaauuuuaucacugggaacaagugugaagaacaucuguuacaucucaaaugugucaacccugucauucugucuaaggcauccaagggcaggcugcuggagggaugacaguaucucaacccuaaauuauuauuuuuugaaaagugaccaugaagcauaaagaaccccccccuucucucugugugugugugcgagagagagagagagagagagagagagagagagagagagagagagagagagaaagagaaagugugugugugugugugugugugugugugugugugugugugugugacuauggccugaacuccuuguguagaauaagcuggucugaaauucacaaagagcugucugccccuuucucgaugccaccaccgcuggcuaggccuguguuugaguaauaugugcuugauaugguucggguacccuuuucuguuuucuugagcugacuugaaaagucacugcauugggauugaucuacaugaaagcagggacuuaauauauaaucaagauucguuccauggagaguguaggugguaaucaucaaaaggauaaaaugaguauucauaucaaucuugauucacagaguaauagacagagauaagccaugugguuugaguuuacguuaaaauguucagagggaguccuucauaggaguaauuggagauuagcucagcauuguauuucaguuuugcuuugaaaguguuaucuucuuuucaguacagaggaauaauguuuucaguauguaaagauaaacuuauggugacacggaaggcccagcuuugggagguuagaguguggaguuggcuguagagcacccggagcucccuccugauuuguugccagcuuucagugacccuagucucaacuagucuccucaaauuaacuguggcuauauuuuaauuaaguguagaguuggggaguggacaaggugaguuuucauucuuuaaauugaaaacagaacuuucuccuuggaguguaacaccaaaaggcuaagauaaauauugggaaauuuucuguuuuuuuuuuuuuuuuuuuuuuuuuuuuuuuaauacugcugaugcaucuagauuuuuuuuuuuuuuuacaucagagaaaauacagacugacugcuuccauuuuuaaguuucaagagagguguuugaauaaauaucaugugcacaaacacaccaccauaaccuagaacagucauccauguccuguuuuuuuuaguaucuaaagacaggucaccauugauguccauucugauauuuacuaccccacuaggaguauagugaugccuggaacccuucagaaauaaagggaagcaccgcucauuguccuuguuguuguucugcaaagugacucuugcaugaugacccaguuuuggucuuuguugucagagugaacagggacaugcuuagcugaugcuaacacuuuuuucuccuuguuuucaaagcaucaacaacagguggcccaggcuguggaacgugccaaacaggugaccauggcagaguugaaugccaucaucgggguacguggccuaccaggucuaccuccuacaguguguaucaccagcuuuuauuucuuuaugguuugauggcauaguacacaacuaaguuuguguaacuuagagaugacugauuugauuaaucagagggugaaaggggguucggguuguguggagauguauagggaagaguaagaaauagcacaagaucgaugagaggagaacacuagaagaggauggaaguaacucuccuaaauggagaaguagagacguuuauccagagauccuuggaaccacccuuguuugcugcuagugggguagaagcuuuagaucacuuucuaaacacuuuccuugcuuucuucugucgagugccguucuaccacagugaggucaacauaggacucugacuuauucccaaguaguucuugccuugugcuuucuaggcacugaaaccugugugguuguuugauuccuuucuuucuuguuccccuuucaugaauuuuaaaguggcaugccaaugaaaaacucccucaccagggaaggaguguuaauugucugcccuagugcuuuguggccuuucaggguucaugucucuugaguucagcuaucucuucuugcuggugaaguugguuucucuugucaaucacaaguuauuuguucugcauuaagggaucuagugagcugggcauucugucucuuccuuugcuggaguuuagcuccacccacuguaggaccuaaggugguucucacaugcucugcuccuuuagauuauuaaaggaaagaaggagcugaaauggaggugggguccuuuauuuuauucauaggcaaguuccucgaaugaauucaaaaucauucauuuaucaauuuauguuaauugcuugugagaagaugcccugcuggucuuuauaguucccucagacacuuuguaaugauaauuagacaugcugcuguagggauuaagagugccauaguccagugcugugacagacaauggaaccaguuaaucuaucaagguuuaaaauuacauccccacuggagaugggaaaaacacaagagccaaggaggauuaaagaaugagccccagcuugaaaacccuccuuucaucaguuucucaauugcagaucugcaguuggggugccugugguaagcuguuggcagucaauuaggugaaauaaacugggagggugaccuucauuuccuuuuaauagcuuuuuccuccgugaaccagggagcuucaguggauuuucagcuuagauuuuauucaagccgcuuuauugcacuugacagcuuagcucugcauaaacaguucucccuccuuccccccaggucugggcucugucuuucuuccccuccuguaucacauuuuugacuguuacuuagugggcucucuaaucacauucaacaaagaacacaauuaugccugcauuugucugcugccuucucuacccuuuucuuguguaaugaauugcuuuauuucagagaucaaaucaaauauucacuggcauuuuugcacauaccguguuugauuagaagagacuaaucgcgauuauacuuggagcuggagcuggagcaagaaauuuuuuuuuuaaccaaaugaaugaggauggaaaagccuguuuugauuaaaagaaaacauaugcaaagcagaucucaagggcccuguucaacuuugugggacauguuuguuuucugauaggaucuaaauuuuuacauguaauuuuucuggucuuuguuuggcaguacuggggauuggaccuucggccucacacauacuaagaaagcacccucuacaagugagccacauggccagcuaugugucauuuuucaguaauagaaucaauaccggucuguaaguucucagagacacugcucagaccuggaaagucuuuguaccuacuuugcgaaaggaggaaauuuauuagccagacagauauuuauaguuaauauucauuuuaaauagaaucagaaaauaaaaauagguuauuucagaaggguggaugaauugcaaauuuuauuaauggcuuuaguugaggaaaacguguugagauuauaaaguaagauuagcuugauaguaauaacucaaguuggagaauugggccaagaguuaauguuucacgguguguucagcauuuuagcauauacaguuuuuagucacucagaugguagggucuguauauuaauuuaugacaggagcuuugaaagcuugcacugaucagaaauagccccucacuuuacuuucaugcuauggcauaugcuugauuuuugcuugaaaagaauugcaucuauccuagaaaaucgaaguagcauaaaaucggacugacaauucaguggaccuuugcaccccuucauugcacaugcagugugccagccugucuggccagaggggaggaagcacugggagacuguucauucagcagcugugcagagaaaaugcagccuguuugauagcagcugucagauuguucuaggauggguuaggguaagggacaaugggagaggccaagcucuucaucuucauugacuuucaggcuaagaaaagaaaagguuuaguuagacaucuauuuuaagugugaaagaucaugaaagaguacccuuuaacaugcaagugggaugaaacccuucccuuccuuucaagguacuaucucuuauggguugcuggacuuagcuaaagauauuuuagcaaguaacccgaacuugucaaggacgcaaaacucuuggugaacucagcuucuguucuuggcccgacugcuccugacugggggaguaggaaaguucuuuucuuguguccuuguugagugaguaaugccaguuucuuaccagccuguuaauguucuccaauguaugagauuuuaguucuuuucuacuggccuucagccuuuaucuagcauacucauauuuaagggagauuuuuuuuuuuuuacguaguuccuuuucaacuaaauuacucaaauauuuuuguuccuuuuuuuagagauaggauuuuacuguauagcucuagcugauuugcaacuagcuguguagaccauguugaacaaccucacagagaugccuccgagugccucugcucucugagugcuaggauuaaagguacuuggccaacgcaccuggucuuuuguugaccugcucaaagcagcuuugauagcaaacugguugacuggcagaauauuaacuacaacacuucuuuucuuuugugugugcgagugugugugcccgcgcgugcgcaugcguguugauccuuuugcuguuuacauagauagguuucauuucugcaaacuuaggaucuuggaugugcugcuacacaugcauuuuacugcugagcuagcacuccagccuucuguuuaggguuacguacucugaaguucaaugggaggacagauggagguauggcuagacgauguugguuuucauacucaguaggagaguacccuaguacccugccuuugugauuuuaagagguacaguagaaauuaucuuuccugucuacaaaaugcuagaucuuuugguaguggccucauuguugacuauauaagaaaauuugaacaguuuucuauaccacuaugugaacucuggaacucaagaaauuagaagggaaucuggggaaccuuauuuuucuuuguaaucuacuugauuacaaagaacauaguaggacuuauuuuucaugcauagaucuucuaugaagacaaggaugguuucauuuacugguuagauuucuacauuccugcuucauaggcaaacucacaccucuguauacuuuaaaucgacuuuguaugaaacaaacaaacaaagaaaagcuuagauuuuugugcauuugauagcuguggaaugugugugggggggggggauaccugugugucugcccagggagggggcuacaauugccgaagauaaucacuuacggacguaaaaaccacugcacuguugccugagaugauugggucagggguuagcaaacuuggauuauuuuccuucagcuauagguguugguucucggugagacuguaguguuggaacuuuaaagacgaugagcuucgaagucuuaggucuaugcagcuaauagcagggaagccugucuuuaacccagccuuacaugccuuucuagaagaguggccauccugcuacuuggagaccacgaagguacaguaaacauggaucuuguuucaaagacuuaaaccuuaaauuccaguagucuaggaaguccuacauguucugcccccccauuucuucuuucauaaaauggucucacuuguauagcuagcccaggcugaacugaaacucaaauacaacuguuugagcuuuccucauacaacgauuauagauguacauaccacuacacccagcuagaaaaucaguuuuucuguauauucuguuucuucugguuaagucaguuugauuuucgauguuaguuuuuaaauagaauacagccuaguaucucacauagauauggagcuuggacuugaugucaggauauuuucauaaaugucuugauuuucccacaguuaaugugcauuguaguaacuggaaauguuguaauuucucuuccaggugcuaagaugugaaauuuuaguugauuccuugguaugagcguuucaugcuuaaacacauauauguuuuuaagagggagaaacugcuucauagaauauaggauaucacauuuuauagguuaagcaugguauaugagcuuuuuuaauauugagagacaguucauguuaaauugacucuuuaagucauacaguuaauuaguuaguguauuuaaccaucacugucucauucugaaauguauuugucacuacugaaagaaacccugugucuauuaucauugacgucccauguccucuuuucuaacacuagcuugaauauauaaauaaauucauuuaauauauagccauucguauucauagcacacugucuugaagguguuccugccuucuagcuaaguaucccuaaguggccugggaauugcuauguagaccaggcuggcuacaaacucacaggaauuucccugcuuauuaugccucuggaguguuggaauuaaagaauaagcuuugguacucagaucauuuauguuuugagacagggucuguggagcugagaaugaccuugaacuucugagaauuugaucauagucuucugagugcuaggauuguagaccugcuguacuguggcccuuaugcaguacugggcaucagcuccagggcuaaauguacauuagggaaaugcucuaccaaguaaauuagacuugauuauuuuuagucaauuuuauuaaggaacaauaacauggcaugcauuuaucccuuuuauuuuuccuuuuguaaguucaauaaaugaucagguugugucuacuugguggcuguuuuggauaauccugcuaugaauuauuuccaggaguugauuucuauccuuucaccauauguguccccaggauaggacucaguucuucaggcuuggcagcaggggacuaucucuggucgauuuguaaguuuuuaaugcagauuuuucucuucuguugggaguaaaccuaggagugggauuuauaggucauuagguagauuuaucuuuaauucccaacauccauucuauuuuccaagugccugcaccauuuuauaucucccauaguguguggauuccaguuucugucccauacauuuuccuaccuugucuacuuuguagagucuagccacucuggcguaaagagguagcuuccuguguuuucauuuacaacuccucucugguuuuugaaauggaucuacguaacaugguuuuuuuaaaguguguucuuguucagacccuuuaaguacuagagaucagacauaagucaggcagugaaggugggauagauaguguaguggcuagacaaaugaguuggccucagcaaaauucagaaagaguaaagauggcaaguauugagagguguggcuguuucuuacuaaucccuuucuggguuucugucacuuucuuguugcuuuuucagcuuuauuggagcacuauagacaaauagaaauucuauuuaagaaguauaacuuaguguuuugauuauauuaucacaaucaagcagaugaacauguuaaucaucccauagucuaauaucuguguaggcacuuaagaucucuuagcaaugucaaacacacaacaugguauacacacaacacagcccauggccaccaugccuuaucuuagauuuccagaaguuacccuauauaaauugaaacuuugaaucauuuggucaucaucuccuauuuucccaacuccggguaacgacuucucauucuacucuguucuucucuuagaauccagacccagguugggccugaggaugucgauuaauuaagagugcuugucuaugacacaugaagcucugaauucgauccccaauacuuccacaaauuguguauaguggaaaauaucucaaauuuuaaaagucaggguuaucuuagcuacauaaugaguuggaggaugccacccccacccccagcuacucaagggccuggauuaacagugauagcagcaaagcacauacauuggcuguugggaugauacugcagugagcaugugagugcagaugucuguuugagacaauuuuauuuccuucagguauauaucuacaauaggauugcuguaucacuuguuuugaauuuuuuauuuuuauuuuuuagaagcugucuaguguuuucuauaauaauguuaguaguuuagguucccagaaacacuaucuguagauucacuuuuugcuauaccuuuuacuaaaacuugucugguuuccuuugauauuaucuuccugaagggcaucucaguguuucugaaugaccgcugaugaccagugauggaugcauuuugauauuuccuugauaugacccauuuuuugagaauucauuuugucuguuaauuugcuauuuccuguugccgaauucaauuauaaugugcagacguuuuguccuauuucuuggaucauccaugaguuguuuucugggcacuuuuagugcauggcuacuuuaucuuuacuucuuucaaguggcuggagaauugucggucccagugagcagcugcuuucugguugucacuguugccccucuuggagaaagaggccuuucauguaauaggagauuucagacaguucuuguaguggccuugagggccaugcugccagccaaacuucccacuuggucauucagggagccgcuuucuuuauguucuccagaccccgagauaagaaccgaagccgccugucuugucaaaaacagcuguacacacuguuuuucuugugucucuauguaguguuaaacuacugagaaguccuaauuuuaaaaaaaaacaauucuaaugccuguauaggcgugugaauuaacccauccuugcugucauguuaaaaacaagugacagaugacauuugggucuguggagggcaggugcauaaaaguuuucuaaaugacagaacuguugucuggcugucuagcaaugccagcauuguauuugaccuaagacacauuuuuaacugguguugcugcuucguacucugggaaagagugauauguaccagacugucuuaggaaccuuggagagagaguguuccuuuaguaacagauggaaugaggugucggcugccccucuagaguuaacugagucugaugagaaccuucuauuuaaaauacauguuuuauuuauuuuaagauuucugcuuuucccauauuaucugcuuuuggaaggaaggccaaugcugugucugggaacuugauucuccuuuacaagucuccuugaaagagagcagggauaugggaacaagcauugagaaguaucauugagagaagcuaugcucaggaagucuaagaacaagcuuguauuugucacugcccuuaggcuccaugguaaagguggauuugugacugaguacacggaguugggugaucucuacagcauuuguccuggcugcccugggagaaaaacaaagcugucuuuggaggagguugacuuccuccucccuugugcuaugaacgugaacuugaccuuuuuuuuaggaagcagagaggauuuuagugcucgaggcucugagcccugugucauauuugaaucuuugcacccuaccuuaggugaguuguggcuucagcugggauauuaaacaugaguguguuuccuuggagaaugggaggcgcacacucaauuuuccaguacccuagaacaucuagaugguugugacccaucucuuuguuccucaguuuuacuacuuuuuuaugacauauuugcuguugugcucuuaaaauuauagaauuuauaaaaauauuuuuguuaaaggaaauaaaaauguuuuaaguuuccugagccaaagaugauugaucccaguuaccucuaagugacagacaucuguuuuugcagggccuggagaacaggacaggguaggaguagaaguucucugggcaguuagucuguugaauauucccauugauagucauuaccccaacucuuugguuuaaacacacacauccuucacaacugacaaaguuuauuuagggcuauguaagcucagcccucuuuuuaguaguguauuuugaucagcuuucuaguuuuguuuuuguuuuuuguuuuuuucuuuccggaaguuaccuuggaauaggggggauaggguguaagucuuaucugcguggauacccuaugcucccuagcacagacuggcugccaacuaaaaucccgucucugaggugcucagccagugguucagucaugcaagcuuguggagggcuaagaggggugucaugcugugcuugucuguucugcucugugcagucucuucuucucuaaucagagcugugccuaaugacccgaggcgggcuuguguucgcuucacugcuucuccgaagcuggacguggcucgugcucgcgauguaaugauaguaauugcuagcagggcaggccugcucuucauccuccuccaagcacauuucuuauggcaggugucucguuccuaacuaagugcuaaugagcgugccuagcggaccggaugcugcugcugcuucuucagguuuacgucccacuggugcugagcucuuaaaaggugacagagcaagaauuagugucuucuggaugacaggaaggugauuguacauguaaagaaacugauugugaucucgagugcagaaugaguaauuuauaaauacuuuccaagaacguuauuaaugcugucuguuugggccucaccccuguuuuccauuuaccccucuaauuaaaacuaauucucuuaggaguugaaguuugagaugaagguggacuacuaaagcuuuuuaaagguucugggagugaaaaaauuaacuguaaaaaaucgcugauuuucauugcuuaagauguugcuuuuuuguuuacuccugaggguagggagcuuaucugaauuggaauuaaaaaugaauuucugguguggguggaagcuacugaacucagcugugaaguauucuguguguuccagucaggagugggcaauaaacaagccauuuaccccugagaaaugaacacgaauuagaaccuuaagaauuuucaaauauuacaccuuagaaauauuuaacugguuuuaauauuuaacuguuuauacugucucaucaaaaauaaauucuauauuggacugcugaaauacaucuagauagaugguccugggccgcuucuuaaauauuugcuuauuuuaaguguaaugcaugagagcaguagugugguuucuuaaggacagguuuguaauuuuugcaauguauuaggugauagagucagcauagauggcagaacagaguggggcccucuacaucucugcagacgguagacagugcuucuccucuccaggucucaaccucucggucucaacacuuuguucuguaacauagccaagguguguggggcuggguuucaggaaugaaguuugggugaaaagaguaacugaaaccuugacuugaagguuucuuccaguggucagccugcuuccuaggcccaucuccugccuaggguaguauggggcagcuguagggcucacugacacuuccuucaccuuagugaaccucaacaaaugccauggagcuugguugcuucagagaaaugagaaagucacugcuuccuuacagucucagagggcucugugaguuagggauacaguacaaggugucauccagaugcuggcauuucuugcucucugaguuuugugauaguuaauguuggaugaaauguuuuuaccccauaaauagugggguuacuucauugagggguauuuaccauauaccuugguuaacuucaguuagcucaggacagguguccagcuuagagucggugacacauugaaguuucgccucagaggcacuuaaaucuagaugagguacauacauaaaucuuuuaaaguagcuaggcaugcccaauaaugagguuuguucagguggcuugcagcaaaaaguggcaggugaaaacucuagguuagauuuggggauuggccggggugauuacugagggacaaaaacuuuugaugaguugaaagcacuaaccucauuuccucuuuccuaccucugucucuguuuccuucucuguguccaacuugugguuccuuccuacauguucuguuauuucuacuuuuccucuggaugguuucucuaucaccacuacugccaccuccuccuccucuuacuccucuucuuucuccuguuucuccuuuuccuccuccucuucuuccuuuuacuucucuaccccuucucuuccuccuccuccuccaaccacugccaacagcagcagcaguugcaagcucagcaucucucccauggccauggacccccaguaccucucacgccucacccuucaggacuucagccuccuggcaucccgccccuugggggcagugccagccuucucgcgcugucuagugcucugagugggcagucucacuuggcaauaaaagaugacaagaagcaccaugaugcagagcgccacagaggugagaggccgggcaagccagauuaggcuuugcucccauacucagacagugcugcagagcugugccucgcuguggaaagccccagccccacacagagagcaaacagugagauaacaggagcugucugucgcaaagcuugcuuuccacugacacucaguucacccugccacucugcaagguuugccuugggcagcugugggguuuuuccgaucuugcuagcccgcaggcaucuugacaucuuaguaacugccuuuuuaaucccaguggccuguaccauauuauggagaacuguuaacugcuuaauuggguaauuuucaaagaaagugauguuuguuaaauggggcgaaauaagaaguuaaauuugaaagugaauguguucaaaugaaaggcuugacaauugcaucuguuacuaguuuuguaggcuuuaauccuagugugcguuaaauauugggcaaauugcacuugacuaauuuuugaagaaaaguaauuuauucugucaagaaauuaaaaauaggcuuuguguaugguuaaacuguaaaucuuauguuuacaaaaauacuguaaucuucaggaaaucacuguauuaggaaugugcaaugacuuauauaaauaaagccauuuuuugaaacugccuggggccuguguucuaauuauuccccccuuuuuuauuucuguucuugccucugugucugaacgggcgugucugugcauuucuugguaaccucgggagcagacagagagccuggcacgguaaguaccccagcgccuguugcacaugaacacagacccacuugcuuucccaagcugccuucuucgaacacaagcaccaagcagacacacagacaccccgcguguagugaccuggguuucucaguuuuucuuuuuaaaaaucauuuuauuuuugugaguacuugcccucucuucuguuguauaaaccuggccuuugaggagaggcaccugcuuugaaaguaaagcugucugcugcaauuccuuacugcucaauguacagcccagaccugcuuaaacauuugugcuauauguggagucuagguugcauauaguuuaaaaagaauauucauuuuuugccauaacaacucuuauuucaaucuaaaugguuuguuguccuugugaaugcaccuuaguuucuagcuuuccauauguuuucuuugcauauuuuauuguaguguagccuuaauauuaaauuuaauuuagaccuaagacugcaucuaguaguaaauucuuaaagacucggagcuucauagucagggcuguguguuuauagacuucauguuuucacaagcccgagucacgcauacccuuuuaugugcugaaugcuuacacugcaucuggcaaugucggggauacacauuuuaaaggugcagaaugagaaucuacucugcuuaaugaggguggcccccagauucuuccuauuuauccucauuucugaacacaguaauauuuuggccaucuuuaaagcaugauuuuaaaaaagaaagaaagaaauaagacaaugaauuuuaaaucauuucuucccugucuuuuuucuuuccuucugucuugagaacugaacccagggccucuugccuggaaggaaaguucuguaucauggagcuagcucccagugcugugcuguccaucgguccuuccuuccuuccuuccuuccuuccuuccuuccuuccuuccuuccuuccucccucccucccucccucccucccuuccuuccuuccuuccucucugucccucccucucccucugcgcauuccccccuucucucugugugugugugugugugugugugugugugugugugugugugguguagagugauucuauuauuucuacaauguaggucccaggaaaugagcucagguuauuagacuugguggcaaguguccuucauagacacacacacacacacacacacacacacacacacacacaccccugucagauggaucucacugcacagcccugggugcugagucagagguaugugccaacaucuuaaaguuuuguuguagguguuuaggaagaagauugcauuuugacaaguucaggaucccguaccaccuuucuguguagaauaggcacugcuuuaaaaguucucuuugagauaaguacugcuaugcucuuguauugggauuuaucuagggguaugaguaaguaaagggaaaaguaguuagauuuuuaaugauugcaguauaggguuuuuaaguuaguuuuagaaggaagggaagaaaacagaccaaagcuuuaaauagaaaauaaaauagcuaacaggcagaguauauagguuuuaguaaauuggcuuuguuuuuugaagaaaccuuuauauuuugcuauuuugguuucauuauggacugucaucuuuucuuccauguucauucaguacaguacaacauuuuaaaaccccagcuuuggaccuguaaaaucagcagacgauguaguaaagaacuguguugcauguuuucaucugaauuaauuuuauuugugagagggcuuuucuaauuuaauauuucuugccucucuuauuacucuuuagccuuaaaugaauguauucauugagugcuccuuacauguguggaugcuacaguuaggaguagguacacagcaaaggcauuuugucagucaaggacaggacaagugacagaaaugcuaaaagacacaugacagcucaaguguuuccacuggcaagggacugagaaaugccuuggguacaaacugaaguugcuagaggccuugcccauauguaaucuuuccaguggucacucauaauuuuggcuaaaauugugagauaucuguuggauauucauuuuuaaauuagucuuuuaguuagcauauaaaauaaaaggucuuauuauggcuuuucagacuaacaugaguuuguuugcuuauauucacucacuccuuacccuugucuuucacuuuucuuuguuacuacuggucucccuccuccaaaugucuccucccucuaguugcauccucaagaguauaugacaguuccugaauuguagggagcuauagauuauuucugaacuucauagaaacauggaggauuccaauaacauaaaagaagugaugguggcuuguguccuuuuacaugugaaaaucuugacaagugugugucuguguguauguguguauacuguuuuucugucuaguaauuaaaucuucaguggugaaaaugggaaaagccaaacauuaauauaguuuguagaggaguugaauuguucucuuuaccuaacgcggguuucaaugcaguuacauaaaauuagcuucucaacuugguguaaaauugaauaugagaaccaguggguaaugaaguguguacauucuuagugccuaaaauauuguacuauuugauaaagcacguggaguugugaaucugauuuuacuuaacucuuugcugcuaucuuccuucacuagagagaugaaaaugauaguuucaaaccaaucugauucaauguuucucuuuuuaaaauaaaauuacugaagaccccuaaggacuuguuucuuuuggugauacauuuugacauuuacaagauuagaauaaaacuuuaaaaaccauuuagauacagagcuauucaguuguguuaaucauuuuaauaguaaugaaaaagcaauguuuucuuuaaaacaggcuuuuaaugagugaauugcuucuucauauuuucaaauaucuuuaaugcuggcuuaaaagaaacuugacuacgucuugaccagccgguauauucagucugugauacaguuguuuucaugucauucuugaagaaaaugugucucaagagauuugugaaaaucucugggucauuauuuggggauggggguucuugguucaaaaucacacaacuugagccaugagaauacuuacucuuuaaugcuauuuuuugcugcuuuuauauuaaacauacugcuuaaaucaaaugaaaaacgugcagauccagagaagaagggcuguaugggaggugcuucaucuuuaucuccuaaugauaguacuacucuaaccuaaaaacauagaaaacaaaugaaacuucacauaggcaguguguuuuaauguaaaggcugaugagccagaauaccacaaagggcuugugcuggacuuuccuucuuguuuguuuaguuuugaccuauaauucucaaaauccauucccugccugccuguuaguugguuguuguuucuuaauuauuuugugugcagauaucuuugggaacagguguuucccaugauacgcauggagaggucugaggacuacuuguggguacucaaucugucugcugagccaacuugccaaccucuuccuuuuacuagagacaaggauuauacucuuaguccaggcugaccucagacuuguggcaauuuucuugucuccacuugcugaguguugggauuucaggcaagagccuaccaugucuguuuguuguuuguuuguuuggguuuuuuugcuuuuaauuuauaagccuuugcauguuaguauggcuguugaacaaauaaauaguaaagaaaggcaauauucagugaaugaguguuugccuauguguauaugcaccacaugugcuccucuugcuugccaaggccagaagaaggcuuagguugcgacaaacaccaugugggcccuaggaaguuaaccuggauccucugcaagagcaagaguguucuucacugcugagcuauuaauaauaaaagaaacaauguacagauacuguuugguuuaaaggugacuugcauuaaauuuugucuaaaaggagugucacuuaaacacaucugcuugaaguucuuagcauuagaggaccagcaaauaauuagauuucuuuaaaaagaaaaggcaaaacaggcuagaugugguaagugcacaccuauaaucccaguaaguguggguucuuccauuuuuuuuaauuugucaaacuucuuuuuuuuaaagauuuauuuauuuauaauauguaaguacacuguagcugucuucagacacaccagaagaaggcaccagaucucauuacagaugguugugaaccaccaugugguugcugggauuugaacucaggaccuucggaagagcagucagugcucuuaagcgcugagccaucucuccagcccggguucuucccuuuaaaaugcaauuaggagagcaggcaagauggcucagcugggaaaggugcuucaugaccugagcucaaucccuugggcucacaugguagaaggagagaauugacaucugcaaauugucuucuaaccuguacaugcuugcugugccugguaucuaucccuaccccuuuggguacauacauauacucagaaaacaaaaauauuuuuaaaauguaaaagagaggugguacagugcauuuauggaugugaggguccaucugccuggguggcuguguguccgccauggagcugauccaaccgagcagaccugcucaguacagcacaccucagcuuuguugaagguaaauaaggguaguaaacagucuucugucugacuauauacagauuacauuuugagaaaagauggcuuggaaauucaggcaaaaauugcgaugacgacuccuguugauuguuaacuuucagguacuguaccuaggcaguugccucucuacacaguccuguuuuggcaguauuaucacugccugaaaaaccugaaauuccugcugugaauuaacuccugaaggagacaaggucaccuagggaucuuaggugguugggguugggguuuguauguaccugugaugguggggguggaauuucuuuccucagaugagugcuaaggccugugccaccuggaaagacauuuagguccguccucaucauugcaaacacgggugucuuuuacugcuaucaaguuuuuuguuuuuuguuuuuuuuuuaauguguacggguguuuugccuguauguaaguauauguaucucaugugugccucguauucucagagacuagaugggaauggauccuguauugcagauguuuguaagcugcuguguaggugcuaggaaaugaaccaaaguccugugagaugagccagugcucuuaaccacugagccaucuguccaguccagcccucaucgccaguuuuagagagcaggcaugugguucuuuuccuuuuuucuuuugaccuugugaugauugcuauuuucccacuggaaauucauaucagcagccagccaguacagcaucuguauguuugaggugagcuguagacauaacugcuaucagaaacccaaaugacucagguccugaccuaauguuuugucaauguggggccauuucuuacguuagaaaaugcaguuugagugucuuaucagaagugcuugggucuaaagaauguuucagaccugaguuuuagauuuugggaauauuguagacauacugguuguaaauuaaaaugcucugaagucuaaagcuauuguuuaaaaaguucagguuuaggaguuuuguaauuuugccuuuuagcuuagagauacugagccauaucugggcuguagagaauggagaggcaccagaguaccccaguaagcaggcuuggcacacugacuuugcugucucuguguuaggaguuggagacauaauuguguuaaauccacuuaaguuguguuuaaguauuuguucuguuccagaguugaauuuguuuugcucuuuuagaaaaagagugggaagggaaauuuagggggcugggagguggugacggaguuacacagacauucaaguauaauaucacaggcucagucucaucuccugcaaggcccaccugcauuuggcaggauagaucucugugguccugguacaauuuacccacguucugcauguagcugugagacagaugagcccucuucaggcuugcugcagaguuuggagagguucugugugugcccuguggauacauuuucuacuuuucauguugacaaguggugaucccuaugguuaugaguaaaaguacauuuucuuuuuugaagugggcaguagaaaaugugaaugacugauuuguacugcugcaaaaguagaguguagggugauggcuuaauugccgucguguguagaugagacaacagacagaugugauggggugcaucuuuaccuaauuguuuuaauguuccccaagaaguuaauugucaguguggaauguacuaucaaauuagguucccaccgucuuaguguaacugaggauaaaugaggugucucaagucuccaaucugugccucugacacaaccacuuguccuguggggaagagaauguucccaagggagucggcauagcagcuggagauccauuugaauugugcucucucgugacaugagaaaagccugucuaacauuugcugugucaguaaguggcucucuuguuugcuauuggugguuucaagguuuaaacuugucagaggaguuucucaagugcauggagguuucugaguguuugagaaauauagcguucacaaggcauuuuguaaaauacaggauucucugagucagauuugugcaaucacuacugauaaguugcuaaagaagaauaaaguucuuggaacaagaucauaaagacugcuuuuauccuuaucaaaguaccugggucuuugcugcuguauuuaguggguucccagagugcagugauagaucaagauaaacuaauaucaagcuggcuugagguuuagccagugcuuauccuguaaauucuuacagaaaaguaugguuguaaaauugcauuuggauauuuaauguuggauauuuuaaguaacuauuggccucucuuaccacuagguugaauacuuugcugucuugcucagucuagacaacgcccugguguauuuuaugaaggauguuaccuguuacaacagugucuucacucuuaccucaagggaaugcacagaggugguuuucuuuggagacuuuuuuuuuuucucugaaauagguauucauguagccuaggcugcccuugaacgccugccugagcuuccugcuuguugcaauuccaggcuauuaccacucugcuagcauuccagguuguuuuacugagagcuuuuccccugaagaacuccacagcuguccucuggguagcauggguagaugugacucuaggaagcuuuaauaguuauuuguuugcuguugguguagaugcuccaagauuucuucugcucaaauaauugcagguuguccuaagggaagaagccccuuuaugcugggcucuucacuuuguccagucauuuccuguguaguuucuacauacaaacaggagaaacuaagcaagugagagugaccuguauuuucuuucugagauauaucagauaagccucucccuuuagagcauaaacauguacagcacauaaggcucguauaguacaggauuuuaaguuuguuuaauaaacauugguuuuagacccuaauuuguucauguuugucauauucucgugggcuuuguaaauccuaguuugaguucuuauagaaaacacaagauaaguaagguaauuuuguuuauuuaacagauuuuuaaaacaaaaacuuaaaaugcagccugaaaaaucccaggccuugauguuugugauagaauccugcccaguguugacagggcuugagaagcccuguagauuguuuauauuuaucaguagcaaggugaacugacagccuuguguuuuggccaagauaaaaaucuuguugugguucugguucuaauguuggugaaaaccuggugcucuuuuaagucuugacucagcaggcaucuauuugaugaguucugugcaggaaaauagaaucuugcaagcccuuugccauggcacacaggucuauaaggucuauaaaacucugaucuguauggagcagcacccaggaauagauguauugcuuauggcuuuacugaggacuuugcaagcacaugucuuggcucauuaguaguaggauuuaugaauggaaaugcagacagucuaucuuuaugguaguauauaugugaaggugugcuuauuggugcagaaauguauagaggcuugaggucaacuuuggcuauguuguuaggucacucaccaacuuagucuuucagacaagauuucucacugaaccucgugcuggucauuuuagugagacugguggaccagugagcccuuggauucacuuaucucuggccugccugucagugcuggggugcaagacacagcugcuuuuacaugggugcuagugaucuaaaugcacuguuuucaugaucacacaguaagcauuuuauucaccagucauucccucagccccuuuucucuguuguuauuuguuguucugcauuuuguuuauauuuauucuaugugucuguguguagguugccugaguuuaugagaucaauaugugugcaggugccccaggaggcccaagguguuagauuccauggaacaaaaucacaggaaguugugaacuuccucauguggguuggguacugagaacugaacccagguccuuugcaagaacaguaaaugcucuuagcuacggaacauucuuucuuagcuccucaugucucucacccccaucuuauuuaagagacagggaaucucauuuuauuucccaauaaagucugcucacuuugaaguggacuauuugguuuuuuuaauuguauguuuacacuugguauggaaaguuuguaaaccaaauaaaucaagagguugcgcgucugacugguaaggaaggugggucagagaccauauguccggcauugguaugucacaguagauugcuuggauauuugaauacaaguauuuucugaaacugaguuuaggauuugcuuucuugggagagggagcacuuacacauccuaccacugaaaguggagugguuguagucgugggccagucaugucugcucucuggacauuauuugguguccaaguaguauacaaaaugaaaaggaauaucuuuuaaagguugccuuugccucugucuacauaggaaucugcuauccuuucugucugaugugucauugcucuuucccaguauguagugguauacauucuacucaaggccuuuuacaugcuaggcaagugcuuggccagcucaacugcaagugguuuaggaaguugaagccauuucaauuacauugcuuugcagccuucuuuuaaaugcuuuuaagaagacguagacuuuauagagucauaaauuuugaaggaacaaaguggccauucagucaguauuucaguuuuaucuuucagcucuuaauacauguaucuaucagugacucauaaugacagucaagauaacuguccuguccuucauccauaggaacaagcagcaguacuuuuacuaucacaagaaauucagcaguaccuagaaguuacuuagaguuccaggagagcaaagacgauacaucaaacacacacacacacacacacacacacacacacacacacacacacacacauacacacacacacaugugcgcgcacauaucuugggcaguaguuggaaggcaggacaggaacauugcuguugcuuucugaauagugcaguaggcuagagcauuacacucagaaaaacugguaauggaagcaaagguauaggauacauugugucuuucuuggagaguggacuuaaagcuuaguagauauuugacuguggcaugagucagguuuccuggcucugacugaugcuccaggccucccuugcccaccuucuuugcugcuuuuuuuaauuaaauuaauagcaucaaaagcauuaagagaugcuuuguuuguuuguuuaacuguagccuacuaguugaauggggccaauuuucugauaaaaagggauguuaacugcuaguccagaccaauuuaggggaauuugcagagcuuuucaaaaucuuuucagguauaggucucuuauaagcuacagaaauggaaauuagaguaguaaguacugaacuuacagaagcagaggucaugguaaccucacaggucugccccagaaauauuagugucucagcagaaacugauguuguagaaguguagaaugcuuugggauuuagacugaguagugugggcagucacugcugaucuugcaggagagacuuuaaaguugcuucagacuuggacucuguaacuucuuuguuuuuuuuuaauauauauuuuacuuauucacuuuacauccugcucacuuuccccccucccagucaucccuucccacaauccuuccccccacuucucuugugagaggguaggaccccuuggacaucccccuauccuggcauuugaagucucugagaggcuaggcgcuuccucucccuuuugaguccuuuguaaggaaggugcuguugaagaucagauguaaaguugagugagauacaacccuacucaggauucauuugcucuguucagagccuggauauaaccucagggccagaacgucucaaauauacuaggaacugcuuugcagggguuuuauuaauucccauccuuugccagcaugggcccugguuggagucugugugguuuaaggaggugauuuuuaaaucaucaguucauggaucuagucaucucaccuuucagccccaggcucugugggccuuggagcugcuccauacugaauugugugggucauucuaccuuuuaucuaauccuccuggccauuuguuuuguuugaacaaccaugaauaaaaaaagcucagcuuuuugaaucaacucuaaagugggacaagagguuucaaacugccuucuagucccuagguuuuuuuuuuucuuuuuguuucuguauguggugaaauuguuuaagugggguauggggcuuaucccuguaagcuuggacagccaaccaccuugcugauuguuucugguaaggaaugaaaccacagccuuaaaaauuauuacauaaagcauuuacuucugguacauacuguguacugugguccucuuugggccgggaaagguagcauaaucgcugacccucugccccuuaguucucaagcagcuuggcagaaauugggguuaucugggcuuugugaaaggcaguuuuugcacugcucauucaguauuguucaaggcaguaacacaucacugaacaaauuggcuccuugcauaugcuaauccaguucuuaaaagagcucuuuguaacaguucugcuuuagccugaggggagaugggaauugaagggaugggcaggucaugucaugugaccucaaaauaucuaaaaaugccuguuuucuuugggucaacaguucaugcucagcaugugcugaugaaaguguccuguaugguuugugacauagcuuagucaaagguuuugcuuuuguguaagagcugcauuugcuguucaagguucacaacuagcuaagguuucuucuuuggauauuacauuucagugguauugacuaacaaucauauuuccaacaguaaauuaaaagaacuuaaaaauccuucauuguugugugggaaaugugauuugccaucuaggaacuacuguuacuccuaccugcaucuuuggugccuuuucuggucauaauaugugccuaaacauaaagugcuaucaggaauuauucaaaggcuguucauauuccucaccaaagucgcggggaaaugaguaaagacacaucuacaaccaaucagcacgugccuauuuuccugacacuagacagaagcacagucugaguaaauagggccucaaggaucugccaggguuuaaacagguaaguguaaagucagguuucuuuagaagcucugucuaaauguuugccacagggccuuaagacucggaagguaacaggguugcaugauuauuggcguguccagucucuaaaacacuuuuccagguuggcuuuccuugcauuacaaagaggccuaggaagaaaccuuuauuaguacuuuuuugucuugcagaguaauucccucuuggucccagacagccuaagaggcacagauaagcgcagaaaugguccagaguuuuccagugacaucaaaaaaaggaagguggaugauaaggauaacuauguaagugaauaaaggacuuucccauaauaaucauuuacuuacugcuuucccuaugagcaaguauccaggugaaaugcuagagugaaauaauucucacuucauauuguaaagcagggaaguuucuacacuggacgauguuguuuccugucagcgcuaucuauuauauugcacuucauuugggcuuagguuuuucuaaauuaguuagucacaaagggaacuugagaaaaucaaguuaguuguaccuggaggcugaaacagggggauuacaauaaagccaaauugggcuauuuagagagaacuugucuuuagucagaauuugcagagauagcucugugguagaguacuuuuaacauaugccaggccuuggauuugaucccccgcaugguaaaacacauaauacaacaaaauaaacaaaaaacaagcaaaacuaacaucagacugacuugagccacuugccuguuggccuugaaggaaggaucuacuuuggagcugcugggaaauuuagacacaaggcuucuguuucuugcuggcuugccuaagccuuuagcuaauaauaacaguuugugugcugggauuagugccaggaacccugugcucugacacagauuauuucauuugguucuuacuaaaacuugccagcuuggguaucaucuucauuucagagcuaacggaacuugcccagagcuuguguuucagcagaggucauggguuaguagcacucuggaagcaccuuauucuaaagccaugcuguauuacagcccugaaacuauuuuuagaauuggccuuuuucuagagguccuagaucaguucacaguuuauaucaugauuuaagaaacaucucaaaaaccaaggucauuggcucuccaguuuaacccaagccccuuaaauauccuucugccucuaucuguugcuccaagcugcauguguuugccuuuucauuuggagcauucaaugccagcaaucaagaggucugugauguucagaagguggaucaugugcugaugccugguucuguguuauuagguucucuacaaggcuuggauauuuaauuuagcaacauggaacuuagaaucaauaucuugcuuggccuggcguaaugguguucuggcacuaaugucuugucuccuuacaaaaaugggauuggggugauauaaugagauuauauuagaacaugugagaggcaaaaccuaagaccagaacuuuuugacagaaguauacuguauuaugcugguuuauauuugcagaaggcccaauacaaagcuucauuuuaguuaucaaaaguaagaaugauucacuucagaaugcccugggaggguuagagggugcuggaaaugagaagcuagaaaacagcacaaaacucugaaaacaggaugaagagagcuuucuccagcagaguacgaugaauucuguuuaccacauccugcuacauguuuaugaagaaguauaaggcaggaguuugagaucccaaacagaaauaauaaaauguaggaacauuaauuauccuacuugggucaucauaauacuguauaugucauauuuuucauugaaagggaaguuuuuuuuuucuaaauuaaaaaggagugcaaugguaauaaauucuuugcuauaguuaauccauuucaccuuuuguacugugaacguuuuaauaauucuuuuucuacaagagaagcccuucuagcuuaugguugcucaccauugcuacucuugacagcugggaacauucgugccuuucuuugacacuaggaggauacauuuucuuuauuacuuucuuuucaaugaaaauauuucaguaaauuuuuaauuuggauguucugaccucaucauuggcugucagucuauguugcugauaaacuccauauacuuucguauuggacuagaagugcugccuggcucugaaagcuaagacuaccccccauccccgccccagugcccgugacauaccuuguccaguaaagccaaacuuaucaaacauagccaccaacuaggggccaaguguucagacaccugagccuguagaggauacuuauuuauaccacacuaagaaaauagaauuucucaaacuuugauaugggagugaacucaacuuuaacugagcaguuuuucugaaugcaauguaacccugggauuuccugugacuagccaccuuuauaucuaagggaaaagacaguaaagacccuuaugcugagugguagugcccuccagcuaccucugucuguuuucuuuccaucucucaauaccuuaggcuaaaaagccuuaucuuuuuuuuuacucccauauguauggugccugaauguacuuguggaugcaugaagaugacauugugucuuugauagaccuccaauuauuauuauuauuaucauuaucauuauuauuuuggaggggggguucgagucaggguuucucuguauagcccuggcugaccuggaacucacucuguagaccaggcuggccucaaacucagaaaucuaccugcuucugccucccaagugcugggaugaaaggcgugggccaccacugcccggucccaacuuuuuguuuuauagaggcaagagucuugccaauuuuccauaguccaucuagaaugcccagagauccucugucucugucuccugaguacuggaguuacagguacccucugagccuguauaacauuccugugaauucuggggaucugaacuccaguccucauacccagcgaguacuuuagccauuaaaucuuaagccaccugcuccccuacuccugaaacagaacaucuuauauaguagacaggcaggcuucaacucacuuuguaaccaaguaugaccuugacuugaacuuugaucacuugaguacuaugcagcacuacaucugauuuuguacaguucuaggggucaaauccagggcuuguccauaguagacacucugaacugagcugugucaccagcuuccaaaaguucauucuuuacaugugauagaucuuuuauuuucugcuauaauuagugaccucaugggaagcugguguaaguuaauuuaucuuuuuuaguuaugaauugccugugaaccccauacugacuagauguauaucuucaaguauaaaagcaaugguguauuauucuuuacuuugaaaucaagugaacugaauucugauaaaaaaaaaguauacaaauuguuauucuaagaaagauacugucaauugagacaucaagccugcaauguauguauguuuuaugagcaaauugagacuaggcagcugccuuguacuacagcagcauucagcaggagcucaguguaccccaggcuauaggaggagggggaagguggugguaaaugcuuauagacuggaaggaagcaagcguguuuaguuuaucugcuaccaagaacuacugaaagaaauuaacaguucaaaacguauucuuagccuuuucuaaucaaaauuaauuuuuuucuaggacagugauggggacaagagugaugacaacuuaguuguggaugugucuaacgagguaacaguguuuuucgugaaggauuuucuugacuaguguugagaaaaguccaguuguaagugaguggaguugagucacguuagcugagucuuauaccuucauguaucaagaauguaauggaugcuuaaaaauggguacucauaaccuaacuaaagcuguaauuucccuuucaaaacaugagguuugggaauggaccucaguucaugaguguuugucuaccauuggcgccaacucuguuugauccccagccccccagaaagaaaaaucugcuuccuaagucauuuuaauuucugugguugaugucuggcuagaggauguuccuggguauugguagaaagaugauuguuuuucuuaugauaugguucuggguguuuuauaaauaccauuuuguucauuuagugagcauuacacuccucaaaucuaaaagauuuucaguauuauccuuuaguugagaguaugaaaaaguauguucauucugagcuaaaacaugucaacuuguuauuguguguugaggacccuucuucuccacaugcaagccccacacacucaccccgggaaaacggaauugacaaaaaccgucugcugaagaaagaugcuucagguagcccggcauccacagccuccucuggaaguuccucuucccugaaauccaaagaagugagccugguagguaggagcugcuuuuuuucugggugacacugccauuuccuuuguggaacaugggauccugaagugugugaaguggggauuuugcugcuuaaagcuuuuguguucaaguguuaaaacacuugcuguccuauuuacuguuccccuuuaucucauuugucucucagagcacaauuagaguggguguggaaguuucugugugcaucguuuuucuccuuauacauggucaugacucagcucugugacacucaauaagugguagugaauaacucacaaggaaucuugauuuugcuaagcuccuguuuaugggguaaacuaagccauugugcauaucccauccucguuggcauguacacaggagacaugggaucuucagagcccauucaucauagcccauucaugugguccuuaaaccacugaaucuuuuauaacuucggaugguagugcuugccuguagugccuauauuuuggaggaucuggcaggaaggaagcucuugggauagaggucaagucugucuuacauugugagacuaccucaaagcaagucuuuacuuuggugaccucaggguuaucgcuuuaugcaaauagaguaaagcaaaaccugaguaacuuguugagaacauucuaucaaauccuaagccagagcugggaguuuuggcucacucuguuuucuacacccugguccuucuugagcaguguucuagggacacaggaguugagagauaaaagaagauacccuuuuuauggaauuacugucucaaguuauaaagguugccaacaggugauaagucuccugugugcacggaugggucuucauuagcuagguagccauagagaagagcagugugggaaggguacuucaggaacuuuauuucugaagugcugguuugcuucuaaaguaauugguaguuccacugucugucaccaucagucugaguccccaaaaggugaggcugagaaaagguuuccacuuuggagauuguagccagguaggcccuucccagugacuuggaaagaaucucccuguggucaucuuucucacccagcgaagacccgaaguucacaagcuucauggaaaacuuguuguaaaauaaaauuuguggaggaucaugcucugugugucuccggcucgaguuuuaaucuggcaggaagaugaaaggucaacauuucucacucacaaguuaaugcugucgacauuguguggauuuaugaaaauuggcuaggguguugcuagaaggugcccagugccccagcugcuguugugauaaauuguguaauauggcuuggauuaaaaauaauacucauuuaauuuguuuaaugauaccagcaugaaaaagccaacacuccuguucugaaauccagcacaccgacgccucggagcgacaugccaaccccaggcaccagcgcuacuccaggccuccguccaggucuuggcaagccuccagccauggaaccccuugucaaccaagcaggucagcaccccuuccccuacugugcuuuguuucuucugucccagcuugaugugcugucugcuaaucuccugacaguuugccccugaaugugaagcacuuggcacuauucuccugucuggaaaggcaugggagcaagcacauuuguccuggaucccagcagcugcaccaguuacucuccagaaguuuacauucagcuucucuuuuauuuaaaaauaguccaaauccaaugguuacaguaaaguuccucauauuauuccaaacauaaucuuacaagucugucauuguaugucugacugauguugcuaauauuaagccccuugucaaccaaccaaccaaccaaccagccaaccaaaguggcugauuuuguagccaguguauacauuuugccgccuauagaugacuggguuuuguuuguuugucuuguuuuguuuuguuuuguuuuuugcuacaucuucaggagucaggaaguugggagguuuugcuaauacucuagcccaugaggucacucauaacuuugaauuugaucuuccucauuggacaagcuaaaaaguagcagccugaguccaggggaauuaggcaccagaauccccuuccuaaagccuugcucugguuugcauaaauccaggauuugguuuucauuuggaauugguaccagggaguggaaaguucggacucaaggagaaaucuuggauuuuauccagaaagucuucuuuugagauuaagucagguaaacacgcagacucuguaccuuggcuugcccuuuaugaauugagugcaaagauguugauuaauccuccuggcuuccuggugcggcugcuuugccaaugaggaaauuuggggguugugcuuucuguccuugaggaauggaccuugugucuagauuggggaucaugauugcuauccccugaagcccugcccaucaucauaacuaaugacuagaaucauuggucagguuuggcaugauagucagucucaucauacauggcauguuuccuugcagcagcuggccugaggacgccccuggcggugccuggcccauacccugcccccuuuggcauggugccccaugcgggcaugaacggagagcugaccagcccuggugcugccuaugcaggucuacacagcaugucuccacagaugagcgcugcagcugcugcagcugcugcugcugugguggccuaugggcgcuccccaaugguaggucaugugcuugggugugccccagggacuaggcaacccaaaggguucagggcccaagguguguaguacucaggcagugagguucuggguauacauacuuggaugaaaggcauagaguugcauccugggugauugggucuaagauauacacccuuacugcuuugaaugggauacacccaacgacaugcuugaaaaccgacaucaaagaugauucucacuguucaagccucauaucuaccuucuugucagcuuuggucaguauacugggcuauuaaauagcuagagaaaauuucuuuuguuucauuguauguguagaugaaaacagcaguguuuagagguccuuggauggaugguuccagaauaggucaccaaacguaauguuuuuuuuuaaucugaaaauauugaagugauuauagucauguauuuuugaccuguuuuccuuuuuuuuuccaucuuaaaaaaaauuugagaagccuuagccuuuucuuuccaugccuauuugucucuuacucuggcuuagguaaaagaagccauuuuugcaugccuuggacagauuuuaaaaccauuaggccagucuuuccauguugcccuaucuuuugccauucaaauggacuaguuuuuuuagcuaaaagauacagaguuucauuugaaagguaaaauuacacaaggaaaaggaguaaaauacaacucacagcaaaucucuccuguaagccauuggaaauauauuauggucagguguuuuguuguuuuuuuuuuuucccuuuaccuccuugaguagauugccccuuguaaucaaguguuaaagugucuaauuguuuuuauggugcacaaauagggauagcauagagucuauaaauacugaccaugaugcaucaguuuugcuuacuaugguggggggagggggugcucuugucauuugaggauaauagccuguuauacuucagcauuccaaaguucucuaaccuguccccaaggaagaaaagaaugaaauagcccaugguauuagugcuagacugguuaguauccuuccugugcuugcugggugaggcaggacagcuaaugucuauggaaaauguuuauccuggaaagcugguaccgggaguguacaaauugaucacacuucaucuccacaucacaaaaaggaaguguguuuguaguguuuuagaugagguuaccacauuguaccuuuucuuuggaaaaauaccagcccuuauuucugugcccacugaacauugcuuaggggauauauggauuuguuauaugaacuaaauguccacagaguguccaccuugcaugaacugagucugccgugcuguacuuucauuuccagguugguuuugauccuccuccucacaugagaguaccuucuaucccccccaaccuggcaggaauaccuggagggaaaccgugaguaccuuuauuccuugguuuuggucuguuucagaggugauagugucagcaguguggaauccccaagggaagauagguuuggauguuuccaaggagacuucuaaggagugcuaccacuuuucuauaaauagguaacuuguaggugucaugccucuaucuucuccaugagugugagcuccugagcucaugcguuuaguuauuuuugaagagaagcaauagaagaugaugacagguaggaggaaagagcuggagaugcuuuugcaggaagcugcuaucuugaugugugguugagagacagcugcuacauuuucgcucauguaaauuguacacagguaaauugucagaaacucuuaaaagcauagagacuuaaacugcuaaucucuuuacccagaacaaugcaacaguuucuguguuuugguagaauaaguuauuugguugguuugucuuguggaacacccaugucccaguuuugcuggguacuuuacuuugccacauaacgcuuauuaagaggcacagcuuccuuauggggaaacaagggacguuaaguuaaaggauauaaaagcauccagaguaugaaaacacucuguuguuuuauucugacuuauuaaagaaacaaauaaaaaaucacucccuuuuaguguaaguuauuagaagcauucuuucaaagaguuacugauuuuucucaaguuuuauacaaaucagaauuaaaauguaaaagcaaagucaaucucuauguguguggcaaggguuauuaugaaguauuaacuuuacaaaugagagauucuaaaggguaugccucgggccuccauuugucuuuaucuuaccccuuacacucaaggauugucuuuaccuuuauuugugucuugagggaauaugaaggacaaguagcugucuaguaggaagagauaccgaguuacaauacuggaauauaugguugguguucaggacauguguaauguagaccauauuucuuaaaguuuguauaugcauguguuugugugcacaugguuauagauguucugugcaccuaagcaugcacacaggcaugauuugaagcaaaacauggggauauucuaagucuuuccuuggauuguggguaucuuguauuucuuuguguuugaagcugugcuaacacuagucuuagugauacugaaggcccugcacucaggaggcagagucagggugauugcaacuuuggauucuuagacuauacaccacaaugcuguuucaacagcaccaacaacaaaaagcccuacaacuauaauuuaacuuuauagugugcuuagagacaaaggcuauaguagcagauuguuaaaacuuaagguguccauugauaucuggaucugaacugccacugcuaacauguaugcggagaugaagugagcugcaguaugugaagaauacagaauuaauugauaguuuggaaucagugaaauuccucauuccuagguucugguuauggcgucuuauugcuacgauuaacugauuaguuugccugagugaauaccuaccauuuauuuccucggugcuucccagagacuuauagugauacauagagugauauuucugaaacaggauaauuauuuggagaaaaaacacaaauucuaaguacuauuuguuauaagagucaguaguuuugaagugacugucaucugucuaaaagcuguuagugacugggcucauuugugacagacaguggcaaguguuuacagaccauccuuugauagaacugauuggaggcacuuaagagaaauagagacaaaucaacauguccuggguaggaagaacaaagaauaacaauuaugcaaauaagugagaaagagcagcugaaggaauauuugguuaggccugcucgaggugggguagguauucaugguuucaaaauaauacccuguauuugagaacaaaggacucuucaggaagaggcuucucccuguguuuccuacauugagggccugguaguguggccacuaaaagaacaacuaucaauuacaauuccacuuguguuaaguuauguauaggcagagcaguaaaugacauguaaacacacacaugaacaaaauugggaugggaaaugcccuuagaaaggagcauacacagugcugaagcucaugucagccaggauccaucaaagggacagccagaucauucagagggaaaggaguaaaggacucguguacacauggaugagugccuccagacaacgaccucugcauucagcugggcuggagagacauuuacaucugugguauaaauguuuaugucuguaucaaguugguuaugguaaccucuucaugcaacagcauaccucugaacagauaugcccaaggacaggcaacuugcaaaugugaaaaucuucaggcccuacccccagaggccacacugugcugccaaauggacauccucuuaauauuuguaggcucaguugcaaaacacagcauuuuacccauugcuuuagucuuuccuuauaggguacaguuugaggccaccacaucugcucaucaaguuuccaggcacuguuacuucuucccugugccucuuguauugggaccuacugcacccgaaugggagcucacagcccaggaaauauguggugcaaaagaagcauuuguccucuacucuuucagagucucaacauggucuuggggcagugguuucucauuuuccuaaugcugugacuccuuaauacagauccucaugcaguggugacccccaaccauaaaauuauuuuuguuccuacuuuauaacuaauuuugcugcugugacaaauuacaauguaaauaucuauguuuucugaugaacuuagaugaccccugugaaaaggucauugaacccccaaagaacaugcaagccacauguugaaaaccacugucauggggacuaaacuaaggagacagauugacagaauacacauaaauuauauuaaguuuuuauguauuguugagauuccucacaagauagaugguguacuggcuaguuuugugucaacuugacacaggcuggaguuaucacagagaaaggagcuucaguuggggaaaugccuccaugaaauccagcuguggggcauuuucucaauuagugaucaaggggggcaaggccccuuguggguggugccaucccugagcugguagucuugguucuauaagagaacaggcugagcaagccaggggaagcaagccaguaaagaacaucccuccauggccucugcaucagcuccugcuuucugaccugcuugaguuccagucccgauuucccuugguaaugaacagcaguauggaaguguaagcuuaauaaauaaacccuuuccuccccaacugcuucuuggucaugauguuugugcaggaacagaaacccugacuaagacagguaguucaaguucuuucacccugugcuugaacaucaggcacauaauucugaagucuucuacuuacuuguuuagaacuuaaaucaggcuuuuaaaguucuuuugguuguauagagccuaaagggaaaagaaaaucaugccauuagagagaaauucccucuuaggaagaaacuguuuuauaguagguaacuucuagccaauaggggcucaucuuccaucccaucucccucugccuuuucugaugauuaacauggguaccauagauagcuagcuuaguagauuugaaaacuuaguugucuucaaacuuagaugauguguuaggguucuucagagaaacagaacuaauauauaauagaggggaagggaacuuuauaugaagaauucacccacaugauuaugaaaacugagaagucccauggucugccaucaguaagcuagaauccuggggaaugggagucugaaggcaggggagugggauggaugggaagauagagcaguuucagcuggaguuugaguccaagucugauggccugagagacaaggguacuggugucacaauggcagaccuggcuaagcagagagugaaagaaacaauaaaccuuucucaaccuuuuugcuguuuuggcugggguuuuuguuuuguuauguauuuucucuuuuguuuuguaugugcuguuuuugccauuguuuuggacaaugcccaguguugccugccuauauuggugagggugggucauuuuauucugucuaccaaugagaugcuaaugucuuuagaaacaccucccagacacagcuaggauguuuucagccaucugggcauucccuagucugggcagauugacacauaaaauuaaacaccacagugauauuuggcuuuugaaggcuguugccugcuaaaaauagugucuauucugugcuuugcuuuugcuguguggguauuaguuuaauuuguuuucaacugcugggucgucugguuucuuuaguuaccuugaauuagggcuugucuuugauguguaguuauaguugucccuccacgaacccccuuuucagaaaugacugcguuuaugagauaggaauagagccuguguacuucuucuucacauuuguuuauaacaggugguuucuuuugcuaguauuuuuaaauugucuaacauaccauguuuccuccagaaaccuuagggcaaaaccuuagguuuuguaguauuuggcaaccuugcucuguuggaaauguuuaccacguugguucuugggcaucucauguugacucuccugaguaacaucccuuuguaucaacaucuucuauguuuuuuguuuuuuuuuuuuucugcuagugaucaggcaacaguagaugacuuguucagacucagugguuaagcacuaguucgucuauggguugauggagacauuucauucgacuuuaaagagcugugggacaguaaaggcagaaauguccuaugugauagaugcuguaguaaagauucagaggaacaagcuaccugcagggagugguggaugggacccaggugauguguaccugagagagaggggaugcucuucuaggcaaaagggaacguuccaaguaaugugggacaccuugaagauuggcagcaggugauguuuugggggcuggcuugugcuccuaaguggcaaagaguguuaguguccuaugaaacaggacuaguuuucuuuaaaaucuugaaggaccucagaaucuguaaagaggcuagagagcuaguuuugaacuguucaggcuuuuuguaccuguuaauauaguaaggacuuucacaucagcagugccauguccuugggcaacagggacuuacccuucgucuccagagucucugcuucauuacuguuuacuggauucugccagugcgguuugaucuauuuccaggucaccggcaagucuuuaaacaccgguuuuccuuugguugcagaacacagcauagcuuuguuaacagcagacagacugcuugcucagaaugcauucuugcuauucagcuaacuguucugggaagaaccucaggacaggacccuuuccuuuuagcacuuccucgauaccaugugcccaauaacugaaaagcccuuugcucucaauaggugcugaucucauuuccuuucaaagugguaaguccacugggcuuuccuuucaccucucuaguuccaccuccugaugucagaaugagaagugaaugaaucaggaggaguuuagccaaaaggcuauggaaacaggggccuccuggugagguauggacguaguguagaguggucccagauccuucgguuucuggcucauaguuugcuacuacucuccucuucccucuggacauuuguucacaucuuuaccuauggacuugucacugagcuugaucuugugacccacuuaccucauuagacaucucuugcuugccugauuguucccaccuguguguuucucuuuuccuggaucccaggauacuugcacuugcccaccggaaguauuuucagcagagccucauuggcuguuacaucugugguggguuaacaacacugcuccuauuguauuauuuuugguuuuaagguguuguuguuuguuuuguuuguuuguuuguuuuuugagcccuguggaucagggaacagauauaucauaggcuggagaauagcuagucaguaagagcauacacguuugguguagcuaucgagcuugugcccgggucaaguccauuucacauaaaaguuuagguuuuucaaccuggucuuggacuuaauguagugggugaguugguuaggagagcaucccuauacuuuuuuuugaauaaauaagugggccauuuaaaagauguaauauagguacagagcagugcaucuaggauguguauacugcucaauugcuuuuuauuggcaguaccuaccucuuccaacagcaauuacauggaggaggaauacaacccuuucucuuagaaugucugcuuaucacuucagcuacagggaaaaccgauacuguuuuuugccucuuuaugagcuuguacaaacauaaucaggccauucuuuugucugaccuuaucuguaaucaggucuagaagaaugguccucacugauugacaguuucagaucaagugcagucugaaaguauuaacaccauaaauaaacagauuuuauuuauguguuuagagagggagacagagggaggauauguauaaguguauguguauguguauauguauguauauugugguauguaacaaugagauucuaggauucugaggaguagauuugcuucaugucacauggaaagucaguugcugucuuaucuauuggcuuugcucuaucugaauacacuaaauauauacacgugaucccauagucucacaauauagcauagucuagccucaaauucaggguuccccugccucugcccccgaagagugcuaccccaaucaaccucauacauuguaguuugugcauuguggugcuugugucuuuaauaauaaugaccucaaaguguaaggguauugauuugauuagaaugcgugauacuuguucuguuucguuauuacuaucuuauucuucuugauuuguaaauaaaacaagcauaauuuuuacauagauuccauagauuguaccuuggaaagcuagcuauaauguggucuuuuguuuuagguguccaccugggacccaguaauguauaccaugaggauaaggaaaggcaguugugcuaacaguugguuugcaaauucuccauucuguuauuccuaauuccucagccuauagagaagguagugucuucuggggucucuaccauugacauugacaugauaccauguauugaagguuccuuuuauuuuugugggugaauaacuaguuccagccaucucugauccccucuuguuuuucucucuaugaaucccuggaggacagcucacagccugaguauuguucugguuuguucauuuguugaggcucuauagcuucuucuuaguccccaagacugauuuauuagcauccauaugggcuucccaugggacagauggguguuuaaagcucucauugcaguguaaauccauuuuaaauugccucaauaugaugcuuacaagcuccuguguuguuggaagaagagcacaccugggagauagaucucucaaagacuaguagacagcucucccaucuguacuugguacagauacuuuguuaaucugaaacauuuaacacuguaaccagugggauucuaauugaagauaaaauagccucccacugaaaaccugggauugcuggaagggcaccugaugcaaauuuguuuccuuguuggggccccaucuugauguaugaagaccaagccuguuaugaggagcaccauucccuaggcaagagagccucaacaaugcuaagaggagaaagcuaggugagagugagcaagugagguuggauccauguguuuauucucucugcucuugacuggauuugauacuuuaggcuccuugcuugacuucaccuuaguugggggcucucacaugggauugcaagccagguaaacacuucuuugucgaaguugcuuguugucagagguuuguuauuguuuuaaccagagcaacagaaauggaacagaaccauuacauaacuuugcugguagauuuuguccuaccaguuaauugaaguccagaauucuugaagggcagaaauaauagacucaaaccucuaagcuuugguaguuuugucuccuagggaacaaaguacuauuugauugaaacuacugacaucccauaauaaguauugucagucccuauucaaauaucuguauuaugcauauauauuucgguauuggaaagaauacagagagucuuucugaauugaaaaaagucagugcaugauuuagaggagugaagaauuaagggcugaggcagugagauauauaaucucccagaaaauucuuuguggcuccuguucuauagcucaguuauucaaacugaguuauacuagcugauugauaggccugaugacacaagccagcuauccuagcuaauuggggagguucaacaggaagauggaaaguucaaugccauccuguaugacuuaguaguacucuguccccacaaaggggagcuagagauagaguucuguaguagagaccuugcuuagcaugcauaaggcccugaauucaaaccuccacaacgcaagggaaaagaaccagaaccaaaccaccagaguaaccuucauuauucugucuccaucacuaugggagucaugauaaaacagcauuguuaacagcuggugacauauagccucuuuccaguggucauuaaagccaguuuuccaagagauaauggacauuuaagaucuuuccuguggaugaagggaggaacauuuaaagucuucauuuauuugauauguugcuucuauggagggaaauaguaaccaaucuuuauuuccaggccagcgaaugugcauuuuaaguacagccucauugagaguugauauugaguaucaguuuucugccaaguuauuuuguacaguuugaguuauuagcagaacaaaaaguucaagagcucuguuaguauuuaugguguuucagaaaggacucauccuuacccaaggagguagcaggaacagaaaaauccuucaggcuuuguuuaugcuuggugacuagaacuccuagaucuaugaugucugagcuagagacgaacagggcucuccaggcuaggaugagaggagaagcccugcacaucuuccacucgaaaguggcuuuguugugugguuuaugaugcccauugugugcuagcucuagggagucaaguagcaauuuaauacaguggaagaaaaaaaaaauaaguccugaauuuuguugccagagaugaaaguacaugacgaggauuaggcucauuugugcugaacagggaagagaacugcaggcagacuacaugaaaguuucacuugcuuaugaaagucagcaacccagggcaggugucagcccagcaggaucuucuaccacccucugaagugacuucucaucuucaaagucagcuugcagucugaaggacuuccugaguccagucagcuugcuuacuuaggcauugggaaggaaaggcaucacucguucuuucuuuauuguuuucaucaaaccuuggccuugcacacccuauguagggcucaacccugagcuguccccaguuccuuugcuuuacuuuuggaaauguuagaaacuuuaauuuuuagguaaguuucagguuaauagaaaaauguacagaaaguacucaaguguuccccuuuccuagcccccuuucaaguaaagaacuaaauugaaaguacucucugcaagcuccaccugcuucccauuguacagcauuugcugcccuggcuaauguggaacugggaagaugcucuuuuagcugguugcuuugccuccaucagauaaaauugucguuuugagguaaauaugagaaauuguucaauaggaaaucugucauuugauaucagaauuucuuucuuucuuuuucuugguuauguaaaggaguuugagacaaaaguguaaaauaauauguuuuaaaagcaguuuuuaaaauuuuuuaaaauuauuuuauguuuauauguauauuuuauacauauauguuaauauaccaugugugucuguucgugggggaaauaacaagguuucagagucccuagaaguagauuaaccaauguuugugaguagaccccauguccucugcaggagcagccagugcacagaaccacugauaucuuuuccagaagcuguuuuuguuugcauguuuauauguuuguauuuucauucuaagauacauuauuuuuaagauuuguuuauuuuauguauaugaguacucuaucugcauguacaccuguguggcagaaggcggcaucagguaauauuacagaugguugggaggcacccaggaauugaacucaggaccucuggaagaguagacagugcucuuaaccucugaaccaucucuccagccccaugauuaagaguucuuaaagacaucaucuuaagugcuuuaaauuauaagaaaucauguaugagggauguggaaggcuacaucaguuuagaagcacauuuuuauagugagauuugaaagaauacuuuucagaauuuguaagaaacaauuuaaaaacauuuaaaauagaguuuuguauacuuuagagcauuguaaaauaguagcuugaauacagacuuuaaauguuaagacuuuugaauucagaaggagaaaccaugacaagaaaguccccaucuuuccccaucuccaggcuauagcucccuuugugauaagugguuuucuuccauuuagagcauacuccuuccacguuacugcugauggccaaaugcagccuguuccuuuucccccugaugcccucauuggaccugggauuccccgacaugcucggcagaucaacacccucaaccacggggagguggugugugcagugaccaucagcaaccccacaaggcacguguacacagguggcaagggcugcguuaaggugugggacaucagccaccccggcaacaagagccccgucucucagcuggauugucuggugagcaagcaucagguucaccugagcuauuuucauaagcagagaguagaagccccucuguuuccuauguuagguggucaagcuucugcccuauucguucauugagcaggauucaguuacugccacuacacugguuaaaucccgguguugaucggcugauuuuuggagauguuugcagugguuuggagcucacuuugaacacacgauuucuaagaucguauccuaugcaguagagaaaaaguaguuaauguggacucuugaucccagcuaucuacucaaaauuucccuguaaacuuuauaucaaacaucaacauuugcuaauauggcauguaaacccuuccaaacugguuugguauugucaagagggugggaagguagcuuuuccuuucugccauagcuguaguaagacuggaacagaaagaauugucucccaaaacacuaagcuacuccaucaagaacuuagaagcacuuauuagccuuaugauugccagaccuguaauguuguucuucagcagacugugaacugggcuguccuaacuagauaucuaaauaaugucauucucaaacaagaaggguagauagagagcuaacaagcaagugguggugggggaaggguugguguggguguguuuggggugaugcuuuuguugugguagugcauacuuagacugaaagcacccuuugucccucuaucuggguugccuuagauggagagucaucuuuuagccuuuugauuaagaaaguuccauaggacaauagcuaugguaauauugaggaagucaauccauuaaauucuuaaauaaguacucagaacucauuuggcagugucggaaaaaugaaaacagaagcauauuuggugggucugcacuguccaacaguaaaugauggggcgggcaguguucuccacaggaaagugcacucacaccugccuugcaccuagaugcuuucaagucugccuguacaguugcaaaucaggaauucagcuuagcagcccugugaguuuauuuacucuuuggaagaagacaauggcaguugaacccuggucuuuccuguagaacagaguguucauaaaaucucucuugaaguuaaaaaacagaacagcauuuaggaauacacaguauuaucaguuggcaaugcuccacagugauuacauuuugcuauuccacagaauagagauaacuacauccguuccuguaaauugcuaccugauggcuguacucucauagugggaggggaagccaguacucuauccaucugggacuuggcagcuccaacuccccgcauaaaggcagagcugacauccucagccccugccuguuaugcucuggccaucagccccgacuccaaggucugcuucucaugcugcagugacggcaacaucgcagugugggaccugcacaaccagacccuggugaggugaguacagggccucuccuagggaagccucaguuaaggggcugcuguuuguugaguguugauacagaggcuaucuggccaccugugggugacgagugcacauggcauaugccagagggucaccaagaccuuauaucccauucuuucguccacacugagauggcagaugcggcugugucgagggacaacauaauguggacuuaaaugauaauacaagagucuccaguccaaaugguuugagcuuggccaauuucuuguuugugcagauggaaaucuacugacacaagaaaacaaaaaacauuaaaaauaagcuuucauugcauugaaaccacaaaauagcuuuaaaauaucuguauuucucauagcuaacuaagagggucauuccacuuggaagcacaugggccucugauuggcuucuagauccuugcucuucccucagcagcuagucugcuuccauuuaaugcacauacuagagucauuccagaaacuauuucuaagaguaagcacuuaagucaaauguagccaacuuuugggagguagaaauucggauuuuaagauaaggcugucuguaccucuguccucucuacuuuauagaugagagccgaggcagagaaguuccuugucucuaguccuuuagucaggccugccauucugcuggugcuggcucucuggagucauguguguguguaugugugugggggugggguggggggccguguuuuagccuggacuggccauguguggccaguggcugcucugugagaguccuguaucuucuaggacacagcguauucucaacagucaacagcuugacagucacuaggacaugcauggagggcgaggcuggaggagugcugauuguucacagggagagauguuuggaauaaagaacuaauaacucuuugaguugaaggaggugauaagucaggaugaaagauaaaaguuguaacaguuguuugaauagacaaaaggaagaaagguacaacaaagacuccuucauuccaggugaucauggagaggccagguagcacucuugagguccacuugcugggcaucagcagggaauucuggccaugcgggagaaggggacugguagggacaggaacuaauguagggguugugcuugggagggaaagguuucuggcucauaucuuggcuaagaauucagggcagcgaugguaauuuuuuuuuucccuuucacuuucaaauucuaagcuuggugcucugugguaauaggggaugggggaccuucuugacauugacguuucuaaacaguucuauucugggucuuuccugguucugaagguggguccuuaccucucugaucugcccuggcgaaagcgugcucagcauguagagucaaguuucugagagucacugcaucacacacacacacauacacacacacacacaucugcucagcauguagagucaaguuucugagagucacugcaucacacacacacacacacacacacacacacacacacacacacacacaccaucugccaaccccagaccccacugugcucauguucucuccacugaacugacuuuguugccucaugcccuuccaggggucagaaauccuugccacccaauugauuagggaugcccuuugaacauggugugaaggucccguguaaagaaagccuuguacuggggcugggagcuggcaagugucuguccuccucaguacuuuucuuugucucuaccuaacuccucugaggucaagaggccugcuugacccuuggucucugggaguccacauuuucucaugcaaggcccuugaugauucagaagggcugaguucacacugugcuagcaggaagggcccuacuggaagauuaucuucuaaaugaauguguucuuggaauaagccuuugacuuucuguggguucaagccuuggccacugaaggacuggucuuuaucuuuccuuaaggaaauuggguuuuguguguuuaucuuuauugucucuuaguacuuaaauucuuuuccagaccagggaagaguuucacugggucuguuuaucaagaggccauaggauaccuggcuucuggcagcauccugcaagccaguccauuucuuuaggccuuggaucuugaaaaaggaaacagaaccugcaggggcuguuuccugugcuccucaggggaagguuacuuugauacugcacaccaacaaacacugacaugacacagugaguccaaaaccaacaacacaacaguguuuaccuugagcucuggcaggaaaucauuauucagucugguuuguuuuaucaggcaauuccagggccacacagacggagccagcuguauugacauuucuaaugauggcaccaagcucuggacaggcgguuuagacaacacugugagguccugggaccugagagaagggaggcagcugcagcagcaugacuucacuucacaggugagugcuuggcucuggccugcuguggagucagaaggggucuguggaucggucucccaccucagcaucaugcaggguaccaugauaagcaaauguguuuaaaaccauagacauacaacacacacacacacacacacacacacacacaaacacacacacgcacacacacaggggaugguuacaaagaauccugugagucaaaccauguugagaugcuuuauguacacgugguuuuggugaaaggaauuuauacaguagagaauauacagguuuucuucagcaggaugcaguguuguguauauuaucaccaucaaaugcagaaggagagugaaaugaauguuaauuuguuucaaggagucuaagaacauguggauacccaucuccuuucuuaaccuuaaaaaacaaccauguugaagucccaacacugagggggcaaguggacuccuaaccaagaagcuauuugcaguugauacccacugguaauggaaaaucaguuuucuccaguggagggucauuagguaccucuacuacccucugggcaggccccauaccucagaauaauugaccaacauaaacuccauggggcauugggagauagggggcuuuuuuauguucuuuuguuugcuuugggguuuuuguuuuguuuuuguuuuugguuuguuuugauuuguuuuuuuuuuuuuuuugacuuacugauguuuuucuuguuuguauguuugugauagaagggcaggagagagaauauaaaggugguuggguaagaaggugggggaggggacaugauuaagauauauaaucaugaucaacuagaucuauagaaggcuuuugaggcuugacucuaacgcaaggcaguccuacuacuucagccuccacaauacuaggauuaaagguguacaccacuaugacugaguagaguuuuaaaauaauauaaaaccauacaacuuuuggagaauguagacuuauuuggcagaagcaguucucgcccuuuacuggugucuuccucucaguaaaguuguccuucuguguauuacucaccccccgcccccacuugcucaugauaugguuuuuucuuuaaagguaauaaaaacuuaaaaaucggguaaaaauggaaaauaacuacauauauuguuuuaauuuccuucuguuccucugauaagauaugacagaaagcaacuuagaagaaaaauaguuuauuuaguuagcuauuccagaucacaauccauuguugucagaaaaucacauugccuccauagucaaggggcaaagaggaaggaaguacucacacaugcugguacaauaucuguguucuuuucauucauuccaaggcuuagccugugaagggguaacacaaacguggugggucuucccauuucaaauaacccaacuaagaaaacauuucacaggcuugccuacaggcugaccaauccagguaacucuucauugaaauucuucccacacaacucuagguuuugucagcucucacauauacuaauuuaggugacuguugauuuuaguuucagaacuuuuccuauucuaccauucuguagaauaugcacaauauuacuuuugauucuguagaauaugcacaauauuacuuuugauucuguagaauaugcacaauauuacuuuuggucaccaguuuuaaacuuaagaaaauuucaaaugucuauaaaugucaaacauauacaggccuauaucaaacacagacaauuauauucccuauccuaagccauugguaccuggcuaguuuuguuauaucauccucauuccaaacucugaauuacauguccauguauuucagucagugucucuuaaugacaacuuccaaugguauuauuaaagauaauaucuuauuucacagcauggauggaacuuuuaaucuuccauuuguucaguagcggauucugggcugggcugcauccccugccccuucccagucuggauuuggcagauuaaacccacuuuucgaccccaugcuuacuccacuugcugacgucucacuuccuuaauuucuugaguaaacucaucagugauccugucuuaccuauaacagaucuucucuuugggauauugcccaacuggggaguggcuugcugugggcauggaaagcagcaacguggaaguucugcaugugaacaagccugacaaguaccagcugcaccuccacgagagcugcgugcugucccuaaaguuugcuuauuguggugaguucagcuacaagaguuucaagggccuaaauggggaaauacuuuuuaaaauaugcuuagagaugguaucuggggggaaaaaauguguugcuccaugcagcugggugcaauaauuccauugccccucagagaagaguaaugugugucucggccugcuuuguuaauuugagaaaagucagcaggcacugaaauauaugguaggggugggacguaauuguuggugcucugaaguuuggagggcaaugaugauuagaauaggaccauagugaaaucacuaugugcugacucuauaacgagaauccagggucagaaggauguuagcugcacuuagauucucuuuuccugaaugagaacagagaagggaaaguccauguggagacuguguuguacuuuguguggucacauauuuauucacucuggcuaugaggauagaugggugacugauacuaguugcacauucuguaugcaucugauaaaugagcauuucugauuagaucaauauugaauuauuuugcucucauuguuuccauaagaaugaaaauggcuaugaaacugugucauguacugaauguguacaccuguguacacacacacacucuuacaaacacgcucaggugggugucaaagcccgcuauccuccugccacucaguuucuugguuuugaggcaagauuucucacuaaacuuggagcuugucuuuuggcuacacuagauggccaacaaugcccaaggcuuaccuguucuuugaccuucccacacuguccaugaggcuuggauuccaaguacacaaagccacaugcuggaaaucugaauguguggacaugcuuguacauguuuauccacucaguaaucuccagccuucuuugauuaugaacaggaucacaccaaggagccuagauguaaaacuugccuggaucauagaccaacccuuuggacauggacauuaguaugauaaaaauguucucuuugggggauagcuagaucauuuccuggauaaaaacaguugucauuacucaagcacagugacaugaguucagucuuugaaacccauguuaagaacuagaugagguaguucacaucugugaacccagcauuccuacagugugaugagagcaggagacaggagaauggccccagaagcuuguaggucagcaauauaaacaguaauaaacaucuugucucaguacaggggaaccggggccaagaagugggaguggguggguaggggagugaaggggggaggguauagggaacuuuugggauagcauuggaaacguaaaugaagaaaauaacuaauauauauauauauauauaaaagaauauuuuaaaaaguuaaaauaaaauguuugaacaucuggaaaaaaaaucuugucucagcaacggcgcaggaaaggaacaccuuuacagagcuguucucccacguucacacaugcacucuggccugugcauuuacacucaggcacaagcacacaugcacauacaccacacacuaaaaccagugcuauuuaacuaauuccaacaggggggauuuuaauauugcugaaaucaccugugccuuuguuaauucuaggcaaaugguuugugaguacuggaaaagacaaccuccuaaaugccuggcggacaccauauggagccagcaucuuccagguauggacaugcuuacccccuggccuuugaaauaacuagugaggcugucucuucaaugggacacauuaaauauucucugccugcuguuuuuucuuacaguccaaagaaucuucaucagugcuuagcugugacaucucuguggaugauaaauacauagucacuggcucaggggacaaaaaggcuaccguuuaugaggucaucuacugagaauaccacggcuucauauuuacaguuggauugggccaaauguuuggaauuuguagaaauagaaguuauaauuuaaaaaaaaaaaaacagaaacaacaucaagaaaccugaagaaaccuguuuccaaaucuugacacagaacugcuuugagucuacaaagagaaggcaacaagucuuaucaguagacagucgccugucuaacuuugggcaccacaaucacacagaagccaggugugggauagaggagcuaccugcugccugucaguccugccuuagccaacugugagcuuacauuucuguuccuugcaauucgguucaccuugaguccuuuguagagcaguggugucuacaaugaacuuguuucuugguuuugcaucuugugauuuuuuuuuucuuuuuguaauuuuuuuguuguuucaacauuuguauaaauuguaaauauauuugguuuauuacaguaaaaccuuuaguaccaguaaguggucuuccuccuugacucuuuuuaaucaauacauucgaguccuagauguggguuuugcaauuaaaguccauacacacauagguaaguccuuuguacacuuguuuuugcagaaauauauucagcuaugaacaucugcuguauugggacugaucccaucaaguccuuggggaucaacagagacucaggaucagaaguggaauugucaguucaugacagcuuuaauaggcgaaauuggaauuaccuuuaauacucauucuuugaggcucuugugauuaagauuuaaaacuauuacuaugacuuuuauuuuguuuuuacaggcucuuacacuauauuuuaugcucaccuuaagcugguagcuauccucuugucuuagccuggaguacuagugugugccacccuugugaguuuuuuaacuuagauaauguaucaaacaaugauccuguuuucacacauuuucaucccuccugucuucuuucucccucauccuuaccccugagaaaccucaucugauguaugcgguuaaaucuaagaguguguggucacaaauuaaaguugugccuuuuccuaguauccuacugacaaaccaaaccauuauuguaggaaggcccagucuuaucuacauucuuucucuuguauuucaaggaauauauugaugauuuauguuuuguuuucugaugugugcuguucagaaagcucuggaguucacgucccuggaaaacugaaguggaaagucagcugguuaugucucauuaguacuuacuugaucuauuauacugauuugcuuaauccagcaagcuuugccccguucaucucauuaagacugucccugcagcucuggauauugcagucuggaauuaaucuuuuguccuuauuuuuauagacacauuuuuacuaauuugauuaggugauaucuguaacccugggcucuuaauaagcuaccaagcauguuuucuuuugaaaaggcuauacaacuuaugcuuuuuauauuugcuguugacuucuauguauuaggaaaacacaugguuaguaaguagcuaaggaauuuccugugcccuuguuuauuuacgauucagugaauuuguaguuguucuuuaugcuuuucauuugucaucaagaccuuuuuauauguuuaaaaauacuaguuuucacccaaaaacguuuuuucaagguuuauuaaauauuuuucauuaaacaaauagcaaauacuaauggccaaagcugauuucucucucccuucucuacauuguggaguggguuucuccuugacuugcagcaagacaaccagcuacauagugauggaauauuuguuucucuccugccuuaggcucgggcacaggccagcaguauugcuauaggucuacagauugacuuccaacuacaaguagagaaggauggaaguccagggagauaaaccugugaauagaaucuauuaaaucccuuucauucaccaguacguuagccagaacaaacaaggugaguccagccuaaaggguagcagcuuuaggagcugagaauggaaaguuggaauuugggaaacuguucaggucaucauuucucacuuguagaaugugaauguuaaaaauccugugccuauugcucaagguauugcgaaccauaaguugauacucagcaugauauagugacacgugucucauaaaugcagcaugaauggagucauugucuuuuccuuuauaguauaacuccacauuaguuguguguguguuuguaugugugugucuacauacacauaggagcuuuuucguuuguagguuucuaugugacugguuggaaggucuuuaauguuauuaaucuuucuguuuuccuuccucugcccucuccuccuaaucccaacccaaacuuaauccuucauguuucauuauuccaguucaacccuuuaugcaaccaugugcuauguugucucccuugaaagccucccccaccacauauacacuaguuuccuaacaucuguggguauuccagauauacacaucugaagauucaaagucaauaccuacaaauaaaagaaaacauuaaguguuugugagucuggaguuaccuuacucaaaaugauuauuucuagcuuuuguuaauuuaccuauacauuucaaaaguuugucuuuuuuucuuuuguaacaacuaaauaaaauugcaguguguaaccauauuuccuuuucaauauccauucaucaguugauggauauuuagguuguuuccauauccugacuauugugagaagagcagcuaugaauauugauaagcaggucucucuauaguagccuauagaguccuuugggucuguguccaagagugaauagcuguauccuguggauaucuauuucuaguauuuuaagaauuaucugauuuuccuagugguuauaccuguuuguacucccaucagcagugauuagcauucuucuuucuccauaucuaaaucaacauuuguuguugcuugcucuuuuuuauuuuagccaucugucuccacuguaaggugaaaucuuaaaguaauguuaauuugcauuucucugauggcuaagaauguugaacauuaaaaaaccaaaauguguuucagccauuuguaguuccuaucuucagaacauucuguugaugccugugcuauauaugucauuaguuuucuugauguuuacuguuuuggguucuuuguguauucuagauacaaaccucugucagauguauagcugauagaguuuuuuccccuuauucucuaggcugucuucccucaggugauggugugcuuuguuguacagcccuuuuagauuagugagguuguacuuauuuauuaguguuaagguacuaccagaauccuauugggaaagaccucuccgaugccugugagcacaagcaccuucccuucuuacuccuuucucagauuuaagguaucaggucuaauguugagauccgugaucuugucgccauugacuuuuauaagggaagauagaaggagcgagcuuccuuuacauaucacuguccaguuugaccagcagcauuuguugaggaugucauuuguccaguauguuguuggccucuuuguccaaaguuugguagcuauaaggauugugaacuuauaugcuggacuuuaguucuauuacauugaucaauaugucugcuuuaugccagugccauguuguuuguauugugauagcuuuuuuacaccuuaaaaucugagguguugacaacuacuagcauuuuguuguucaaaacuguuucaguuuuccuggguauuuggaauuuccauauaggauuuaagauuuuuuuuuuuuaauuucugugaagaauuguguuggaguuuugauggaaucugcacuguauugguagauuacuuuugauaggauggccauuuucacacuacucuaccaaccaauaaacauguggggguagggggugacuuucuguuuucacaucuuucauauuuucuucaauuuuguuuuucacugucuuaaaguuuuuuauuguguaagucuuucacuuccuuagauuuauuccaagguuuguuugcuuguuucugaagcuguugugaauggaauuguuugccugauuucuuucucaguguguugcuuacuuguacuuaggaaggcuacuaguuuuuuguguuaauuuuguguccucuuacuuugucaaguauguuuaucagcuguaggaaauuucuguuugaguccuuagggucuuuucuggguagauguauaucaucuacaaauaaggauacuuugucuauucuuuucauauuuacagggccuuuaucuccuucacuugcuuaauuagccugaauagguuggaggagagugggcauggaaaugauuuuucuuuuuuuccccauuugggaugauguuggcugugagcuugcuguauauugccuuuuuuuuuagguuaagcuauguccccuguauuccuagauucuuugggacuuuucucaugaaaguauguuggauuuuaucaaagguuuuucucugucuaaagagauaaucauuagauuuucauuacucagucuaucuguguaguagauuauacuuauuucuauguaugagguagauuacauuuauuuauguauguauauugaacaaucucuguaucccuggggugaaacugacuucauuauaauggguaaucuuuaugauguguucuugaauucaguuugcaaauugaaauguaaacuuaaggguuuuuuggaaagucaguuguguuggaugguauuuucuuggagcaaacacuugaaggaguauuuuacugaagcagacacagaugaaaggauguuuugcuaaaucaagcaugugggacaugugaaggauucaucacuaaugagaugccuauauugaucugacuuacacugcacagcugagcucuguuuguugugacuucauagaauugcaucaaaaaaacuaaacaaaacaaaacaaaaaaaaaaacuuuaggcugauuggcaaagugaugucagcugauacagauucaagugaaguuuugcuaagucagauucacaugcucaggcaagauguggugaggcaagcaagacccaugaaggacauguaauacuuggagggaauguaaguaggacucaacaggcugugagagaggcuuggguaggcuuggcuugcuugcuaguagagcuagcuguacaaaucaucuucacaucuucacugagagaggcacagccaagaacuucuggcauuccccuuggccuugauucuuccugcggaaucguggcgauuaggcugaggccuggcugucucugcuaggucaugcuaccacugaugauucaaguuugcuauucugacucuauugaacuagcugguuuguugguauauucaugaaggauuugcaaguggauugagcugccauugcugagcugaacugaacugcugaucuccugacaaugcagaugggauuugcuccaaagaaccauuucuaaacaggugcacccccuccccaccuccauccaacccucuguauccuuucuuuuccucgaccucugguggguggagguggaggacuacaaagaaaguuaaaggguuuaagaaccaacauuaaaaguaggcccugaaaaaaauuaacauuauucuaagggguuuuauugagaguuuuuccauucauucauauuuaucaaagagauugaacuaugauucucuuuuguguauaaggaggucuuucucugauuuugguauaagggugauacuggcauuguaaaaaugaugaaauguccuuuaauuuccuauuuuguggaauaauuugaggcguauuuguaugaguucuuuugaagguguuagaaaucuguggcgaauccauccaucugguacuaugcuguuuugaauuggaggauuuuaauuacuggaucuuucucguuggauguuauaguucuauuuaaauuauuuauuucaucuugauauagauuuagcuuuuauaggugauauguaucuagaaauuaauuuaugucuuucagauuuucuauuauguuagaauauagauauuuuuaaaaauauugucaugauucucugaauuuccuuuuuauauaacuuucuguauauuauaaugacuauuaauuugaauccuucuuuucauugauuugucuaaagguuugucaaucuuuucaaagaaccaacaccuuauuaaauugauucuuuguuuuguuuuguuuucuauuucauucauuuucagagcugauuugauugucucugcccaucuacuuuguuuuuuuuuuucccaaggacuuuguguguauuauuaauuugagaugccuugcuugcuugcuugcuugcuugguuacuugcuuccuuucuuucuucuuucuccccccacccucuuccucuuucucuuucuuuuucuuccuuccuuccuuccuuccuuccuuccuuccuuccuuccuuuuagcuguaguguuauggaauuuuuucuuaggacuuacugucuucauugugucccauagauuuugggauguuauguuuucauucaguaguuuuaggaauuaauaaaauucuuaauuucuuucuuucuucauucaguuaacacucagugagauuuuauuuauugucuacaagcuugugaacugucugugguuucugugauugauacauagcuuuauaccauuguggcaagauaggaaaugggguguaauuugaaguuugcugcauauuuuagaccuuuuuuuguaucauaauaaguaguugauuuuggagaauguuucacuggcuccugagaaauuauucuugugauaauuagcuuaaaaucgcauguaaaacaaagcauaccugaaucucuuugauacagauuaugugugauuacaucaaaacacuuuauaaaguauauaugacacucuccauaaagauaaauuuuguagauugguagaaauguccgugagcuacacauauugaaacaaaggucaccaggcuagagagcaccuccaguccagccuucucaguagaaagggggcuuugcauucuuucucugaaagaacaucccugugugcuugauauucuggguucccagaguacauauguguaagcacaaagauaccucuguauuuaaugcauaguuuuguuaggucuaguaaucuuguuugaaacaugggauuguucaggacuuggaauacaugcaggcucuucuggcuuuaauauguucuauucuaauguaugugccuuuaucucucucauagagcuuucagugcucuaugagagcucuuuagucuguguucuuaauauuugaaccauaaaauaugaauuacuuucuucucuggacuugucuauuugguauucuguacgccuguuuuguaccuagaugagcauaauuuuagguuugggaaauagucuuguauggauuuacugaagauauucuaugcauuugcuguagcauucuguauuucuuuuuaugccuuuaauucaggaaguugagguuugguuuuuguugguuucuuucuuucuuuuuuuuuuuuuccuuuuauccccaguuuauagaauuuuggccuucugauaguuuugguugacucucuguauucuuuugguauguguuucaucacuuuuggccuuggucuauacugguuuuugccaugugcucaauuuuauuuuggcuuuuuacauuguagagcuuugggauacauuauuagguuauuuauuagugugaacacuuucagccauaaccuuuccucuaaggauugcuuagguaugucccagagguucugaaaaguguuguuuucauuuucauuauguuuccauuuguuaagaccuccaagguuucuucaguuuaaaagugugcuguucagucuccaaguauguuuucugagguuaucauuguuuuugauuucuaguuugauuguacuggggucugacagaugcaggaaucguuugcuuuuccuuuccucuuccuugcauccuuccuuuugcuuuguguucuacaauguguucaaaaaagugucaugugccacugaugaaacugcauuauuuaucuguuaggugcaauguuuguagcucuaccaaguaaguuuaguucaccugugguaugacuuaacccuaagguuucuuuguugaauuuuuuuugacuguuguuuuugguggguauuugggguuuuuuguuuucuugagacugguuuucucuguuuaacuuuggcuguccuggaacucacuguagaguaggguagaucucaaacucccagagaucuagcugccucuaccuccugagugcugggaacuaaagguguguaccaccacggauggucuuugcugaauuugauuuggaggacacaucuaccuagugugaaagugagguccuaucuccaggccucugcagugauguguaccguuuaaugucaggacucagaaaauauguggacccaauaaagccucagugugucuuuugagcaacauuauguuuguuuuauuugauacgucuucauuugcauaaagcugaccgcacucacaacuaugacggcuuuacagcagucccaauuaacuaccauggaagaugcuacaaauuuuaccucuguccccuauaaacuuuguaaacuagaauacuagaguuggggaaaaugaaauauucuuacgcagaguugagcaugggcugaguagggauaaagugugaguaaggggaaaguaagcuagaagaaugaaaagccaagacagcacuauguguuacauuugaaaacaagaaggacacaaauaacaaugcaucaauugaacauuaaaaauacaaaacugugguuauuaaga

SEQ ID NO: 1948 - RNA, 163370 nt, Mus musculus
ugaugaggucuaccuugcuuaaaugucucuuuaucaguaccaggcugcuuaauuaagugcaugaggcagaccgugaauggaugucuacugagccauuuacugaguuaaugaaugaaggauuaucaaguaugugcaucaucaauccguaaguucuguuuuauuuuuauuaauuuauuuacuugaaauccagacucauggaacugagggugugaacucagacucacucauuauuuagccaaagacgucuuguauuucuaaucccucuguccaaaugguaagauuauaggcauauacuaugaucaacugaggcgggcacacaaacaaaauguuggagauaugcagaacccccucuucaauagugcauucgucagccuaagacccucacuugcauguacuauguauucacaucccucuccuaaaaguguacgcaguaaccucaaccccgcacuugcaguccagccacauacauacacauacuaugcuagacgauggaauaaguuucuccuccccuaacaaccacaaaacuaggaaagugucuauuuaaauguauucuuuuuuuuuuaauuagguauuuucuucauuuacauuuccaaugcuaucccaaaagucccccauauacccuccccaccacuccccuacccacccacucccacuauuuggcccuggcauuccccuguacuggggcauauaaaguuugcaaguccaaugggccucucuuuccagugauggccgacuaggccaucuuuugauacauaugcagcuagagacaagagcuccgggguacugguuaguucauaauguuguuccaccuauaggguugcaguucccuuuagcuccuuggguacuuucucuagcuccuccauugggggcccugugauccauccaauagcugacugugagcauccacuucuguguuugcuaggccccgguauagucucacaagagagagcucuaucuggguccuuucagcaaaaucuugcuaguguuuaaauguauucuuaguuuuaucuagguauccugaguucagaugggcuugaugguagaggcugauaugacaugaacuaauuuuagaugaguauguaauaagacaaauugcccucugagugaauguuuaucaccguauaccuaugcauaauuggcgaugaaugauuacaauuagaugcuugauaacaagggacaugcacaguagagaaaggggucuuauaauuuaagcgugucagucaaaaaggagaccugagcguguuacaccucuuaguaaccagcccuuccuuuguuuaggucccauaaagagaaacuccaagugauaacugggaacccuuaaauauucucucauucauagggccugcuguuauuuuuuuaaaaacuuuuuuaaaaagaaguauuuauuucuuuuauguaugugaguacacuguuacugucuucagaugcaccagaagugggcauuggaucucauuacagaugauuguaagccaccugggaauugaacucaggaccucuggaagagcagucagugcucuuuaccacugagccaucucuccagcccccugcuguuauucuugacaauuauucucauccauucuaucacuuuacuuuugaagaaaguuucuuugcuacucggaaauuucaguucuuugagacaagaaacugaaaacuuccaguccagacauugacuagcccaguaaaacaauuauuuacaguuauaaaauaauaagaaccugaagcaaaggauaguagaagauacuuuuaugacacauaaauucuccagugucaaguucucuugucuaguggguaccuaagugacucaugaccaugaacugcaaguuugacuuucuauauguuguuuuuaacaaagucucaaagguucaauuuugccaauaaagacucaggugccagaugcugggcuagaagccugcuagcucagagaggcagagaaagcacucaaaugaucuuccuccucggcugucauccccaaaccaagcucuccucucucacagucucuaaaaaccuccuucaaacugaaucuucccaagucuacuuccuaugcaucucucuuuccauccuccuaacucccuuacucucugacuuuuucuuaguaaucacauguccacucccugucagcugguugcuuccucugacauuugaccuaggguugaauucauuuaacccuguuuacaaugcucaagcagaaagcucuuuaauuaaaggugugagcugaggcugacccacacuguagcuaaaagcagguuucuuuuuuuuuccccaguaaauaacacaaucuuaggguucacagugaucaaauauucugcaacaacuauguaauaaaaaaaaagcuugucauuuuccagucaacauuaggucacuucuagggaguaguaugaguaggcaggcuacuugauucuggaaucucaguguagcaaaauuuggaacaagguauuuuuuuauaaauugagcugagcaugauggaauauacuuguaaagucaaggauaucuuuuuucuuuaauuuauuuuaugugaguacacuaucacuaucuuccgacacaccagaagagggcaucagaucccauuacaaaugguugugagccaccaugugguugcugggaauugaacucaggaccucuggaagagcaguccgugcucuuaaccacugagccauuucgccagcccuuggcaaggauaucuuuaacgacauagaaagaucaaggucaccuagacuacaggagacucuguugcaaagaagccaaaaggaauuuauaaacaaacucagacuuaauucacaaguggcuuuugugaaaaaguaugagacgugagggaggagucugucuguggggauaugcucuucucuguacccaguuguuucuucagugagaagcaugaguucauggacuagugaaugaagaagccaaugcuaguauaauacacaacguuggugauucaccaggacaucccucugcacauuaguauuuggaagcaacggaacaacaacaagaacaacagcaaaauaaaaccaaaaacaguugugguggcucacacuuguaauccuagaauuugugaaguggaggcaagaggaucaagauuagccuagauggguuagacaguuugagaguagccuggacuacacgaagcgcucaacaaaauaaaaccaaacaaaagccuuaguaauuucagaaggacccggggauccaucccauauauaaccaccaaacccagacacuauugcauaugccagaaagauuuugcugacaggacccugacauagcucucucuugggaggcuaugccaaugccuggcaaacacagaaguggaugaucacagucaucuauuggauggaacacagggccccuaaugaaggagccagagaaaguacccaagguacucccaaacugccaggaagcaggaguggguggguuggggagcaggguggggggagcguauaggaggcuuuggggauagcauuugaaauguaaaugaagaaaauaucuaauaaaauugccugaaaaagaaaagaaaagaacgaaaagaaaugcgcacaguagaaaacuaucuccugguuuccagcucucugaaaacaagaacuuucccccauuuuaauaaggcugccucuauuguucaugagaaagcuuucaggggaaagucuggaaccuuggguggggcuaaggauagcaauauggcagaggagccaugaagaaagacagagaacuucuggggcacucagagggcuacguggaccauucauuaaaugaugaagaccuauggauaagguuagacaguaugggagagggggacaggaaaauagaaggguacagcuuccugggucuccugagguccuauccacauuggagacauccaagauagcacuuaaggauacuuccugaagucuucggugaucuuagagaggaaagucguguuucaagggagagucauaggucaggcagaaaugaauauauuauaaagagacgccgcgucucucaaucagacuuucaacuauugaaagaagggaacugaaagaaacaggaaucucauacugggaucaggaaaaggcaccacaccuaggggauacauuccaggaaagagauuucauaguuuuagcuauuugucaaugaugucuguugggaacuagucuugaugguaagugcuuagaugugcacaucuugguucucuauuuaaauuuuaaucucagggaauucugugauauccuuguuuaaucucgauucccaaagaacauuaaauaaauccacuuuaguuguuuucaaauaaauuuauuuuuuuguuuuccacuccucccccccccccuuuaaucagcuuauuaagaacagguaguggcucacgccuuuaaucccagcacucgggaggcagaggcagguggauuucugaguucgaggccagccuggucuacaaagugaguuccagaacagccggggcuacacagaaaaacccugucucaaaaaacaaaaaacaaaacaacaacaaaaaaaaacccaaaaaaaccaaaccaaaacaaaacaagaacagguggucagaucugguuucagaacaggcugugauucugaaguucagugacaggacuuacaagcaaugggacauuuuaagaauuaagaauuauggggcuggagagggcucagaucccacaaccaaacaguggcucacauccauccauaagaucugaaacccuguucuggggcaccugaagacagcuacaguguacuuauauauauuaauaaauaaauguuaaaaaaaauuuaagaauuacuagauguaagccggacgugguggccuuuaaucccagcacuaggggggcagaggcaggcagauuucugaguuugaggccagccuggucuacaaagugaguuccaggacagccagggcuacacagagaaacccugucucgaaaaacaaaacaaaacaaaaaaagaauuacuagauauggugacucaagacuguuuaccuagcacuuugaugcuagaggcucaccucauguacaaagccacauugguuuacuauauuagucaggauucuuuaaaggcacugaacugauagaaugaauaaauguguguguguucuaugucauuuauuggagugucuuacaggcuaguccaaaaaugucuccugacaggaaggccaagaaccugauaguugacagcccacaaggcuggagauuuuagcuggucuucaagcuaugcugaaauccugaauaaagccucagcaccggcaaguggacaagcagacaaaaagcaaaagauuucuucugggcuggagagauggcucagcaguuaagagcacugccugcucuuucagaggucuagaguucaauccccagcaugguggcucacaaccaucuaaugggaucugaugcccucuucuagugugucugaagagagcgacaguguauucacauacuuaaaauaaauaaaucuuaaaaaaaaaaagcucuuuucuuccuuuaugaaggauugccauuagaaagugcacaccagauuuagucugagucaagugaccuacuucaaaugauccaagcaagagaaaucucucacagcucagcugcuuggguuuuaguugauuccagauguagucaaauugacaaaauuauagccauacagcuacaugagaagauccugcuucaaaaaagaacccccccuccccgagacaucaucacugccacgucaccaucaccaccaccaucaccgucucgucacccuccuuccuuuagguuccauauggccuuugaguauugucucaaaaaugcuaaaugaagucaggaaaguaaaccuucugacuaaaaaauggaaaaucuaggcagguguggugaugugaucuuaaucucagcacuaguagguagaggcagguggaucgcugagaguucaaggccagacuggccuacaaaguaugguccagggcaggcagggcuguuacaaagaaacccugucucaaaacaaacaaacaaacaaacaaacaaauagcaaaaaaccaaauaaucaaaucuuccaaacaacaacagcaaaaacaggacaauauaauuuuuuauacuaaaacaagugcuauuuguacaacauuaacauuaacaacauaagugugaagcaaugggaguucaggucuccaggguuuuuagucuaggguacuagguuuccagucuaauauagccgacagcuucuuuauuccucuguuuuuuguuuuucucuuugccuccuuuauuacugggcaugcauauuuuacuuagauuugcuuuuuuuuuuuuuuuuuaauaaaaacauuugucacuaggcaaugguggcgcaugcuuuuaaucccaacacuugggaggcagaagcaggcggauuucugaguucaaggccagccuggucuacagagugaguuccaggacagccagcacuacacagagaaacccugucucuaaaaaccaaaccaaaccaaaccaaaccaaaccaaaccaaaccacaccacaccacaccacaccaaaccaaaccaaaaaaaccccaaaaccccaaacauuugucacacuuuuuucuuuacauagacacauauaugugcacccucuauuuacaguucucucuccuuccuucuucccuuccuuccuuccuuuucuuucuuaaacccaggauaucucuucaguuacuuuuaauuuagacuagcuccuggacuuuccccucccucccucucucccucccuccuucucucucucuuccuuccauucuuuauuacuuuccuucuuucuuaagacagggucuuacuauuuagcuccaguuaaccuauauauagccagguuggcuuugaacucaaggugaaccaccugccaaguagcugguaccauaaaggguuguggcacuaugcccaacaagucuugaaaaaaacuucuguuuuuuguuuuguuuuguuuuugaaacaauguuuaucuuugcaccccuggcugucuugaaacuccgucuguagacuaggcuaggcuggccuugaacucaagagaucccccugcuucugcaucccuaaugcuaggaugcaaagcauacuaccaaccccccacuccccacgcccgccccagggugugugugugugugugcacagacgcagcacuuuugacauugacuuauauuucgguuauacagagaugaggaaagcucuuuucuuuucuuuucuuuucuuuucuuuucuuucuuucuuucuuucuuucuuucuuuuucuuuucuuucuuucuuucuuucuuucuuuuuuuuuuuuuguuuuuuguuuuguuuuuuguuuuuuuugagacaggguuucucuguauagcccuggcuguccuggaacucacucuguagaccaggcuggccucagaaauccgccugccucugccucccaagugcugggauuaaaggugugcaccaccacgcccggcuggaaagcuauuuucuuauguuauguuuuaagcacaccuucccagacuacacuuuuacucauuagucucauuauucucuuuuguuuccaaggcagucuugcuuuuauuuucaccccauuaauauguaugcaaaguguguggugugugugugugugugugugugugugugugugugugugcaaugucuagggcccauaaaagagaucaugaagucuuugucucucucagacugcaacuggggauauacuucuaucucacuccccucuccuucauuucuuuugagacaggguuucucacauauaucccugccuuucagcaacucacacugaucuacacuuguaaaucaaauuggccuuguauuuagagaucugccuuccuugucccccaagugcuaggauuaaaggugugugccaguacguuggccuugauaaucucugcuuagcaaggauaauaagaguacuuauucauugaacuauuucaauuauuuaauaauagaugugcaaucuuuguaguucacaaaacgcccuaaaauuuaagauauguaacuauaguuuuaguauauucaauugcuuuggaguaugguugccaaucucuauaauauccacauugaaaaauuaccaguugacuauauauaaguuaaguaaguuuagaauuguauuuuuccaaacccuaagcuguguuuuauuauuauuauuauuuuuuuauuauuauaucuaaguacacuguagcugucuucagaugcacuagaagagggcgucagaucucauuacggaugguugugagcuaccaugugguugcugggauuugaacucaggaccuucagaagagcagucgaugcucuuuaccacugagccaucucucuagcccccaagcgguguuuuuccagucaaagaaauauggugguuagaucucauuaucuuucaguuaauuaaccauaucccaucugucuuuacagugcucccccuaaaaaaaaaaaaaagaaauaaauuaaaaaaaacacauuuaaguacauuuaaauaguuauguugagcuuuuuuuuuuuaaagaggugaucaguuuuugagacagcauaucauguagcccagucuaacuucaggucuaugauguguugagaaugaucuugaauuucuaguccucugaucucuguuccaaguccuggguuauaaguaugcaccacauucauuagaaauccuuguuuucuaacaacacguaaaaugaugguccugugugcucacuuuuguauaugccuggucaguaacuagaagaaaugcaacaaaaaaacccagauaggaacugugggacaguaaaaccuguuuagccuuugcaaaacgcuuaguguuuaggcaccuaucuggaaguaagaguuugagaucugugugauuccucugcggucuuggaagucagauuuacacagacguguaggaagguaacucaauucaggaucccuaaucaagauuucucuagucuuuaaguauuagaccuuuuugcucaagggcaggcuugguugcuaggaauuugggaacacugcucacuugggaucuccgacugaaguaggcucagaggugcagcccacugguugguguaccggcacaggacaaugucaucgugagucuggccuuccugaccaccuccacucgagguaaaaaucagccagccguucuugcaccgaggguugccauagacucgcaccgagucccugcaggcguguucguguacuauuuuauuucagguccagccccugugggaaccuagugagugauccgacaaagaucuguugcgcaccugcuccuucugcuucgucaguguuuuuccuccuuugagaaagaagaggcgagcuuguccccaaggcaaaaggaaauacagcacggcaagcguagacuaggcaagaggcggaagucucggcuucaagucgggcaccuuuaagcaguuuagagacccacgugacccagagagcgcccggcccagcggucacgugggggcgcgugcgccacacgcaggcagaggcagcccgcacagccugcgcgcccgcgccgccucccgcccaccuccgagccgggagggaggggagcgcggcggagggauuccgugguggcgccccgugcgcgugcgcagcgaacagcugucacccagugcggaacaagucuuccaaagauucccaaaacccucaggggaggccgcacuuuucaucccuuucauucggguggcgucuggaccuccgccagcggcgcagguaaccucuucuuggucgggacggagcgggaaggguggcggccucgguccggucuucgcagggcagcacgggccugggcgcuccgcggugcaaagcagucagcugggagggaggaggcggcccugacaguccauucuggcccucgggauucgggagcucgcucgccugccucccgggagccgaucggaggugcuguugcuccggacugccacgccuguguggucuggggcgccgaccgaccccucugcggccgacuccaggaaggccgggccugugcguccuccgagccucccuugggucgggauguccggauccgcgagguagcagguagcccgacccucacucggguucguucuuggcccuagcagaugaucuuucccuuuuucuuuccuccgucuugaggccauuucuuugugcgguuccuggggggagccaugaugcgggguagacagugggcgcuuaauagaugcgacuucguugcggcaugugaacugccagggagagagggcguguugugcgaugggaaugccaagaaggcaggcggucuagcucgggcuggaaguugguguucucugcucagcagugaaagcagcuggacucaguucugaggauuuucuuggggacccagaaggcagccgccgguguggcugagcccgcaagcucgcacguagucagucaggugcucugagagaagacuuggaagacuugaccaacuuuuuuuuuuuuuuuuuuuuuuaaaucuuggacucaguacggucacucacacuuggugauuuaccuaguacugcuuagaaagcuuacguuagaaaugaagcaauucggaacccgggagacgcuuuugauaggcucgguaagcuuagguuagcaccaaucuuugcuguauuucacccacuugaguuuugcguuuaaaaagggcggaagggaguggagccuaacucuuucuaugggaaaaguuauuaguauucuaauuuaaaagugugaugguuaaaacuuuugguauuuuugguuguuuuuugagucagggucuuauauguaguccugcccaacuuagaacucuguaugguagcuaaccuggugcuccaggaaauccaccugccucugcaucaccagugcagggauuccugcuggucauauuucugcacugcuacugguuauuuguucucuaaaauuuacgguccguucccaccgccuggaauauauagcucaagugguagggccaaugcuuaguaucugaacaccuuaaguucggucucuaagauugaaaaagaaaaaaaaagaaaaaggaaaaaaaaguucguuuuuaaaauuuaaaaauuuuuuuuuacuauugagcauguucacuaauguuuucuuaaagcuugcuggccugguaaccuaucaugcuuuguuuuggaaugcacugccuaguuaaguaguuuuaggaccuccuucccauuuuauuuuauuuuauuuauucauuuauuuauuuauuuauuuauuuauuugguuuuucgagacaggguuucuaccuucccauuuuaguguuuagaguuuacacauaauguuuacaguucuccacgaaauugguaauacaauaaaauucaacgcuaaggcuugcuuuaugguacuaaaaaacuuacuuaauuccucccucccccaccccacucucuuuccuuuccuuuugucuugagacugucucuuguagcccacauagauuggugaauuggugaucuuugucucuacuucuugaguguuggaauuacuuuguuugacucagaccuggggacugaauucaaggcuuuggcgcaugguaggcaaacucuauaccaagcuacauuuccaguccuacauucuguagcaaggauucuuacugcuauacccuugauacccguuauuauuuacuagauauuaaaugauaaaacaaguacauucuguacugucauuaaguucaauauguaaugcagguuuuuuaaaaaaauucucuuugaagcaguaguucuggcugaguguuuaaggcgauggaauagaaaaaauugucuccuuuuuuuguauguuaauauuucaugguccuguaaauaccauuuuuuguuuauuuauacuuguuucaaacaauagauuuugauccugauguuuucccuccacauacuccugucagauccucucucuaccucuuuacauacuucauuuucucucucaaacuccccacaaaacucaaccaaccaacuaaaacucaaaacacacacacacaaaaaucaguuucacaauuaaacagaacaaaaaguguauauauacacacagacacaggcccaggcaaagggagugggggggagaggaagagaaagagaaggggggauagaauaugaauaucuuucgucuuggucaacuaauucugggcaccagggccugcccuggauagaacugacuuuugcaggugguaucaauuacaaauagcuucuugguuaguggugggacuacagguacacguaucccucuuagcugagaccuuaucuagcuugaagcuguacauaucuuuuuuuaugcugccacaggcucaaugaguucauaugugcauuauuguugugucuggaagaugcccucuuucucuggaguccuccauugcuauggccuuguagucuuuccaccuucuuggucuucagucccuugaucugggacuggagaaaaaaauuuuuuuuuuuuuuuuuuugguuuuuucgagacaggguuucucucuguagcccuggcuguccuggaacucacucuguagaucaggcuggccucaaacucagaaauccgccugucucugccuuucaagugcugggauuaaaggcgugcaccaccacgcccguuugggacuggagaaauuugaugaagauaucccauuuagaccugagugcuccaaagucucucauacucugcauaugguguagcugauggucucuguuuuaauuacugucuacugcaagauucugugaugcuggcugagugaggcucugaucuguggguauagcagcaugcuaagggcagucauuuauugcaguguccuuagcaaaguaacaggagauguuuuuccuagacccauagccacuuaaucagugucauggauucugucucaugguaaguucaauaaaaaagugguuuuuuacugcaguaaauaccaguaucccuugcaggcaggucacuguuguagguuauaggguuuguagcugggugauacugaugauuaaccaccuucucugguaugguauaaagugccuuccagcacuguuaaaguuucuauucggauaccagcuccauuucuucauguuugaugauauaaauaggugauauacgucagcauuagggccuuaucaucugguuguggcaaguaaacaauagcuuauuacauuuugcagacaugccuaugggagccauuuggccaaugacucaaaaagauguaacccauucccaucauuggggguuugugucagguaucuagcugugguauugccucccucaguaugugaugauuccauuuagauuacuuccauagauuauauguuuuaggaacguguaaaguaguagguuuccauaugguuuuccaaagggccuuuaguguaccuccccauauuuuuucuucugcucugcccuuccauuuccuucuccauuugaucuuccuauuaugucuuuccauuugucucuccauaacuauauucuauuuucccuuccuugggauauggucuccccacccccaacuagguacuuaaacuucugugacuauucaaaucauagcucacauaucuaaagaguaaaaacugacauccacauagaagagauaccaugcaguauuugucgccuugggucuggguuguccgggaugaugguuucuagcuguuuuccauuuacuggcaaauuucauuuugguuaacaaccaaauaauauuccauuguguaaauguaucacauuuucaugacuuguucuaauaguugauuagcaccuaggcuguuuuucuggcuauaauguauagaaaaguaaugagcauggauguacaaguaucacuuuaguaagauguagauuucuuugaauaugaaugcaaagagguagcaccaucccugauuucaacuuguauuacagagcuauaguaauaauaacagcauggcauugccauaaaaaguugucuugcuaaauagaauaaaguugaugaugcagacauaauuccacacaccuuuggaaaccugaauuuugaugauggagccagaauuacaccagggagaaaagaaagcaucuuuaacaugauguaguuagacuggauagcugcauguagaggaaugaaaauacauccauaucuauuuuucuguacaaaacucaacucuaaauggaucagaguccucaauguccuaccauauacccugaauacgauagaaaugaauuaggaauagccuugaacucacugucacaggaaaggguuuucugaacagaauguugauaggauaggcacuaugaucaacaauuaauaaaugggacuucaugaaacugaaaagcuuuuauauggaaaagggcaccauaauuugggcaaaguggcaggcuauaguaucuugaaugcacaaagaagaaagagaacugggauccaggaaacaacucaauuaaaaauggggugcagaacuaggcugagaauuauaaaaaaaaaaaaaaacaaacucacaaaacaaacaaacaaagaauuaaaacucaacaaagauugaaaugcuuaaauguucaauaucuuuagucaucagggaaaugcaaauuagaauuugauauuucaucuuaacucagaauagccacgaucaauaaaauaaacgacagcagucugugguggggaaaggauucuucauuauggugggggugcaaacugguaggggcagucuagaauuuaguguggaggucccuccugaagcugggaaucaaucuaccucaagauucagcuguuuguuuauuuuuuggggaaaaugggucucacuuugcaguucuggcuggcuuggaacucacuguguauagcaggcuggccugcaguuccuaaaucugcccccagaauucagggguuaauggugugggcuaccauuccuuuuucuucacuauugagucucauuugaacuucuugggaaguauaguauacugucaucuuuuuuuuuuuuuaagauuuauuuauuuauuauauguaaauacacuguagcugucuucagacaccccagaagagggcaucagaucucauuacagaugguugugagccaccaugugccaugugguugcugggauuugaacucaggaccuucagaagagcagugcucuuuuuuuuuuuuuaaccugccuccucccucccccauacgugcucuuaaucgcugagccaucucuccagccccuugucuuauuuauuuauuuauuuauuuauuuauuuuugcaguucuggggauagaaacuagaguucuggaaauagaagccauauguauacaugcaauguguauuuuugucuuuauaacuauaguguugugaauccgaaaguacaaauuuaaaaaauuagugguaaaugaaacaagauaccauuaacaguaagucuugacagggagcugacagaauucauaauuuacuucaggugugagguuuaauuagagugaaacagacucaguuuuuacuuuuacauuuuccauuuacauauugcagcucauuuuacuuuucaccccccccccccacacacacacccaaagcuucccuacacacuucccucucugucucuuggaauuaagugauacacugaaaauauuucauauuccgugguagcuuaauccacccacgcagucagaauaaucccuuuaagaagguuagccuccuugcuccacuuccagcagcucuucauuugggguagcagccugcaguugacccuguguuugugaggcuuuguucagcccaucauuucccacuccuuuccucuguucgcuuaccucucagaguggggcugauccuuuguucuuccucccuucugauuuguacuuuacuguuuauuuaguuucaccgccccagccaccuuucugaaagcucagcuggaguccagugccuucgugcacgucuggccuguaacccagacuccuccuccucuucuuuuggugaauuguuuauuaaguuuuugaauagugacccauuaguugcucugcuuguuuuugcaucuacauacauuuaaagaaaacaguaacauguacaacgugcuaaguacuugcuagauaugggaggaaggcaaugcuaaaacugcagcuuucaucuuagaagggaauaagagauucuccagccauuuugaguaaccauggccugggaacacagacuuaugugaccucaaauucuauguuccaacauggaagcaagcaauuuaggaucggucuuaucuuacuguuaccaggcuacugaacucauaauguagcccagccuuuaaguacagugauccuccuugaccaaguguccaggguagcugcacuugcaggcugggcucuuugucucuauuuuuuucaaagacaggguccuauuauccauacugguucugaauucuacauagcucagguugaucuagcauuugugacuuuccugccucagucuccugagugccccaccacacuuggaccccucccuuuuccuuauuuucaggcgugguuuuggucuacaucuccagcugugcuuccugccucagcuucucaagugugaggauuuggggcuacccccuccuuccccuugcccccacccccacucuuguguuugaacuccauccuagugcaugcaaagcaagcauguacaauugagcuacacaucuccagccucaguuuagaaaucuugacuuuucuuccuuuuucauuucuguugugaaauuuucuucagaacauaccaaauacuaauuggaucucacugcacacuauauacauucacuucuguuuugucuggcuaaauuuucuuuggauaaaucucuuccuugguguuucccccuuuucauccccccuuccuccuucuccccuccuugucuuccuuacucucuuucuucacagcaacaagaaaugaaaauaugagcaagauuccuuuuuugcuucaguuuccucagaagagguauacuuagggagcuuaguucuuugaauggugugacgaaaaugacugaguucaggaacuggauauguuaagggguaaagguccaaaauuacuugcuggcauacucagauaaacgccaaacuucuuuuuucuacucucucucucucaaccuucucugucuuguuuucagccauaucugccuucuuggagaucucuugaagaauagagcagaacugaaccuaagagauaucucuuccuuuaggcuucuccuggauuuuauuucucugaaccaccuucgauugccugcuuugaaaccggaacccccucaguuggcccugcauuuuuuaguaguuacuauuguaaaucagaacucuugaaaagcagcuuugucuccagagcuugccugacugauuagaauuucaauacuguggagagguuggaauguugcaggcccaggagguaguuuuaccuuaucuugggcugguuuuccucuucugcacgcaguagccuuucuuuuuuccuggcagucuugugaguaguaggucauuucuucuuggacucuauuaacaugguagaccaccagcuuccaccaaccaaaugcuaagaaugucaucagagacccuucuguagccuagcauauagcauagcauagaaaagcuuucccugucuugcugugacugcccccuuugauauucuguguguuuuaaauuugccuugacuuauauuucucuuuguucugcaacauguucuguucucauaguguaacugaaacucaugaaacugcuuccauguuggaauauggaguuuggagugaucuaaaucuguauucccugugcaacagucauguuaaaaugcuccagaaaaauuuauuucauauucccuuaaaaaacaaaaacaaaacaaaaaacugcuuuuuuuuuuuuuuuuaauuucgcauugauaccauuuacuuacuguauuuuaugugucauuguuagugccaggacuguuuuguccuuucaaugucuguggaacuaaaguuaggaauucaaucacuguugaauugcuagcugcauuuccaguuccuucaguggcugcugacucugcucagacaaauaccaaggugacuuguauuuuggccagaagaaaaggaauguuucauuucauauagcugguguguuucacacagauaguuuguaguuuucuuaguuuccugcugugguuuuuuuuuuuuuuuuuugcuagugaaacaaauuagauuuguuuauuguuuuguuuuuuguuuuugagguaggacucuagcugccucacccagaguuugguauguagaccaugcugacuucugacuugugaaaauccucuugccucuuucucucaaguaccaagauuauagauguguuuuucaugcuaggcuaaucugcuuucugaauaacuuuuguuuaggacaaguuuauuccuuuucccgaaugugacauucuauguaaugucuuuuuaauauuuuauguguaauauuauauguauaugcauagucuguauguuagucaccauguugauucuggaaauugagccaggcaggguccuauguaagaacaacaaaugcucuuaaccucuguuccuugcuucuagccccuugauacucuuuucuuuacuuuucuugaucccccccucucucccccucccuuccuuccuuccuuccuuccuuccuuccuuccuuccagggguuuuuuuuugccgucuuggaacuugaucuguagaccaggcugucugcaaacucauagaaauccaccugccuccuaagugcugggauuaaagauaugcauuccuggccaauacuucuuuauuauuacucauauauuauuguaaugauuauuguauauaauauuauuauagcagaugugaggaagacuacgugccaaucugucuuucuuuucagugcuugauaacucaauggcuagugggcugugccagcauugggaggaaccccuugcugucuauaguauggguguagacaaggagacagagcacaggauggcucguugaguucuguauugcacagacaguugggaacucacagcuaggaagugugcagaggcugcuucaagggaaggaauaugugaagucacagauuacuuaacuuguuugagaaacugggugaaguacaguuggcuuucuauauuugaguuuuuuuguauugaugaauugaaucgaccaagggcuuacaaaaaauugcaucugguuaaggauguagcuuagcugguaagaguaguuaccuagaggguuugaguuugauuuccaguacuacaaaccuccuaugaaggagauacaggcauauggaucagaaauucaaggucacccucaacuacauaacaaguucaaggccagucauggcuauaucagaagucucaagaggaaaacuuggcauguaaaacauaaaaaauaauucccugugcuggaugccuuuaugucaacuuaacacaagcuaaggucacucgagaggugggaaccucaauuaagagaaugcuuccaugacuguuaccgagccuguuggacauuuucuuaauuaaugacuggugguggaugacccagcccuuugugcauguugcggucccugagcugguugcccuggguucuuuacagcaggcugaaugagccuugauggucaagccagucagcagcauuccucuauggccucugcaucagcucuugccucugguuccugcccuauuugaguuuguauacugacuucuuugacuaugagcuaugauauguucaaucuuacucucuuucuugaaccuggaguaggcuggagggcagcaaaucccagugaugcuucugucccugccuccucccacaaugcuaggguuacaaaacauggccaugcuuggcuaggcuuuuuacauggaugcuggaguuugaauucagaacuucaguuuugcacagcucuuaucagagcuccucugguacuguuuucugucuucaguagauuaguuuaguuucuggugguuuugucaugugauugguuuuuaauuauuauagaaaaccaucuuauaaaaaacuggaagacacuucagcucugugcuagugauauugaacauccuucagcauauauaugcuaggccuuuauauauauaugugcauaugugagauaguggaccaguacaucuguguguuuauuugaggaccauuaacaccugaccuccagguuuucccagcagucccuccucagcauaccuuguccccaacccugaacuuuacagcccagcagcuacgcugcuuuucuccuucagaggcuucuccuuggugucugucucuauguuucucuguuugucugucugucugucugucucucucucuguucuuuucccucucuuucucuccacucucuuugugggcucucucuccaccuuucuuuccucuuggggccagugaacuugccuaagaacagcuucccaauaaacaugccuuuaagauaaucaaauuuggcuugaacuggcucauuuucaccaguggagaaauaacuuaucucugugguagacuguacuucuagaaaauucaguuuuacuuggaaagguuucauggaggucaguuuuacagucaggucagugauucuguauccagaauaggagcauguuaggaagcccugaggcguccuuuuugaggaguccauuauugauggccaccuuuucuuugcagaaacaucuguggccaucauggaggugguggagguggagaguccccuaaaucccagcuguaagauaaugaccuucagaccuuccauggaggaguuucgggaguucaacaaauaccucgcauacauggaauccaaaggagcccaucgagcaggucuugccaaggugauuauauucagacuuguccuaaaaaguauccuuugacuucgggaauuacauuguuaguuuuugguucuuucagugucugcuaucuagcuggaaugcuuaauuuucuuuuguuuggauuauuuauacuagacuauguucuagaauuucucuuccuuccucccucccuucuuuccucccucccuccuccccucucucuuucuuuuuuuugguuuugagauagguucuuucacugucuugaaucauagccaucuucucucuucaacuuccugaaugcugggauuauaggcucuagcaacuaugcuugucucguguuaaaacaacaagauacaauauccucaaucuacaguuucuaauucagugguguuuguuuauucaaauaguuuuauagcuguuacuacuaucaaauuauauguggauaucacaaagagaaacuauauauuuuaaauggucauuuccaauuuccugguaucacuguugcccuaggcaaucacagucugcauucucuaucaauuugccuuuuuaccuauuuuugaaaaaaaaauuuguauauuauuuauggguggugccuauguaugacauguggagauguauauauugccacaacucaucuguugaggccagaggacaacuuuagaguugguuuucuguuuuuaccuugaugugguuccaggggacaauauuguuuaucaguauuucuuuguucuuauuuuguuuuguuuuguuuuguuuuuguuuuguuuuuucaagacuggguuuccuauguagcucuggcuauccuggaacuuuuucuguugaccaggcuggccucugcuuccugaguucugggaguaaagguaugaauugucauaccaggcuguaacaagcauguuuaccaccgagcucuuuuaccagauccuagccuacuuucuuucuucaagugugaagugucugcuguguagcagugaugauggagggcaugcaggcagagucuauaauucuagcacuugcgagguagaggcaggcggaucucuugaguuugaggacagccuugucuucagagugaguuccaggacaggcaaggcuacacagaaaucuuguuuccaaaaaaaccaaaccaaccaaccaaccaaccaaccaaccaaccaaacagauaauuagggugaaagaauccagguuggagacaugguucaguagguaaaauauuugcuaccaaacugugaagacuuacagucuccagaaaucauguaaaaacugcggccaauagcauauauuuuguaaucccagcccuccagugucaguggcaaaugaagacucauggccagccugucacagaaggugguaaagagacugucuuaguuaggauuuauugcugugaagagaaaccaugaccaugacuacuuuuuuuuuucuuugguuuuuugagacaggguuucucuauauuuagcccuggcuauccugaaaguacucuguuagaccaggcuggccucaaacucagaaauccaccugccucugccucccaagugcugggauuaaaggcaugcgccaccacaccuggccaugacaacucuuauaaaggaaaacauuuaauuggggcuggcuuacaguuucugagguuuaguucauuaucuucauggcuagaagcauggugaguaggcagaaauggugcuggaggaggugagaguucuacaucuucuucagcaagaggcaggcagaaaacugugagccauugagccuggaauugagcaucuuaaugcacgcccccacagugacacacuuccuccauuaagaccaaccuauucuaacauggacacacccacaccgaaugggccaaacuuucaaacaugagucuggggagccauuccuauucagaucaccacagagaccugugccaaaagaguaggagguaggaguuaaggaaaaacauucuagguuguccucccugccccuccacuaauagaugugguguguguguguguguguguguguguguguacacgcacacgugugcgauugcuuaugaaguauauaaaagggcuuugaaucauuuagaacuagauuuacugguauugccauccacccaguaugguuacucggauuugaauucugguucccgugauugagcaguaagggcucacagcugcugaaucacuuuuggagcucacucuauuauuauuauuauuauuauuauuauuauuuuauuuuuuuaagacagaguuuuuuuuuuuuuuuuuuuuuuuuuugcuaagugcuaggauuacugagguaaugcauuaggggguuuauuccaccugcaguaagaagugaggguagucuugaauugaauagauuagucugacaaaacaauuucaggaaggaaugauuuauguuggcuguuuuagaauacauuauggugguagggacaugaggcagcuagauggucauauuacaucuacacuguggaaggaggaagagauaaauacuguuguucaacuuguuuucuacuuuuuaauacaguucagaaucuuagcccacacuuagggugggucuucacgucucuguaauacaaucuagaucuguccccuaggugacuucuaucaaguugacaaucaauauuaacuauuaaaauugggaaggaagauguaguaguagauguuuccuuguccuguucuuuugcuaugcugagacauugcuugaaaaaaaacuacacuggcaucuauguaaaaaaugaguuugguuguaaagacaaguguccacgggaagucuuaccagggauagugugcugaucuacugaacagcucucgguagcuuugaacacuuaaaaagagaagccaguuuugaguagguucaucuauucuuguucuuaaagauacgaaauuauguguuuuaaaaaauaaugguaaauggugugcuuaaggucguaggagaguucaugaggucccaaagacuguaauuucaucauauaggugcauggcacuggcagaggcuguugcuagugauacguucacugggaaagguuuuucccuggacuuugcauaucuguuaugaaggucaaaugguguggauaaugacuguuagcugaacagagaacuucagaaauauagguuuggaguacgaggacgagauaucuugauucauacuagagacuguaauccaguuuuuuacuguuuguggcauuuuguauccagaggucauuccuuuuguuagguggcuguugucaguaguuaugcucugacuucuacauuugugcuauguacuccccaugccuccauguccccccuccucauacacagaauaaguaaauguaaaaguuguuuagaauuugcuuuuucaguuuuggucucaacuugcagauuauaauuugagguagacaugggggaaucuuucuucaguugaacagaagguguuauuuuuccgucauuuggcaugaguaugaaaugcuaugucauguauuaucuaggaacugggcuuuauuagcccagagagaagcuggagaucaccuucuccucucuaguuuucuagcugucugucugucugucugucuagcuaucuauuuuuuuuuuuugaaacagauuucucauauaucccagaauagccuggaacccugaauuucaugguuguucugccuccaucuuugaaugcuggguuguuggcauguguguuacuauacuguguucauuauuugaccuuuuuugaaaaccuuuuuuugucuccuuuuuuguuucuugaacacaucuccugguccucuguaauuaguaugcugucuaguggugagaugacuuguuaaguaacgagaagaggagcuguaggcacacugaguacacccaugacagguauaaauuagaaucagaauaaaauuaauaugagaauuacaaauacaccugagugaguccaguguaccucacccucaauggaacacucuuugacaaagacagcguucucuaauaauauuagguuugcucuccuaggaugaagcugaacugcuuguuucuucuaauaguauuuugcuguauucuuauugucacauaaauuauguuuaaccuaguuucauucuuacucuggauggugaaguaacuuaaguguauagagcuucaacaaaccaaguuacuugguugaaaauccagacuauauagauguggauguuuuucuuuucgugggggaauaaagguccccugugguuccuuucuuaauguauuauugacauuucguggacuugucuuaacuuauaauaauuucuuuaacuuacaauaaucaauuuuugaguacuucaauaauagugaguuuaauuucagaguagcccaauuuuguuuuuucucuaauuauuuauauacauacacauaaacauauacauauguacauauauaugugugcauauauguaugugcuucauaaaauacaagagagugaagauauguaccuaugccuacaacaugaagauaacaucguucuucuuuugcuacuuuguagauagcaucuggcuucaacauaucuagugggcaugcauauuuuagcuggcaaugccuggguuugggaaaacagugacauaaaguauguauucugucuugacauacucaggaaguagucaauauaguugauagaaaugaagcagaauagguuuccucuacuuuaacucauuaaauaugaagguguuacuauuaaauuguuuaaugagcaaauauguuguacuugguuucgaacugugugaggugauuugauauuuaaagacuuaaaauggaacugaaaguaugacuguagguaaagcacuugacuuaccugcugcugacuguugaguucuggaucccgugggaaagagagaaccaacuccugaaaguuguccucugaucuccacuugcaugccacuuccaucacucaugcacguaggagaauaaaauaaaaucuaaaaugaauucaaaagaaaauaguugguauaggcuuggaucaacaugccugccugccuuccuuccuuccucuuugacauggggucuuucuguguauaccugucuggccuagaauucacugcauauacugacuggccucaaacuuagaacugauaggcuuaacuuuguaauaacuuuaauuuauuuuaugcuuuauucucuggcauuaaaaguuacuuaaaaauauuccuggugggcuggagagguuagguuuaaugauuaaaaccacuugauguuauugcagaggaucuggguuuaguucccaguaccuacaugguaguauacagucaucuauaacuccaaggaugccagacaaucaugugguacauguaggcaacauacuuacacauaaaauaaaaauucaaaaagaauaaaauauuccuagccggguguguuggcgcacgccuuuaaacccagcacucgggaggcagaggcaagcggauuucugaguucaaggccagccuggucuacaaacugaauuacaggacaccuaggucuacauagagaaacccugucuugaaaaaccaacaaaacaaaacaaaacaaaacaaaacaaaacaaaacaaaacaaaacaaaaaauauuccugggaaaccaguuuacuucuuuuauucuuuuuauuuuuaaaauuaauuuuuaaaaauuauuuguuugugcgugugugaugugaguauggguauauucagagaccuuuggaaguuuuuuuuuuuuuuuuuucuucccaccaagaauucuagggacuacacucuggugguggcuugaguguauaugaaccacuuguguaggggaucucaagaggucagagguggacauugauuccccgggaacugaguuauaggaaguugugaauugccauuugggugaugggagucuucuguaaaagcauuaagugcuuuuuuccacugagauauuucuuaagccacuaauuuuauguuuuauuuuugagacaggaucuguugucucaggcuggcccugaccuugcuauguagcuaagaacauuucuacugucuagauguacagccuuguacuaccaugccaagcuuaggugguucuggagggagaacuccagacuuuguacaugcuagauaucucucuuuuccuuccuuuucccuuuccuuucuuccucucuccccucuuccuccuucuccucgucuuauuuauucugagacaguuuucucuguguagccuugccuguccugaaguagcucugaagaccagcugaccuugaacuuguggagaucugccuucuuuugccucccaauuaaaggaguacggcaugcuuaccuggcuguaugcuugauauuuuuguucuuuuaagauuuauuuuuauuucccuuuguguguugaugugaguaucugcugugucuuugcaggugucugcagagggcagaagagagugucagaucuuguggagucauaggcauuugugagcuuccugauguggguauuggguaccaauuucaagaccuuuggaagagaagagcaacaagugcucucaacuguugaacuaucgcuuuugcacucacaguugaucuuucuaauacuuaaacacucugauuuccuuucaguuaccaagauuauaguauagugucuuaaagauuccuuuuuaacgguuuucugugugagcacguugaugugcaugcggguaccccuccuggagcuagagugcuggcacccucugagccuuugcucaagccuuccacuuuuauauaguguaccuuucaaauaguaguauugauguagacuggagguguugaguaccugcuguacagucaggagguccugaguucagauuucuaauacgcauguuaaaaaaaaagccaggggucauuaugcaucuccauaaugcuagugcugggaaggugaagagaggacucggcuccaugacagacucuguuuccaaauaaaauauaauaaaauacauacauguguauccuaaugcauauauacaaacacaaaaaugucagacauguuacauacacaaaacaaaacuuuuuuuuuuuuuuuaaagauacauuuguuuuauguaugugaguacacuaucacugucuucagacacaccagaagagggcaucacaucccauuacagaugguugugagccaccaugagguugcugagaauugaauucaggaccucuggaagagcagucagugcucguaaccacugagccaucucuccagccccagacaaaaacuuaauauuuagugaagcauagccacaugcauuuauuaccaauaaauaugguaguuguugccacuugagcaggauagaccuauuuugaaaagaguguguggaggacuugggagggguaauaguauucugcuucuuauacuugcccaaguggguccucugugcuuugguuucuaauaauucauuuucauuuucuguaaauaaaucuuucaauguuaauuuuuuuuaagauuuauuuuaugcauaugagugcacuguaacuuuucagacacaccagaagagggcaucggaucccuuuucagaugguugugagccaccaugcgcuugcuugggaauugaacucaggaccucuggaagagcagucugugcuccuaaccacugagccaucucuccagcccucucaaucuuaaaauauuuuaagaaauuucuuagguauucuggcgcauucaugcagucccagaauuugggaggagcaggagguauuccugggcauuccuagagacguaacaaauucaaggacagucuggguugcuuaagaagagacauguagauaaaauucaguaaaggugaacuugcuuguguucugugaggaagaguccaucaacaguugagagguaacacguggugaauuguuuguucuggugucauugguguuucaucuaacaucucagccugccuuuuuuuuuuuuucucgagacaggguucucuguauagcucuggcuguccuggaacucacguaaaccaggcuggccucgaacucagaaauccaccagccucugccucccgggugcuggaagguaugcgccaccaugcccagcucagccugucuuauaaacaccuaauaaauaucccagccugucuuaucauuagcucuuacucuuagucauucuguauacauaaaaaaaucauaaaaaaauaaaagcaaguguuaugaguggcauuaaaaacaagucaauacaaauguaguuaugggugucagugaauuuuguuauuaagaaucauauccuuacugcaaaguauuagugaguguuuacaguacuuuuguuacagagguauugagaaaauguguucuucugaaaaauaaaagguauguaauacuuaguuuggagugccaaguuaauauuuuguuuugcuuccaggugauuccuccuaaggaguggaagccaagacagugcuaugaugauauugauaauuugcucaucccagcaccaauucagcagauggucacagggcagucgggacuguucacgcaauacaacauccagaagaaagccaugacugugaaggaguucaggcagcuggcuaacagcagcaagugagucaguugaguuauguuuguaauucuuccaaaggggucugugagguaagaagccacguggacagagcagccggaaaagcaggaaccuccuuugucaucucuugucuucaucccugguuucuguucuucaaaugacggcuuacucauauuugauuauuucuaaagaaauugauccauauuuuauaauccuguuuauaaaaucuagaagugguucuuuuguguuuuuuuuuuucuguucuuuuuaguugucagagguuuuuaguucuuuuuagcuuuguuagggaaaauuuuauugauaauuuuguuuaagacuaaaaugagcaguagcaauuuaaaaacaacguugaaugaauagggaaacaucuauuauaucaguuauauggcauauaacaaauucuuaaaguuagucccuuaagccagcucauaauuauaaaagucaggaagcuaggagucauguagaugaaugauuaagcuuaggaugucugccacguuuacugcuaaggcuuugacugggagggcggcugcuugagaacuuagcuggaagauuugucuaggagggguccuuguaugaggcuaaaguucaugcugcucguccuguaaguggagcuuugcaaauguguagaaacauggacauauuacuguuuccuuuuuccuauaccaguccugcuaugcacucacacaucuuuaaaaagcacauuugaguaaauugcagacauuguggacuugugcauguguauguaacuuuggaguucaagauuugcuuucuuucuuucuaucuuuuuuuuuuuuuuauuauuauuuuguucuuugucaauuucauauguauuuaacauauucugguacuuuacccacuacccauucuuuuuccccaacuccccugucaguucccucuccuaauaggucccauucccauguuuucuuuuguuauaugaccuacuguguuuaauaagggguuuuugagugauuaugggcuuauauugaauggagccagguaggcucaccaguggguauacaacugaagauaaugacaucaucaucaucaucaucauuuuuaaaaauuuauuuauuauauguaaguacaaguugucuucggacacccaagaagagggcaucagaucucauuaggaauaguugugagccaccaugugguugcugggauuugaacucaggaccuucggaagagcagucagugcuuuuaaccacugagccaucucuccagccccuggacaucuucuuuucuaaauccaucacuagccaguagguucccccuuccuuuacuuacaguugacaguccaauauuguucacacccauaguagacagccacagcgucagcgaguucauaauuaaaaugucuguguccugucuaguagauggcauaucucuguuacuucucuauccuucugauccugcauucuuucuguuuccucuuugucuguguugcccgaaucuucauauaguggccguugucuucuuccagagaaauugaguagguauaucauauacugaauggggagaagaaugaagucuuacuuuguuuuugaggcagggagauagcuggccacuauaaagcuuaggcugacaaugaauuugugguccuucugucucagucucucaaguucugggucuguagguauaugccaccauaccuagcaaaauuuucuuucuugaagggaagacuauuaaagaauuuacggaaaaaaaauauauguguguguguguguguguguguguguguguguguauaaauauauuguuguuuuguuuuguuuuuguuuuuuguuuuguuuuuucgagacaggguuucucuguauagcccugacuguccuggaacucacuuuguagacaaggcugaccuugaacucagaaauccgccugucucugccuccugagugcugggauuaaaggcaugugccaccacgcccagcacgaauauauuuuuaaaccuuguguuuuuuaugugguauuggaugcccaauauaaaaaucuuaaucugaaacuggggauucagcuuagguguuguuuuuuuuuuguuuguuuguuugccuagcaugcaugaggccuguguuuaaucaccaguacuaauaaaccuggcuugaugguauaugcaccugacucuagagggagaggcaaaaggaucauuaaaagcucaaagucaucugaaaaucccccuaaaacugacugugcccaacuccugcuuuucucuccuuuuccuguaaaaucucagaaaaaaguuccaccuuagaacaauaauaaaaucuccaaguauuuuaaaaaacaugccaaaaauguuuaaauuucuuguaugguugugaauggaagcaaaucuuuggaugaacuuagcugauacggcauaaaaguaacuugcguguaugagugcauuauuugauauaguauacaaaugaugaagagucuuucuuguuauuucuaguuuaguguaaaaauuaaauuuugaauuaaaaaauauacuauuagaucccauucuuuuggaucuuauugagaauaggacuuuaguuauagauugagcaccucaucauuuauacuauuaagaaacuuuauuagcacauguacgugugugugcauguguguauguguauauguauguguguguauauaaguaugauguguuugugugagcauucauguuccauauaacuuuugugugguggucuuggaacaacuuuguggaauugauucuaggaauugaucucagaucuuuaggcuucugaggcaacuacuuuuauccauugaggcaucuuacuggccacauaauuuuucugcugcuguuguuguuguuguuauuuuucugcugaggauuguacucagggccuuuugauugcuagccaaauucucuacuauugggaauagagcagcugucaacauggcuaugcaaguaucuguggaguagguuggagaauuuaugccaaguaguuguauggcuguguuacaugguagauuuauuuuuagcauuuugagaguuuuuuacaugauuuuuuguagugcaacacuaauuugcaccucuacuacauuacccccagcauauguugucauuugcuuucaugauuguagucguucugauuaugguaauauaaaacucaaaguauuugucugugucugugucucugucugugucucucucacuguaggauauaggcuuugaacucauagaaaucugccagccucugccuccugagugcugggauaaaaagcgugcaccaucacuuccaguuaccaaacuaguagugauuuacauuuucugaguugcuaaggauguugaauacauuuugagauggcuuuuguuaccugaaccucauguugucuucuguuuguuccauugguaaaaaugucaguuuuugugccugucccaugcuguuuuguuacugugacuauuuuguauuaauauagcucaguaagauaucucguaauuuagaauggcaaaugcauucaguguuacucaccuugugccuucuuaguuuagauuguugaucucuucuugcuuugacuuugcugguuuggaugaaucuagaaauucauccauuucuuuuagauuuuuauggaauauagguuuuaaaaauauuuccuuauaaaguucugaauuuccuuggugucugucauaauguuuccuuguucauuucugauucuguuaacuuaggucuuuuuuuuuuuuuuuuuuuuuuugcugaguuugucuaugggucuguuauucuuacuuauuuucucaaaaauaagcuaucagacucauucuuuguauuguuuucauuguuucuauuuuauuuauuucugcuuugacuuuuauuauuguauccacauacuagauuuaaauuuuauuuguucuuuuuuuguuuguuuguuuguuuuuuuuguuuuuuguuuuguuuuguuuuuuucaaaacaggguuucucuguguagcccuggcuguccuggaacucacuuuguagaccaggcuggccucgaacucagaaaucugccugccucugccuccugagugcugggauuaaaagcaugcgccaccacgcccagcuuguucuuauuuuuguaaauucuucaauaguauuaguaauuuuuuuguguguguauguuuagauauauguauuauuauuauuauuauuuuucgagacaguauuucucuguguagcccuggcuguccuggaacucaaucuauagaccaggcuggccuugaacucaaaucugccugccucugucucccaagugcugggauuaaaggugugcaacaccacugcacagcagauauauguauuuuaaugcauggucuuaggauuccuguuauaggaauacuuuuaauguuucccagggauauuauuuuguuuucagaucuaaauuuuuuuaaauuacucuuauuucucauaugaccuauuuaucauuaaguaacaaacuguuuaauuuccacaaguauguguauuuacuagagauuucuaucaauuuuaacuuugauuauauuguggucagauaagacauaugaaauuauuucaguuuuuauaaaguuuuaagguauaguuuuugcuccagaauauggucucuugcguggaauacauuuuuccauccuuccauuuuaaaguauugccuaucuuuuaaagcuaaaauuaguuucuuguagacaauggaaagaugcguuuucuuucuuacuccauucauauagccugugccuuuugagauuggugaaguaaagcuauucguauuuaaagguacuauugaaagguacagguugauuguaguauuuuuauuguuuguggucuuguauuuguauuuuguauuucaauaauuauaacuucauuuauuuucuuuuuagcuuuggcuuguuuauuccucuauucagucauaaguauugcuucuaguauucucugcaagguuuguuugguagagaugaaauauaguaauaauaauaauaauaguaauaauaauaaugugauaacaauaauuauuuauuuuguuuuuguuuuuuguuuuuuuguuuuucucgagacaggguuucucuguguagcccgggcuguccuggaacucacuuuguagaccaggcuggccuugaacucagaaaucuaccugccucugccuccugagugcugggauuaaaggcgugcgccaccacgcccagcuuaacaauaauuauuuugagucaauaucucauguagccuuugcuguucuggaucuugaccagaauggccuugaauucauagagauuagguaugcgugccucaguguucugagugguaguggaauuaaagauguguaccacuauggcuggcugauacuaauccuuuuaaucucuugauauuagaaaaacuuucucuucuuccuuugugguagacuguugugcuggauacaguagucuaggccggcaucugugguguuuuagaaugcacuacuucagguuuuuucccucuuaaaauuuucaucuagaaauaagcuaaauguuuuccuucauauguugucuguguuuuuuuuuuuuguuuuguuuuguuuuguuuucaguuuucaaauacucuauauuuguguuuuacguaugcuauaucguuggacuuuuuuggucuugcuuauugguguccugugugcuuucugcauauguauguauauguaugauuuuacuugguuuaggaaagucuuuucuuugaucuuguugaagaucugaugauuuucuuuaaguccagauauuuguucuacuuaauucaaucaacuuuuaagacuuuuaccugagcuuuccgauugaguuauugaguuuuguaauuuugucuuucauucauucauuaauucauucauuuauugagauucucuucacuauuuuuauuuuacuuucaaauucugaauuauuuuaguuuuauucagauuuauguuuguuucuuuagcuucagguauuuagugcuagcuauucucuuuaucuuuggucugucuaugaccuuuuaaaauuucacagcgaaauuuagguucugugucugugguuuauguaggaaauuuuuauuggagaacauauauauaggacugguggauuuggggaaagauauguugccuuggauuuuuguauugugauuuuaucauauaucccaggcauauggacuucuuugcuaguuguguagccgaugugcggaucuacacugccucagguuaggccuguguuuaggcuguguggcuggggcaaggugugagggaccaggauggcacaggaagaugaggucucuugcauucaccaggcuguaucuuugcauagaugucugaucugguuuaugccuguaggcuggauaugguacagccugcuagguucugguggaacucacuggacuagacuagugcacaugguacacagggggugggaccagugccaagccugaagcuuggaaaggcacuagcagcaacugaucagaaugggcaagcauagaggauaugagacuacugccaaacuuggggguuggaaaccccacaggcaggacuggccagacuaauuuugggggcuggaaagguaugcaaugguucagggaguucaccacgguggaccugaguacaggguuggggaccagaacaggggcuguagauuggauuugccauaagcaacuggaguggaggaggaggagaggcagcacacagguugucuaccugggucugccgugguggcuacauggucccuaguagcaaguggggcugacaucaucuguauuuuuuuaauuaaaaaauuuuuuuuauuagauacuuuuuauuuacguuucaaauguuauccccuuuccuaguuuccccuucugaaaacccccuauccucuacccccuucuccugcuccccaacccacccacucccauucccaguucuguccuuccccuauacugggguauagaaccuucacaggaccaagggccucuccucccauugaugaccaacuaggccauccucagcuacauauauaguuagagccacaugucccuaucaucuguauuuuauagagcaauaauaagcuucugagaaauucagcacucaccccagagauauuuuaguuuuuacaugucaaaccuugauguuugugguggcucuuaaucguaguuagaauuguaggguugcuaaggcagaaggagccuggucaugagccucucuuuuagaacugugcucagugaguaaaugguucugagaauguauuauggagucaguuuugaguaaauugggguuugaacaacugugauggucuggcagcauguuaggacggaccuuugcuuauuuucuucaugaaaaaaaaaaaaagguaucugucuuaacuucuuuucuuguugcugugacaaaauacccaguuaaauuaaagauguguuugaagagguguuugguuuaaaguuucagaggauacagccuauaggggcugagagagccauggucgaccagagucagagcaaagaccuguagugaaggcuggugcucaucuugcuuucaucuuuuuauucaguacaggguggagcuuuccacauuuagggaaggucuucccacuuaauuuauuuuagguaaucucuuauagacaugcuuugaaauuuauguuuucagugauucuguauccugucagguugaacuucauuauaucuuucauaucaauaugauugcuuaaaauaaauacaaaauaauucagagaaguauauuucuuuaauuauuuugugagagaaaacuuuuuuaaagacauuuuaauuuuuucuuuuaugugaaugcauguuuugccugcaugcaggucucugcaugacuuguauuaaauggcugcagagaccagaagaggguguuggauccucugggauuggaguuauaguuuguugugagcugccauauggguagugggaaucagacccuaggccuuugcaaaaaaagcuaguaccuuuaaugucugagagaucuuuuaaucuggauuuaucuuuuaauuuggauuauaugcauguucauauguggcuauauguacucaggggggccagaguuguuggauucccuggagccaaacuacaggcaguaaauggccuguuguggguacuagaaggcaaacuuggguccuuugcaagaguguucuuacccaccgagcucucuauacauuuccccuauacauaggauuuuauguauguauuuucaggcaggauuugaauuuacgguguagccaaaacuggcccagaauucuugcuugauccuaaugccucugcauccugaauauugaaauuauauacauguaccaucaugcucaagaaguuaauuguuaauuuuaacauuucuuuuuuaaaauuaggguaucuuucuaguccaaguuggcauuaacucuugauguagcugagguaccuuuucuaucuauaauuuaugauuuuccuucuaucuuucaagugcugaguuuauagggauguguuaccaugacauauuuagguaaucaggguauuuguuaacucuggcauccugucugauagacaagcagguuaccaaggagcuggguuccuaccuccagaguuugguuuuuaauuuaacuuaacaacaacaaaaaaaugcaaugugauuacauuauauauacacaguaaucucuaaacugguguagucagcauggaaauauuuuaaugucauuacauagaagacuuaccuuauuuuauguuuuaauaguuaauugcuggcuauucagucugauaguuaauauucauugugaaagugacaggaucuaggaucacuuaagacaagucucugagcaugccuaugaggguuuauuuauauuagauuaauugagauggaaauacuuaccuuaccuggacagugccauuguaugggcugugauccuauauuggaauagaaggagagcuguacugaaaauuagcauuaaucuuucuuugcuuucugagugcaauuguaugcagaucagucaccucaagcuucauugcuaaagcgaacccugcuuuugucagaguuugaucacagcuacaggaaagugccucuuacccauuguguuucuaguuaugcugcugugcacuuccucauuugucauugucugcauuucugugcuggcaagaggaauuuauaaauucagaucgaggguguguaaaauuuugauaagauaugcgaugagaaauuaugcucuggaaagauugugcuagcuuauucuuccacucuaacuacauaaguuuuuuuuccuuuuuuucugucauuaguauauuaggcagcaccaaucuaauaacuacagaguaucuuauuuuaguuuuguugucuuagaauuuuauaaaguuuucuucucaguuuucuauagauguguuuuucuacauaaaugugcauaauguucuuauauaauugauuacauauuuuagaaauauuuugaaagcuagcgaaugaugccuuuauuaguguguuuuggaagcccuacugauaaggaacauaagaaauucuauagagcuuuuaauaugaaaucauuuauauauuacucauuaacucugauaccacaugaguguacaauauuuuuauuuagaaaguaaauuaaauuagauggguagaaaaccuuaaaauugccuuacugcuuugugguuuuuacuuuuuaauuuuuuauagauacuguacuccaagauacuuggauuaugaagauuuggaacgcaaauacuggaaaaacuuaacuuuuguggcaccuauuuauggagcagauauaaaugggagcauuuaugaugagguauauuuacacuuauguugugguuuuuaaaaguuuuuggugauguuguuuuuguuuucuauuuuuagauagcuuagaaguacucaauuauaucuuauuuauuguauucuauuuacuuuuuuuuuugguaucuauacuuuuuaaauaugagagaaagaaccaggaggauucuuuccuucuucuuuccuccauucucugccuauggcucacuuuuucuguuuguuuguuuauuuauuuauuuauuuguauuguuguuguuuaucuuaaauuaugugcauguguguaucuguggguaaggcuauguauguuuguauagaagcuuguggagguuagaggcauuguaucccuuagaauuuguuacaggugguugugaguucuuugauaugcauacuaggaaccaauuucagguccucuagaagaucagcauucacuauuaaucacugagcuguuuuuuucuccagcccuccccaucuccuuugcugucuuugagccagugucuuagauaguucaggccaguuuaaaacuugcugcuuaacugagcaugaccuugaacuucugaucauuuugccucuacuccggguugacaugcuacaacugugacagaugucaauuaauauauaggauauauugagguugccauaauuucucuaacauuacuuauaguaacuccucuccuauagugaugaauuacuccuuuagggcuagagaugcaggucagugacugagaacuugcuugucaugugugacaucacauuuugcaguucuggguucaaguccuugggcugcaaaaacaagcaagcaagcugggaaauagauaaauagaagaauaauaaauuucacuguguaguuaauaagggaguaaauaguagaauauuguaggguauuuuuguagaaaauauuuuguuccccaacaaucuuccuuguacuuuaugcauugacacccauugcuaacccuuaccuuaguuuccuuauuacacuuuuuuuuaaaaguaagacaaguugaaaagugcaggucuuaggguuucuauugcaacaacaaaacaucaugaccuaaaagcaaguuggggaggaaagagguuauuuggcuuacccuccauauuguuguucauuuuguugaaggaagucagaacauaaauuuaaacaggguaggaacguggaggcagaggcugaugaagaggccauggaagaguggggccucuuuuccaugucuugcucagcuugcuuucuuacaguacccaggaccagcaccacuaccccaggaaugacaccacccaaauuggacggggcccugucccucaaucacuagauaagaaauucauuacagauggaucuuuuuggggcauuuugccaguugagcuuccuacuuucagguaauucuagcuugugucaaguuggcacagacuagccagcacaguacacaaagcacagauucagaacaucaugacuucuuguauauggaaauuuuuguguuauuucugaccucaagaaagaauuuuaucagcauccuuuucccucuaagcaugcauuaccuguuauaggcuccagcuuucuccagugauaauaauuguucucacuuauaguaacucucuuuuuuuaugacaacauaauucauuguggccuguuuaugaacuuuauguaguuuagaucaugugguguauguucuuccuuucuuuuccuuccucuuacccuucauuccuacuuuuggacaguuucuugccauguagccagguugaucuugaaaucuugucccucugcccuuucaucucuucauccucaguucugggauuauaacuguauuguaucagacaaccuuuuuuuauuuccaaguaauuuuuugaauuauuagcuguaguucauuaguuuuaacgacucuaugugauauaagaauaaguuauaguuugucuuuuuguuauucguuauuuggguugcuuuuaauuuuaguuuuuaugaucgaggcuucuaugaaucuucuggaaauguuuccuaaggcauagaaauauacuuuccuguugguauagauguagauauacaugacuggcaguguuggagagauggcucagggguuaagagcacuaacugcucucccgaagguccugaguucaaaucccagcuaccacaugguggcucacaaccaucuguaaugagaucugaugccuucuucuggugugucugaagacagcuauagaguacuuacauauaauaauaaauaaaucuuugggcuggagcaagcagagguccugaauucaauuuccagcaaccacaugauggcucacaaccaucuguacagcuacaguguagucauauacauuaaauaaauaaaucuuuaaaaaaaaaaccugcgggcgugguggcgcacgccuuuaaucccagcacuugggaggcagaggcaggcggauuucugaguucgaggccagccuggucuacggagugaguuccaggacagccagggcuacacagagaaacccugucucaaaaauaccaaaaaaaaaaaaaaauaaauaaaaaaaaaccugacuggcuuuagaagaaaacauugcaguuuauaguuauccuucuuggaacaacguuugaauuuuuguucuuccuuagccuucuguagauuuuagcuauuuuuuuagguguaguaucuuguguguuuuguuuuguuuuguuuuccucuugagacagggauucuucuguguaacaaacaaccucgagcuguagaucaagcuggccuugaauguacagguuuugugauuaaaugugugcuacuaugccugguuagcuuguguuuuaaaauugcauuauauuaucugccucccucaagucguugugaaauauguuuguuuuccacucccaucuccucuccucucuuuucucccucuccucuuuuacucuuucuuacucuuuuguuucuccuucucuccuguuuuccauucuuuucuucccucuccagucuguuccuuguuuccccuucccuuccccuccccucccccccuuuccccuaccccuccccccuccucucuccuuccagcuugugggaaccuguaagucccuccucuuucuuuccacccagccauuggccacuggcaucuuuacugauagaucaaaaaccaguugggagcaaggaccuucagaguuaguaaacagauuccccauaagaucaucagaaccaccccucuacacagccccaccaccccccuccuuuuaaauuaagacagaaucuuacucugaagcccugcaugaccuagaacuugguguguauuucauuucagccuggccucaagccucugguuauccuccugcaucugcuucaccaggggugggguuauaggcaugugcuaucaugccuacuuuuggcuuuguuuacccuuuuuuauuuuuuuauuuuuuggacgcaggauuacuauaacugaggcaggccagaauggaucacuaugaagccaagucugucaucaaacucauggaaguucuaccuucaugcuuauaauuccagcacuuguaaggcugaggcagugaauucccagucuuagaucaaugguuguccaagagcacuauauggugaaugaaguucucucagcuuaacuuugaaugccacaaagccaaaauuggucaaaaagaaaggaauaguugcuuauccuaauauauuuuucaguggucaguaggauuguucugugaauacccauaugacagaucacagcugucugcaauucuaguuccaggggaucugauacuuucacacaaaaauaccugcagaugaaacaugaagucacguaaaauaaaaaauaaaguugaaaaaauuaacuugugggcuggagagauggcucagagguuaagagcacggauugcucuuccagaacuccugaguucaguucccagcaaccacaugauggcucacaaccaucuguaauggguuucaauguccucuucuggugugucugaagacagugauaguguacucacauacauaaaauaaauaaaucuuuaaaaaaauuagcguguuugaauccuuaguuuuaguuaauucuccucuccguuuacuucccagucguccuccccccccccccccauuuccugcuuauaccggugcacgcucuauccuuguacuuucauaucacaugcauucuacuauuucucaucucuaaaugucuagucuaacaucuacuacucccagugaccaugugcuagccucuugcuucuucaacuuaaauagacaaaucaaaaugaaaauaguggcuguguauaagaggaaacauuuaaguuucugccuuucugggccuagguuaccucacuuaauauauuuuccaauuccauaaauuuuccugaaaauuuuauaauuccaguuuucuuuauagcuuaagaaaaucucuauuguauaugugagccauauuuuucuuauccacacagcuauugugaauaaaacaucaaugaacauguuugaugugggaauauuaaaaagacuauuuguauccugugcuacgccgggcacuggcagaccacauagcuuuagcuggguggucuccacucaaucucuggccgggagcugcugaaauguuucccuuggccggucauucucaugucagccccaugcaaggaccgcccucccagccgucagcugccacaacacccaguaacccgguagaaacaaaacucuagaaguuaauaauuaaucagucagauuuauauaacaauaaauucucauuucacaggaugcccucacaauaaauucagagucaguugauauugguacaagaugcccaccuagauuagacaaguuacccuaauuauucuuuuuuuuuuaauuauuacauauuuucuucaauuacauuuccaaugcuaucccaaaagucccccacacccuccccccgccccacuccccuauccacccauucccauuuuuuuggcccuggcguuccccuguacuggggcuacccuaauuauucuaucccuauaugauauaaaucuaccuauggcuauuuaaaaccaugcggauuaugaaucaucuugcuuguugcccuccaucuugcuuccuucuccucucuccugagucugucugucugccugucugucugucucucucucucucucucucucugcagcacuuagcuccgccucucuuuucccugucuaaucacaagucuccugcugcacuaauaguaauuggacagggacuauccugccacacauguuuguguggguagcucugcaguagaauucaaaaucuugggggguaugccuaggaaugguauaguugggucaugcagucauucuuuauugauaccuuuuugaguaaacuccacacugauuuuuauaguugauaaaacaguuuacacagacacuaagagaaaucagcauucucucuuccuccacuugccuguauuuguugacauuugguuucuugaugauaaccauucugagugagaugaaguuaaccucaaaguaauuucuugaugacuaaagagguggaacucuuucaaaauauauauacauuugcauaucuugagagcuuuucaguucuauagcccauuauuuggauuguuaucuuuguguguggguauauaugugcacucaugugugcaugcuccuguuaauccuaugccagaauauauggcuccuaaauacuuucucaucguuuuggaaagccucuuuacucuauuaacacuuucuguugcaguaucuauccuuugaauuuuuauuuguugauuuuuuuuaaccuauuuccuaagccacuagaauccuacucagaauguccucagcuaugucuguauuucaaaauauuauuuuucuagaacagugguucucaaucuuccuaaugcugugauucuauaauacaauuccucauguuguggugaccaccaaccauaaauuauuuuuauuuuuguuguuguugcuacaucauaacuguaaauuugcuacuguuaugaaucauaauguagauauuuguuauguggcccucugaaaggguuguuugaccccuaaaggguuccagacccacaggcugagaaucacugcucuaggaacuauagagguucaagucuuuuuuuuuuuuuuuuaaagauuuauuuauuuauuauauguaaguacauauaguaagcuaucuucagacacuccagaagagggagucagaucuuguuacagauggcugugagccaccaugugguugcugggauuugaacucuggaccuucggaagaacagucgggugcucuuacccacugagcaaucucaccagcccgagguucaagucuuauguuauggguuuugaucuauuuggagcugcuuuuuuguuuauuuguggaucgagaaaagcuguaguuuccgauuucugcauguuuguauccagcuuuccugaugcccuuugugaaaagaggcugucauuccuuuacuuaauucuauucucucugucucugucugucucucucucugccugucucucucucucuccugucugucugucugucugucugucugucugucugaggugaguacauaugagcaugugaauucagaugguugaagagccccgaaguggaucagaucuccugcagcuggaguugcaggcaguuguaaccauucauuaugggugcuggaaaccaagccugagcccacccucugggaaaacagcaaucacuuugauccacugcaccauugcuccacccuagaugcugucuuuacuccugaguuuaguuuucaugucuuugucaaaaaucauauagcuguuacuuguuuggguuuuugucugguacaaucacuuaauuacguugauuuaguagccuacuuuugcgauagcauauuucugcuguuuuuauuacuuuuguugugcaauauaaccugaggucagauauacugacaacuguggcauuauucuguuugaucaggauggcuauggcucucugagcuuuuuuauauagccauacaaauuuuaacaauauuuuucucauucuguggggcauuggaauuuuugcuuuuccuucuccagcuuaguaugcauguggugugucuuucauguuugugcagucauaucggugagaauuuauggcuucggauuucacaauagagacucugaccuuuugauuuuuauaguccuucugcccccucuucagcaauguuuucugagccuuauuuguuauacuguuuuguagacgaaaccaacugggacuggucugcacaaaucugcauuuuggugguugugguuuuguaugguguuuccauuuguugcaaagauaaguuuccuuaaugacuguuaaagguaacacuuaucugugggcaugaacacauauguuuauagauuauaguuagggauuauguugauuuaauaaauuauugauuguagauucuaccccaguuuccaugauuuucauuaguacugaguagugguuuccaguuucaagcauggucucucucucuuguugaaugggucuuaaauauaaugagagagcaguugguuacuaccaaguauguguucuacuacuaugucugguaugcugguaauugauguaguucauaggugacagagauggguaggacuguuucuacuucccuccuuuggaaauuucccuucuucugguacuaugaaagcuuguccuuagagaggggucaggauguucagguucauuguagcucagggccucuggccauguuucugaaguguaugaugucuucagcaguagguacuuaccuucuaucucuauuuggcaaccaagggcuaaaguaagaguguguauguuuugggagucucuuagacagcccuggucaacaacacaaaagaaggcuucucauguuuggcauugggguuuuucucagguaguuuugaccuuugaagggaauauuaucagcucaaaagagaaaagcucauuaauauuauauaucuauauuauguauauuuauacauugaauuacaugcauuaagugauuuuuuuucuagguaaguaauuaauaguaugauaucuugugauuuuucucaaccauauuguuauuuaccuaccuucuuccuucuguacuuaucucuauccccuuuucuuaaagugauguuccaucuuucccauuuuccuuauccagucacuuguaucaugcaugccguuccccuuuugccccgucucaccuucuuuuguauuuaccuaccucuuauuccccaacgaacccucgauuuucccauuuuccuuaccagauuucuuauaaugugcuauuuccuucucuauugucccucagauacaguaucuugauaguggucccauuuuacuuuccugguuucuguaguuacuauaggguauguacucacauuagaagauuuggagcugaaaaccuucaguaagagaacacauaccacauuugucuuuugggucuggauuccuuccucaauaugaucuuuucuaguucuauccauuugccugcaguuuuuaugauucuguuuuucuuugcugcuaaauaguaucccauaguguauaggaaccacauuuucauuaucuauuuauuauuuauagaacacuuaggcuguuuccucguccuagguguuauuaaacauaacauucgccuuugaacauggcugaacaaguaucugugcaguaugauguugaguccuuuggauguaagcuaauaugugggccauauaguaagauuuugagcuuuuuggagaauuuuuuuuaauaacaauuuccauagagacaauaccaguuugcaauuccacccguagugaauggggucccucuuccucacucuuuaacauuuguugucuguuguuccacugaucauugccauucugaauggucuacaaugaagucuuauuuauuuauuuauuuauuuauuuauuuuaauuuaauuuauuuaugugaguacacuguagcucucucagacacaccagaagagggcaucagaucuuauuacagaugguugugagccacuaugugguugcuggaaauugaacucaggaccucuggaagagcaguuaguguucuuaaccgcugagccaucucuccagccuccuaaaaugaagucuuaaaguaguauuguuuuacauuuuuauaaugucuagggaaugaugcacguauuuagagauauuuugguauguucuucacuuucaucuaauucuagguauauuguuguuuguuuuuaguuuucuugauuuucuuaguggcuccauuucauuacugaguaaugugauguuuacuauccaugacuuugugaauuuucuguguuuuuucuuggaauugauuucuagcuauauuccauuauauucagaauauaagaaauuauuuuaauuuuuuucuuauuuguugagacuugcuuguauucuauuguaugaucuauuuuaaagaaaauuccacaggaucuugagaggauguuuuucuggaguguuugauugccauguuucauagauguuuguuaaauacauuggaucugugaugccauugaauuccacgacuuuagggcuggagagauggcucagugguuaggagcauugauugaucuuccagaggcacugaauucaauucccaacaaccacacgguggcucacaaccaucuguaaugacaucugauacccucaucugguaugcaugaagacagcuacaguguacucauaaaauaaauaaacagaucuuuaaaaaaaaauuccaauacuucucugguuuuuguuagaauggcauguuuauugauagagcauuuugauagugaaaccaugaaguauuacuguguuaggauuaaucuuuauauuuaguuguauuuuauguuuaggauuauuauguccucaauagauuguuucuguaauaaauaugaaguaaauucucguaucuuucugggccaguuuuaaguguaagucuaauuuugucaggcauuuaaauagagacaccugcuuauuccuuaguucuaucuauuugcauucuaagaaugaccuuuucuauccucucacuguuagggucaugucugucauuucugguucuccagugauaaauggauggaugcuguuuguuugucugccugucuuucuuuucucuucccuucucuucccuucucuucccuuuccuucccccuucccccuccccuccccuccccuccccuccccucuucucuucucuucucuucucuucucuucucuucucuucucuucucuucucuucucuucuuccuuacuuccuuguuaguuuuaaaagcuacucuauaucuuuugauuaaagcuaauuaauacucagaauuauugaaagguauauuccuuuuauuuuguuguuuuuguaguguuugcuguuucucuaaugcuucuuuguuucacaaauauguuacuuuucucccucauguagcuauuagaugucuuuaucauucuuuugaauaugaagaauuccuuauaguauccucuguagagcuggcgugauguacauuaguuuuuauaaugaacuauuuuaauuucucccucagucaugauagacagaauugcuacauauuguagucuggguuggcacuugugguauucuagaauguucaaugcauaugaccuucuggcuuuuaaauuuuaguugagggguuauuuguuauucugaugguccugccuuuguaugugauuugaugguuuucuauuguagcucuuauacacaucccuuguucaauauauuuaguguuuuaacuauggauaugucauguggguuuugguuucuuguuccaguugcuuuuuaaaauaccuuuuauauguggaugagcccuuguuucuuagguuugagguuuuauuuauuuauuuauuuauuuauuuauugauuguuacaauuaucuuaaaaugcucuauccuuuuggaauaaauuaacuucuuagagucaugcccuucauccuuugaguuuugcccuuguccauuuuucuacuucagacuucugaggguuggaccuaggacuucacacaugcuaggcaaaugugcuacacugcaccucaucuccagguguuugcaugaugccuacaagaguuuccuguucugucauguuauaaaaauuuuauuauuuucuuucaguguaccaauuccucuaccucuuccuaaaacauuuucacuugacuuuauugaaauuuuuauuuuuaccaucauuucauuugguguuucuucaauauuugucuuuauugaauuccauucuuauauccuguauugaccuccuuuuuuuauucaguugucuuuuuucccuuguaguuuauucauaucaccuuucauuucuuuuuuucuuuuuuuaaagacuuauuuguuugcuuauuuaauguaugcgaguacacuguagcugacuugagacacaccagaagaaggcauuggaucccauuacagaugguugugagucaccaugugguugcugagaauugaacucaggaccucuggaagagcaguuugugcucuuagacacugagcugucucuccagccccccauccuucauuucuuaaacauacuuuucauucuuuugaguuauuuguccaggaucuuuacugaucuucucuuaucaggcaggggacauuauuuuggaauuaguagacuuuagagaagucauaagguauuuuguguucuguuuuguauugggauuuguaccuuagaaguuaguuuuuuugacccucccacccccauauuacagcaucuguaaugcuucauaggaauuaagucguaguggcuuuuugguauuguuuucuuuuguuagacuuguauucaggccauaauggucuguucccagccguucugugcaacaacaguagauucacaaugaaauagagucuuagucaauuacacaaagucaucaccuaagcacuaaucgcuccuuggacuaaagggauauugguaguucugugucuauuacuauauuaguuauuguguguuugaauggaaucaaaagaaaauagaaagaaggaagccaacacugguaggauagugauucgcuuugucaugauagagaccaaacaggagaggaagacauaaauaggauaagggauugcagcaaaugucaugggaugagagaugcuugacuagcagacuggagagaaguaaagcuaugcugacugauaguauggggcaguugcauuuuucaggagccccaccacuaguuucuugggagcguaaagaaauaaaaggaaugaacgaacaaggagggagggauguagaaaucaaaaaagaaaagagaagaaagaagaagcaauacagagcaagaacagaauaaggcugagguggcuugaugaaguaauauucggauauuaaauaggugcuagagaaagagagaaagaaagccuagaagaguugaaguuuaaggaaacugacuagccugauuuguuaggagcauuagcuggucccccccgccccccaccccagaacugaggacugaacccagggccuuucgcuugcuauaggcaagcacucuaccacugagcuaaacccccaaccccagacuagacugauuuguggucucaggauucuuguauuuuuccuaucugcugggaguggucugugaugucuuugugauuguucauauuggaucuaacuuugggaauucagauuacucauauccugauguauguguauuacuuuguagauggaguuucauauauagucaaaugucugaauuucuuucuaggcaucgcauugccaauguucuccacaucccuaugcagccuuaggcaguauucugcaagaugauugccaucugggugaauguugcucuuguauacuuugguuuuggccagauuaucgauuacugauuuguuaaaugcuguucagaucuggcucaguuuguccacccccuaucccccuguaguuuugcaguauugucuguaaaguuuccuauguagucccauaacccuuggucucagaguccugagacucugauuccgagagguucucaggcugcaacggcaccacuguaucaaaagcucuuuuuaaauggucucuugcuuuuguuuucucaaaugccaguguugagugagcaggaaugggaaugggaugcuuguauuaauggcuuauuugacaguauuuaucuguuuuaaaugauuacuuucugcuucaguaccucaagaagaggugagcuaguucuuaauuuccccaaaagaaaguaaaguccugugaugcauauguuauuuuaaagaucuacaaggucuauauguagauguauaaaaguuagcuagguaugcugacacacaaggaagcaggcagaucucuggugaguucuaggcuagcuacauagcuacaaagauagccagugcuacacauaaugauacucugucuugaaaacagcaaccaaaaaaaucaaaccagucaacgaaucaaacagcaaaacccuauagcgauuauuucuuugagguuuaaaauagcauuuuuucuuuugguguaugugugugugugugugugugugugugugugugugugugugagacaugugcauggcacuggguguguugaagacagggugcaggagcuaguucuuccuuucuagcauuugcuucucggggacagguccugacacuuggggacacucacuauuguuuuuaaauaauuuauuauuuucuuuuauuguuacuuuaaaaagaaguagacugcauguuugugaguguguccaugaauguucuuuuuggauuuagcuauuucuaaauuuugaugcaccauucuuuuaauacaauauaaaacaaaaugaaacaccaagaaaacccagagacccaaaguauuacauuacugaauuucaaaguauuggaaagaauuuuccuuuacuuuuuaaaaaaaguguaaauuauacauggaucagaguugacuuucuggcuuuugcuuggccacauuacuuaagaaacagagccagcccugguuagagguguuuuuuuuucuuuugagacaggguuucucuguguagcccuggcuauccuggaacucacucuguaaaccaggcuggccuccaauucagagauccacccgccugccucugccuccgccucccaagugcugggaucaaaggccacugcccggccugguuagagauuuuaacuuuacuuggauaaucccuagcuuuuuaggcaugaacuuugggauccugagcaagugaugccuuucuuacagugcuuucagaugaaauggcuuuugaggacacaugccacuuuauuaggagagaaugagaugacaugauuaaaaaauuguaauauuguauguucugucuuauucacuugacaaaauucaucaccacuugugauaauaguacagaagggcaauguagaaauccaugggcuuuaaugauagucuguaguguaaucugauaacagaaaauuuauuuuauaguuguccuuguaaauagaaguccugccuaacaucuagcuguuuauaauuuuucuucugucugucaaaguuugaccaagccaugagaagugcuugauuagcagucauugcuuaggaaaaugcauguauuauuuuuaggaacuauuucacugucuuguauucaauaagaucuuguucugugaguugccuagauggaaaguuugacauguaauggaacucaguagauagucuuaugauuuuuuauaacuuauuuuauuucucguguaugaguguuuugcucacauauauguccaugaacuacauguaugccuggugccuggugaccauggagaccagaaagggcauucaauuccccugaaacuggaguuaacagauuguugugaaucaccaugugagugcuaggaauugaacccagguccuggggacgagcauuuacugcucauaaaugcugagccgucucuccaaucuuacuuuucugcuuuuaaauaaacuuuuaaaagcacaaacucuuugugggcaauauauuuuaauauuuauauacaaugaugaauauucuacacugcccaugcagccagcaaucaggacauagaaauagugcucgcugaugugcuuuuuguaggcugccuuucuauuggaaucccaucacuuucaguuagccugaauugcaugcugauugaacuugagcaccaccccaugcuugcucauucucucucucucucucucucucucucucucucucucucucucucucuuccucucuuucucucuuucucucccgccccccucccaucauucauucacauacacacucuuuuuggguguccagugcuuuaagccuaguauccauaucuaagugauuacuaugcauguccuuuugggucuggguuaccucauugaggaugacauuuucuagcuccagguguccuugugguauuguggagcaucuuuugguguaugccuagcgggguguaggugguuugggagguggugcucaggcuagcaggcugcagcagcacuaaggaaguuuggcuagacuggcauggagaacaugaaggagaaucuaauucccucacaugaguuucagccuagucuggcagcugugggucccugguagagagauucauguggggcagcacaguaaaaaagagcugaaggucggcuagaagggaagaaugaauggggcuuucagaagaaugggccgaucuuggguaugcacuaagaugcuuggugcaucauugcaccauuaggagcuggagauggaucgugaaguaauguuucugugcguagagugcaguuggacuaaggauccugaggugacuuguugucaccuaagaauuucagugaaagaguuuguuucuuauuccuauggucuuucagauuaaaaugguucucauaauuaugaugcucguuuauuaauuuagauuaguuauaucuguaaagauuuuuuuaaaagauuuauuuauuauuauacauaaguacaguguagcugacuucagacgcaccagaagagggugucagauuucauuacagaugguugugagccacuaugugguugcugggauuugaacucaggaucuuuggaagugcagucagugcucuuacccgcucagccaucucuccagcccccuguaaagauuuucaaauagguuucuuacuaaaguguauggacugaaguuaaguuggacuuaaguuaagaaauaggauacuauaaauacaagagaaaaaucuauguaauuuuauugaacuuuuaugaggucuccuaaaauuaaaucugcauuuuuaaaguucccagcauaggccuucaguuguagauagaacaguuauuuagggaacuaaaauguuuaaauacuuucuucuucuucuucuuuuuuuaacuacuucaucacuauuuuuucuuacacaauagugcuaggaaaugggauuagcuuauuaagcaaagaauuauuuaaagaguaaaaugaaaacagaacaagccuagaggguuuuaguguaaaagagaaauugguaagagugaccauuuguaaggcuguuuuaguacuauaguuauuagggggcccuuuuaggucauagagaauauuuuauucucuuuguuaaaggacugugugcggauugaaauggauuuuauaguugucuuguaaacugacauauaugcgcccaauguuggauauuagacuuugacuaugaguaaaguauuggggguugacaauauaguuugcuaaaacauucuacauaguuguguauuacaguaaauuaguuacugauugguaaauucucuuaaacucagaauauuucccuauuuuaaaauguuuuuaguauuguuuugucuuuaugagacaacacauuauguagcuaaggcuggccuuaaauuugcuauguagcuuaguugaacucguccuccuggcugcaguuuccaaaguuuugaaauuauacacauuuacuaccauuccagcuaccuuuaaugaaaaccaacaaacaacaacaacaaacucccccuuaguuuuacugacagucauucuaauuauuucuuuucuuuaucaccagcucuaugggcuauuccaguaauuuugccagaguuuagaugaguuguuaaaugcugacguuauguauauuuuaucaauauaugcuauaauauaugcuauuauugcuuuuugaggacuagucuuagcgcagggucuaugauuuggaaaacuugaauuuuuuuuuccaguagcacgaaauuuguaggacacaguggaucacaugcuacaguaaaauggacacgaccaagggagaaggagguguuuuuugcuguugauuuccuaagauuauguuucauguugaacagggccucgaaacuauugggcaaacaugaaacaaacuaaaaauuucagccccugaauguaaauacaugccaauuaucaguaucauauuucagauuaucugcauuaaacuaggauuauuacuauuucuuaauuucacugagaaucaugcaguuguuggauauaauuuuaccuuuauaauuauauauaaaaauauguugauaguaauuuuagaauaauuuuaauaauaauuuaauguaacuuuugaauauguucuauauuuuccauuauuaaaugauaaaauacacaguauaguaguauuugauaaauagcuauuugauuaguaaguacuauuuuuuauuuccuaacaccugcuuuugcuuuuucucucccugucuugucucuaggguguggaugaauggaauauagcucgccuaaauacagucuuggaugugguugaagaagagugugguauuucuauugaggggguaaauaccccuuaucucuauuuuggaauguggaaaacaacauuugcguggcacacggaggacauggaucucuacaguauuaauuaucuccacuuuggggagcccaagucuuggcaagucacuuguuuaauauucacacccauuagaguugagaaucauugauuguuguucauuauugaugagaauuuacuucuuuuauagagugaguguaaggaaguuuuggguuguaaucuuauaauuauucuuuccugccucugcaauuuaauauauuuuuaagaauaacuauuuaugccguguagugguggcacaugccuuuaauucuagcauguggggaggcagaagcaggaagauuucugaguuggaggccagccuggacuacagaguaagguccaggacagccagggcuacagagagaaaaaaaacaaaacaaaaaaagaauuauucauuucuggucauauuuggaaguugggucagauguggcagugucugcugcugauuaucuaugaauaguguuguugacaguaagccugcauuagggagugggaagguuaucuggauaucuaacaccugaaaauuuaguuuauuuuaucuguugaguauuuuggaguugauauuaggaaggaaagguuuucauuaaauuaaaaaaaaaugucaacuaauacuucauaaugacccuuucaugaaaaaguauuguuagauauauagaaaguauuaaaaaggcugagaagugugagaucuaauuucuugaagauaaauuuuguguauuuauuaugucacuagcuuuuauauuaaugauuucagacacaagcauuuuuauguguuugauugcccaggauauaaauuuucauagaaguggcuacugaaccuuauuuagaauccuggauugaacagaauauauuuuuggugauuaauuuucuucacugugccugucugcuuaugcaucuuacuguuggaauuuuuuaaacucagagguuguauagggauauuggugaggccauguuggguuuuuccucaggacuugucauguauuauacuuucaggcucagcuuaaguaccuuauuccuugccauauuuauagaugucuagccauuucauuuucaggucugcuauuuccugcaaagauguuauguucauuguuauuauuacagcucagaugguaggaaagauuguuuugaguuuugugugcccuauaguuucaggguagucucccaggagugauaccucugagaagaaaggaagguugcacuagucauaagcauuaagcaguguuggaguccugggaagauucuauagacagaugugaagcugccaaaauucuucagaauggcuuaggaugagacaaugggaucuggccuuuauacucaaguugucccacacauugcacauggggcucauccuuccucagggacuguauuauauuauuuuagacggaaugugagcuuggaucucagugaugugaagugaggagcuuguaagagaacaucguuuggggguuggaaagauggcucagugguuaagaguacugacugcucuuccagagguccugaauucaauucccagaaaccacaugguggcucacaauuaucuauaguggggccuggugcccuccucuggugugucuucagauaacuauagacuacucauauaauaaaaauaaauuugaaacuauaacaaucacaucuauggaauguauaguuguucaguuuugcuuuugauauaauuuauuagggauaugcuauaauuauuauauuauaaaugaaauauacuuaaaucuuauaaaaaguaguauuaaguauuuuacuuuuugacucauguuuuugugaugagaaauaagaaacaccaauucuuucaaauuaaugcucccuuuaggaaguagauugauggcuuucuuuguuguucuuugauuaauuuaaaggugaauguguccuugaaagaguuacagguuccuuaaccuggucacaucuuuccuauugucuccuucacagugauccuugggauauaguaguggaacaugaagcugggaauggcucucagacagauuuguguagggaaccagcuauuucauccuuuguguuucaucugaagugaugacccugugccuggacuuucucauuuauaacaugcagacaauagaaaacauauuacugugucagcacaugcuguuguguuguaaauacugaauaaauguuagcugugguagacugcaauccuauuuaauuggucgacucuugugccuuucagccguuucugaacuguagagcauaagucauacauacaaguuugugguuguaaaaguggagaacgucaugguaggaugaacuacuacaaauugaccauaaaaucuuugguuugauuuauaggcuaugacuaugaguaaaauaucacuuagcagaacuauaaauaaaggagcuagggagaagaagagagggcaccuguauuaguuaggguuuuauugcugugaacagacaccaugaccaaggcaaguuuuauuaaaaaaaaacauuuaauuggggcuggcuuacagauucagagguucaguccauuaucaccaaggcaguaaguauccaggcaggcauggcgcaggaggagcugggaguucuaugucuucauccaaaggcugcuaguggaagacugacuuccaggcaacuagggugaggaucuuauacccacacccacagugacacacccauuccaaccaggucacaccuauuccaacaaggccacaccuucagauggugccacucccugguccaaggauauacaaaccaucacagcaccucuuccuguuuuaggucuuuauuaaccuggaagggguucuuuguggccuuugacacuacauguggguagaagcugucccugauagaaauaccagcagugcuuaugaguaugagagagcaguggugacugccagugguagcagugacagaguucuggauagggaaagaguguuucuaaguaaauuauugagaguucuaggacaauuaacaacacuaaggagauaccgaaggacuaaccugaagcaaagaagccauugaaugagcaggacuaguuaacaagcaaguggucugaagguagcuuuuaaggacgcauaagaaggacacuucacagaaaauuggagccagcagcggguggaguuauauaguauguuuuggaaaauuuagcuuuuucugccaagaacuugcaauggcagucuaauaccguucaguuaaaacuguaaauuuuguuucuguuuuccagcuuauuugguugauaagauuuuaagucccuuguuuuuuuguuuuguuuuguuuuguuuuguuuuguuuuguuuuguuuuuugagacagauuucuacauugacagcccagaaagucucuauguagaccaggcuggcauugaucucacacagaucugccugccucugucucccagguguugggauaaaagaugugcaccaccaguacucucagugagucuagcuuuuuuuuuuuuaauaaacauuaguuuuuuagcguuuuguuuuguacaguguguuuugacuauaugcacucuuccuucccuagaucuuaccagauauauuccuuccauucauuccccaacuuggaguccccuacccuacucccuccaggucaauuugugcugcugagcuauuuuuggaugaguggucauuuacugaaacauggaguuaucauagaaaauuaaucuuuucuuucccagcagcucagaguugccaauagcuucucagcccaacuccccuuuccacggagggguuugauuuggggcuguuagaagcacugcgaauuuguauguguagcuauccugcaaugugcagacaacacugguuucuucucacucuuacagucucuuucaucuuucacacuaugugcagacucaugucaucugcauauaaggauacuuggauuucuuucuuucucauuuguaucuucucuaccuccuucacuugaccuaguguguuagcuaacacuggaaguacugugccuggggugcgugcaaaugguguuaaauuccuaguauugacugaaaaugaaaacauaacauuucaaaaucucugaaggaaauacaaaugaaaacagucaccagaugaaauuuuguaaaacuaugucccuauauuaagaauagucaaaggucucaaauuaauaacuuaacaugcaccaaaaggccagggaagaacaagaaucauaacaccuccuaaaaguagaugagaagugcuaaucacaauuaaguaaugaaauagaaacaaacaguagcaaaacaaaaauguaauuuuugaguugguucuuugauaagaugaagauugacaaucuuuuauucaaauuaacugaagaaauucaaucuaguuaaauaaaauuauaaguuaaagaggaaacauuauagcagauaccauggaaacucagacaguccuaaggaagaagaaauggauaaauuucuugguaaaugauauaccaauguuguuaucgcuggggcaucugcgcuuuucugaguggaaauggaggaacagugggucuggggaagagguugugauggaguggcacugagaggaauaggaggcagcagacagagugagggacacuguggcaaggauguuuuguaugagagaagaauaaaacaauaaaaucucaaaagauagaauguucuguaaugugagguagugacaaguauuaugauccaaaguaagcuaauaaguggaaaaggaaaaaaaaugaacucaaguauagaauucuuccuauccauuaaaggaccauuaaccauuaauauuuuugaaacuauuacaguaaauaguaaaagaaguaacauuuccaauuuuuucccaaagccauuauccuaucaaaaccucacaaauaucuaauaaaaaauaagaauaaaacugugggccauuuucguugaugagcacagauguaaaacuugucaauaaaauacuuacaaacugaauucaugaacacaucaaaaaauacuacugugauaaaguuaccuucauccuagagauuuaggguugguucaacauauguaaaauaguaauuguaauuuacaacauaaauagauuaaaugauagaaacuacaugaucaucuugcuaaaugcagaaaaguccucagaauacauuaucucuaugauaaaaguucugagaaaacagggauguagggaacaucucucaacauaaaggcaguauacaacaaacucagcaaacaucguugaaaauggggaaaauccuuaaaguauugacuaaaauuuucauauauacauauuuuuuggaacaaaucacucagagauauacuuacaaaggauuguguuuucuugaccuugaaaauaagaaaaauuuaaaacaaagauauuggauuaaaaugaaaauguacuauuuaguaucuaaucauugcuaccuuuaaaggaauuguaccuguaauaucuaaugagugugcuucccucauuagggagacacauuuuguucauguaagcacagaucuugccaguagucuuuacagcaggacaaugaaauugucuuucagaauucauuuuuaccuuguacuuugcugacuguuaucauagaauugcuaucaauaugaagaauuagcuuuacugggaacuauuucauuuuucuuucugggcaauaguguuaaggaauuuuuuacccuuuaaugauuucagagaauauugaauauguuggauuaaccauaggacauuuauuugagucgauuuguaauuauaugaauuggguuuucuggaaaguucagaaauagaccaaaacauuauucuaaacauaaaaagaaaagcagacccaauuaaauagauaaucuguccacuauacugcauuauuuagaaguuugggcuaguaaggucacacagguaauguggcagaagaauaucuaaugagagugauuuauauacuagaaguaaauugaggaucagaugugggauagaacaauguuaacuuucuauuuucuuaacaaaugaaugcacuugcuuuuucugugaacugaugauuacauuuaaaauggagggaauuuaaccuugccaguugcuuagaguaauauggguauauaacuaucucuucacauccagcucauuuugugcagccagauggugugugugugugugugugucuguuucugugucuuugucuguguguaugcacauuugugauguuaugaagagggaaucaccuugaaugggauacacccacaauuuuuucuuuucugaguguauuccugguauaaaccaauaagaaaaauacgacaagaacuuaccuuaaacguugauuauuuucauuuccuuaugcuaaaauuuuaucucuccccaauucaguugguagaauuuaaauagcaguauuuuaagggacagaacauaugguugaacuuucauucagagaauugcuuaguuacaucaaaaucaaauacauuuugaguacagaugcuauuaaauacaaccaaaugugcuacuagguaugcuuagaaaauuguaucagcaaaaaggaauuuguauuuauaauauacugugcuaguaagcaggaagucuucauguuuaaaagcaguauaucaucucaccuaacucauucaaugauuauuagauaugcuuguaauauauguacuguuugguuuuugugugucaacuugauacaaacuagagucauuagaaaggaagaggccuccagcucuaaggcauuuucucaauuaauagucaauagaggaguguccagaucaagguggguagcaccauuccugcagugauguuccgaguucuauauuaaagcaagcugaggccgggcagugguggcgcacaccuuuaaucucagcacuagggaggcagaggcagguggauuucugaguuugaggccagccuggucuacagagugaguuccaggacagccagggcuacacagagaaacccugugucaaaaacccaaaaacccaaaaaaaaaaaaaaaaaaaaaaaaaaaaaaaaaaaagagaaggaaaagcaagcaagcaagcugagaaaguggggggugggggugagggggaagggaagcaagccaguaagcagcaugucccuguggccucugcauaagcuccugucuccagguuccugcaguguuuauguuccuauccagacuucuuuggugaugaacagcaacgagaaaauguaagcugaauaaaugcuuuuuuccccaacuugcuuuuuuggucauaauguuuugucauaguaauaaaaaaaaaaaaacccaacuaagacaauaucuaaaguuuuuauugaaggaccuuuaagauuuaguuuuguacuaaaauuuucaguucaaaauucagcaaauaauucauuuacuucauguuugaaagcacuacuauaguguuucucaacuuguuuguugugacacauuugguaaaccucuaucuugagcaauacuuacauuacaauucguaacaguagcaaaauuacaguugugaaguagcacugcacaugauuuuaucgucggggggaccggucaccacagcaaugaagaacuauuagagucacaguguuaggaaggcugagagucacugcacuuggaacuuuaaaugaauauuucuuuucuuuagggcaaacaaaucuauaaucaggauuuuaaaagucauauacccacaaaauaaauaaauagaagcaagcuacauuuaagagacaacaacuagguucaugagauggcugacuggauagaugcuugccacuaagucugaaaagcuaagcuugauccccagaaacuaacucaguagaaggagagaaucaacccuuacuguauccugugaccuucauaauacacaugcaugccauacacauacacauacacauacaugcaugcacauauauacauaugcauccacaauacauaugauaaagauguacaaauagauaguaaccaauauuuucuacgaaauaauacccaaacucaccagcuucuaaacaaauaagaauaccuauguccagaaauagcuacacuacauaggaauguugugguuaguggguagucuccaggcuuagacaaggaaggguucaguagucuugaacaucuguucuguaagcuuuaaauuauaggugauuugugacauuuaaguaggaaguuuaugcucauuuuucuucauuucuaugucuaagggacaggcuuuuuuuuuuuuuuuaaguuuuuuuuuuuuuuuuuuuuuauuuuauaugaguacacuguagcugucagacacaccagaagagggcaucagaucccauuacagaugguuaugagccaccaugugccaugugguugcugggauuugaacucaggaccuuuggaagagcagucagugcucuuaaccacugagccaucucuccagccagggacaggcuuuuaauauucuuguuuccuaguucauuuaagugcaguucaguuuuuguaaaugaagauauuuaaauacucuucauaagcuagcuaaaauauuauaaacauaauuuuuuuuuuuuauucuuaacauuuuagguaugcuauaccuccggagcauggaaagcgacuugaaagacuagcccaagguaauacuugcuuucaauuucuuacaucguaggcuuuguguuuugagguaguucagcagcuugcuuauuuauuuauuuauuuauuuauaucuucuucaaacugcuagcuuuuaaauguuaaccuaauugaacaauauuauuuauuuucacauuaguagguaauguuucuucuguuguauagucuucauaaugaguuuagcugacucuuaauauuucacugggcaguuggcauuucaauauauuguaccuauucuuaacuuucuuuucuuucuuaaacacugcugaaauuuaucuuguuugcuggccacccuuccucuaaagaugucagcuggacaggaacuauuuguaauaacaauuagaguugaauuugagugauaacugguagcaagcaucuugcuuuaucagaacucacuauugaaugaguagaacacuucugcucaugcauugguauauguuauguuaugguuuauuaaaaugaugaagaaaguuuuccuucuauguaccauauauauucacuuaaaaaaugaagugugagggcuggcugauuaagagcacuggcuauucuuccagaguuccuaaguucaauucccuguacccacaugguagaucacacaacuucuauaauccuagucccauguggucugauacuuucuuuuagcaugcagaugaaccugaaagagaggggugggggauguguguguguauauacauguguacacacacacacacacacacacacacacacacacacacacacacacacacauacaguacauuaacaaauaaaucauuagguuuggagagauuucucagcgauuaagagcagugacugcgcuuucaaagguccugaguuuaguucucaucaaccacaugguggcucaccacuaucuguaaugggauccuaugcccgcuuuuggugugucugaagacagcaacaguguacucauauaaauaaaauaaauaaauaaauaaaaugaaaugagggcauugauaaaccucauuggccugaaaguuugaccagaaauuauuaauggcaucuacgauuuuuccccuucccccaauuauaggaaauuauuaaaaguggucauaggaucaccuuuauaagacacagugcuauaauuuuggcaggacaguguuuauuauauuacaguaauaagaguaguucaauugugagugugaauuuaaggauuauuuucaagaauacugaaguaauugaauacuguuuaggguaauagauuagaguagaauguuaugauuauuauauauucagaaugugaagguaguguacucuguguuaaaacuaaauguguuaaaacuagcuauucuuuucuguaauaaguccuacaacauuuaaauuaaccucaucacuaaagaacguuaagaggaaguaaggucagcuuuguggcgcaggcucaaacacugaaguuuauccugugaacuaugauagaugacaucccagggagguaaaggaggaccaagguuuuaaucaacagagagguaaaacugcuuacaguauuuugagaaaggaaacaaacgaaaaaguccuauaagacagugaaagauuuguaucuguugugcagauaccagccagauaauuacaaugauaaaauagugcaguacauaugauagacuguacacuguaucuacaucaaagcaguguaggaaacaugaaaugaaaaacagguugagauauuuucccuuaucuugccuuuacaguguaaccauugcagccaccuuuuaugcacaggugcauucgcuuuugauuuccaaugaaaucuugcuugauuguggcauuuaugaauauuuuaucucagaacucuaaggccuguauuugauacuuaugaauauuuuaucugaaagauaucaggcuuguauuuaacaaaaccaggaauuugaauuugccuuucaguugcuuuuucauuuuuuaaaauuuguguguguauguagguguauauagguauagaacuuuaccauccuuuaguaguuuucuaauuuaaguuaaauuauguuuuccuauuguucauguccugauuacaaauccaccucagaugcaaauuaauggacacuuuuuucuucaguaauuuuaacauaaaauuuaguucaaaauauagugcugcacaaaguuacagauuuggaaagcuucccagauguauucagauuuuguuauuaacauuguuggcuggguucugaauuugaugaccagguagcugcagcugggugccuuccugucuccuuugagaaggcuuagggcauuuaauuguacacauuuaaucuuuauaccguacaacuuucacuuccuauccauuaaaguuucauuuaguguuuauauuuuaugauuauuaaucauccuuagauugcuaugaaaaugaccccacagggcaaaguuacauuuuuauuuguguuagucuuguaaagagugguaguauuccuaaugucuccauagagaacugauuuugcaaacucccccucugucccuuuucuauuuuuaaacaggugaagaugcuuacccagaauguacuuaagaaaaaaacuuuauuuuuuaaaaaugaaucaugugucugucugucuaugacauguaugagucagugaagguaccucuggaaacuggaaaagaccaucagaguccuaguagcuaaaguuacagguggcugugggccuccuaggauggugcuaagaacugggcucacgucuugaaagaacacuaggcuuuuaacugcugagccaaccauuuagaguacaauacuuuuuucuaccaagcuguuccuuaaauuccuuugucugcauacuagcuauugugugcucgugcacuucucucucucucucucucucucucucucucucucuccugagcacuguagcauaaacaaccauuucaauuaucuaaaaguuucugugaauuuauucuacaccauuaugaugauucgugauuaaucauuuauaucuaccuugcuguccagaggccuuguguggauaaggauaucugaaaucaaucuaacucaaacauacuuuuuuuuucuaauuaauugaguucuaaugaguuuuucauuaagguacccuacuccgaguuguguguagagcacuaggcaagccuucucuucauuuuagauaugaggucacauaguaccucuacuucuaccacauuccuggaguccacacuccaucauuccuggagucuucuuguuuccucuuucauguuccucuaucuucucuuuguccuuuucauugugacuuguuuuccacucucugagauuucucauccuuugaaggagaaagggcugaauaaaacaucaaauaugccaguuuucauuuuccucucccuguaucaccaaggugaugauaacaugccucagcuagauugaaagcagugauggagaaaaucgaccaugaacuaaagcacaauacacugcugagugaacauuuaauacauugaggaaucaaagauuuccuuaauguuuagcguccucucuuaaaagcucccaaaauaggcuuguaaggcaaguuuccaaucaugugugcuagguuuacucagaugggauuuuuuuuuuaaauuuagauuauuuuauuuauguguaugaauguuugcuugcauauauguaugaaugugcaccauguguauucuuggugcuguggaggucagaagauggcaucagauccuuuggaacaugaguucuaggugguugugagccaccguguuggggcugggaaacaaaccuugguccucugcaagaacagcaagugcacuuaacaguuuaucccucucugcagccucugaaguauuauuucaaauugauauguaguaauuaugaauguuuuuaugguauaguaugauauuuucaaaugcuuauaccaugcuuggaaggggaaaucuaucauuuaagagcuacaucacuuuuuucauguuagacauauuaaaauccugucuguguuggggcuggagaaauggcucaguggauaagagcacugacucuucuuccuaagguccugaguucaauucccagcaaccacaaggugguucacaaccaacuguaaugggaguugaugcucucuucuccugugucugaagacagcuacaguguacucauauacauaaaauaaguaaaaucuaaaaaaaaaaaaaaccauaaaauucugucugugacuuugaaauaauuuaguuaauuguugccaaacauaguuauuguaggauauuguaaguuagucguuguuagugugaaauacgcaggaagauaagaaaguguuuggugcauauagugucucaggcuuuuggaacuggugcuuucagaauaguuaguucucagagucuccacugagggauuggcuaguacggguguucuuaaucucacuuucgacuugaacaggaaguuugaacaguuacuugcuguauauuuggcaacuguauuucaauuacgugccaaauugaaauucuuaaaauuaagugauuuuguauguacaaauguaauucuggguaaauaguuuugaaaagaucaaccuuuuugacauauauauauuaccuuuuaaggauuaguacuugggcugauuuuuagucauuguucuaaggacauuagaauugaaguguguuuuccaaccauaugaaauguuguuuuagcugacugcauuucugcugcuccuuaggcuucuuccccaguagcucccaaggcugugaugcauuucuccggcacaagaugacccucauuucccccucagugcugaagaaguauggcauucccuucgacaagguuagcggcucuccgacuuuacaaguccauugcucauaucauaggauuuguauuuaagaaaaguucaaaauggcaaaacguggucuuggauuauuaaauaauacuuaugacgggugaagagaaauuuaaacuccuauaacaucaauaauuaauuuaaaucguaauuaaauauuuuaaaauguuuuacucagguuuauauauguuuaauuuuuguuggaguauuucauacauaaauauaauaugcacccacuauucuucccauccagauuuuucccuaccccauggucacuuuuuucuccaaacagaauaaugcccuuccuuccuucuuccuuccuuccuucauuccucucucucucucucucuuucucucucucucucucuuccuuccuuccuuccuuccuuccuuccuuccuuccuuccuuccuuucuuucuuucuuucuaaacucacagugucuauuuaguaauacuuacaugugcauggcuguagaaccauguaucagaggaugaauacauucuugggggcccacaguuaaaauaaaaaaccaaaaaacuaaaaacaaaacaaaacagcagacaucaguugccaguagcucuuaugguagaacuucaugaucuccuuuuccauccauacugauuugguggcuugaaugaucuuguacaguuuuuguauauauaauuacagcugcucugagcucauguaugaaaugguauugucaugaauggcagauagguuuuucucgagauaucugcuaucucuggcucuuucuguccucucuuccauaaugauucucaagcuuugcggggaggggauaugguauggauacucugagcugacucagucaagucaguacaagucagugauggugucccuggaagccagaagaggccaucagauuccccacauagaguuaacaggugguugugggucccgcagcauggugcuaagaacuugacucagguccucugaaagaguagcauuuuauuuauagcacauuuucuauacacauuuuuagguugguggguaucuaggcugcuuuuuuucccuaggcauuaugaauaccacagcaaggaacagggaggaacaaauauuucuguaguaagcuauagauuccauugaggauauaccagauaugcuguaacuggguugugucauauaucuauuucuagcuuuuugaguuacuuccuuacugauuuucauauucgcuucuaccagcuuauacuuuuuccaaagugcauaaagauauuucuuuccucacagcauggcagauuuguugucauuaauggagguaagaugaguuucaaacuaguuucaguuuucauuucuuugauggguaaggauguuagacuuuuaaaaaauaaaauauuucacagucauuuuuacuuuuuuuuuuuuuugagaacucuguuuacuuucacgugccaguuuuuguuuuuuguucuguuugcuuucuugguuuuucaaguuuuucuaucuuuuagauaacuacuuucuuccagauauaucauuguuuaauaccaccccccccuuucuacagauuacaugaauuaucauguccuuuacuuuauagaaguuuuuuuuaguuuuacuaggucccauuugauaguuucaguuagucugaaugccugugcuacuggguauuguucaaaaaggguuuuuguuguuguuguuuuguguguguguguguguguguguguguguguguguguguguguauuuucgagacaguguuucucuguguagccuuggcuguccuggaauucacucuguagaccaggcuggucuugaauucagaggucugucugccucugccuccuaauugcugggauuaaaggcgucagccaccacugccugacucagaaagcucuuucaugucccuauaaauuaaaguacauuuucuauuaaaucauggugucuagucuuauuuugaaguuuuuccauguauggcuguuuuuguguauggucgaaauuaauauauaauuucauucuucuaaguguauauaucaaguuugacugguacuaucuguugaagaugcugucuuuucuccaauuugcuucugaccucuuuguuaauagcuguaguaaugugggcucauaucuggcucucaauuuuauuccauugaucaauguguuuaugccauuguuguacugcuuuuugguuuuucgagacaggguuucucuguauagcccuggcuguccugcuacucacuuuguagcaggcuggccuugaacucagaaauccgccugccucugccuccccagugcugggauuaaaggcgugcgccaccacgcccggcuuauuguacuguuuuuauuaccauaacucuauaguauaguuugaauucaaugaugguaaaacuucuagcagugcuuuuauuguuuaauguuauuuugguuauccuaggucuuucgugacucuguaugaauuuugugauucuuuucuucaauuuaugugaagaauugcaugaaauuuugauaggaguugcauugaaucuagagguuacuuuugauaaauuuagcaauccaugaacaugagaguucuuuuaauccuaugagauaggaaggaaugaugugacguucacgaagaaccuuugaagugagaaggagugggccuaaguuguguuuguggggagccucagagagcugggugggccuuguggcaugggaaagggaagguacaugaaguaucucaaggaggggucccacaggcuggguaggaggagaacuugcuucuuugaaauaagaaggaacuacaacccagcauaacaaaggucccaguguuaucuucuuuuaggggcaaagcuuuguucaaaauaggauuuuucauucagcuugaugugauaauguggcuuucuuuaaauugggccaguaauguaguugcaggacauuucauaaucaacaacuaacaaggccgagauggccguuugauugcagucuauacuucuauauuuauauacuuugacugcaaaauauuugaauacaaaucucuacgugauucauuuacuucccaaaauuuuagaacuggaauaucaagagaauuauuucccuuucgucaguaacuucaaacacaacauuacuugggcuuuguuucaaauguuugagaggaaucuuugggcagugagaacuggauggugaaauucuucgcuuucuuauuuguuaacauacuaaauaauaguuggugucuuuucuaggauugacaaucuugucccucacuauuauucucuugguucucauuucacguuguuuauuuagucauucuuuugccaacuauaguugcuguucaggacuggaaaucacuguagauauuuuauguuuguucuaaugguaauuuuuuuauccauaaguauaugcuuaccauuauuaguagacuuaccauuaagaauauauagaauauauggaaggagcaguaaugauaaauacaguaucacaaaugggagagguuuggggucauaagacuugcagaacacagauggcaauagugaauccuuuuucuguguuguaucugcagaugagauguucacauucaauucugugauugcugaaaauacacaauauguuugcauugugguccauagauugaacucaaguuaucaggcacuauuaaccacugaaaugaaacaacaucuagaacuucuguuauuugaaaacacuugugauauuuugacaguuuuuuuuuugguuuaaaaaagaaaauguaaauguauauuaauuauuaaauuauuuggaaaguuauugaacauucugucuccucaaacuccacagaucacccaggaggcuggagaguuuaugaucacuuuuccuuauggauaucaugcugguuuuaaucaugguuucaauugugcugagucuacaaauuuugcuacagucagauggauugacuacggcaagguugcuaaguugguaagucucuccugacaagugaagcacacauaguaugcaccuaaggagcaugugcggcagucguguuccccauucacacugugccucucacuacuuuagcuuuugccagguuagcuacauuuacuuuucauacgacgaauggccacucauuacugaauuugucuguuuugagauuguuauaggacguuuuauucugcugggauuuuuuucuguccgugcuuacuuucacucucaaagcugccauuuggauuuccugcagcguuuuuuuuuuuuguuuguuuguuuguuuguuuuugguuuuucgaggcaggguuuuucuguauagcccugacuguccuggaacucacuuuguagaccaggcuggccuugaacucagaaaucugccugccucugccucccaagugcugggauuaaaggcgugcgccaccacacccagcuccugcagcauuuuucuuggcuguguguaaaaugagauuuggacuucacauuaaaguugagucaguuguuuagaaaacagcagguuauagaaggaaguuauuaguuaaauugagaacuguugguuauugagaaaguauaguaaaaagaaauuaaggcuuccuuaauguaaaauuauacuucuuagugguaacagucuaaaacacauuuuauaucuuaaugauaaacuugguauaaagauucguuugcaguuuuaguuuuaaaacucuguauuuguuuuaguucauauaaacaauaacauuaaacuuauauaaaguuuuguuuauaguuuuaguuuuaaaaacacuuuuauuucauguacuguguauuuucaucugcaacaguuuuucuugaauugaauugcuuucaccuugaggcauuaaaacagagacaucuucaaaacaauugaugauaugacccuuuccuauggcuuuuagggagaagcaaacugggagagggcuuggucuuaaugaaacuauuucaaaguauaugaaguugacauagucagggugaaaaaugauaaaugacccuuauagccuuuuccuagcuaugucaugguacacgugacuguucauccuacucugaguaagauuguaugugggaccauuucaugaacguagggaaaaucacucguaaguuaguuacagguguaauagaagauuguauacauuaaaauacauaaaaaguucuacucuuuggcaacucagaaugaauucuuguuaaagguuuguuuugguucuuugacaggauccugcauauacuugugugaucguaaauuggucauuuagccuucagaaccucuuuacaucuucuucucacuccuacugaauccugucuuuuucucaaaugguucccaucugauuuucuauauuucuguuauggucuugucuaguuuguuagcuacaugguaauuagaauuguugagaauguuugcgguuauacagucaagcacagacaaguuugcacgacuacaccacaagugaagaaaaugauuagugccuauuucugaggggcugcuuacgaaggcauaaaacugaacuagcuccuacuaaacagcaucauucuuugucuaaugagaaauaggacauucagcauguauuuguuggccuguaacaucaaugcuugcauugaggucagccauuuuuuuaauuaauacaauuuauuuuaaaauauacaacucaguauugacauuuuuaaaaaaugauuuauuuauuuauuucauguauuugaguacacugucgcugucuucagacacaccugaagagggcaucagaucucaucagaugguucugagccaccaugugguugcugggaauugaacucaggaccucuggaagaguagucagugcucuuaacugcugagccaucucuccagccccaguauugacauuuuuuaagucaucaaaauaaucuauaauaguuaaaugccucuuaaauauacaugauaucuucugaugcuaaaaauaauauguauauacucaaucaguuuuuagaaucuguuuggaacauuaaacaugauagaaguagaaaaaaaucucauauuaaguucuuuaugaaaggaaauugugacagauuccugauuagacagaaacuguuccaucuccaagggagaauaugcagucuaauuguggcuucacaguuuuggguaguguuccuucuguuucuauuuuguggaauaguuugaggaguauuggaauuaggucuucuuugaaggucugauagaauucuucacuaaauccaucugguccugggcuuuuuuugguugggagacuuuugaugacugcuucuauuucuuuagggguaaugggacuguuuagaugguuuaucuuauccugacuuaauuuagguauuuguuaucugucuagaaauaucuguuuagugcuugcauugaaaugaaaugcuuucuucuguguugaaaucuugccauaaacaugcaguuguacugugauguuguuuuuugcaucuuuaaauuuggcagaauaaguaagcuauuuuagauauuuggauaaucagaaaaauggccuagugcuuguuuauuacaggcuucaaaacuauuggguggaauucaccaaaauaagacauuucuuguuuauagucauuggcaaugagaucauuuuucuauauuuuuauaguaggaguggacagccaccagugaagaauuguggauguugguauaccuuagaaccuuagcugccugagguguuacagaaguggaucuaagcccaauuuuucuauucuugcuagguaugauauguauauucaggaaaguaacuuauuuuucaacaaaauuagaaaguccucuuuaaagauuugcuguggugggagaaaucauaugcacgugaaaucacucauuauauuacuucuuuauuugguuuugaacacuuuuuuuuguuuaguuuguugggcacaugacuauugauacauauauauuaggcuagcuaauuuaaaauguuccacauauccuauauagguauuuccccucacucuacucuuccuauaggccaggugacauggcuuugcuuugagcauuugcuuugagugguagcaaaagcuuguaggugguauagaggugggcuuuaaaaccucaaagccagugacauaccucuuagucauucuuaaaugauuguaccaaguggggaccaagcauucaaauaugaaugaaccacugcucgcuaaauuuacuucuguagaguuguaagaguagggucuuuuccuagcuaauugacaggcuccauccaguauauaguuaauucaggacaaacaauguucaaauauauauauauauauauuuuuuuuuuuugcuuguuugcuuguuugucuuuuucauuuuuuaaaaaauuggauauuuucuuuauuuacguuucaaauguuauccccccuuuccugguuccccccccccccaaaaaaaaaccccuuccuauuccauccccccuccccuugcuucuaugaggguguuccccaccccgcacccauucacuccuaccucucugcccuuacauucccuuacacugggguauugagccuucacaggaccaggagagucuucuccuguugaugccugaaaagguugucuucuguuacauaggcuggagccaugggucccuucauguauacuccucgguuggugguuuagucccagggagcucuggggagucugguugguugauauuguuguucuuccuuauggaguugcaaaccccuucagcuccuuuaguccuuucucuaacucuuccauuggggaccccaugcucaguccaguguuuggcugugagcaucuacuucugcaauugucaggcacuggaagagucucuuggggauagcuauaucaggcuccugucagcauacauuuuuuucauauaagguaguacacagguuuuagagauuuggaugacugcaucguagaugcuaaccuaaucauuugcccacaaaugaguacaaauuagcaaaugaugaguaauaacugaaaaucuacuuugccuaaguaacuggugucugcuuaaaaacaggaacuuacccuuuuaauagacaguuuuuaaaguuucauuaguuuaucaccuuaguauuaugauuucuauucuuagucaauuauuuuucuuguacuaaaaugugaugugaguuucuuuuagacuuuguuuuuugucucuauauuuuugauauaucuaagguagaucaccucacuaauuuuuaauauuauauauagcuuuuagccauuugaaauuguguuuuaggcacaaguuuaccuguuuuguucauuacugauacaauguauguguuaguuauggauugaagucaacaggcuuuuagcuuuguuagucuuauuauuuguuccuuugaauuuuuucuaaaugguagaacucaugacuuguaggugcuuuugaguaaagcuuuuuguuacuuuuuaaacagacugcugcuuccuuauagcuauacaaggacuuggcuccuccuuauggcuugaguauaauguaagugugugauaaaagucucuggacauagaacaauaauggaugaguguacauaacaugaguguucugaaucuucuuuauaauauauaacauuuauauaaaucauucauucauacacucuaaaacauguaaccucacauuauuccaaauuucuaauuugaugucugagaaaggaauucuuacaaaaggcuauuuuuaaugaaaagcaccuaaccauuuucuuuggagauucuugauuauaagcuaucaaguuugcuugguagagaaaucugucacuacuauauauggcuuguugaaagagagaaaagcuacauuuacugagacugugcuugauuuauguuguugccggucuggagaccagaggugagaguagaggguacugccuggguccaauacuccuucuugccccuucugcuguuguagugauuucugaugauauuuuauugguuuccacugaaauuauuagugaccuguagguauguagugaagaaaacuucauucuuaaugucuggcuuugguugaagguucuaaguucugcagcuugcuggagugggaacuuggcccucuuguucuucacagguuuccuguuuuugaugauuuauuuuacuaccuaaacuugguuaucuuggaucuuggucuauagacugaccuugaacucagagaucugcauucgucuucugaaugcugggauuaaaggcauguacuaccaugccuggacauaagcuuuucuuuacuuggaacuuacucaauaucagccuggccuugaacugcuugcccaugucuccugggaauaaaggcauguacuacacauggacauaaguuguucuuuaaauccuuuaauccccuaugccauaagaucugaaucacaggugugcccuauauuuccaaauuacaguucauuccauacauuucaugcagguugacaacugagaauaaccaucacaauccaucccuugucgauuugacacacaauaguauuuucuuauguucaaaugagagcaauaaccaggucauaacaaugccuaacuuguuuaacugcaaugauauaaauaguaagguuaggugagugguaucuuucccuguguccagcauucccuuaacuuuguuuauuauucugaaacagaggccccauuccacuuccuuguacuccuuugaucauacauuuuguaguuuuccuuuuucaauuugcuccauaagaaugaaccacagggcaguuaaugcuaaguuguuucuagaucucuaaaucucuuuauuuuagccuaaggcagaagacuuuagacaaaggcaaaaauuagccacauucuucaccaaaauaucagaagaacaaucucuaggcaucaugcuaaaauucuccucugaaaccucuugauccaggcccccacauuuuaaaucacccucagcaccacuguguuccauacuucauucuaugaguaugacccacuaagcucuucuuaaagcauucuacugcuuucguuuuuuuuucaauuuuuuuauuagauauuuucuucauuuacauuucaaaugcuauucugaaaguccccuauacccucccccgcccugcuccccuucccacccacucccacuucuuggcccuggcauuccccuguacugaggcauauaaaguuugcaagaccaaggggccucucuucccaaugauggccgacuaggccaucuucugcuacauaugcagcuagagacacgagcucuggggguauugguuaguucuccacugcuuucuuaaaguccccaaauccacauuccuccaaauauaagcauggucaggacuaucacagcaauaccacaaucccagucuuaguuauucaaccaacagagcuuguaaaauaaaacauagugcucccgagcaacagaaccuuauauuuaacaggguuauccuacucaacaagguguuuauguaguuuuucaugauauucuuaauguaagguaugauuuucauaaaauaugcauaguuccuuguaggcuuuucccugccagcuaagccaucuuugacugguaagugcucagagucugcucuggcaaaaguacugggcugcauuuauguguaggaauauaugggaaaggauuuucugagaaaugcuguucagaucuugcucuuacaaaucuaacauucagucaacuguaaccaagcuaauaaugugcuuucagauuauuuauaacuauauacucacucuuuuuauguacuauguacuuaauauucagaauuaucugcccuugaagaaaagcauacuuagcuugcugacgucuugugcuuuuggggauuccaugguguaaucuuuauuuugcuuuugugugcaugcaugucccugacucagaauaauguauguguaugugaauugugaugaccaggucuaagaccauucauuagaagcagugagauguugaaggcaggcagcacccucuucccucacguauguaugaaugacauucugcacugcucugcgucagcagggacagcaaaacuauuuucugccuuagaagaagacaagcuccucauuacuugucauugccaugucggcucugcugcucaguauguaaagagaauggcccuauucaggguuacgaggaugaaucagaaucauuuagaguagaguagacuacucuuagauacuaacaggaagaccuaaagucuugggaauauaugagagccucucuuucguaaaggccacuaagaauuugccuuuucucuuuuauguuacagagaaaauacaaauuuccuugucuuuagggagccuuccugaaaggccuuuaguaauugcaugcgcaaagcuuuaauaucuguagaauauaguguuuguugacuuaauuuaguaaucuucauugcuuuaaaagaagaguaauuuagaauauaauguuguuauaacccugguaaagauuugaaaauaugugacagacaauguaucaauugaagccaaacauugcugcauauuucaaauaacugcauuaaauuuuauagcauuccuuuguggaaaaauggagccuaugaauauuucuuuguaucuauaguggugcugcaucaugucuaggcuaaaucaaagagcuaacuuauagguuuugauuucauucuuucauuggguaggaugaagugucauauauaggaugaugaugaucuucacauuaaauaaaaccuggcagcuguuaaauaaagcuuugucuuguauuuggccuugaguguuugaaaacauuugugaaagucuuuuguguugcuaauauggcaguuguaaacauugugauuaucuuaaagagaaacaguuuuuaacuauacugauuguuuucagagacaaucaugucuucccuguaucuuuagaaacgguacuuauuucagugugcagagugagagacucgccaggacaugauggacauuguugucuuaggagagggugcaguagucagugacauuuuauuuugaggugaucuuauuaaaaguaacuauugcauagugugugucugaaucuugaaaauugaacuacagaucugaaaauauuuucugacaagauucagaaucauuagguuacuaauuuaaaguuauuuuaacauuugaauccuuaggcauuugaauaaaucugaauagauaugguaguaauauuuaaaauuaauuuggaauuuauuucaaaugugaaaauuuccuagaauuaaugccaggguauggauucauucuauuuuauauuucagucuuuuuuuaaaugaaaauaaauuaagucaguuaaaacauucuuccagcaaagucuucagucucgggcagucuuuguucaaagacucaaguaucauuuuuaaagugaauuucuagcuuuuaauuuuauuugcuucguuuucuagcugguacaguuaaaaucuccuuaggcagcuuggccauuguuuugcuccuggggguuuaccagcuaauacugaacuuaguguggguaccgaauaggcauuaugaacuacaacucagaauuugugaauuguagacccaggaguaacuaguuuuuacagauguuuggcauugacuuuuuauugugucauaaaauguuaguuuaauguuuaucuguucuuacuguauguaaaggaaagaaaauccagacugccucgcauuuguucauuuaacaguucuuuccuccuuguuucucuucuucccuguguugggcucaaacccauuaccuuggacagauuagaggucuacuauuauguuacaucaccagccuccagaucuauuugucuuaaaguauuccauauuuuguguuaugcaguuguagcuugugaaguucauauuuaauaacuaaguaacuaaugcaguuauuuacaaagauaaguggaaaauacaccucacagaauuuaagacaaugucagcauuuaagccaaggcagguuuaccacuugaccacuaaaccuacuucauaacccccgccagacuccucacuuuccuauuuaagaacucaaaacaucauucucacuucaaaguugaugccacaucuagucucacugagucuuuaucauaaagaaauggggcaaagugggcauaacuaucuagcuagucccucugcggaagcccuucaaaaugaagcagcagcuucccgagcuguggggaaugagagcuggggcaggagugcaugcucuggcgcugucgucuuguaagcccuccccaguacacgguuuuauuuuauugucugugucuguauaugcuguuuucauacagugcuccgcucguaaggaucagagccuugaacagauugcgagagaucuguaaauaaauuauagccaguucacaaaagauaacaguucaauuugaugaugcaaacacuugguaaguagcaaaugaaauuuucauuuaauaaauaaaauuauaggaaauauaaaugauaacaugaauauuuuuuacauaauuuagaaucaucuuuuuagcauaaccaaauaaggccaauaauaucccccaagagaguguuagauuaggaaaagaaguaggaggagaaccauaguuccagaggacuagaaagagaugcuauguaguagugauucacacuacuguggaaucaugaguuugaaaacaaaaauagugaaauauuauaauauauaauucccaucaucuugauguaauuuacaaaauguuuuuuuuuaaagauuuacuuauuuauuuuauguauaugaguacaucauugcucucuucagauacaccaagagaaggcaucauuggauccuauuacagcauuucaggugguugugagccaccaugugguugcugggaauugaacucaggaucucuggaagagcagucaguguucuuaaccacugagccaucucuccagcccaauuuacaaaaucuaauacaguuuugaauauaaauggguaauaagcgcuuaauacauauccuagcaaaagccaauaagcaauucaaaauuuacaaaaaaagaauaaauauucuuucuaaacauaguuacaaaacauauauauauuuuggggggggguggguuuuuuguuuuuguuuuuguuuuuguuuuuuugguuuuuuugagacaggguuucucuguuuagcccuggauguccuguaacucacuuuguagaucaggcuggcaucgaacucagaaacccaccugccucugccucccgagcacugggauuaaaggcgugcaccaccaccacgcccaggcacaaagcauaauuuuguuuuaauuucuuaaaauauaguguuuuugggauguauauauauguguguauaagauuuuguguauguguguguguguacacgcuuuuguguuuguauguauauuuacuuguauguucauauguauauguaugugauguaaauaaguaugcuuguguguguguguguguguguguguguguguauauauauauaugaaugcauauguaugugauuguauguuuggguuugugugaccagcaucuuuaucuucugagacuuaacaggucuauaaaacucuuuuauuuauacacacacacagacacacacgauaguaauuuuguuacuugaaaucuaucuuuuuaaauuuugcuuucuuuucuguuuauuaaugcugucucugcuucuguccucccuugaucacuccaucucugcugcuuuugacuuaauauguuuuaaaguguuauuuuuaagucuuauguuucagaagucaguacauaauauuauauaguaagugcauauuagaucaaaauauucacagaauaacaugacauaaaaauugaaaacuucccugacuuuacaguagguaacagagaguauggauuuuucaaagcaagugcauucucgccucuccccacugcuucaccuucccuccuuucaguagcuuauggagauauuuggcaucucccauaccugggccuguucauuguauuuaucuacuguaagugccuaacuaauucugugucauuuacugcucaagauucuaaaacuguucgaucuuaguaaauuauuuugacauauuuaacuuaauucuuugagaauuagaaugaaaauuggucauuuauguauaaugccagugauaauacuaagaauugaacuauagaagaucucugcugaauauucaugguaagacuagaucaauacuuguuuucuguccaagcuucaagaagguuaauguugagaauucaaacacaucaauuauuuuuuccuagaauuucugacagagcucuacaugaaggaauuugaggguaaugagacuguauaagaacuuguccauuuucugaaugggguuuguauuucugaccugagaauguauuuagugaagacuuagaauccugcuacuauugaaaugcaccucuacuuguuuuuaugaaguugaguauuuauuuguuucuuuaggcccauggucuuguauaguccaggcuguccuugcacuaccuguguaguugagguugaucuuuaucuugugauccccaggcuucaguuuuuaccccgugagugagggaauuacagguaugaggugccaguccugguacuaggacagagcaaggaaaugauuucauccaaggccaguauagugaacaagugauuuucuuuggacuaucuacaggaguauggcugacucauaggcaacuuaccagccaacuuaucccagcguuggggaugcagccccugaaggcuucuuccuuaaggcuucuuguguaaguuguuagaaacugggucaguaggagcaguuccucuccuugguuacuugguuacugcuuuuguaacuuuuuggaugagccuuaugauaauuuucugagccuuguaaguuugcuuacuucuugugucuuagcaacuucucucucucucucucucucucucucucucucucucucucucucucucucuuucaggaagcagugcaucaauucagaggagaugaauauagacuuucccuuaaguuacaguguuucuuucucaauugcuuucuaguccuuucauuuguuuucuucugacugcagauacuauuauugauaugcucagugacuuguauugaagacaguuaggcacauugaucucuaugacaaggaaauaugacagugucauuguuggcaucauauauuggaacugcugaguguuagacaugaagaaccacaguuuauucuaaaguuaaaacagugcugaaaauuuaagauccuauuugagagaaguuaaaguaacuuuugugacaguagauuguuuagaaaugguauaguuagagaaguucuuuauauuuauuuugccaaaauccagggucuguuugaaacuggagcaauguugcgagaaguaacggaugcaguggauacuuuacuggcagguuuaacagcagaucaugucauauucaguguguaaggcuuggggaguugcaaggguaugaaauuaugaagcaacuuaguauuauucauagcugucaaauuccuauauguaguuuaugaaguuggcuuaaucugacauaaauguuaugaaauaucguuuauuucuauuaauauuaaaacuagccacauauaguaacucacaucuaucauaguaacagcuccuuagggacagggcuuuccaagauucggaguuucugcuuauaguggguuacuugucuauauagccugcuucuaaaaauacaaaacaaaaauguauagcucuauuaggggaaauucgccaguggaaauuaaacuuggaauuaauuuauaugcaugugauaauuguaccaacaauuuuaaaaucacauguucugugacuagcuauguaaggaauuauuaaguuaucgcagcuaaaucauugagccuguuacuauaccauugcuugcugcaaagacuguuggauucaaccuaauuaaauugggugaaguuuuuauagaaagcuuauaagguaugacugaucacuguguauucaugagaaauagucuucuacuaaguccaaaauaacuucgucugaaauucucaauccuuuuagccuuuuaucuuuuucuauguauguuugguccuuuuuuuaaauuuuauuuuaugaauagcaggcuuuauuauuaguguacgaucaauagauauaaaaauccaacaccugcucccccaacaaaaggagcuuguacuagggagucagaaauccugugacaugccaucucugcuuugguacccagaagagggugugagccucuucaaggcuuucaaagcuucagggagcccagugucauuuuuggaggacuccucaggguucugccugggugucccucuuguuggccagugauaguuguaaauuuugcaauucuuguucaagagcuucaguaaaccaaauguuguggcaaacuucuuuuuuuuugggggggggggauaucugagacaggguuucccuguauagcccuggcuguccuggaacucacucugugaaccaggcuggccucgaacucagaaauccgccugccucugccuccccagugcugggauuaaaggcgugcgccaccacgccuggcugguuugcucauauugaacauauugaaacaugugcagacuaaaaccucucccuaccuaagaacucauucaagaggcucuaacuaguuccuugacaagagaagauccaaagccaugcauaacucacuuaauagaaccccauguuaaaacaaaguacaacacuuucuuucacgaaggccugaauaguaauccuuuacaaaaaccagacgugguaaaacugguaccaggacuuuaccagaaggaauucagacgcugcuuacuaucaaguguuuccacucuuggucucuccaacuauaacacgaaagaaaaaaaagaaaagaaugaagaaaagccaucucagacaugaaugauacgcuuucuucuccuaaagggaaaucuggaauauauugaacuaauaacugaacauauuuagguuuugaagaaugcaaggagauaggaggcuuugcauaugaacaaguaagaauacagagguggaugcucucagccaaccauuaggcugagcacaggguccccaauggaggagcuagagaaagaauccaaggagcugacaggguuugcagccucauaggaggaauaacaguauauuaccagagcucccagggacuaaaccaccaaccaaagaguacacauugagggccucauggcuccagcugcauauguagcagacgauggccuugucggacggacaucagugggaggaaaggcccuugguccugugaaggcucugugcccuaguauaggggaaugacaggucagggaagcaggugcauuggugagcagggagagaggggaugggaucggggguuuucugaggggaaaggaggaaaggggauaacauuugaaacguaaauaaagaaaauaucuuauuuaaaaaaaaguuauaccuccagcagaugcuggcauugggacaagcuguaaagguaggaagguggggccaaaauggaagaagcaggccauugaggucuugcccuugaagaacacuggagcucugaacuuguccccucucucuguuuccuggcugcuguggggggaaagcuguguucugucucagccuucccaaacagugggaccaaacacccauggaugcaaacuucugauacuaugaaauaaaucucauucugacuuaaauaaaaaaagcaaaaaaacaaaaguuacaaauguucacauauagcaaacuacuauaagaacuauuuccugcauccagugaauuaaaaaccaucuauuaggccucaucuaucaauauucuuuccauuuguaccgaacgucuaauuacaguggaucuuuggugauguucagaacauaccuaaauuggcacaaacauucuauauaguauugguacuuuggaauuuuguugcauaucugagauaguaaucauuucauacaaacacuacuugcucuacuacagauguugauggauaucugugauaguagaauaauguuucguuugcuggacaaccuuugaagaaauauucauacuucucuauaacuuauucuuaagugguucauaugaauguacagacuauauuuaaaaguauuucucauuuuuaaguuuccuuugaguuuuuuuguagauguaaauauuauucucauuuauauuuucauuaaacauucauauucuaccuauguuauauaauucacaaaauauuucauugucaguuuuauucuguuuauugcguuucagugcacuugucggaaugacauggugaagauaucaauggauauauuugugaagaaauuucagccagauagauaccagauuuggaaacaaggaaaggauauauauacuauugaccauacaaagcccacuccagaaucuacuccagaaguaaaaacauggcuacagaggaagaaaaaauuaagaaagccucccaagagguaagaagcccaucacauccugcuguagcauguucuuguaugaaauggaaccaaauguucucuaggccucuuccuuuauucuuguuccuauuagucauaccuuuacauaguauauuacugaaauuuuguguguuuaacuuuugagucgguguuuuagaauuuaggaaucgguagucagauaugcagaguacuccugaaauugauauacacaguaaguagaacagcauggaacauuuuagaguuuucucauuaauuuaucuuaaacauguauuuguuguugacauuauucaccauauuucaaacaacuucagauacuugauuuccaaauuuuaugugcuacuauuuuaagacauuuucauaauaauuuccuucauuuuuuuuucacauggaugcuuaugcuguggcauuuuauucaguuuguguuaauucuuuucuaagacucaaaggagaauguguuaauucuguccauuguggucuucuuaaacuuuaccucugguccacuuuugugaucuuugucacaagcuuucuugacuuugucaaaaauccuuuuuaaaauccuuugaauauaucuugucuauggcucagguccuuaggcuaauguaauagcucguaauuuggaauuuuuauuccaacuuucuuuuuaauauugcuuguuauuccuuugguuuauaaaaguaauauuugagaauugcuaaaauuuuauaaauucaggaaaaaauauccagugaauccaaaucacucauaaccuaguuauccaaagagcauccauuuuaagauuuuauguauauucuuacauauguauuuauuauguauauuauaaaaauagcauguaccucguucaaaaugagucuaugcuuuauuaacaauugauuguccagguaagugaaugauuuuuauauaaucaaauuauuuucuauagcacaauuuuuaauaucuacauguauuuaauaucuuacauuuagaucuauggcacuucuguuuauucuguaauaauacuauaauuuuaaaauuuugcucagaguauaauguucaauuuguucccccuaccacuugaauuuauuuuuuguuguuuagacugguugugagcaggagaaauuuccaaacauggaauaguacauaguuucauuuugccaccccaccccucauuuuuuguuuguuuuuuuaaagauaggguuuucauuauguugugguuauccuugaacucauuaugguuauccuagaaccuguaacucagagagaucuaccugugcuucugcuuuccugauguugggaaaaugucucccaugaauaaauaaauacauaaauaaaugaaagaaugaauguaauacauauauaaaaguuauaaaauguauaguauaauauauguauuguauauauuauauaauguguguauuaacuauauucauauauauguauuauauaauaaguauuauauauuguauuuauuaucuauugauuaguucugucguguacacacacacacacaaaacaggacuaguccuuagcuaaucuaauaauaauaauauuucgguuguaguauagagcaaggaauuucaaaauaguguuuguaaaaauuugaaugaucaaaugcaguguuuuaacagacaauaugaauuuaaaagucuuacaauggagcgggagagcuaucuuaaaaccacugaaugaucuucuaaauaacucaaguucucagcauaugugccacagcuaacaaccaucuauaacucccauucuauaggaucugaaagcuacaauaguguuuuaugugagggaaaugguugucaugguuuguguauuugcauguauauaaguguugucucaaaauguguaacugauugacuaaaugcauuuagagauugauuauuuaagaaaucaacaccucuagagucauucaggagacacaccagucuaaauguucaugagcugagguagcugcuaaagucuugaaagucugaggcaucccucucccugaggugccagccauaggacagguguaguauagaauagacuuuauuuugaggacauuuaaagaggauaggugagggaggcgggggauaaagagaagaggcuggccaggaacacuuggagagaaagggggaggagggagggaagagagggagagcaugggcagagagagggggaaggggaggaggaggaagggagggggcaaacauucccuuuuacaccaagccauaccuaccugccuguggcuagguaacugcuggacauagcauagaaggaaugccaacaacauguguaucugugauacucagauugccaguguuuuuaucagaguagguuucucauuucuuauaaaugcuaauauucaggaguauauuugguuuuuuuaguugguggcuuaaagugauugcugaugaccuuuuaguccucagaacauuuccucagaaaauugaagauaguacuaccugaggacccagcuauaccacuccugggcauauacccagaauaugcuuccacauauaacauagucagaagcuguaaacaauccagauguccaucaacagaggaaugaauacagaaaaugugguauauuuacacaauggaguacuacucagcuaucaucauaaacuuauaguaugcaaauucaguuguuaugaaguugauugaaagcugacauaaagccauuaugguuuuaacuucagacuuuauuaauuguaaaaauuaaagaaguuuuuuuuuauauaaguacauaauaguagcauuugcauugcuguauauuauuuguuuugaacuuuuuugcucugaccagcauccugcuuuuaauagcuuacagggcaauaagccacuuuguaaaaggccuaaaccugaagaagaugaggaauuugcugaauuuaguggggaagagggugcaaacccugccaugggcccuaggcaccucaaagucacugaaaagccagaaaaagcauuaaagcuggggaaauuagaagaaucuucagcaaaagaagcuuuggauaccaggauacaaguggaucaaagcuuacugaacgacaccaagcucucggguaagaaaauagcugguugucugucacaugugacuagggagcuccguaaucugacucaccaagcuaucucacugacuacgcagcuugucaaugaguauagaaacuuacagaugauuuaccugugaggaaagugaaugcuacacaauaagguaaacagcucuuauguguaauagaauucuaaaauaaauguccaauagaauacuugugguuuaauuaaacaugaagagaucuaagagcagaaaguuuuagugaaauucagcuuauaauguacgaaaagaaacuaaguuacagacaauucuguucagauaccuuguuucagacuucauuuuaaggcaggagcccgauauagcuguuucuugagaggcucugccagugccuggcaaauguggaugcucacagccauccauuggauggagcgcagggcccccaauggagcagcuagagaaaguaccgaaggagcugaagggguuugcagccccauaggaggaacaacaauaugaacuaaccaguacccccagagcucccugggacuaaaucaccaaucaaagaaaacacaugguggggcucaauuaaaauuaaaauaaaauauaaaaucaguaauuacuuuguaauuguucaaucauuguacucaguaguaaugcagugcaauacuuacuaugaguuuuuuguuugcuucuuaggaaaagguugcauaaguucaucaguaacagcugaaauuccaccagaagacaacagagccagugcuguaauuucaccaucucagcugaaggagggcgcugacugcauaccacuuucucauggccaucaagcaggcaaagagucacaucuacuuaagauucuaaagcuugaaucucccaagauaccuuccccccugccagaaaguaauaaaguauugacagagggagaagaaaaugaugaagagggccauggaaguaaccuugagccuggggaaaucccagaagcucuuagugaagagagaaaugggcucaacauuccuaagguacaugucauuuuguaauucugcuguguucauugaauuguggccuguaugguauaaugaugcucuaugaguauaguuuauuaacuccugaaaucuugcuuuagggcaaaaaucaauaguauuuacauuuuugaauuuuaauuguauuucaucaguggaauaugauuuuggcauagaaauacuauucuggcuuacauuuuaauucauuaauacaaacccuuuuggcuacuguuaaagucugauuuuuuuccacuuuauacuuuaaaauaagcaacaucuguauuuguaaauaaugcaggcuucagugccaacaguacacagagaguuaauugauacucauuaacugcucuucacaaauacuaguacuugaugaacuguauuuugaaaucuuagucauguugacauucaggcagucauggugcaaaacguccccauaacaagcagcguuauccaggcugagcucaggugucucuugggcacugcccuacugacaguagaaaguauuugagucaguuucauauagucuuggucuuaacaucauggcuacaugaucaguguuuccuuugacucuucuuacucagaauauuagagauauacuuauggucacguuuauuuccacaaaccuuuugccucucagaaaaguuaaguuucccaugcugguuuuauggcuacagccuccucucuguauuucuccuuuguucuuguuuaguguuauaauuauaugcuuacauacugaacauucgggcgagcuaaugcugugcuaccauucugagucccucaccggggacuuaaggagcuucucucucauuugaaauggcagcugagcugucugcugaccugaguaacaaucuugcuugaucccauuuuacuaaaccuacuaugagucuuuucauauccuuuaguaacaaagcacguuauaaaaagaguaauuuuaaagagguuauuucuuagucaucuuaaaguauauuaaauauaauucaauaauuugaucaaugcacuuaaucauuuuuuuauaucauuguauauucuacagaaauauguaacauauuaucucaaaaguauuaaaaguuaaaagguaaaguaucucauaggggcuuaaaaauaucucacaauuuaaugguuuccaaauaacagaauguuuuauuuaaaaauaauauuuuccuauugaacucauggcucauuacucuauggaaggaaagguccucuuuaccacuuggcuaaauuuucuucucugagaggauuaaagcuggaucacuugccaaguauucauauaugaaaggugauacaacuuaacaguuuuucaucauuuuaacaguauauaaugcuggaugugggauaguuuuaaaugaucuuugaaaccuuaauugucuucuaugaaacaauauuuguugaaggagaauuaauugacuucuuagaaaaaugcuaccuucuuccuuuaccuccccuuucucucccacucuuccucucucacuuucuccuucuuucccccugcccucagccuuucucccuaugucacccugguaguacucuggaugaaaacucagggcuuugugcaugcuagguaaguguucuaccacugagcuguaccuuagcuuguaagucuaaguuucuuaaagugcucauuucuuaaauaaguauaagauauaacuuguaagccauguuaucauuuggaaguauauauuuuucccugaaacaaauauuuauugagucugaagaaauagcucagugaauaaugugcuugcuaugcaaucaugaagaaaaguuagacauggcugcacuagucugggaggcagaaacagaaggauccuuggagcuuccugguuacccaagcuagucaaagaagugaucuccagguuuauugagacccugcuucaaaauguaaagcagugagcuaguagaauguaagcuccugcauauauacaggcauagaccaaacaaaguaaaaccaaaagaaccaaaccuuguucauggauauuucuacuucuuuuuuuuuuuuuuuuuuucuauauccagauaauugaaggacagccaaaaacuacuaagaguuggcgccauccacuugguaagccuccggccagauccccaaugacacuugugaagcagcagguagcgagugaugaaggugaguguauagucuuuuguaauagauggcuuaugcaauuaacuguaauacgauuuuucaguuagagaggaaacuuuuacucuggagcaaaucauugggagacuauaaguaguaaauaguuuauagguaaaagcaauugaaguuuagaaguaaugucaugcuucauauacuuuaauaauaauacuaguacaaauauuuuguuucaugccauaaguaagucauuccugacauagccugaaaauuuuccggaagaaucacuucaagucauggcauauaugaauuguuaguacuuuuguguuuuuuuaaagacaggauuucuucauguagcccuggauguccgggaacucacucuauagaccaggcuggucucugccuccagggugcugggauuaaaggcauaugccaccacugcccucugcacaguuugcacuuuuaaccugaaucauuuaaauugauuuaaauaccuuacagucagaaaccagcucuuauauaccuccauagcagugugugguaaaucucugucauucuuugauagacuacucugaugaggcuugauguaaaaugauuucuuuuauaggucacguaucccaauauaguauuuacuuuucuuguuuagcuuguuccucuuucucucugucuguguaguguuuaaauuuacuuacuacuuuccuacauuucuaaggguuuuguuguuguuuuguagguuuuuuguuuguuuuuugaguucuuauuugagaaucuccuuuucugauggauauugacuaaaguccccugucuuugaugauguaguccagguaaaacaggauagugguucuuguuuauauaaaauaacacucacaauaugugucagcauuauuuuccacauacaucucuucauuuuuauuuuauuuuaucuguguuggggauuugccuacuuguguucugugaagaugcuugguccccuggagcuacagaaaguccugagcugccaucugggugcugaggcuugagcucaggaccuguggaagaacagucaguucuguuuuuguuuuuuucuuaguuuguuuguuuuuuuuuaagguguuuauuaucauggcgggaaguggagcuaagaggguaggcagagaaagaaaggcagagaggaagaagaguauagaaguagagguugccagguaacugggguuggagucacagccugugugacugauggccacggaauuauggagcuggggccucuuguccggaacuuagugucugggagcauguggcaaacuuccuuuugucccuugcagauuaaucugcugugucuccagggauuaaaccuagcucgaccagaaaacaggcuuccuuucauggucccauaacucccccuuuuacuuuuuucaaagggaggggucacuggaauggaucuaucauuugaaguaaacauuuuggguggggaagcaguaucaaaagaaaacacaauacaggucggagggguaacacaacuaagccagugugguaaggaggguuaaguguagguguugggaaggcaagggauuauugaaucuauuguuccauggcuaguacaguuugagggcaauagcaucaguuuuaaacagcaauugauuaaucuagauaaacaucauguuuuccuuacuauccuguaacuucccccaaguucagcagccauuugacuuuggcaagagaguucaucuguagcugggaggucccaagucuguccucugugggacucagugcaugucucugaaucucagcaugugucucaggagucuucugucagaugaggugucuggaggaaggcagcuuuguugucccaggcaggucucaggagauggcacugucucagcaggaucugugcagcaggcacuggccuuuucuuuugugggaauaaaccuguagaguaaucauaacagaggugcagaaccccaacagggggaugucugcauaggguggauaauuuauguuaagccugcagugguuugcuugggagcauaucacugucugcuguuaugguccuagaaaagcaaggguuuuugaggaauuuaguucuggaaggcaucauuuaaaucugcuuuggauggcugaggaacaaaauaucauguuaauuaugcauccuggauaugcaguaaccauuugucuguaaaaggaaauugguuguuaauuaaggauugaauaaugguaaucaguauaguugauuugaccuuuggaaguagauuaggugacuuuuaaaccuuaaaagaaaucuuaaacaaguugaacaauuuugaacauacaucgcgaauauuagggagcaaagcaaaccuuuaaauaaagaagcaagaaaauuuuagguugaaaagccugaaaacuguuucagguguccccguuaggaagagcaagcauuuaaacaaaccccaaaaagggucucucucaggugugguuuuucuuuggggggcuuagauggaggggggaggggccuacucugcuaugagguagcugugugcucuaucaaacagguuccuguuuuccccauuuguguuuucuuggaaagcaggagaugaaaggccaaccuugaagaaaagcucaaaagaauaagcauagaccucuggccgaauagaauaugucauacucagggaaugguguguugacuugcagacagaggaagcagagaguucagagcaagagcugccuucugaaaggagcccuugcuacagggcugggggaggggcagagaguggaggcuaguccccaccuagggaagaagguggccuggaacacauggauguggggugauggccggggguggggugguggggguuugggggggugaucagaggacggccuagucuuucgaacuaggucagcuuacucauggucuugggcuaccuggaguucugaugugggucucucucuauguguggguccccagcugaggguauguuuuagcugguucugccccaaguuggucaucagauguggauuaaaagugggguccuguccggcccacagcuugugccacugggccaggcggaacacugaggaaguuuugacugagacacggaucccacaccgccgggcugugagaagcagcaggaccuaucuccugggguugggaaggcguagucuggggucccugcagaacugcagaaauuugcucgggguucccaggccugcauggaggccagggacgacagauucuagcucuugggcaccacagucauggcugaaugcugcggaagagcugagaauggagugggcaggaggagagcuccagcugggucccaaguggaggcgaguucuuggcuugcucagugggcugcuuggcuugguggagaccauggcugagaacauagagaggccucccaugugaaauuagacgagaggcuaggggaagaccugcuccauugcuucagcaugguggaucccgaugagaaguggcaguucaugguuuuaaaguguuuauuguuauggcaggaaggggagcuaagaggguaggcaaagaaaggcagagagugggagaagagucgagaaguagagguuggccauggccauguggagagagggaagggaagguggagagaggggggaagggaaaguggagagaaggggagcaagagugcaagagacaggggcaagagaguaaccagagucagagcaucucucaggccccauuuacuacauuuauuuugugacacaugcuuauguaggaaaauagaacacagugguaguacuuucuauaguguacaguagcauuuuaguugaauaauugaaauaaagagaaauauuagauguuauuucuguaugaauuaguucuaguuuuuguuuccuagauauaaguuaaaguuaaagucuaggcagugccgagacuugaucaccugcauacauccuuccaauugcuaggauuauagacaucauguuuacuacaauuccuucuuuaucucauuuuaguucauguagcacaagcuauugugcuauuuuaguuauuauaacuauaugacagauuuuuaaaauuaauuauguaacauauuugggaauuuuaauuacuuuuccucaaggcuugcuauuguuguggcuucccuggaggaaggguacuagacauccuucuaaggaagggucucuuuuucaugugauuuucuuccuagaaacuuauuuuuaugucagccacuugagaauuugcacagaauauuccuugauuuccguguauagaacuugcaaaacuaugugugaauuauguuaacaaaguugucucaagaguuuaagguuaaguauuuuucugaaacauuuguaguuguagccuuugcaacagucccaaguaaagaaagguuuaaugauauaaagcaagagaggagaaguugauucaauguggacccauugggaaguaaaacagaaaaauccggugacgugaccucacuacaaguccucuuuucccaguuaaaauuuaaagagugaaauagcuaagcaguccuuguccaggugugguccuucccaucauugacucuacccuaaucucucucauaagguugucuggcagguugcugaacuaugagaaauuucuuuuaaaagacaaacuuauuuucugucuggcagcaggauucaguauuuuccuucuggucaugagauuccaaauagaauucuagugucuuucuguccauuguuucaauaugcugauacugagcaaauggaagggggaacauaaguauuuauuuagaauauuuucauuccuugguagcacucaaguucauguucuuucuacgugucuuucuuagguagguggugucgcaaaaacaaaaaccaauccucaaaaaugaaaauuaauuaaugcaucaucuguagggcaugaaugggaggaggggaucagccaagagcuauaucagugcuuaagccagguccucauucgagucugcccuucucguuaucucaguagcccucugggaaaaauggaagcuaggaagagagaaauggagaaaggucgauuacgguuagaggauucucuggcauuguagacaccaagccauguagcuaucauuauuuauauuaguacauagugucuuuccucauauaucgaguaccaucuugguggugcauguaaccauagccuucuuuaguuguccaaauguugggugggcaacuucaguguacguaguccuaaugugaguaccuaagucuccagugagaacuagguuuccauguauucauaugcuugacuuggaucacgauggcuccuugcaagccuuccaguuuaaagauagucgccccuagauaguuguuuucccauuuaaagcaucguuucucccaggaagccacuaaccaacuucugcuucuuugcccugucucaaggcccaguaggagagggcaagagagaaggucagacauacccucagccucagucccagaaacccaaaagccaugaaggaaagucaagggaaaugcggaauguaguucuagucuaucuuguucccauaggcugucauucaggccuuuugggggagcuuugacaccauuugaaguauuccagaaaagagaaaggugaggguaaauguuagaauaaauagccauagauuuuacauucugggucuucuuccagccuuugcagccauuuauuagaguccacaguauaaccacagguuauuguaucuuuaaaaaggaaaaucacaccaggaacuaaugauuaaugauugaaauagagauacuuuacuaaggaaaagaaaaugugcauuggcuggcuaacugaagaagauaaaccuccaaagcuauaggccuucagagguuauuuauauagguccuuugcuuacauuuggauauuauagggcuuuccuaacauaugaccugauuuuucacuugcacuuagaccuaauggggauugucuuccauucuuucugcagcuaacuucuuuuauauuuuaauuuucaugccuuuuucucccacucaguuuuucugugacgacuaccuuguuuucuacuuuuguaaaugccauggauucuugaauccaaaaaucaauucaaugaaauucaacuaagcuuuuacugaacuaugaacuauguacuauguuagguaaagauaaugaaaauauuaauacaagagacuuguuaacuauguggguaguuuuacaguggacgauaaaaauaugaagugaugagguuaaaauaggauuggcuaauuuuuucuagaagaaaggaaguagcuaacaaaaaggccuugcuuuguguucccaugaucuaaucugauuguuugaagaugauuaaaaaaccacauuuuuucuaucucuuucagaauauaguuuugguaaauagguuaaaaaagcuaacauaaagauuugauauuaauaucacagauauuuaggaguauuuacaucuauuauugggugauauuuuuuuucugagucuuauguuuauuguauuuuccuguuuucuccccuaagaauugccugagguucuaagcauugacgaagaaguugaagaaacagagucuugggcaaagccucucauccaccuuuggcagacaaagucuccuaacuuuauggcugaacaggaguacaaugcaacuguugcaaaaauggagccaaacugugccaucugcacucugcucaugccguacuacaagguaauuuagaguuucacuaucauguaucuuucuacugcuguacuucuuugggggcuuuugguuggguuuguuuguuguuuauuuauuuuuaguguuuguuucuaucauugcauuuuagaaaccuguauuuuaacccaauucuuuuacuaaaagacacacaacuucuaacuuaaagccuagaaacaaaacauuucguauaaaaaagcaaacaccuaguaucuaacuaaaauugaaaguaguacuguccaguaauguaaauaucaaugcccauaccuuuccauguaaaacauacaaaaggcauguccaggacucauuacaaacuggguauccaguucacuauuuucagcuaacugugucugaugcuucuaucaucauuccauacaugucauucugacaggaucucaacucaggaaugaauguauucuucaauauacacauaagaaacauauuuaaugcuguguauaaaauugcauuaugagcuuuaagguacaauauauuagaagacccacuaauauaaacaucauuuucuuuuuuuuuuaauuagguauuuuccucauuuacauuuccaaugcuaucccaaaagucccccauacccuccuccccacuccccuacccacccacucccacuuuuuggcccuggcguuccccuacauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggggcccugugauccaaacaauagcugacugugagcauccacuuauaaacaucauuuucaaauugugauucuucugacauaauaaggaauacuuuauucaagaucauaagucucguaaauauuuauuuauuuauuuauuuauacuucauguaguuacauacaauugugaguuaccaugugggugcugggaauugaacucagguccucugaaagagcagcuaaugcucuuaaccacagagccaccucuccagcccuugaaaugaauuuuuuucaagugucagauuauagugauuuaauucuuauauuucagagcuggaaagaagaugaaauucuacauuuuuaacuuucuaauuaguagcuuacucacuuuugguuuuacuuucuucuagucauugaauauuugcuuuuauugauuuguauuuaagcauuuuuaucucccuguauauuuuccaauaauaaaaauacucccuuuaagggauacgauuuuagaaacugauuaauuuaagaucuagggaguaauaaagguaauuuauuaguuguaauuucuccaugacaaucaggucugacacauuauuuuuaucugaccacgucggcuaguucugucuucuguauuucaaacuuuugugggaggcauguacuucucguuggugcuacccuagaaaaccuaaggauuauauauauauauauauauucuuugagguauaaccacauaauauuuuucaguaagacaaagcagacauuacccuauuacauguggaucacagauguaugugagcaaaaguaguuguacauuccugagguauuuuggaagacugcaguuugaagagguucuugaacucuuguaugaacucucagagcuuacugauuuaacuuugaaugggagucuguaugggaacacuggugaaaugcuaccaauugaauuaaagaaaucaacaagaugaaguuguaaaaacaagaugagguuguaauguguuggcuaaauuggcauaaguggauuaauggauaaaagaaagucucuuuccagugucuuucacucacguggauaugauauauuuuucagccugauagcagcaaagaagaaaaugauucuagaugggagacagcaguaaaugaagugguucaaucuggaagaaagacuaagcccauuauuccagagauguguuuuauuuauagugaagaaaauguagacuauucccccccaaaugccuuccuugaagaagauggaacaagucuucugauuuccugugccaagugcuucgugcggguucaugcaaguaaauacgucagauuuuccagucucuagacuugcaguguuuuauauagcccuuacaaaucaccucagaguaaccugucaguuccuuugucgacauuguucuuuguacugggguucuucuagccaggagagcuccauuucuacucuuacaguugauauuauuaaugguuucauucaagaguaugaauagaaugucaucaucccuuugcaguuuuaugaaacacuagugaagagaaggccugggccuuugauuuggaaggaguccaguuguuaggaaucccauaaacauggcuggggcaucuucacuuguuuaaauuuuuauauucuaaugauuguggaaauuuaaccuaaaugucuaguauugacugaaaacuauuuuuaugacuuucuaagaaguggauguuauucuguagguucugaggguuaguguauugaauuaaauauuuuucuucauaaauauagggaaguuccuauuaauagucauuacaauaguuagguucuuuaucuuucaaaauuuuuuacuuuuauacagguagauaaguaucaaauauauuuauagguaauaaaauauuuuauauauauauauauauauacauauauauauauauauauauacacauacauacauacauauauauguguguguguguauguguguauguguauauauauagucuaauuuuaaaguauuucaauaguccugauuuucauuguuucuuucugucuuuuauuaguaggggccaaacaaggaccucauauaugcuaagauuauguuguaccacugagccacaucccaagccuuuaauacacauuguuuuuagacuuuuuauuuuuguuauauguauuuugcugguauguuuauauguauuccacaugagugacugaugccuagagaagucagagagggcuuucaguucucugaacuguaguaauggcugguugugaacuaccgugugaguguugagauuccgacccuuauccacugccggaagaacaaaaacuagugagccaucuuuucagccccucaaucccauuuuauucacuuauuucugucuuuuucuccaacauaguuucaaugguugcuaaugcaauuaauuucuaaauacaguauccuacuauguauagucaagagacaaaguaccagacaauaaauauggauuuagucuuguuuucuaaagucaccagcuauauacucuaaccguauuaaucccauaaacaugauugaauuuaacauuuuguuugauuugauuuucuuugauucuauuuauauucuguuauugucucuauuaucacucuuuguuaaaauugcucauuuauuucuuccaaacuccuuuuauuucaggaauuaaggauaaugugucucuuucugacucccaguuugcuuucugucccauuuauucuccucuugccuuucuguccuccuuugcuguucucuaaggaauuuucucuguaggcuaggcagaccuugaacauaccauauuuuccaucucaguaugucaaaugcagguguuacacauccuagauuguuaauuuuuugauuuauuugcuuauucauuuauuuugugcuaauauaaaacauauaucaccaagaucuugguaucaugcaauuuaccacacauauuuucaccaccucccauccucacauuuagucucagcauggaucuaucaaacauugaauugaagcaaacuuuaauuauuagucauggacuguauagcauuuaccccaucacugaaauuugagucacacuugauuaacauuccccaaccuguuuuaagaguuguaacuuauuaguaugacauuuuaggaauuuauuuuucuucuugcaaagauugucucugauaauauuaauauguguccucucaagcuuggcguggugcugcaccuccugaccucguucuccagaaacuauggcaaagaucucauucaaucuuuacuauauaagaaaaacucaucuggaagauuccaaauauguaggcuucuuagaugacccagucacaacauaaacuugcuuuugcaagccugacuucagaguuucaucaucauuaucugugacggagugagauuacuuaucgcacuaugaucucugauauccacaaacgugaauccacacuggcacacacacgcaucacauacacauauuaaucccaagaaagcaaagaagcaguaagaaaaucccaaaaagacaaaaaagauagaucuucauguuuugggaauugguagcaugauaguuacaaaauuaaccuuuaauuccagcauuugggaggcagaggcaggaaggucucugacuuugaggccagccugauuuacagugagaguucuaggauagcuagugguacacagggaaacaacaaaaaacguauuugucacaggcucauguagauggguaugcuaggcauugugcuguguaguaguaguaguaguaguaguuguuauuguuguuguuguuuuugaaauaugcauuuuugccuccuccccaccucgagaacuggauauuuuaccuaauucuuuuuuuaaugcuaggcuaucuaacacuaagcuauaacccaacccucuuuguaccuuuuauuuucgaauuaucucacuuaauuauacaggcuagcuuugagcuuacaaauagguuaugcaggaguugaacauaugaacaacaugccucugguagcuggaacugggauuucuuccaggguuguggacacuuuaaagaugcaagagacuuaaucuguacauccauuauguucuuuuauagguuguuauggugucccuucucaugaagucugugauggauggcugugugcccggugcaagagaaaugcauggacugcaguaaguagauuuaguauuaugucauuccucuucucuuugcaccuauuauugagauggcuaaaucuaauggaaagauaaauuucgguacauauuucuuauguacuuguagccccucucuucagaucguucuacauaauggcuuuguaaccacuguagaaaguucaggugacuuucuauguggcauucuacuucagauccuaugugcaccauagaucaucacguccauauuuacuuuuccagacuuauuuuuuuaauuucauuuucuaaaacauuuucaaauccuuacaaauaaauguucuaauaaaaaaaucaagggagguaucuugauguauccuuuaggaaacaauacaaucugucugcaguuuuccaacuaacaagaaaucuucccuuuauuuauucuuucguuuacucacaccuuaacaaaugugauuagaauaccuauucuaugaaguggaauucaucacugugaacuuuagacagaacguuugacaagaaaugauucuccauuuaaggaccagaauuauuguuuuauaaaauugcccuuggaacuuuacucuaaacccaucuuugauuuucauuccauuaaucuaccaugcuuuauacauuuucuauuuaaccaugcucugccaacuuuuuggacuguguucaucauuggugaucucacagcagauauugcccaguuuaugaucagcagucacuauuguuuaguagacagaacuuauacucugaguuaauauaggcccggauuuucaaauauuaauguuugcuaaacacuucauuaugaaucagugaauuuuguggcucauauguuuguggcgcaaaucuuuuauguugacuucuugaggaauugucuuccuacaguaaucuuuagauucaagagcaauggugcaacuccuuugacaaagagacucugaaggaguucacgggaauccaauaauucaccugaggucagauaauauaucagugcuggccuauguaugacaaagcuucauuuguaauuauuucuuaugauugcuuuuacuaucuuguguaaaaguaagauuuauguauuaggaacacagacuauuacuauagcauauuuagcuugguuuauacaaucauauaguaaauguaauuuuucuaauacuuuuuuauuguaacuaagcuuuuuacacuuuccuucccaauguuuacugagcucugaguagauuuagauauguucuuaggacugaacacacaaccucacuuauuguccacacucuaauagcuaugagcauuugcacugacuauuagccaauucacaaagaagcuucucagaccaagguugagaacuguaucagucaacggauaugaccauaaauauuuagaaauuuuugacaguauaucaauuuaaacaaaaccggagugguagguuucauuagaaggauuguaacucauuguccccaaccccuaggcauuagcauuuguccaggcuuacaaguacuagacauaaauugcuuuugguggaagaagucucaaaucaagucagaaaacaugccauuacuccaacagucacuacacuacugcacugagguguacauuuugaaugauaacaauauuuuuggauucagcauucaaggcugaguaaaucgguaaugacuuucucucugaguguucugcacaacaucucuuguacuaugaaaaguaguguggaacaaguuuucaaaucaguuucagauuaauaucuuuaugugcuauaaccaaaauguguuguguuuucaagagaagggucucauaaucuaguuguuguggccaacugagaauaagccauagccuauguuauuuugcgugccucuagggcuuuuccgaugauuaacucuuugaguaguacucauaccuaauacugagauuuuuguuuuauaauuccuaucuguuaguagauguaucaucuauacgaacagauugccuguuuucaaacucaaaagaaaaaucccacccauugcugaaaagugacauuaugaccaaggcaauuuauaaaaggaguuacguaauuuuggccuugcuuacauuuuuauuuauuuguuucccuuuuuucuuuuuuauuagguauuucccucauuuacauuucccaugcuaucccaaaagucccccauacccuccccccacuccccuacccacccauucccacuuuuuggcccuggcauuccccugaacuggggcauauaaaguuugcaaguccaaugggccucucuuuccagugauggccgacuaggccaucuuuugauacauaugcagcuagagucaagagcuccgggguacugguuaguucauaauguugauccaccuauaggguugcaguucccuuuagcuccuuggguucuuucucuagcuccuccauugggggcccugugauccauccauuaacugacugugagcauccacuuauguguuugcuaggccccgguguagucucguuagagacagcuauaucaggguccuaucagcaaaaucuugcuaguguaugcaauggugucagcauuuggaggcuaauuaugggauggaucucuggauauggcagucacuagaugguccaucuuuuugucucagcuacaaacuuugucucuguaacuccuuccaugguguuuuguucccaauucuaagaaggggcaaagaguccacacuugggucuuccuucuugaguuucauguguuuugcaaauuauaacuuauaucuuggguauucuggguuucugggcuaauauccacuuaucagugaguacuuaucauuugaguucuuuugugauuggguuaccgcacucaggauaauaaccuccagguccaaccauuugccuaggaauuucauaaauucauucuuuuuaauagcugaguaguacuccauuguguaaauguaccacauuuucuguauccauuccucuguugaggggcaucuagguucuuuccagcuucuggcuauuauaaauaaggcugcuaugaacauaguggagcauguuucuuucuuacuaguuggaacaucuucuggauauaugccaggagagguauugcuggauccuccgguaguaccauguccaauuuucugagaaaccgcaagacugauuuccagagugguuguacaagcuugcaaucccaccaacaguggaagaguguuccucuuucucuacauccucgccaucaucuacugucaccugaauuuuugaucuuagccauucugacuggugugagauggaaucucaggguuguuuugauuuucauuucccugaugauuaaggaugcugaacauuuuuucagguguuucucagccauucgguauuccucacgugagaauucuuugauuagcucugagccccauuuuugaaugggguuauuugauuuucuggaguccaccuucuugaguucuuuauauauauuggauauuaguccucuaucugauuuaggauagguacagauccuuucccaaucuguugguguccuuuuugucuuauuaaaggugucuuuugccuuacagaagcuuugcaguuucaugaggucccauuuaucgauucucgaucuuacagcacaagccauugcuguucuauucaggaauuuuuccccugugccaauaccuucgaggcuuuuccccauuuuuuccucuauaacuuucagugugucugguuuuauguggaucuccuugauccacuuagauuugaucuuaguaaaaggagcuaggaauggaucaauucucauucuucuacaugauaaccgccaguugugccagcaccauuuguugaaaaugcugucuuuuuuccacuggaugguuuuagcucccuuguugaagaucaagugaccauagguguguggguucauuucugggucuucaauucuauuccauuggucuacuugucuguuguuauaccaguaccauucaguuuuuauuacauacaauugaucuguaguaaagcuuuaggucaggcauggugauuccaccagagguucuuuuauccuugagaagaguuuuugcuauccuagguuuuuuguuauuccagaugaauuuggagauugcucuuucuaauucguugaagaauugaguuggaauuuugauggggauugcauugaaucuguagauugcuuuuggcaagauagccauuuuuacuauauugauccugucaaucaauccaugagcaugggagaucuuuccaucuucugagaucuucuuuaauuucuuucuucagagacuugaaguucuuaucauacagaucuuucacuuccuuaguuagagucauggcaagguauuuuauauuaauugugacuauugagaaggguguuguuucccuaauuucuuucucagccuguuuauucuuuguguagagaaaggccauugacuuguuugaguuaauuuuauauccagcuacuucaccgaagcuguuuaucaauuuuaugaguucuccuguggaauuuuuagggucacuuauauauacuaucauaucaucugcaaaaagugauauuuugacaucuucuuuuccaauuuguauccccuugaucuccuuuuguugucaaauuucucugacuaggacuucaaguacaauguugaauagguagggagaaaguggguagccuugucuagucccugauuuuagugggauugcuuccagcuucucaccauuugcuuacauuuuuagaggguugguccaugaccaccauggugggaaucagguaggcauugugcuggagcaguaacugagaguucacauaucaucuacaaguuagaggcagagagagcaagaucugggcuggcuuugucuuuugaaaccucaaaaccuaucccaaggggcauaccucuuccaacagaucacaacuacucaacaagacgacauauacuaggauuuccugaacacuucuaguaacugcagacaaauauuuaaacaugagccuauggggaucuuugucacucaaccuagcacagcucacagaauaguggguuuccauaggcuuuuuuguacauccauaccuuuaguuaagcauccccucuccugcccaugucuuccuuguuuaagccuuuaugccucccccuaauuucagaucccauguuuucuacuucccucuuucucuguuuuaaaucgucuuucccucucuucucucaugcacacuuucuagcuucuagaccucaauagacauuucagauuaaaacacaaauuuaaauauucaaagacagaauaugcacaagaaaggaagcauguucauuuguugugcuggguauggguuaccucauuuaguaugauauauauuuuuaaauuuuucuaaaaaagaucuacuuauuuauuuuaaguauaaguacacuguaacuauuuucagacgcaccagaagagggcaucagaucccauuacaaaugguugugagccugugguugcugggauuugaacucaggaccucuuaacugcugagccaucucuccagcccuuagcauauuucuaaguauaucacuuucaugaaaguuucauaauuucacuauucuuuauaacugaauaaaauuccauuggauauuuguacauuuuccucaucuguucaucaucugauugauauauuggcaucacauuugcuggccauuaugaauagaacagaauacaacacaguucugcauguaucucuagaaagauguggauuucuuuugauacugauuuauuuugaugauugaauagcaacuucuaugcugauuuuauuacuggcuucaccacucugcuuauauucccaccacuauaagauaaggcuuccucuuucuucacaucauuaccaacauuuguguaauuuuuuaaaaauuacccugcugaugaugggcaaguggaauuucagaguacacuuuuuuccaguuugaacauacuucuguguuuugaugaaaucauuguccguuuucuuuccuuguaauuccugcccuaugcaacuccacuuuucuccccaaacuuugugugcuucucccccuuuccaguuuuaucaguugucgccuuuuauuauuucagcuguaugagaguugaugucauaauuucaacucuggguaccauguauagugauggaaucaggauagguagcauuuucaugucauuauacauuugguuuucuucagugcuucuuaugaaaccuaaauguggauaucaaguguuuaucacuaagcucuaccuaaagcaccuaaauuuguguaugcuuauauuuuaauuuuuaaucauuuuaaauuaaaaaaaacaauugcaucuuucucucuuccuuuucuuuccuccagcuccucccagguaacuucccuucucauccucccauggucccucacucucagauugauagccuguuuuguuugaauauuggauugaauaucuacuggagguggauuaaggucaccuaaggucccuccuuuggguccugagagucacucaugucccaguucuauguuacuuucuuuaggguccccccccaacuuauacccccccuagguugccuguuugcauucuuucugcugucccucagggcuucagucuuguuuccccccaccccccaauaccuuacuauguuccauuuguccccucccuguccccucuuccacccagguuccuccuucccucagugugcuuucuauuaucauccauugccccaaacuggcaccauauauaaugggauggccccuccaguaacaauuauaaaucaagaagaugcuccacaggccaauuuuguguuugggugcagggaaggguucucaacugguucccucuucccaaauaacaauaacuugugucaacuugauauaaaauuagcuagcauacacgcacacaguauguuugauugauuucuaaguaccuaaugagugaauacauuuaaugcugccucuauauguaugguugugggacuauauccugaaacauuaguagccucucagggaccauguccaagaagaaaacaaacuuucccucucccagcagucaugaguugcaauagccugucaaccuagcaguggaacuucacgagccucuuuacuauccauacugagguuugggcugucucuaccuuguacaagucuguugcauacugggcugguaagauggcucagcagauaagaacacugacugcucuuucgaagguccugaguucaaaucccagcaaccacauggugggucacaaccaccuguaaugagaucugauacccucuucugguaacugucugaaggcagcuacaguguacuuauuuauaguaauaaauacauuuuaaaaaaagaaaaaaaugucuguugcauacaguuacagcuucuaugaauucauuugaacaacuaacuguacuauaaugucuggcaacuacuguuuuccugcaugagucuaguccuucugucuuacagcuggcauucauuauucuguccccauuuuugacacuguuaaugaugccagauauggauucuaucuguaggcuuuaaauucauagugucauucucacaacagucuucacauuugauuccaugcuucuccauacuacccgucugaucagacauugaauacacagaccugugcugcauuucugugcuaacauuaauaccuucaaauacaugaugaucuccuugacauaaaguacugggauuuauguguucuaugguucuuggccacuuuaacaagcaucaggugccccuuccaugaauggaccuuaaauccaauuaaauaaugguggauuauacucaaauuacugccacuauugcacuacuauaucauguaggcaagucacuguuguaggucccaagaauuguagcuacauacuauugaugauuaccuaucucuucugguagagugaaaaguacuguccagcaccauuagcacuagguauuauuagaggagaaacugcuauauagacaccaguuagauuuuucucuguucaaugacuaaguuacuguugucuuuaccuguaggaccuaccauaaguuguggagaguaagcaauaaucuuggcacuagccuaugacauuugcugguggggguguguuuuauagggccccuuugccaguaauucaacaagaugucacccauuccugugauuuuacuugguagccuaaggugucuaguuuccccuguuauuugaugacuccuuuuaaagucuuuuuuuauguaaaugcaugcuagcaagcuucaaugguaguacgcuuccauauagguuuuaaaaagccuuuaguauuagcuguuucucuguuuauuuccuccuugaucuugcccucccguucucauuuaauuuaauccucucuuauuuaugucucuauaacuuuauuuucuguuucucucuuuuugggagaugcucuggucucuuaugguaccugacgugguaccuaaccuaaccuaugccguuacuuggauuguaguauacaugucuaaggcauaacaauuaacacucacuuagcagagaaaacaguauuuguguuuugaggucuggguuaccucacucagcaugaauuuucuagcucuguuugccuuuggguuuuauaauuucacuuuucuuaacagcugaguaauauuucauuguguaaauguacuacauuuuucuuauccacucaucuguugauagaaaucaagacucuucccaguuucuggcucuuagagcagcaaugaacauggcuuaacaaguauuucuguuguaagguacaguucuuuuucacaacaucauuacugcacucaagagugaaagcaauauauggugauccuuucuaaggaccuaugcacucaaccguuuucaggcuuucuuuuuuuaucuggaacuugaaguaccuaucauuguguaauuucuuacacuuuuaguuuuaugauaaaugaaaaaugguauauacaaauuucuacaguaguuuauaugaagggcagugauauuuguuauguggguuuuauaacuauguuaauucccaucuccuccauaggaaugcugucucugcaauuugaggggaggugcucugaaacagacuaagaacaaucaguaaguaauauauuaauuauguucaauuucaucauuucuuuuccuacucuugaaguucugcaugauaguuggauuuacaguucuuccucggacauuaguucacauacuugcucucuggagcuaggguugaaauuuggcuucagagacaaaugccagaguauuucuuccucucugugcuuccuauguaaugacaguccucauuuuaugaacagguuucuccucugucuuaccucugauaucccuuuccuccucuccacuccucaccccuuccuucuucagcaguacuuccucccuguuaacugccuucccccugccccccucacuuccucucuuucuuuuuaaauaaacugguaggagaacuuggcuucaguggggcaagugaucuugcguggcccauacacuggaauaggaacuccuugugcauaaucuuuugaugucaguaccguauuuuuguacauauacaugagucucguugcuuggaaugaagacuaaaagcauuuaucauccuuaacauugauaaaagugcuauguaacagccaauacuuuugcuuggauuuguaucaucuuucauaaggucaucuaguaagauuggcauuauucuacauaggugucacuagauuuuagauguuauauauaggcucuggggauggcuuaagugcaucauguaaaaacauuuaucaugagaaauuaucuuaauagauuuacuauaagaugcuaauuuuauucaaguauugaagaaucuucuggugggguuaacaguuguccuuucuuccuaugguuuugggaugaaaccuggcauauuuacugguuaaaagaaauaaauaagcuauggcugagcagggccucgaagugcaguccuuuaaucccuguaucugaaaaggagaggcacuuguaucucugaguugaaggccagccugaucuaucuagaagcuccaagacauccuauaccugucuuugaaaaacaaacaaaaaccuucauuugaauauaaguugauaguuuaauaauacaaauccaaaugauguucugaaguccuauguuuacuuagagguauaacacuuaaagagauacugaauaauauuauuaacaaauugaugcggauuugggaugugaaaggaugcccuaauauuuuaaaaagaucacaaaacaagcuagauuucauuucucuuuaccuauagauucuuuuguuuauauuaaucuugcacugaggaaaaauauauaaagacuuaacuacuuuuaauuuuauagaaaauaccuauuuauuuauuuauuuauuuauuuauuuauuuauuuuuccgagacaggguuucucuguauagccguggugguccuggaacucauuuuguagaccaggcuggccucgaacucagaaaucugccugccucugccucccuagugcugggauuaaagguaugcgccaccacgcccggcccagaaaauauuuauauuuuaauuauuugccugagaaaauaauacauaucauaucauguauuauauuaaaaggugauuccuaguucacugaacuauugccauguaucacacugcugaaacauaauacacauguaguaucaagugaaaaugaaaaccuacauuuucaguauccuuaugguuuucaaauguauauauccguauuauagacuuaguccuuggccuuuauaugguucguuuuuuauauguguuuaugccuuagugugcaugcagcucauggaaggcagaaggaacaucgggucaucuaguauuggaauuuguuguaguugugagcugccauguaggugcugauaugccgugcagugccaagacccacugcaggaacugcugagccauuucuccagccccauuuaccuaguucucauuacagaacuuauguuaaguauauccaguugucauuagagaaguuuauaaucuagaacauacuugcacuggaauuacuuggauucauuucuucuaugugccagauugcuaccaccaaguugaagucaguaaguuuagggaauuuguuuauauuuaaugucuccuuuccuuaggugggcucaugucauaugugcuguugcaguuccagaagugcgauucacuaaugucccagaacggacacaaauagauguagacagaauaccuuuacagagguuaaaauuggugagugucaaaguuuuuuuuuacuuuauauauuaauguuaauuucaacuucugaauuuguuuuguuuccaaaucaguauaucagauaguuucauuuuauucuaccuauauuucccuguauccucuauauauuuuucuucacaaauucuuuauuaguauauuguaagucuccauaacaggccucauuuuuuuaaauaugggaaagggaucaauuuucuuuauugauaugaacuuguaaacauuaggcucucugauauuguucagcaauucccuaaccugucuuacagaaauugccugcuguuuuucuuucuuuacucuuguguuucuuuugguauaacaaauauguucaaccuuagcagccaucucuuugccaagaagaauuuugcuuugaaucgcagaagcuuuuuuuuuuuuuuauuacaagguuuuuuacucaaauguagacucuagauacuuaauauucccaucucaaacuuguuaccuucuaaucuauucaguagcauucauaaaaauuucuucacugauuuacuuuuuuaagagguuuuuuuuuuuuuuucauuuaaggacaagccugugaugaguguacuuuaacuaauuuuuuuauuccuguaccuuucuguaacauauaguauuaauuuaggccucuuuucuuguuuuuuguuuugauuuuuuuguuuguuuuuuuacuguaggguaucucugucuaucagaguccuggccauccuggaucuugcucuggagaccaggcuggccuugauuccuugcuucuaccuccccagugcugggauuaaaggcauguuccaccaccaccuagacuauuuuguuuauuuaauaaggcacuuuucuuagguuaaaaacauucauuuaguaugcuagugaacuucccuacaaguucuucaguuucugucauuaucauaacgcacaaucauuccucuacagaacauuucaagcauuaucauugaaacuguugcuugauucuaacaaccuucuucccacaaagaacccuguauuaggaauuuaucuucuauccuuuguucucagaaaggguaagugaacacuauuucucauuauaacacuaucaggcuuuuuuacuuuacgaagaaauaugugaucugcuguuacguaauuugaguaauguggucaagguguaaaaguaaggccuauaaagacagcgcaguauugaaagagcaagcgugucagccuccuccccacucuacaucuuccuaucauauggauguaauauuucuaaguguuagcuuauuucaucaaaacuauuaccuauuuugccaaauacuauauuuuuaaaauaaaccacaguucuuaaccuuuacaucuuuuagcaugauuucccagccuuagcacuugauuuaguauuuuaaguuaucuaugcuuauagaagcuaaauagcuugugaauacuaagaaguauaaaaugcccagguguugguggcgcacaccuuuaaucccagcacucgggaggcagaggcaggcggauuucugaguucaaggccagccuggucuacagagugaguuccaggacagccagggcuacacaaagaaacccugucucaaaagucccccccccccuccaaaaaaaaguaugaaaagauaugguauguaugauauauggcaaauuacuauucugccuuaaaauaauugucaccugaagagugagaucauacaauaacaaauaguuugagccuuucuugggauucuucuuuaauuucuaucuaccucugcacgccguacuaacguauggcacuauuauacucauuuucaucaugcaagagcuauguuuaugugguagucaugugccagucacuguauucacuuauucaaaaagagauuguuagggguccacaaucccucuaaaccaauacaggcaguuggcauguacugcuuauuguugccagccagaauuagaugauaaaaucguauuagucaagauacaacauguacuagugacagaacacagaaaaaaauaaguuggaacugaacagacucugauaauacuagaagaugcuauccgagaccaguggcaaguuccuguguugcuuugggagcucaguaucugaugugcguaaucgucagcagcaguuuuacucagccauggacuucagauccggaaaaauaaacccaccacuguaaugguguuucaggucggugaugcucucuaaauucuugacuuucaggagcugccaugaccuccacaagguggggacuguugagggaggcagaaagggauuuguaaggcccccguccucccuaaauaccauaaucagcugaugcaugguagacgagaagagacauuuaucuaacucaguuguguggccacagguaaaaguggcucgugcuucuugaccuuucauccauucuuuuguaagcaaccccaauacaaagcauuucaucugucugucugucugucugucugucuauuugaaaguaaagaacaaguaagccaguugaucauuucuuuuuucuuuuuuuaacuguguagcccuggcuguccuggaacucgcucuguagaccaggcuggccucaaacucagaaaucggccugccucugccucccaacgugcugggauuaaaggugugcgccaccacugccuggccagcugaucauuucguaugcagcacugagggcuaggcugagucucuccagcacccaccacaggguaaugcugcugguucgccugcaaaugcuucaucugagccuuaaucacaaguugucguguacagguguugcaaacuuguuugccuaacauaaaggauaguagcagaucacaaaaauuaaacaaaaacagaaaaauaguuugugaugcauugaaacacucaaaaucaugaagacaaacaaaaauguuuuuguucauuuugcaauguaaaaaacauuacuuuuucuugugaaaauuuagucuuucuauacaagucaugcuuaacaauuaguaacuacauaagguuuaaugaagaacugauaggcaagcaugaaccuauuuacuguuugucuacugacuuguuuuuuuggggggggggggaucugagacaggguuucucuguguagcccuggcuguccuggaacucacucuguagaccaggcuggccucgaacucagaaauccgccugccucugccucccaagcucugggauuaaaggcgugcgccaccaccgucuggcuuuaaauacuucuugauacuggauagauaugucuucuagcugugggaaauuuucuucuccuuuuuuuuuuuuuuuuaaauaaugugccuuuuauccagauuacaucuuuuauaccuguaauuuaaagguuugguauuuauggucuccuggauauccugcauuucuccucuuccuacuccucuuucucuucguucucuccgccuccuguuccucuuucuccugaucuuuuuucuuaauuauuuauucuugcuaacugauuuaguuccuccaucccaaucucuccacuuccugucugucauuaaguuccuccuuuuuguguggcuucccucugaacuuuuuauuagaauuacuaaauuuuauauuugaaguucuaguucaguuuuuccucagaauuucuguuucuuacuaaauucuauuuuuauguauugaauuauucuuuaauucauucaauaauuuguuucuauuuaaucuaguagucuucuuucuugcauuuuuuucauguccccuuugaguucucugaaugcauuaagaguuguuaucuugaguaucauccaaguuucuuuccuuaaaaagaaacuauugaaguacuaauuuuuagaguagcaaauuuguuguuuuuugguuuugcuguuuguuuugugauaguguuucuuuuaguauggauauuuugcccucccuuguucaguguuuuuauuuggaucuguuugcucuuauugguuuggaagguuuggaauuggcuaagugauauuucagacuuauuuuugugggcaugaaggucuaaugugugguugugguaucacagaugaucuuugcucugcuagggcaaguugcugcuucggaucucauaguaggugcuauguagaaucagaacguucucauugcaguuucucugagauugagguuggagggccagagagagaugugugaagguuaccauuugguucacagaugcucaacauuagcacagaauuaacacucccagauagaaggaaaaagggaguguacuacuuggaaugcagcaggguccugccucagguccucaacugauugugacuuugguauuuguagggagaguaaaggggugauuucuuuggaaagcaugugcaagucucacuuagaggugcuaauauuucaaugggugguggguaaaggaagcugagagugcugucuguggaacgugggcaugggccucagcacagaugucaagauggaggugacuaggucuuaugaggggagagggagguacuucucguguaugcagacuggcuuguugcagauccccagaugggaacccuugguagaagaggaaaaaaaccuacuugucuaccugugagauacauuuugagacuugguacugauccuuaccuggaaagagguuagggguggaggagggacuuccaaaaguauugguuuuauuuuuuuauuucagaagcaaagaaaaauugaugugaaacauuuuuauugaguagcagacuauuuucagucaaaagaauaaugacauucuggcauugguauaguaacauauauaucaaacuguucaaugcuuuucaaauuauaauggcuaguuuauugcauuuuagagcacuuaaggaguuuuuuagaauuaaauauuagucaacaaucacuaaacauaccaugugacacauauugaaauaaaucauaccaaauggcuggccuauaagcugcuauggaacuacaacaaauuuuaaaaaaagaaaaaugaaucaaacucucauaaguauuucacuacauauuacagcaaauuuugacccagucaauucaucauuuuaaccaucacaauccgugcucuggacagaaagcucauuggcauacuuaaguuauuccacccuucagcauuugucccuaucuucuuaggggauuucugcuaaaaugcuuauauuuaaaauuaauaacauuaugaucauuucacuuggagauuauuucauuuugccauuauuauaaauauuuuaaagaaaauaccagauuagggagccccccccccccuuaaauugggcugucagguuuuuacuaaaagguaauugcuccaagccucccucucguagagaggugagacucuggaaaagagaaacaggagccucagcaauaacuccucuacugaauucucugcugcuauacagcauauguuaauugacagagaauuauaaaguauguuuauaaaguaagaguuuaagaguuugcagaacuuauucaagcacagaguacuaucacguaacuuaagaagagagauaaagaguuaaguuucuucaguacuuaaugaaguacagaccaguacaaaagaguuaaguucuuagcacagaacaagaagaaaaaaaucaaguuuccuacaaggcuggagaccaucagucuuuuagccugugauuccccuaagaccaggcaggcuccuggcaugugaguauagcagaauaucauuagaauucauuuuauggcuauguuccuuuggccgaacaguaguuuuugguuuucuccuaggucccuggccuauguagucuuagguucuuagacaccugagcugugucaggaauggguucuaucucauggaguuagccuuaaauucaaucagauauugguugguuacuuccacaccaguagugaacuagcauaucuuguaagcagguaaccauuguaaaucaaaaguuuguagcugguuaccuuaggaagaaacauuauuucuaaaucuagguuugcacugcaguggcuuuauagugaugaguuauaaauuuuuauucugacuuaugaaucagaauuucuaacuguggagaaaaggggaacagaauuuuaaacaugauucccugauaaacauugauaguaguaaaacuaauucugcaaauguuugacucuccuauauuggauaguuucuguaucccagccuaauguuuuggcaggaucuaaugugauaaauuuagcauaaaauggaugagcaggagucagaaaaccagaaguccuuauugguauaacucaugagugacuuggaaagagccauguugaucccucacauuuggaggagaugcacucucuauagucccucuuugacugguuuaaccuauaacauggcauguuuaguuucuuucauuaagagauucuauuuauugacuacaauuuucuagccugucuuuaaaccaugauuugccuaggaccacucagacaauauugauuucaaaaucauuuagaaacagaacuuuuaggucagggaauagcaucgggaagggauauugucuuacuaagguccagcuuaauuuuuucuauagguuauuguuguugggguuuuuuuguuuguuuguuuguuugauugauugauuuuuguuuuuugguguuuugaggcuacacaggguuucucuguguagccguagcuguccuggagcucacucuguagaccaggcuggccuugaacucagaaaucugcuugcaucugccucccaagugcugggauuaaaggcgugcaccaccacugccuggccguaucauguucauauacauauauauguauauauguauauauguauauauguauaucuauaucuauaucuauaucuauaucuauaucuauaucuauaucuauaucuaucaaucuaucuaucuaucuaucuaucuaucuaucuaucuaucuaucuaccuaucuaucuaucuauauauauauauauauaucuugauguuauuuuauaguccagucacuauucccccuccuggucuggccucuguuccucaucgcauaucuccccccccaucuccaauagaauaugugugugugugugugugugugugugugugugugucccugccaaaccucccacucccuggggucucaagucucucaagggcuaggugcaucuucucucacuaaggccagaccagacagucaucugcuguuuauguuuugggggcuucauaugaacugguguaugcugagugguugguggcagacugagagaucucuggggggaccagguuaguugagacugcuagucuuccuauggggucuuucuccccucagcuucuuacagcuuuucucuaauuccagcacagggguccccagcuucuacccauuguuggggcguuaaguaucuguaucugacucacugagcuguuuguugggccugucagaggccagucaugcuaggcuccugucuauaagcacaccauagcaucaguaauaaugucaggccuuggagcuuguccuuaauaugaaucccaauuuuggccugucaccguaccuccuuucccucagucuguucugcauuuuugucccugcuguuuuagacagaacaguucugggucaguuucugacugugggauggcagcacaaucccuccacuugaugccuugucuuucuacuggagaugaacucuacaaguuccaucuccucacuguugggcauuucaucuagggugccucccuuuggauuuugagacucucucaccucccagguuucugguacauucuggagggucugcucccccucccguccccacuuuuaauacuugaucauguugcccuucuccccucacugaccccucuccuauccagguuccucccuccuucugccccccacccccaugacuguuuucuucucccucccaagagugauugaggcauccucacuggggccccuuggcuuuuguggauuguauccuggguauucuguacuuucuugauuaauauccacuuauuagugaguacauaccaugcauguccuuuuggguaugaauuaccucacucaggaugauauuuucuaguuccaugaguuugccugcaugaacucguucuuaauagcuaaguaguagucccuuguguaaaugaaccacguuuucuguauccauccuucugucgugggaugucuggguuguuucuagcuucuggccuucacagauaaggccacuaugaacauacuggaacacuugccacugcugcauuguguggcaucuauuggauuuaugccccagagugguguagcggguccacuuuagguagaucuauuucuaguuuucugaggaaccuccagauugauuuccacaguggucuuacuacuuugcaauaccaccagcaaugaaggaguguuccucuuucuccacauccucuccaacauguguugucaccugguuuugauuuuagccauucugauugguguaagguggaaucucaggguuguguuaauuugcauuucucugaucacuaaguguagccuuccacaagccugaagccaccugagccagaccuugacuuugcaauaccacuaaggagaucaccuaggguggagccugccucccuagaucacucuauuguucagccacuaccacugcugcuaccugcugggagucugccuagcuauucaguagccuacacguggucacuugcagcugggcuccaaggaugauuuggcaggaaugggccuccccucuccuuuauaaagcgugcccaccauuaaaaauuugagucuugaucagaauacuuucuuggcuccauuucucucucuacccuccuagauucccucuuuucuuucaguuccaagaugccucccagguuccaacccagacaugagagcugcagguccgccccaacaacuaaguacuuugaacauuucuuuaagugcuucuuagcccuuugagauuuuucuguugugaauucuuuauuuaguucuguacuccaguguuugauuguuuuaucuuuuuaucuuuuuuuuuuuuuaaaacagguuagcugcuugaguucuuuauauauuuuggauauucuguagcuuucuacagaaugugggguuagugaauauuuuuucccaaucuguagguuacagauuuguccuauugucuauauccuuuacaauacagaagcuuuucaguuucaugaguucucauuuaccaauuguugaucuuagagccugagccauuggaguucuauuuaggaaaucuccucuccuccuugcuuucaaaguuuccauugagaauguuucuuuuuucuuaagcagcuuuuaauacucuuuuuuuuucuguauggcuuauguuuuaagugucuuauccaguggagaauuucuuuuuuaucuuaucuauuugauauucuguuucuuauaucuguaucuaaaugucuuucuuuauuugggggacauuuucuucuaugauccuguuguuucaaagauuuaaucuuuucauuguaucugacaguuccugugucuuuccuuuuuaugcuuuauucaaauuuccauauucuuugcuucuacuaucugauccuugaguuuucugauuguguuuuccaauucuuucuuuauuccaccuugaguuuucuucaauguuuccaucuuuuuaucgaauuaccuugucaaaucuuacauugucuuugucauuuaauccagugcuauuuuuguauuaucuugggcaccauucagguauuaugcucuuaaauuucauucucuaagguuuuugagguuuuuuuuuuaaugucuucuuuaaacucuuuucuuugaagucuauaauuucucuuuuauaaaaaaaauucuucaugcuuagguuugcugugguaauucucuaugccaaauauuuccuucuguaugacuggauuuaagaugacacauccuauuuugacuauucacaauguguuuauuuuugugguuaaacuugggcauguggguuuauuuuguuaguuuucugucugauguagacauaguauacugugauaggaaacagauuaaacaggaagcuugauccugaagguugaauguaaugucaaaggacucucuccuggaagacaggaugugccuccuguccaaagccuguagauuguggguuauaagagcagagacuuggccuguucgcuggauuugaaaucuggauuauaucuagcacuugagaguggauguuccagaaaacuuaccaggauagcccugguguaagaugcaucagaucuggcuuagcugaaagguugcaugacauucaaaagggaugaugucagaugguaccuggggcucuaugcuaucauacauaaugucccucaguucagagcuuauauagguuguggccagugcaagcacagguuagacagacaguggaugggcaacuaggacuagauuuggggacuggguaugugaaagaaagggaagaggaggcagaucccucaggcugggcccuggagcaagauacacaguauuguccugcucugagauguuauauggaauaccaggaaacaguaauuuuauuuuuaaagauauuuaugccuguuuuagaauuaccuugauauuuacagaaggaaaaagaaugauuaaaaaacuggcaaaauaacuaucuaucuaucuaucuauaaaucauauaauauuauaauaauauaacaaaucauaaaauauguaaauaggaaaagacaagguguuuugaaccuccaacuacuucauagcucaucauuucuugauguccuuugccaagcuauaugcgcaaguaaaucauuacaagggcuuauuaccuccucagucuguuagugcccucaguggccugugccucagaaugaagugugagaauccaguuccccagcagaguacaguacucuguaagacauucuucugagcaucuucuucucuaggcauuggacagcagauggaguagcuuauacuuccuucauuccuuugaauuaaaaguaccucagaauuguugcugcuuuauauuuuguagccuucccacccaaagguucuuaaggaccgauauguggagcuccagccucaggaucacugagauuuaugucauaaaauauaaaugccgugguucuacccugaauguucagaguuuucaaugcucuuagaucuguuuauagacuuccuggucgcucugauucaugcuccagugucuuuuuguugaggcauguaaugugucuguugagauuuagaagaagcaggucaugaaacuugacuaaaguucauuugaaggaaucuguuuaauucaaugaaaaaaaugagcaguuccaggcuccuucccuggaaaaauguaaggaaugacgaaggugauaaucccaugguaucaguguccgcauuuucuacuuuuguuguuuucuggcagucagcauuuugguaaacuuauucuaaagcauccacaggggugcuucccucagaauccccauuuaacucucgaaucucuuguauuaguuguugcccagacauagccuucucauucuuucucaaggcaucacugauaccuuaaugaguggucugcaaaaauaauugccuugucuuucuauacuuucccgcucucaaaugccuauaaucuuauauccuuaaguucccuuuguaccugugucgcauaggguuaccacuuaagacucuagggagccaagccugguggcagagucuuguaauacaaacuauucuggcugaaauaggagagucucaauaucaaggucuuccuagccuacagaacaaauucagagcuaacccaggaaacuuaguacgacgauauaucaaacaaacaucacuguuagcuucccugaagacauugauucacuucccauccuugagcggauagcuuugcuuaaaggcagaaguucucuguaagucuuugucaggaaagagcagcaaauacggaagacaucucaacccuagccucuuccuaaugucagaauccuaaagccuggcuggucagaauuuguagugauuuuuuuuuuuaauuagguauuuuccucauuuacauuuucaaugcuaucccaaaggucccccauacccacccccccaauccccuauccacccacucccccuuuuuggcccuggcguuccccuguacugggacauauaaaguuugcaaguccaaugggccucucuuugcagugauggccgacuaggccaucuuuugauacauaugcagcuagagacaagagcuccgggguacugguuaguucauaauguuguuccaccuauaggguugcagaucccuuuagcuccuuggguaauuucucuagcuccuccauugggggccgugugacccauccaauagcugacugugagcauccacuucuguguuugcuaggccccggcauagucuuacaagagagagcuauaacuggguccuuucagcaaaaugcaauggugucagcguuuggaagcugauuaugggauggaucccugcauauggcagucacuagaugguccauccuuucgucacagcuccaaauuuugucucuguaacuccuucuauggguguuuuguucccauuucuaagaaaggguaaaguguccacacuuuggucuucguucuucuugaauuucaugcguuuggcaaguuguaucuuauauuuuggguacccuaaguuucugggcuauuauuaugcacuuaucagugaguacauauugugcgaguuccuuugugauuggguuacuucacucaggaugauacccuccagguccauccauuugccuaggaauuucauaaauucauuuuuuuuaauagcugaguaguauuccauuguguaaauguauccauuuucuguauccauuccucuguugaggggcaucuggguucuuuccagcuucuggcuauuauaaacaaggcugcuaugaacauaguggagcauguguucuucuuaccgguugggacaucuucuggauauaugcccaggagagguauugcgggauccuccgguaguacuauguccaauuuucugaggaaccgccagacugauuuccagagugguuguacaagcuugcaaucccaccaacaauggagaaguguuccccuuucuccacauccucgccugaguuuuugaucuuagccauucugacuggagugaaguggaaucucaguguuguuuugauuugcauuucccugaugauuaaggauguugaacauuuuuucagguguuucucugccauucgguauuucucaggugagaauucuuuguucagcucugagccccauuuuuuaaugggguuauuugauuuucuggaguccaccuucuugaguucuuuauauauauuggauauuaguccccuauccgauuugggauagguaaagauccuuucccaaucuguugguggccuuuuugucuuauugacagugucuuuugcuuugcagaagcuuugcaauuuuaugaggucccauuucaaaauuccaacucaauucuucaacgaacuagaaagggcaaucggcagauucaucuggaauaacaaaaaaccuaggauagcaaaaacucuucucaaggauaaaagaaccucugguggaaucaccaugccggaccuaaaacuguacuacagagcaauugugaucaaaacugcaugguacugguauagugacagacaaguagaccaauggaacagaauugaagacccagagaugaacccacacaccuauggucacuugaucuuugauaagggagcuaaaaccauccaguggaaaaaagacagcauuuucaacaaauggugcuggcacaacuggcgguuaucauguagaagaaugcgaauugauccauuucuaucuccuuguacuaaggucaaaucuaaguggauuaaggaacuccacauaaaaccagagacacugaaacauauagaggagaaaguagggaaaacccucgaagauauggguacagggggaaaauuccugaguagaacagcaauggcuugugcuguaagaucaagaaucgauaaaugggaccucauaaaauuguagugauuucuaacaguuccuuuucuuuuugugcuguuucaaaacagagagcggugauuuuuaaaaauaccaagguaaguuuuaaaguaaugcuuuaaaauuguaaggaccuuguuuuuguucuaugguaugcgcucucucccuauguucuugcugauaaggccccagaaucagaacuuguguuguucauauuauucuuugaugaaugaauguuauauucucuguuuuaauccuucagaaaugcaucuucuguagacaccggguuaaaaagguuucuggagccugcauccaguguucuuauggccgcugcccagcuucauuccauguuacgugugcccaugcugcuggagugcucauggagccugaugacuggccuuacgugguaaacaucacaugcuucagacauagagucaacucaaacgcgguaagaucugcucucccauuugcugacacuuuauuugaauucuuucugggaccugucacaggucucuaauaccuugugaguguugacauguccagacuguaguauaauuaagacucggaauugagaacuauuauuuaaacauaguugcucagaaccauucaguuucggcuaugcauuaaacacaguauuuauaguaaguugaaugagugaauguauacaaaaaugagucaaacucuuaggauccauucuuuuuuuggaucuguguacagauaucugaauaguuguauauagauugugcuguucauguguucagcaugucagaagauaauuucaaguagaacaacgugaaaagagcuccuaaaaucugcaaugcauucugugugcaaugauacacauuuauuuaaaucuuuccugaaagaaagaaauagcaacaacguuguaaaaggaaaauggccaggaacuuuugcuucuuucuaccuaacacaggauaagugagcucuaacaugaaggcccuggaagaucaguggaauaugacuaugaaaguguauaacuuuuaacgugaggagaauauauuagcauagauuauagaaaggaaaaauaguuugccccccuucauucauauuacuuaagacugaaauuccucuaagaaaauagaauuuguacgcagauaacuugaguuuaaacuguaauuugcuuaauuuuuccuugguuaaugaaaccauucccuugacuuaaaagcuuaaaaggauuagggcaauauagagauuuguauccuuacaagcucuuccugucucuauuaauauuaauaauauuuuucuccucuacucuuuuuuuuuuaaauuauuauauguaaguucauuguaguugucuucaaacacaccagaagagggcgucagaucucauuauggaugguugugagccaccaugugguugcugggauuugaacucaggaccucgggaauacaagucagugcucuuaacuccugagccaucucaccagcccuacucuuuuuuuuuuuuguuuguuuuuguuuuuguuuuaauggaaugacuucuauuauuugacaacuucacacauguaaaaaacauaucuuugucauauggacccacuaaugaucuuuuaugagcaggugccaaaauuguccacauugacuuguagaaauaucuuaccuacacagcaaccuuccagccuuuuguaaugauuccauuagugucuacuagugucuuuagaaauagcugacauuuguggcuagcgauuguguggaugugugagaauguucaaauggacaaacugcuguuaugagcuccuuauuuuaaaguuauuuuccauuaugugaaauuauagguugcauaggagacacccaugucuuuuucuuaguuaguugauguccuuuaaucaaaaagauuguauucaguaacaaccacacauuacuagacuaauaaauuaguaauaauauauacauuacuguggcacuugccacguacaucaagaagucaauaauguuaccccauucagugauucuggauguauucuguaguauaauaagauccugaccucuagagccauagugaucaguguucaugcuuagaaucugccaauaaaagcugauagcuaugaaaaagugaaaauguauacuaauuuuuuuuuacuucuacgauugcugguacugcaaucuuacacgaauaauguaaguauuuucuuguuuuaaaaauaauaaaccuaauuucagaggcacuuaauucuaugcacaaucuguuguaaucauaaaugacaggugacugacuguucaaccuauaugcucuauuacucguugaacccuuaacuccaaacuuaaauagagcuaacaguaugcuugggaccauagaucccauuuuaauacugcagugcccuguggcuauaggugauucuguugaaauuggacuuaagagcucuaggacucuggcuccgcuucacucugguguguggcuuaguuaggcuuaggcugcuaaccauuuacaaaagaugaugaaaaaggaaacaagacuugucagguaauuuagaaacuacuuuaugugcgguauguuuauaaaggaauauaucauauaccuuaaauauaaauaaaagaaguuguagguuuugaaauuaauugcucccgacccucugcagguaacucuagguuguugaaguauaguccugguagcuccuacuuagcuauucuucaauuagacuccaguacaauugcugcuuuaaucuuaucuugacauuacaucaacauagauaaggauauaaaagaaauaacaaguagcauuuguauagcuucuuacauaguauuguguauguucagacaugcacaggucuugaaaaaaguaccugcauccccauuuucugaaaucguaaagagccauucaccucugaaaugaaccauaaucgcuaauuacagagaagauguaaaacuuuuuaggacauauagcagagaacugcugauagauagauagauagauagauagauagauagauagauagauagauagauagauagaagauacauauauacauuuaaagauuauguugggcaaaugugagaugaugugagcagcaauuaauaaaauacaauaggacuuauauacaauuaggaauaagagauuaaucagcucaugcugacacguuugguagguagguagguaaguaaguagaugcaagagaacauaggagaugcccauaucaaauaccaagugauaucuaguaaauuuuuuaagaaugagauuuuuuuuauauaaucacagcuccagacaguaauccuucaagaagaugaacacugacacuuuaaucugccucguggacuuaacuugaucaaaugagcaggaugaucagcaugugccaccaucaucauaaagaauaagugagauucguuauuggauguuaaaucuaaccagacuuguauaaggauuaugauguuucuccauaguaagaaaacgucccauauauuauauauuaauauaagagaaaaauagagaaauugggucacucuuucauuuagaaucaaaaguaacauugagacacaugcagacaucaaguacccucagauggaaagaauccugaaaagaauauaguauaguacaguacuguuuauaaucauggggaaauauuauacagauaucuauugaaaagcagaaggagaaauuuuaucuuucuaaaauaucaguaccauuuuuuuuaaagaaggucuauagaaaugaauuuauaugagucuaaaaugaugggacagauaaacaaaacugaaguggagaauggauccuuuucuucagaguuuugggggagaggaaaggaaagcacuaaggucauuaugaggucaguugaauccaggugacagauuaaaaugucgugcuaguguucaccuucuucuaguugauuacuaucuagagcugugguuauauaacaggauaccucauucuuagaaaggaaacguugaaguauuuaggugaugaacaccaugaugugcauugcuucaaaguaguuuaagaaaaccauagagaauugaagaguugggcucagguaucaaagacaagccacagaggcagaauuauacacaaaugaaacauaauuucuauccucuuucacacugaaauaucagacaacaaagcacauccuaagacguuaguuauuauguguuaguaagcagcgacugacuaauagaugaauuuugauaccugucaaaggauagaugcucuacuuuuguacuaauuguagucuuuacauuugaaauuauucuuuaauacuaaguuuaaaauauuuaaaucuugacaaggucaguuuuugcuucccaaguaaauacuuuuuauuuucuguucuuuuuuucauauccgucucuuuuuuuuuuuccuuuuucuccaucucacagaaauccaaaacuugugagaaagccauuucugugggucagacagucaucacaaaacaucgaaacacucgguacuacagcugcagagugauagaugugacaucucaaaccuucuaugaggucauguuugaugauggcuccuucagcagagacacauuuccugaagauauugugguaaggaggauuccccuggaugucugauuccuuagaacaggaauuuacuuguuuaagcuguaaaaagguaaggcaguccaaaaguuaaguucugaccuuuuucucuggugaguaccuucuugcugaacucuuacaugggacaggacuuuguuuggaaccccaucucucacuugauguccuguaugucugcuggagguggcucuauaaguucccucucccugcuuucaggcauuucauauaggaucacucccuuugauccuggggugaaucucucaacucccaggucucuggugcauuggggggggggggggguccuaaccuccuauuuccugagguuaccuguuuacuuucuuucugcuggcuucagggcuuaguccagucuguuaacuuuugccuuuuuauaggugaguugagagcccauuaauauugagagauauuaaagagagaugauuguugguuccagauauguuuuuguuuguuuuuuguuuuguuuuguuuuguuuuauuuuuugguacguggcuugaugugcuuguggcucucugcuuuugacuuuguugugagauauccuuucuuuggugcagguaucuuccuuguguuguaguuuucuuuccaguauucuuuguagggcuggguuggauagauacuguuuggauuugguuuuauccuggaauauuuugguuucuccaucuauguugauugagaguuuugcuugauauaguagccugggcuggcauuuauguucucuuagagucugcaugaccucugaccaggcccuucugguuuucauagucuauguugagaaauaugguguaauuuugauaaguccaccuuuuuauguuacuuggccuuuuucccuuuaaucuuucuuugcucuguucauuuaguguuuugguaauuaucugacgagaggauuuucuuuucagguuccauuuauucggugguucuauaggcuucuuguaccuuuauguccaucucuuucuuuauguuggggaaguuuucuucuaugauuuuauugaagacauuuucagguccuuugagcugggaauuucauuuuccucuauuuccgcuauccuuagauuuggcuuuucauuguauccugauuuauucauuguauccuuagauuuagcuuuucauuguauccugaguuuccuugaugcuuuggguuaggaguuuuuuauguuuugaauugacagcuguuucaaucucuccuaccauaucuuuuauaccugagauucucucuucuuuuucuuguacucuguugguaauaauuacaucagcaauuccuuaccucuuuccuagguuuuccauuuccaggucugccuccauuugcauuuucuuuauuguuuuuauuuccacuuuuaggucuuggaucgcuuuauucaaucccuucaccuguuuaccuguacuuuccuguauagaaauacaggaaaauucagaauacagaaauucagugcauuauugauauccuccuuaaaggacucuauuaucuucaugagauaagauuuuaggacagauuccuaauuuuccuguguauucagggcuugcuguggggugaaaacuggcuucugaugauguccacauauuuuggcuucuguugccuauggucuugcucuugccuuucaccaucuggauaucccagaugauuguuggucugggugacuguauggagucugccucuuuugucccuggguugcuucaggucuccugguaggcuugcggcccuggcuguaucagaccaucuguggggccuuccuacugggggcucuucacaggggcagagaagcugcugaucuguugcccugacugcaguagaucuccugggaggccuucagacuguuggaucuucuguggaacagugaagcuguuguccagcugagugcagaggauccucaacugcucugagcgcagugggucuaacugcucuucaugcugcagguccucuaggauguaucaggauauggagucuucaugggagcaacuaggagccugccccagcagcaagggccauguggaagggcacaucucuguauucuuaacugggucagggauauuucucagccaguaaagguucuugcugccaaaccugauuaaacuaauucuguucccugggcccauaugaugaaggagacagccaguuccuacauguugucuucugacuuccacauucacaccaugggaugcacugacuucuccaccccaacacacucucacacaucuacacauauacauguacacaaaauaagcaaaacuaaaguauucacaagauuuaaaaugacauaaauggaaaccaaacuaauguuuaaaagauuuuaaauccaaugaauuuauacacauugaaaaucuuggaauuuuucccaaugaagacuaauggcuuauuggaguauaucugaagcugugugucuguacugcucucagagaucaccacagugaaccacacaaaccugccaagcagaaaaggaagugacacuugcuacugcucccacagguagagugaaacuuacaaacuuaaugucacaguucaagacuauuaugguuaauuuuauguccacuugacagugcacagauuuuuuuggucaaaccuuuucauuuuuuucuagaugaauuuuacauuuaaauucauugaauaaaauagauugcccucuauucuuugguuagcccuuauugguaguccucuagugguggaccuacacggaacaaucugacuucucccaaguuaaguagaaucguugcugucugcucuauguuccucugcagacgugggucuucugcauuuagaaagauuuuuuaaaucuugugaauacuuuaguuuugcuuauuuuguguacauguguauauguauaugugugagaguguguugggguggagaagucagugcaucccauggugugaauguggaagucagaagacaacauguaggaacuggcugucuccuucaucauaugggcccaucagcucgucagcuuuucuauaugucuagccugcucaccgcagaucugcaaacuuugcagcuucuagcaucuuggaagacugaguuacaauuuugcuuuuaaauaugaaaaucaaauuaggacaacaaauuuaaugaccauaaguuauuuaugugugacauaaauacaaccuauuuugaaggcugauacuucaguaaugaaagguauaguccccuauuuaaagauucaguguucagcucacuuuauuaauucauuagacaagaguucucuaaugcaaaaacucuauauuugaaaauaaauuuggcagucauaaagggauuggaauuuuguuucuagagaguauguauagcagcaggaaauuucacuaccuagguacuuaauucugugguagaaaaguguccaaaaaauucucacgaaacagagcaccuauacaaaguguguauuggccaacuuaaccucagaaugaaauguuuagcuguugaaggaaauaauaaaugauauauugcuacaugcuugcaucugucaguuucuuaaacauacucuugaugaauuuuuguuguacauuauuuuaacagaaauuaaaaaugcccaucuaaaagaaauguauagcguggggcuccuuggccccuuuagcauaugccaaagccugggauccucgugaugccugccuuggcuccagagugagauucacuugcuucuuuccucacuuggaguucauuucaagggaugaaggggccuaagagucacugcaucuucuuggauaggcacaugauauacaccaugcaccacaaagggaaaauugacugccuagaaauuugaucacaggagcccaucagugaaacaggaguuguuaaaaacaauuauauuuaaauuaaauuaaauauuacaugcuguauuagauaaauagacagaguaaugucacuuagagugguuauguuccuucugugaguaauagacuagcuaccaaacuccagcuucagucaugggaaaccuuacaucuagucuuuguucagagaaguugaagaaauucccaaaauauaaaagcuauugcccuuguucuugauuuucauuuagaacuugaagagucuauuguauagacaccaugcaugcuuugagcaugagacagaggaaucgagcugaaacugaucaggaugccugcucucugaaaacuagcucucguaguuucaggaggugcuuugcaagcugccaaggaauaccaucaaguuguaccaagggugcaguaaugacaguuagggccacucaaugggagggaauucgugccuuguacuggacucagccaacuacuuacggcugguaaggucauaacuccuagaggagacccuauuauucucacuuuccaaaaccaguauaauuccuaauuuauucuaaagacuuauccagacauuaguguaacucuuaccuuuuaucaaaaaacuccuuuuugcagcauauagagaccauuauaaaaacucacagcuuguauauguauaguguggugucaguuauguauaaauagguaaaggaaaggcccucaaaggaaauacaccaaaauauuacuuuuaucugaagauuguuaucagucauaggugauuaugacuuucauuuuaugguuuccauaugaauguuuucuguuuauaagcagauaaaagauuauauauuuuauucuuuacuuuuuccucaguuuuuccuaccuggaucauuucagauuacuuuaucaaauauuuuauuuuggagccaucaucuauugauguuuccuuuguauuccuaauuaaguuucagucauauaauuuuuuuuaauauauacaucuaguaaugcccuuucguauccucuuuucauuccugcuauaacuuuuuucuuccagucucuuucuauuucugugccuucucgugagugagugugagugugcaugugcgugugugugugugugugugugugugugugugugagagagagagagagagagagagagagagagagagagagagagaggaaagugacagaggccuauugaguuucauuagauuuuguuuccuaugauacaugugagguaacuuacuggagcuggagcaugucuuaacuuaaaacaaaaaaggacuccuccuccauaguuuaucuuagcugcaaauaucuucuuagagaguguguggucucaugaaucccuccccaauccaugggauguugacagguucaauuuaguacagcucuuguggagguuaccuaagcaucucugauuucaugacuacaccagcaacagccuuuccaggaaacaucauuuuccaauuuuagugcauucucucucccucucccucucccucucccucucccucucccucucccucucccuauguguguguguguuuguuuguguguguguguguguuuacacccuuuauucuauaauguuaccugagccuagggugcgguuauguagauaucccauguagcacugacuaucccuuauuaaacucauuuacuuauucucaaccuuuucaccaguuacaagugucugcauugauugcacucauguuaagaagccuuucuaagcagcugauaguacuaaucugugaguauaaauauuuggaagaagauuuguuucuuucaauacauuuuaucaaaacaccaguauuguucuccuuuccuuuccuuuuuuuuuuuuuaagauuuauuuauuuauuuauuuauuuauuuauuauauguaaguacacuguagcugucuucagacauuccagaagagggagucagaucucauuauggaugguugugagccaccaugugguuacugggauuugaacuccggaccuucggaagagcagucgggugcucuuacccacugagccaucucaccagcacuguucuccuuuccuuagucaaugacuuaccuagcuaugggcuuuugcauauuuacaguuacaggcaugaauucucucccacaaaauaggccuuaaauccuaucagaauguaauuguuuaccuccauaucagucacgccacuguagcaucauugggcacaauguccugguagggugauauuguuacacacuggcaaauaacugguuaagacuauggcugacuuuuuuccucugaacccugcauagcaucuuucagguaccaugaaagcuaguugaacaucaagaaagcauccagcucagcuauaguuucauuucuucauguccugcagcuaaagaauagcucagcaauagacuuuucccauuaaguucuagugggcaaguaagaggaaugagauauccuguguuguuugagggaucuccaggggccucuuugaccaacaacuuuuagaaauguauccuaugcuuuguauagggauuuucauuuaacaaacuuauggcuucuaggagagggauuauccauccauacagcuuuuaucauuguauuuuuaacuacuuuacaaauagaaguuguucauaugccuuuuucauauuuuuaaaaucugauuaccuaccuccaacucuacaugccccaacacucaucccuucuuacccuauuucaaauaaaacauuuucccucuguacuuucauauuacuuuuguuauauucucuccauucucuguuaaguucauacacaaauucacacucccucuucacugcaugcauauuaaaauuguaauaccuucuuaauguucucugaucaguauaaagugacauuuuuagucccuucuaacuaguuuuaauuuaaagccuauuuugucagguauuagacuggccauauuuguuauuuccuaguccauuuuuuuucuuuucuuuuuguuuuguuuuguuuuuuuuuuuuuuuuuuuuagaauagccuuuucuaucguuuuaccuuaaugugguaucuuccucugaugaggaaguauguuucuuugaagcaggaaaaagaagagugcuguuuucuaauucaguuugccauucucaucuuuugauugaauaauuaagaccauuuacauucagggcuuuuuuuuuuuuuuaaugguauguuauaaguccugucauuuuuguuuauuuucuaauguuuuguguuuucuuaguccacauuugccuaacugguuuagcauuguuugccccuacccgaacuuccugaauauuuucauugagaaaucagcuguucugauguacucucuuauauaauagauuuagucuuucugucuugcaaucuuuaauauguuuucuuuguuccauaaucuuugugcuugaaauuaaacugggaguuucuuuucugccccaguauauuugauaaucuguguaccuuuguacaugguuguaguuauauuauagaaggcugagucauggauagugaguucccaguccccauccaucacugugauugcauauuuccuuaugcuaugugcauucugauguauguuugaguaccaaacuagaucugaaucccuuuagcgaaagaauuaggaaaaaguugggugguuuuuuguuguuguuguugguguuguugucuuaaaccuguuuaccuaauggucagugccaggcccugaggauauauuuaguauguuauuguaaaacccaaugaucacccuuuccagagaguuuugacuuucccucccaccaauauuggaacuugacagacagagaaggaagguaaucugucucagagaaggcaauucuguuuccuccauacucucaagcucaaaagaugcagagaguuuccccaguacugcagagggcaacccccagaccaaccucacuguaccugcugcugccuggcccuauucccacagccccuuaaaacaggcugguuccccaguaccagucuugugggggguuuuguuuguuuguuuuguuuuguuuuuuaaaagauuuauuuauuauuacauguaaguacauuguaguugucuucagacacuccagaagagggcaucagaucucaucucauuacgggugguugugagccaccaugugguugcugggauuugaacucaggacuuuugggagagcagccagugcucuuuaaccacugagccaucucuccaggccccccacucuuguuuuuaguuauuggcuuuucugcuuuuuucaugguaucuaacuuuagaggaaccaagaagaaaacuuccuaaagaaacauuuacuuaugcauucaaagcucccagaugucaaggcccauuaauucugauaccauaaagauugccuucucucauaaacagaccucaugcuaaugcugaaauacguuuuaaaauaauaaucuccauaucaggauuuucuguucuuuucucagcccuguguauacucuugacauauggcugaaggagaagugcaaaccaacaaaccacuuggccuugaggaauucuccaaauaaguacuaaugcuguuguuacauagaagaugauuuguguuugugugucagggccuggcaauaggaugugucuaauagccaagaauuugguuuaaugaagaaacaaggugggcuuugaaguaacauaacaaugacaaccacaguauuguggggguauaggaagagguguauucacacaugcauaugcauuuauuugcuuuucaaugggggaaaaaaacuauuuaaaaaaaaaaaagauaggaaauuagacuucuuacuuuuaagaguugaauccuuuaacccugaaccuacauuggcaaugauccuguauguaacacaaaacauguauaggcagauaacucuggguaagagccuuucagauuuucuuuuuagcauauuaaaugccucucaauguaauauaaaguuguuucucuuuucauacauaaacauagccuuacauuaucacagucuuaacauguaucuauuuuacauuauuacaaauauguuugcagcuacugggcuguacaauuaauaugggggaauggcaaaucuuuuuuuaaaaacauuuucuuuuauuggguuauucaauauuuugaagaaaauaucgaauaaaauauaaaauaauuggauauuuacauuuuaaauauuauccccuuuccugguuuacuccuccuagaacuccccccucuucccauccccucccccuacuucuguguggguguuccccuuucuaagaaggacugaagcaccugcaccacguuggugcugguucaacuggaggucagcauauagaagaaugcauaucgauccauucuuaucuccuugaacaaaguuuaagucuaaguggaucaaggaccuccacauaaaaccagauaugcugaaucuaacagaagagaaaguggggaaaagucucgaacacaugggcacaggagaaaauuuccuaaacagaacaccaauggcuuaugcucuaagaucaauaaucaaccaauggguccucauaaaacugaaaagcuucuguaaggcaaaguacccuauauucauuuaacauuuuggcaucuggucuagcuugaaguugcacuagucuugugcauacugucauauuauugugaguggauauaugaaauuaccauacuguauuuugaagacacugucuucuuguuccagugggcaugccuugccagaucaguuguuauuguaguucacaggguucacugcuauguaagauuaaugaaagcuagccagcaggcaaugaagcuuccaugucaguaucaacuugguuucucauuuuuuuaugagucaaguauaugguauuuucaguaauagggucuuacuaucaauuauaucuaaauuauaccuaguagaauuggcauauucuaauaaauuauaucuaauagaauuggcauuacuaucaauuauaucuaaauuauaccuaguagaauuggcauauucuaauaaauuauaucuaauagaauuggcauauaucuaaguguuggcauauucuguaaaguucuuuugguuaauuuggcuauauaucuggcuguauaacuuuuuuucuuguuuuauuauuuguauguucuuuuguugauagcagaucacuuuguaaucuuggcuguccuggaacucaguauauagaccagacuggccucaaagucagagaaauaugccuaucuuugccucuguauuagaauuaagcauacauaccaccaagccuggcuugcuaaacuuuaaaaaaaaaaaaaaacuagcucuuuuuuuucauugcuucuuuguaucauuuuuuuuuauuucuaugcaaugaauuuuagcccugaucuugaaaaaaauauuaauuuuuuuauauuguuuguucuguuuuucuucugcaggcuuuuguugcaucacuaaauuguuaguuugagaucucuaaaacauuuuuuuauauagauagacgcuucuauaaacuucccuguuaggccugccuucauuuguccuauugauuuugguauuaauuuucguccaauuuuaggaggcuuuuaaauuuucuuucuugauuuuuuuuucugugaccuaauuaucauucaguaguguguugcuuagcuuccaugaguuuguguacuuucuauaauuccuauuucuguugauacccaguuuuaucccacuguggacuaauagaacacuggaugccauuucaguguuccuauuuuuauuaagacuugcuuugucuucuaucauggaguuaauuuuggagaacauuuuaugagcuacauaguguuuggauggaaugcucuguaggcauuauuuagaaccauuugaaugaugucauugaauagcagcauuucuuuuuucauuuuuuugccugugaaucugugagagugagauauuaaagucuuccacuguugcgggaaauaauaaaaaaugauccugccaacucuccugccccagagggguuccagcucuagcacuggugggccacaacacuguguccuggcaggguaccgcucacaaggucucugagagacucucucccagcuagcccccgcuguguuuguuccaucaccacuaguucuucuucauccauaaaucuauauaguuggagaucacauauuccaguaacuacaugggaccgccaaccucgcgguuacaucucacaacccaauaccccaguagaaucaagacucuguaguuaaccaacuagauuuauauaucaauaaaaucucaauuuacaaaaugccaauaaagaauuucagagccaguugguaaugauaaaacuuuaccccaauauuucuaaacuuaugaaaucauagcuacuuguggcuaguaauugccacaggaguucacagucugcggucuugguucuucucccuacccucugggauacucccucucugcaauucuuagcucaaccccacuuugcccuguccauucacagaccucugcacuaauguaauuggacagggaacauccugcaacauuccacagucacucuguuggggucaaucugugguuuuuagaucuaauguuuucuuuaugaaaugugaugcccuguguuuugguguauauagaccuagaguuguaauauucuguugguggguuucucuuuuacuaaaaaugaacugauaguccuuaugucuucuuccuaguuuuuguuugaagucuguggucuugaauauuagaauagcaaugcugcugguucuuagucccacuucuuuggaauuccuuuguccaugcuuuuacucuaagguguucucugucauuacuggugaagugugguuuuggaggaagcaaaaguauggauguuguuaucuaauucagucugauagucagugugguuuuguugaagaauugaaauaguauuuaguuauuauugaaaggagugucugcuccugucauuuuuguugguguuguguuuucuuggaccucuuuauucuguguccugcuauucauuuuuuuccuaugacuucuugugugucuuuacccuuuucaguugaaggauuccuuuuaggaucuuuuguagagcuuguuuaguagucaaaacuuacuuuaaucucuuuuuaacauaaaaaguuuucuuuuuccuucaguuuccaacuagaacaauuaaacaucugugccuuucauacuuaguccucaccuggcaauaaaaugaccacuucuuuuuagggcagaaauuuauuaauagaaagaaauaucugacaugucccuaguuguaaacaaccaaauauguccuguguuucuuucauuuaaacauaaucuuuucaggcagcauuuauagcuucauuugucaaaaauauauuucuuucagccagauuaauaaccucucugagcauauuuuauuauuugacacauauauccucuuggcagaaguuagcuuucugaaugaacuccccuggggaguuuugcuaaucuuagaggagagagacaugaaaccaaacaccagaagacagaaaacuuuggauaguuucugugggaccacuaguacaccuguauaccguaaccagcacacuuaauggauacaggagcauucauguucaggcaacugaaggaagacacaucccaccuccuccaaauaccauguguugcggccgccagcagcucgcaacgugaaugguucgacugauauggcuacucgagcuguaagagaggaaucuagauggggcgaaagaagaaacggagcuaagacaaauucauucugaucaaagcucaaauuuuauuguugcgacacuaguuaugaaggaagggggaggggacccgauucccaccgaauaaucucugguccaguagaaaggugagcaugaguguggcuccgaacagcaaagcggcagguuccagcaguaggcguggcagaacgaaugagcaggaagcuccaccccugagcaggcagguuucaggcuggggaaggggagacuacaccaugucccuuccaucccuugucuuuuccuugcagccugaaucaauucucucagcucugacuuugaggccccucauccccauuauuuucagagcuugacugacugacauucagcgucauuuaugguagagguguuccuuggaugcucaguauuguugccaguaaaauaaauaucauaauuugccacuucauaugaucucaacguggguuggggguaguagucuuauaggccuaccccagcucaguaucuaauggcauugaauagcugcugugacaggauaguuuucuucaaugguuugaccccuguaccaucaacuccagugcagccuucacauccaacacaaauuaggcaacacaauuuugacuuuauggguguuaaaaagagagagaacucuaauuuuggguaaaucagaaggugggauguauccaggaaaauuugggaaggaggauaaaugugauauaaaaaauacauuguaucaaauucucaaagaauacacgaaaauauguaaaaauucugucuacuuuaaagaguaauuagaaagaucaagaucauagcuaugccaaagacacuuucuuaauugcacauugcuacagaaaugucagguauaaugaaucccuuugucucaggcaaaguacuuuguauuuauuauuugaguuucugucuugacaguuccuugucaagcagcaaauguaaaguacugauucguuguuuuuguugcuguuuuguuuguuuuguuuucaugcuugucuacagggcuccugcaacuuaauaguauagacuaaaucuuuaaguucuccuacaccucuuaucucuucccugaacacccagucaugauaauaaucuguaaaacccuaggauaauuauuucuuuuaauucccaagaguucaucauuugcuaaguuccaaauguauucacuuaggcacuugucuuaaaaugcuucuccauuaauuccacagagccgaaacugugugaagcugggcccuccugcggagggagaagucauccaagucaaauggccugaugguaaacucuauggggcaaaguaucuuggaucaaauguugccuauauguaucaggugggugcuacucucucugugcuguuuguugagaaagacaggauauaccagagggagauaacaugaguaugcuauggaucaaaaagccacuugaauuuuguucuuucccuuaaauuuugugaaagaggcaaaaugucauugucuagcagccuggguuucaacuuacaguuuagcaacuuauaguuuaguugccggauuggacacugagaaccccuaacaauugguaaaugguuaguucacuauaugguucaacugcuagauaguaggcucuuuccccuguguuuucauuaugagaguugguuuaucucaccuuaagccagaacauggagcuuggguuauuauagcucagcaguagaacacuugcuuugcauauacaaggcacagaacuacaggaaucagauagauagauagauagauagauagauagauagauagauaggaaucagauagauagauagaaagaaaggaaucagauagauagaaagaaagaaaggaaucagauagauagaaagaaaggaaucggauagauagauagauagauagauagauagauagauagauggauggauggauggauggauggauggaaggaacauucauuugccaaguugauacagugcuauauauuacuuuugugguaacuuuguauggcuguucaacaagcagccccugacuugauuuacuuggguggaggcaucucagauaaaacugagucagguaaggagcauugacauagguucuaaggaacuuacaguugucaucuacucaaguuuaaagaaauagucguuuaucaaguguauguucuggucacuaggguauucuacauguuaauaacuaaacuggaauuuuauauuucuacccgaaaugaagaagaguugaacucacaaaagggaaacaacauaggcagcacauguguauuccuauuccuuggggaacuuuacaacugaagcaaugaauuucaauaacaccaugucauaaauuaacauucuaguguaaaugguauaguaaaaauggggaaaaccaagaugauucaagugcaaaacagguuaauaauaauaagacacuaguuugcauaaaguaaguuagcaaacugaucagggcuuaaaagguagaguacauuacaaaguacggcaccagaaacuagaacgaaauauaauuaaaagaugcucaaagaaguuuagaaaacaugagaguacacuuuuucauggucuagaaaaucccgcuugaguugguauacuggcaaguuuuuucucauguugacaagaaccagaguuaucugggaagaagauccucaauucagaaaauguuucuaugggacuugccuguaguguagguaagccauggcacagcuuaauuagugguugauggaugggugggggccuggcacaucuugugugugccauuccucugcagagaguccugaguuauauaagaaaacaggcugaggaaaccaguaaguagugagcuuccaauucuccauggucccuguuucaauucuugccuugagauucugcccugacuucaguaauggacugugauguggaagugaaauaaaaucucaccuuuccaaguuguuuuggauacuguguuuuuauugcagcuuagaaaacuaaaaguuaacaagugaaggacaugggcauacuguuggucauuuucaaucuuucccauguguagauuaggauuauguauggugggauaagugcuacagcaucguuguagcagauuguguacaaugaaguaaaccucacaagggggcuguauaauacagaguauuucuagaggaaguuuuaauauagcuuucaaaaacaaagugucacauuuaauaagagcaauggugaagcgauguaacaaagcucauugcuacauaaaaguaucacauguuaaaaugcaggcuaauuaguaaucacuguguuagccuagcagcauaaaauugcagccauaaauauagaaucaaugaaaguuaaagcugguauuaaaaguaucucuuuaauuacaaguaguauaaaauuccucauuaaacaaagugguccuuugagacugcuuuguucuuucugucuuucaguuucaccacagaguaaaccagauauucauuaaagugcauagagauaaauaucaggcucacaguacauauaugcuaaaucuguguauauuuguuguuucugugaauguaugggucuguguguauauuugcagguguguguuuuuaucuguauguguauaaauuuggcccuguuuguauauuuguacuuacguguuuauguguauugauguagcucuuuaugugcauauuugugugaaugucuauauguguauguauguggcuguauuuaucuguguguauauuuguguauguaaauuuggguccaugcgcaucuuuguauaugugugucuguguguguauguauguauguauguauguacuuaugucuguuuaugugauuguauguguauguuugugugauuguaugugucugugaguguaugucuauauguguguguguauuuuugcuucuuacaauaguccugcaaaauaggguuuauaaauucuuauuguacaacuaagggaaggagacagcucagugaacaaauuuuaacuauuuucaggaggagaacauauuuuuuucauaguucguaagagcauacagcugauaaaaaauaagagccagaaaguuacucuuuucucuguccuaaugagaggaagcagcuguccaugcugguaguaaaguuuugccucuguauaccugagacuuagaaaaauuaggacagccagcauugcuuuaggaaaauugucuucuuuuaauuaaaguuuucaaaugacucaaaacaaaagaaaguagucacagauaaguaaguuaaagcuaugcuaucaaaugucuaaaugagaagacaucuugccuacuuuaaugcuaaaggagccauuuuguuaguagaaaaggccaggaugaacccaguuuuuauucucagccuucuaggcaguagcaacaaaguauuuuugugaccacagccugauuccaccuuguuguaaagcuucaucuuauguuaguaguauaugaauguaaaugaaaacaaaaacauguuuaacacgugcuuccaucucuguuucauugaugacuuugaaccacuacauaauuugacuuaucuuuugacuuuuaaaguaccacucagccgggcgugguggcccacgccuuuaaucccagcacuagggaggcagaggcaggcagauuucugaguuugaggccagccuggucuacaaaguaaguuccaggacagccagggcuaaacagagaaacccugucucgaaaaaccaaccaaccaaccaacgaaacaaaugaaguaccacucuauuaaaagugaaaaauacagaaaaucaaaauagcuggaaguucuaaauccuaggagacuuaagaguuguaauauaucaaaugucuacuuaucccaccuauauauauauauauauauauauauauauauauauauguguguguguguguguguguguguauuuuuuuuuuuuuuacaaauauuguuguuggaaauuccuaagcacccacuauccaggccucagcuaggccagcaucauagacuuuucucuaagucuccuaagaucuaaaaaaauauuucagaauuaguugcugucauuuuacaaggaguugaaaauguuugucuuuuaaaagacacuguuuucacacacuggugccauuuacaugcuaugaacuagaggccuauuugaauuuggaaaaguaauaauaguuaugaaagcuucuuaauguguauugaagaugugccaaaagauaugcuggcccugggaaguaugacugaaguucugcaccaggauccugucacucugauucucuacugauacccuggagugacuagacuggaguauauauaagauguauaaucacugccuagaugagcagucacuggagaacccaagaacccagcucuccuucagguaaauguagucucagacaacaacacuacugggaaaaaggaaaauggcuaggauuugcuaggaacacaaaguagcaaauuaucuuaguaccguauaggacacaaguaaaguacauaauugucuuugacugcaagggauugcuaauaauuccuauucuuuuccuguuaacuagagucaggcuccucccaaguaguagagaggaauauaagcccaaacaaauauagcucaccaugaagacguacaugaaacaaacagaaagaaggaaagaaaggggaaauaaagacagacuagacauucaucccagcagaugcaagaaaugcaacaauaucaaaaugagccauucugacaucucaacaauacauuaacauuaaaaaccacuuacaacacaucaauaugaaagcccauagauaauggcauagcugaaaugcuagaaaagauuucugggucuucuacaaaggcucaagggccaaguagagaacuuaagaaaagcaauuugggaccuaggaaagaaacuuaauaaaguccaaaaaggucaacaguuggggaaaaagcucaugcaagaacugagugagcagaucuuugcucccuccuccucuuuucuccuaggaggcugcuggccaccagcaugacaguacaaaggaagcagaggccaagagcaggguucagaaggcagugaauaugguaaaaugaccuccagagaccauagcaaaguuuaguuuauuauuucagggauagccaaccgcaguuggcauguaccagauuaaguaggaagaauugcagacccuaacugggaugacugccuuacaaagacagagaucuucagggugaacugcaacagcaccuaccugcagauggagacugaaaaucucaaaggccaagguacaauccuggaggcugcaugagcagcguggggagauggccauuaagaaucuagcugcauauguaucaaaagauggccuaguaggccaucacuggaaagagaggcccacuggacaggcaaacuuuauaugccccaguacaggggaaugccagggccaaaaagugggaauggguggguaggggagugggggggggaggggcaugggagacuuuugggauagcauuggaaauguaauugaggaaaauacguaauaaaaaaaaauaaggaaaaaaaaaaagaaagaaaguuagaagaaacaauuuaccgugaagaaaauaaaaagaaaacuauuaaucucucauuuaaaaaaaaaaaaaaaaaaaagaaugccaagcuggguaagcuagaggcugcccucuaaugggcccagaaguguauagccaggcagcuucaagaguaccaggaaauguugaacaguaagccgggcgggcccuugacaucaagaucaccacuuaacaacaagcugcugaaguccgaagagagcagccuagagucugagaggcagaacuugaguauccauaugaagaucaccagcagcuacucaggaguacugaacucagcuuauggagcacucacuaguccugguuuuagcuauagaaugagcuccuuccagccaagcuccagcucugucaggggcuacagcauguuuuuucacaccaaggcuguggucaugaauaagauugaaacucauguuuggaagcuggugucugagucuucugauaucccucccaaaugaauggccacuuaaguuccugccagucuguguaccuacagcuacucagggauuacagggggggcagcuguaucgcagaguacagggaacaagagacccaccugaucaaggaucaacacuaacccucaggccaaccuugggaagaauguccuaucugggauaguccucccuugccuuccacuaaaacccaacucaguuguauuuuccaaaaaaggcuucagcugguucuuaaaaaaauccuauccagcuauaacccugugcuuuacaaccacaaccucccagcaaaauacugaugauaauggcacaaacguuaggggaguaaccaaacacuuuucaguuggauuuacggccugcuccaugagcuagaacccauaucagaaaucugagacuagauaggucaugagccuacgggaaaugacuucugcuaccauacagcuguacccaucaaacagagcaugaaucauccucaucagagaaacaacuucuugagguauaugacaacacagagacacacaacuggaaaauguacagaacgugugcaauuguagagugcucagggagagugucucaacucuaaggaaaaaauggugccuuuuguucauauguaguaaucuuuccugauaauguuaaguuuucauagagcauuaacucuuuuaacuuucuguuuuuaaauuacuuuuuaaagugagcacacaaguaauggauuucugccauucauggaaauaggccaauucacuuuguucuuacauuuuucucaucccugucuuucauguuuguguucuuuucuuauccuccagauaccacucuucugguuuuacauugcuauguguuccauugccauuucucccauauucucuuaacaucaucuuuaccuucaagguucccugugaacuuaucaacacacacauacacacacaccccagauagaaauaaauuuaaaucuagauucuucauaagaaagaaaauauguaauaugugucuuugggggucugagcuccuuugcuuaauacaauaauguccaguuucauccauucuuuggcaaaugacauuauuuuauuuauaaugaauaaauuucuuuuuauguuugccucaguuucuugguguuuguuuguuuguuuguuuguuuguuuguuuguuuguuuuucaagacaggguuucucuguguagcccuggcuguccuggaacccacucuguagaccaggcuggccucaaacucagaaauccgccugccuuugccucccaaguacugggauuaaaggcgugugccaccacugcccuuugccucauuuucuuuguucacugguagauauauacugugguuccauuuccuugcuauuuugaauaccuacagaaauaaacauggaugugcaaauaucccuguuguauguugacuuaguccuucagagaugcaccaggaaaugguauacacagauuauaucauaguucuguuucuauuuuuguaaggagccuuuauacugaguucuauagugucuguacuagugcacaauucuaccaguaguguccugcuuuucccacauccuucuaacauuuguugcuauuugcuugcuugauaauagccauucuaacuagagcaggaaucucagacugguuuuaauuugcauuuuccggauagcucagaauauugaacaauuuuucaaguauuuauugagcauuuguauuuuuucugaggguagucuauucauuucacuaacucauuuaauaaugacuuugggcuuaaaaaaaaacuugguuugauaucuguuugcucuauuuuucauuuuuuuuaguucuuuaaguauucuggauauuuucacccgauguauaguucucaaauaacuuuucucauuuuuguaggcuguuuuuuucuuucuucuaauaguuucuguuaauaagacaugaugcuagcaagcccagcccaucuuaaugcaggacuugccacuuuucagagaaauuaucugaucagcccucauuuuucuuaguugguuuugagauauuaaaaauuucauaguucauauuuuaagucuauccucuacaacagucuugacuauuucucaacuugcuuuguucuuaguuggguaagaaaaugcucuucuagugucccugacuuugggucauucuauauuuucucaguuagagcccuuuacuucccuaccucccaauacucauaauuaauuggaacucuugaaaaauggccaggauuucuuugguuuuacuacauaucacauuggcuuuuguaucuuuagguugaauuugaagauggaucgcagauugcaaugaagagagaagacauauacacuuuagaugaagaguuacccaagagaguaaaggcucguuuuguaagugcaagggacaaauccuacuuagguuaaguccucauucucuguguuaucccaagccuaaaacaaccuugggcuuuugguuaauuuugaagaaagcuaaaguaacuuuucccuuguuguaaccugaugaaugcaaguguccacuuagaaaugggaaaaccagugcaugcagaguuuacuucuaaugagaucaaauggcaggacuuuguguuaaaauuuauugacacauaauaauaguuccuaaauuugucauuuauacaaagcucuggguguaaacaaauacaauauuaagguauuuacucuuuguuaguggaaguuacauuaaaagaaaguguucaaaauagauaaagagguagcauuagagaagagucuguaguaaucuuaucauguaacgguaaaguucuacguaacacacucacugauguuucuuuccaaacucucacuuucauaaaggcauaacaaaaccagaauauuaauagugggaguacuaaaagaguuauaauaagugcccauguauauguauaugcauauauauauauuuuuugccaaguccaauuuaagccacuaaaugauaaguaaauauggguggccuaaucuuaaauuauuuuuaaauguaauucauaauaauguagguuucacacuauuauaaaguauuuaacagaguauaaaauuuaaguuugguuuauucauuuggagucauaucuauagcaucucucugaaaauaaauuuuuaauagagaaguuaauuuucugaauaaauuugacuuuuucauacgcaaucacugauuauguccuccugcagaggcagaguugugauaccaaccaagggcuucuuuaaguugugaacaguuccucuguugucaagugagauccuuaggcagggaacccacaauggaugugcacuucccucucagcuguaccuucagaggaaggacauuaaaguaagaagaggacacgacucagugucagugcugcuguucacccagugaaaugcgggguuuucaggacagcugcacguacucugagaacauucuaguuuaaaaaaaaaaagaacagauuauaauaccugugagcaaagagaaaauuaaguguuccaauuauggagacaaauauuccugaagccuggguaacuugucagcauuguaagaucuugaaacccggggcuagagcauggcacuacuguuccaucccaaucuuggagaggaccugggucuggguuucuguauccacacccacaugguagcuacaacuauggauaacuucaggguucgguguauccaacauccucuuugguccucuacgggcauuggaaacacuucaaggaaaaacacuccaagggaaaacauucauacacauaagauaaaaauaaauauuucauaaagcauacugaagucuuucaagaaaaucugaaaucaguagagaugguuuuauauccauaucuccccuuggcucaccucuacucucccuguuuuguuuugcuauuuuguaacuucuauugaccccuaaauauuuggguagggaauagaguaggaagcccucugaaagucucuugguuuuuuuguuguguauaucaggugugcauacuaaauugauucuuagagauuucauguucauguuucuuaugaguucacuucucuaaacagauaaaaucuuuuuauuccauaguagauauggucuugauucuaugaugcuaccuucaguuuuuugguuuuuuuuaaaaacaaaugucuugaguaucauuuugugguguguauucucaauacaucccccuucucucugcccccugguuuuuuguuucuguuuugaaacagguccauaugugagcuaggcuaggcuuuaauucacuaagaggccaaggauuucuuugaguucuuggucugccucgugucccaugcuacaugucaggaugaugaguguuugugaccuguccaacuucucugagaacacuguaauuaacuuuaacaaaacaaugaaugcaguccugugugcccagcagcuaagcccaguaggaaauaguguccuggagcuacagcucuugccacuuuuguuacuagaucaaaaacuuuauacccuucaguuagaagguauaccugccuucagguagguugucucauacucuuccagcuggggagucaaaucuaauuuaauauucuuugauagauauuuuaugcuuacagaauauuugguuugaggaagauugauaagcaucgcuuaucacugaaccuuuauguuuuagugacuuugccucccucagauucuucucacuugggggaaaauguuuuaagagagccaucggacugcguaaugacugugcugggcucuuuuuuacucuuuucagaaacagccccauuaccuuuuauugucucauagaguaaccauggcaaccacugcauaauuaacuagagcuccugguaaauugacuuuacuauuguguuuaagaggcugacuucugcuguuucugcagaguagcaacacuuucauagauguuuuauuuccuccuuugguaacuuuagcacuuaauaaaggugaaauauaaguuaguggaggugcuuucuuuuuuuuaauucaauuuuuuauuauauauuuucuucauuuacauuucaaaugguaucccaaaaguccccuauacuucuccgccccgcccugcuccccuacccacccauucccacuucuuggcccuggcauuccccuguacuggggcauauaaucuuugcgagaccaagggguuucccagugauggccuacuaggccaucuucugcuacauaugcagcuagagacacgagcucuggggguacugguuaguucacauuguuguuccacuuauaggguugcaggccccuucagcuccuuggguacuuucucuagcuccuccauugggggcccuguguuccauccaauagaugucugugagcauccacuucuguguuugccaggcacuggcauagccucacaagagacagcuauaucaggguccuuuccccaaaaucuugcuggcauaugcaauagugucuguguuugguggcugauuaugggauggauuccuggguggggcagucucuggauaaaaucauccuuucaucucagcagugggggugcuuucuaagaguuacugaaacaaaauguuucuuucugaugacgaagauccaaccaauucacaauucuaaguuuccuccccaaaugauauauggcacucucuagggaacccguagauuagccucaugagcggcucagcagaaaauauaugcaucugccaacuugaaacauuuccaaauucuaggcuuccuucugucugaucccuucccucucuacuacacaaugaaccauguauuuuuaacaccugaaagaauaacagucuacuuuguuaucaaccucauauauucuauuuguucaugucauuagaagucauaccccuaacuuaaaccaguggagaccguauucuagauugaaacuagacuaaggaaucaggaaugaaguuugguauuuuauuguagacucuagguuuggucuugaguaucucaacucaaugaucacuuacugaagaguugcugaguuccacgcuuuaguguuccaacauuaguuuauacaacauuuaguuuauaguucuuaauauccuuuagcuuaagaaaugcccaaugggaugaacauugauuauuccugcauucauguucagggcucacaggaauucccagcuuuucugugguagagacucuuccauggaagaaaaacuaucucagacagaaaacuuaaggcucucauauguggcucauaauguaaaauuuacucuuccgaaagaaggaaguaggaugugcuagguuguaaaagucugcccuugggaaugugcaguuauucuugagggcagguagaagauaagguuacagacagguacauguagcacucuuuaauuaguuaauuaguauguuucuggagagcuuuguuuucuaggaguuaaaugggagauagacugggacuacugcauuuguucuagugguucaaaaggagaagggagugacccugcaucaggaucauggcuauuucaaguauauggagggcuccuggcagaaugggaauccacaguaccauuaaaucuuugacaaaugauuguacagaaaagcaugguauugacauucaggaaauuuaagaagggcagucauggagcaagucuuuaguuccauuuuauacaaaauacuuuggagagggucugaagcacacagucuaagguaccuauugagcaggguauuguaagucugagugugagagauccaaccuagagugagauuccaucaucagccuuggagucugcauaggcaucaaugccaagaauauggguuacaggccccagaguugaacagauagcuaagacagugaagucugaaaugucaaaaaugagcaaacagguagccaguaaaguaguuaagcaacaaagaacugccauaggacuuaggaacuagggauuuaaccacauuagcuucaaggaaguggagaaaggcuaaaggaacaaagaauaggauucggcaugaacuaggaaugacugaugacuacccacccccaccccccaaaagacaaaccuguuggcgcagaagccaaguggagauggugacugagcaaguguuaauguaaaaugggcagcuccuauucuaaagucacauggcuaugacucaagaacauagauuuaagacaacuaaaauuucauauuccaacauggaagcugcuucaugaaguguuauaguuuuguaggaccaaaaaaaaaaaaucuaaauaccucagcgaguuuaaaauacauuaguggguacaucagagagguugcuauagcaagaagggggaagguuugcuauaggcccaagauucugucugaugacauuguuagcuuuggggcuggagggaacuagugaucugcuaaguuaaugggcuccaaaaaguuuuuuaucuguaagucacaagauguuaacuugcaacacagaaauaggaaagcauggguggcucuucugaggggcuagagcuagugaugagcuauuagaccuggaucauuuuaaucucaccacaauacuuucucaaaaucuaauuagucaaucaauuucuauagacauagcuucuuuuuaggaguuuucauuuacagcagacucaauaugagaagacuuuaauuuugcuuuuguuuggggaagcuuccucaggcaggauaaagaaauugggaccaaauagagccacauaucucugccaugugguauaggugagaccuaccugaugaugaagacacuguaagacacugugguagguuccuucgacccugugauagauccuagccucuguucccuagaucuguauguaguguuucaguaauauauuucucauuuauacacucaauaauguauuucugcguuuaguccacagccuccgacaugcgauuugaagacacauuuuauggagcagauguaauccaaggggagaggaagaggcaaagagugcuaagcuccaggcucaagaaugaguauguggaugacccuguguaucguacuuuccugaagaguucuuuccagaagaagugucagaagagacaguaguugauaaugugcagcagccacagugcagcucagaccagaagagggaagacaaagggacagccuugggguacacauugggacagguggcugggugcuucuuugguauugguaauaaaccaggcuucuggaguuugauuaccaagcaaccaagaagagacauauuaguugcuucuguaaucugaucaccccucagucauuuguuugaccccaaagaauauuccuaaauuaaaggaaacagcagugaauggcccacuagauaaaacaacugcuaaagaagcgggguucccucucuggcucaggucccuuccucagggaacacauuuggaggcuccuuucccaccuccuucaguggcagccucaucacccaacagccgguggguguauuuauauauauuuuccacagccagggaaagagucucacucacauuuguuuucaguggcaguuuuuauaaaacauuuuuaaaacacaaauggcauguaugguaauaggauuuaccuguaugcuaucuucccuuguacagaacuuuuccauuuuuuauauuauuacuuuugauugugucugaaaacugaguuggccuuuauaagaggaaauuuuuugcucuugaagaggaauucauaugaaguauaugggaauuuuauauauuuacagaggaaaaaucuuggccugauauuuugaacacuucauaauuccuguucugaaaugauauuuauaaaauauauauuucuuucauuauguguuuguaaaaauuagaguuuaaagaaauauacuuaaugcauaguuuuaaacuaauguaacaugauuuuucuuugcaaaacagccuggagauguauuaauauuuaaaaauuaaaaucuguuuucuccuguccc

SEQ ID NO: 1949 - RNA, 2258 nt, Mus musculus
auugaacuauuucaauuauuuaauaauagaugugcaaucuuuguaguucacaaaacgcccuaaaauuuaagauauguaacuauaguuuuaguauauucaauugcuuuggaguaugguugccaaucucuauaauauccacauugaaaaauuaccaguugacuauauauaaguuaaguaaguuuagaauuguauuuuuccaaacccuaagcuguguuuuauuauuauuauuauuuuuuuauuauuauaucuaaguacacuguagcugucuucagaugcacuagaagagggcgucagaucucauuacggaugguugugagcuaccaugugguugcugggauuugaacucaggaccuucagaagagcagucgaugcucuuuaccacugagccaucucucuagcccccaagcgguguuuuuccagucaaagaaauauggugguuagaucucauuaucuuucaguuaauuaaccauaucccaucugucuuuacagugcucccccuaaaaaaaaaaaaaagaaauaaauuaaaaaaaacacauuuaaguacauuuaaauaguuauguugagcuuuuuuuuuuuaaagaggugaucaguuuuugagacagcauaucauguagcccagucuaacuucaggucuaugauguguugagaaugaucuugaauuucuaguccucugaucucuguuccaaguccuggguuauaaguaugcaccacauucauuagaaauccuuguuuucuaacaacacguaaaaugaugguccugugugcucacuuuuguauaugccuggucaguaacuagaagaaaugcaacaaaaaaacccagauaggaacugugggacaguaaaaccuguuuagccuuugcaaaacgcuuaguguuuaggcaccuaucuggaaguaagaguuugagaucugugugauuccucugcggucuuggaagucagauuuacacagacguguaggaagguaacucaauucaggaucccuaaucaagauuucucuagucuuuaaguauuagaccuuuuugcucaagggcaggcuugguugcuaggaauuugggaacacugcucacuugggaucuccgacugaaguaggcucagaggugcagcccacugguugguguaccggcacaggacaaugucaucgugagucuggccuuccugaccaccuccacucgagguaaaaaucagccagccguucuugcaccgaggguugccauagacucgcaccgagucccugcaggcguguucguguacuauuuuauuucagguccagccccugugggaaccuagugagugauccgacaaagaucuguugcgcaccugcuccuucugcuucgucaguguuuuuccuccuuugagaaagaagaggcgagcuuguccccaaggcaaaaggaaauacagcacggcaagcguagacuaggcaagaggcggaagucucggcuucaagucgggcaccuuuaagcaguuuagagacccacgugacccagagagcgcccggcccagcggucacgugggggcgcgugcgccacacgcaggcagaggcagcccgcacagccugcgcgcccgcgccgccucccgcccaccuccgagccgggagggaggggagcgcggcggagggauuccgugguggcgccccgugcgcgugcgcagcgaacagcugucacccagugcggaacaagucuuccaaagauucccaaaacccucaggggaggccgcacuuuucaucccuuucauucggguggcgucuggaccuccgccagcggcgcagguaaccucuucuuggucgggacggagcgggaaggguggcggccucgguccggucuucgcagggcagcacgggccugggcgcuccgcggugcaaagcagucagcugggagggaggaggcggcccugacaguccauucuggcccucgggauucgggagcucgcucgccugccucccgggagccgaucggaggugcuguugcuccggacugccacgccuguguggucuggggcgccgaccgaccccucugcggccgacuccaggaaggccgggccugugcguccuccgagccucccuugggucgggauguccggauccgcgagguagcagguagcccgacccucacucggguucguucuuggcccuagcagaugaucuuucccuuuuucuuuccuccgucuugaggccauuucuuugugcgguuccuggggggagccaugaugcgggguagacagugggcgcuuaauagaugcgacuucguugcggcaugugaacug

SEQ ID NO: 1950 - RNA, 2258 nt, Mus musculus
caguucacaugccgcaacgaagucgcaucuauuaagcgcccacugucuaccccgcaucauggcuccccccaggaaccgcacaaagaaauggccucaagacggaggaaagaaaaagggaaagaucaucugcuagggccaagaacgaacccgagugagggucgggcuaccugcuaccucgcggauccggacaucccgacccaagggaggcucggaggacgcacaggcccggccuuccuggagucggccgcagaggggucggucggcgccccagaccacacaggcguggcaguccggagcaacagcaccuccgaucggcucccgggaggcaggcgagcgagcucccgaaucccgagggccagaauggacugucagggccgccuccucccucccagcugacugcuuugcaccgcggagcgcccaggcccgugcugcccugcgaagaccggaccgaggccgccacccuucccgcuccgucccgaccaagaagagguuaccugcgccgcuggcggagguccagacgccacccgaaugaaagggaugaaaagugcggccuccccugaggguuuugggaaucuuuggaagacuuguuccgcacugggugacagcuguucgcugcgcacgcgcacggggcgccaccacggaaucccuccgccgcgcuccccucccucccggcucggaggugggcgggaggcggcgcgggcgcgcaggcugugcgggcugccucugccugcguguggcgcacgcgcccccacgugaccgcugggccgggcgcucucugggucacgugggucucuaaacugcuuaaaggugcccgacuugaagccgagacuuccgccucuugccuagucuacgcuugccgugcuguauuuccuuuugccuuggggacaagcucgccucuucuuucucaaaggaggaaaaacacugacgaagcagaaggagcaggugcgcaacagaucuuugucggaucacucacuagguucccacaggggcuggaccugaaauaaaauaguacacgaacacgccugcagggacucggugcgagucuauggcaacccucggugcaagaacggcuggcugauuuuuaccucgaguggagguggucaggaaggccagacucacgaugacauuguccugugccgguacaccaaccagugggcugcaccucugagccuacuucagucggagaucccaagugagcaguguucccaaauuccuagcaaccaagccugcccuugagcaaaaaggucuaauacuuaaagacuagagaaaucuugauuagggauccugaauugaguuaccuuccuacacgucuguguaaaucugacuuccaagaccgcagaggaaucacacagaucucaaacucuuacuuccagauaggugccuaaacacuaagcguuuugcaaaggcuaaacagguuuuacugucccacaguuccuaucuggguuuuuuuguugcauuucuucuaguuacugaccaggcauauacaaaagugagcacacaggaccaucauuuuacguguuguuagaaaacaaggauuucuaaugaauguggugcauacuuauaacccaggacuuggaacagagaucagaggacuagaaauucaagaucauucucaacacaucauagaccugaaguuagacugggcuacaugauaugcugucucaaaaacugaucaccucuuuaaaaaaaaaaagcucaacauaacuauuuaaauguacuuaaauguguuuuuuuuaauuuauuucuuuuuuuuuuuuuuagggggagcacuguaaagacagaugggauaugguuaauuaacugaaagauaaugagaucuaaccaccauauuucuuugacuggaaaaacaccgcuugggggcuagagagauggcucagugguaaagagcaucgacugcucuucugaagguccugaguucaaaucccagcaaccacaugguagcucacaaccauccguaaugagaucugacgcccucuucuagugcaucugaagacagcuacaguguacuuagauauaauaauaaaaaaauaauaauaauaauaaaacacagcuuaggguuuggaaaaauacaauucuaaacuuacuuaacuuauauauagucaacugguaauuuuucaauguggauauuauagagauuggcaaccauacuccaaagcaauugaauauacuaaaacuauaguuacauaucuuaaauuuuagggcguuuugugaacuacaaagauugcacaucuauuauuaaauaauugaaauaguucaau

SEQ ID NO: 1951 - RNA, 2015 nt, Mus musculus
gggucgaauccacugucuccuguuaugugagauacguuucgacccggagcuccgccauuaaaaaaccucuuguuguuacaucaagguguuguguucuauucgugauucuugggugcacgccgaaucgggagcugaguggggguuuccccacugaguucuuucauuuggaggucccaccgagaucugcgugacacccaggaaccccgaaggaccccuuggaggugcguuuguuugugugagucuuguuauguugucuguugucuaagugucuaaguguggcacugcugaauuugugucuuaguuuuucaguucugagauuguggguuugagccccaccuguguuaccaguucugguauucuguauucuggcagcugccacugcggaccguaaggacccuaguggcugugggaagacuacggucuauuuccccacaggcugcacccuuggaagacauuccgagggagacccuggagugcccgggguacggaacagucaggaggaccuggcuguugccuggcagagugaagaagagugagugcucuuccugccagaggaguggagcggaaucccacuccaucagagguagcguuuggcugguuguguaaguccagacgcagacgagugugcuuggaugucuuaguguuuuccgucucugucauuguguuguguuuacucuuauucuucacuaugggacagaccgugucuacuccuuuaucuuugacuaaggaccauuggacggacguuagggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaaggaccagggucgcauccagaccaacaaccguacaucaugguaugggaggacuuggcacgcuacccacccccguggguucgcccauuccucccgccucuccgcccuggcaccaagauucuagccauccgagaaaauggugagaaagagaaaccgaaaccaccgcucgggagagaugaugaucgcagcacaccagugacgaaaccccccaagaucuauccagagauugaagaacccccugaguggcccgauaccccucaacccccaccguaugcuccccagccccaaccuuuagcucccucgggaccccugccucaggccccggccggaggagggggucccuccacaggaacaaggagccggcgaggagucaccccugaggggccugcggauucaacuguggcgcucccccucagggcuauuggggcucccccugccgauccaaauagucuacagccccuacaguauuggccuuuuuccucuucugaccuuuacaacuggaaagcucaucaccccccuuuuucagaaaacccugcaggauucacuggguugguugaaucauuaauguauucacaccagccgaccugggaugacugccagcagcuucugcagacucuauucacaaccgaggagagagagaggauucuccucgaggcucggaaaaacauccgagaugaggcugggcgcccuguccaaacuccagcugagauagaugaaggauuuccgcuaaccuggccccgaugggauuauaauacggcaucagguagggaacgacuguccaauuaucgccggguccuaguggcgggucucagaggugcugcccggcaggccacgaaucuggccaagguaagagagguuaugcagggagcgacugagccccccucagucuuccuugaaaggcucauggaggcuuauaggagauauaccccauucgaccccacgucugagggucaaagggccucaguaauuauggccuucauuggccagucagcuccugacauuaggaagaaguuacagcgaauugagggcuugcaggauuacaccauaagggauguaguuagagaggcagagaaaguguaucauaggagagaaacagaagaugaaaaguuagagagag

SEQ ID NO: 1952 - RNA, 957 nt, Mus musculus
cuuauuauuuaaaaaauaguuuauuuugcuguugguuuaucauuuaucccauuuuaauauguucucaaaaacguuaucuuucaguauaaacugaacagcacauaaccucccuggacaagacagagaaccauguuugcuuccaagggguuuauuugucucuuuauaaucugagaggggguaaaccguaagcauccauggccaaagaaugacagcucauaucuucacaaucuucucgguauguccuuacaguuaaguacauccuuggccgugugugcaacgaauauccaccaacccaacgcuuguucugucugcccagaagccagugaugauagacaacaaugaacugcugguauuuucaaauaacuggguggcucuucccuuuggggucuaccagaacaacuacaccccaacaggcaauaccugaaaaaaagaacaagaaaaaaaagugccuuuuguauauuacauuuuaguuuacccagugcucugcauaaagcauuuuauuuaacccucucaugguugaagaagaaaggucgaucauucgguaaucuuucuuacagggccgugaggggaaaggcgucccaguaaucacccaccccaccccaccccucacgcuguccccgcuccugcucacugaugccgaugaccaucugcagaacggugccugggccaggugggauuccuugcuucaggggccgccuggccaccaaauagacguaggugcccgccccgaagaguguagagcccgacagcacgcgacaacuccagcagguuuuuaacucagggucccgggcgggggaggccggcacggcggauuucgcggguggguucgcgggaaccgcuguggaaacaguugggggggcaggagcggaaaacucgguacuccccgaaaaagaggaccccaugucagaagagugcacagcgagccgagccuucacuuugaaaugcuguaaaaugcug

SEQ ID NO: 1953 - RNA, 957 nt, Mus musculus
cagcauuuuacagcauuucaaagugaaggcucggcucgcugugcacucuucugacaugggguccucuuuuucggggaguaccgaguuuuccgcuccugcccccccaacuguuuccacagcgguucccgcgaacccacccgcgaaauccgccgugccggccucccccgcccgggacccugaguuaaaaaccugcuggaguugucgcgugcugucgggcucuacacucuucggggcgggcaccuacgucuauuugguggccaggcggccccugaagcaaggaaucccaccuggcccaggcaccguucugcagauggucaucggcaucagugagcaggagcggggacagcgugaggggugggguggggugggugauuacugggacgccuuuccccucacggcccuguaagaaagauuaccgaaugaucgaccuuucuucuucaaccaugagaggguuaaauaaaaugcuuuaugcagagcacuggguaaacuaaaauguaauauacaaaaggcacuuuuuuuucuuguucuuuuuuucagguauugccuguugggguguaguuguucugguagaccccaaagggaagagccacccaguuauuugaaaauaccagcaguucauuguugucuaucaucacuggcuucugggcagacagaacaagcguuggguugguggauauucguugcacacacggccaaggauguacuuaacuguaaggacauaccgagaagauugugaagauaugagcugucauucuuuggccauggaugcuuacgguuuacccccucucagauuauaaagagacaaauaaaccccuuggaagcaaacaugguucucugucuuguccagggagguuaugugcuguucaguuuauacugaaagauaacguuuuugagaacauauuaaaaugggauaaaugauaaaccaacagcaaaauaaacuauuuuuuaaauaauaag

SEQ ID NO: 1954 - RNA, 217617 nt, Mus musculus
augguugacuugaaccugccuacuuuucuugaugugucguugugaaaugcuugauguggguaacuuccacuuggggaaggaaaaagucacugguucuuucagguccgcugggggagggcacgguggucaggagugcgaggacuggagaaaguugagggggggaaaguccaggacgcggggugggagcgggaggccgcggggggccuggaaacgcucggcggccccaagcuagggcgacauggagccccgggcgcucacuuuucuuucuccauugucuggggcagccuuugauuccuccauuuccccacccaccccuagcggaaacccggaauuuggggggcggugugugugggagagagugcccgcgcgaaagggggugcuggccggucgccuccagggucccgggaaucaaguucauucacucggcggggggcggggcggggagccggcgggagccgccggggagacccgcagccgcacacgcaccccgcgcgcucccgccccgcagccucgggcgcgccgcggccccgcccugcccgcacccccgcgggaagggagccgcuuuccgccggcgccccgggcucuggggguggggauugggacgcggccagcgcggcaggaggaggaggagaggaggggcgagcgguggcgcggccuucccgcuccgagcgcggccacgugcaccgggcgccgggggagggcgggccgcugcggcgaggcucgggggacccuggggaccccggcgccccucuccgaucgccagugcgagcuccgggcugggcugcccgccgcgccccgggcuccgcgcccguccgcugcaacuccaggaggccaaguucacucuggcccccgccuccacccucccucucccuccagccgccuggggugcuagagucggcgcccuagccccggcucggggcggccugggugugagggaauuuuccauucguuucuuucuugggcccaggccgguucagggcuucuccccuuaggauguucucgcgucuugagcgucugcagcgagcagugaaauaaccucucccugggcggguuuucggggguaaacgaagaguggcagagagaagagcuauuuuugaaaaaagaaaaaagaaaagaaaagaaaagaaaagucccaauacuguggcaccggucugauaccuuuaacaaaugagggggagagacgcgagggcugggggaggcgcgcgggaggaggaggaagguggggggcgggggguguggagaggcuggugcaaaaggaacgcgcguuugcaggaggaggaggaguaaagcggugauuguguaauuaaauaauaaaacaauccuuaagucugauuuggagagagcucgagcgggguccagaggguggaaccggugaaucuuucaacuugcaaguuuuucaaggaaagaaagcgagagagggagggggaauagagcccaggacagaaaagaggaguuugcagccaagcgggaucgaucguuugggauuuuuuucaggagguccuuccgauccuuuccgugggcuguggccagcggcaccggcagcggaguccacgcgcggcgggucagacccggggcgaagcgggcgggcggcggugcggcggggcaggagcgcagcaaaggcuuuuccgcccgggagcuccgcgccugcgcccccucccucaccccggccucucccugcucccccccacccccacccccacccggcccucuccugcgcgcgccccgccacccgcgcgcacucgcuugcgcucccccucgcgcacacacguggucggcucgcagcaaaguuucgccugcgaucgccacucccggauccugcugcaguguuggcggcgguaaccuugaacuuuaccagcgcggugacacauucuccucgcuuuccccaccgccuggccuccugcgccccccuccccgccuuuuuuuaaaaaaaacauuucaccacccaccaucaccccaauccaacccacaccgaacccucgcgcaccccaacccccaacaacaaacaacaacaacaacaacugcaaaacagaaaacaaauccccuaaaccaggcgaccagcagccugcaccagcggcggcagccucggagagcucggccggcgcgcgcgaaccgcaagaggguuaaaaguguagauuggauuucaccccgggaaaucuagcucgccgagugaacuugaaucuuuggcuauuuaaggaggacuggguuuguugcgaaguugcggugaaccggcgcagugccccguccugauugaucgcaucgcugggcucagaugacuguaaaaugaauagaugaaauccuugcuucuggaagauuuucuugggcaucuccgggaaagugcguuuuaaggcgaagucaugauguauucucccaucugucucacucagguacuuaucuuggucgcuuucucgagcuuucucuggccccagacgccuuuguugugucuucuugcucuugugcugcagacccucaaaggcuuugccuaaccuuggcacacccuggucuuccccgagaaguagugcggaguugcggugggcugugcgggcggcgugggaccacggcugccgugugcgcccaucccagcgcccgagcggggagagccggcaccgggcgggcgaggcugcugggggugggcagggccgagaccugcggccgugagccccuguccgccccuaaggagauugcggcgaaggcagcggcggcggugguggccgcggcggcacccucacucccuggccggugcgcguggggcggacuccggcuugggagcgucuguagauggacucuugggcaaggggcugagaacuaggcuugagcgccuuuggacucugcugcccacagugggcgggugacgccgccagucuagguggugguccagaggacuuauuacuuugcguuuuggggugccuaaaguccuguucuacagugacccacauuucggguuuuuaaagaccucacuucagaggcgaucuuuuacgcugacaagaaguugaaguguuuguggugaauuuuuaggacuuuuaggacacguuuguuuuaaaagugagacuuguucauuugaugauauuugaacaucgcucgcaaggcauaaaguaguaucagaaaagugagauuuuuuuuuuuaacuuggaaauuugccuuaaggaacaacguuaggagguaaaacacugucuuuauaccuaaaaacccaaacuaguuucuaucccuucagucagaugguaaaaugaagaaguggucagaucuagagacuuaccuggggcgcuuucauccuuucauggaugcccgacgaacucaccaacugaugauagcuuaaacagccuaguccagaacuguuaauuuacagcaguuaauucaaccuugaaaguuaugggacaguuuacuuccaacuuuuaagaguaugagucuagauugggucauugaaauuuuucauugacauugucaagaaagugaaacauaauugccuaguuuugguugucuuaaaguuuuaaaaaucuaagauuaugaggaugcauuuuuauaaugaacaaauaauuaagauuucaauuguaugacaauuagaaaccauugugauucaaaaggacugcggcauucauaaauugugaaugaagaugagaacaacgauaaggggcauucagugauuggacacagcccuguagcuuuuuggcugacacauuuuuuauuguuuauauuuuguuuggcaucugaguaugauuaacuuagauauggcuauuuuaagcaaguaaacgugcacuuuaaauuuaacaaaacuggaaaaauggguuguuugaguuauuuguauuuuaaaagcucugaaugauaguaacccacgaauaggaaaggacuagcucagguauagcacaucgccuguaguguuaaaaguuucuuuuauuuaucuaucugcgggcuuuucuuuuuuuuuuuuuuuuuccaucuuuuucugguaaaccaugaacauuucuauucuuucuacauugugaucaaaggaaacagauugaaguaagcuuuuccuucacaaaguauggccuagcuuauucuuaccugggaaggacuggaugaucgcaugugaguucauauuuguguuuccaacacuuguuuuuggggaacugcuagcaauugcauugcauuuuuaguaucuccuaaauaagcauuaaaaagucacuagccccaucuuaauuuguguauguuagaacuacuauugcagaauccugacacaugaggugguaggggccuagacugcacaaucacgcaacuaucacauuucuauucaaggacacauacuuacuaacaguaauucagggugaugacuacgcauucuuuguuauuuuagcaguauaaaucuguguauuagcacuguuuuggaacuuaaggccuaccagagaaggaguugcagcuuuagaauucucaacuaacuauguagguaacuuaagguauugcaaaagugagaauauacuaaugaguuacuuuuguaucagaugaguacuuuaguuuuauguuacaggagcaugauagcugccucauaaccuguuuugagacauacagauacaaaguaaaauacauuguuaauuuguuagaaacuuuaagaaguaccucaggucuuacaugaaugcauguagguuuuguaaaauccuaauuuaaaugaugcuacuauuaaccgugauauuuagcaagguaguuugguguaguaucaucauaaaucagcauugguaggucauuaugaguaaaaagaaaauuaaggaauaucucucucuuuuaauauuucauuuucucugcacauaagcuuuuggugcaacccucaguuugcaugaugaugcuuuuguuucauugccauucaacuucuuucagcauuuuuucaggguuuauuguuacguagcgaugaggcugcaggagugcacaguauuuacccuuccguugcuacagugggccgguuuuccaacccuuucauggaaacuauuguuuccucgaagcagaauaaauaagucaaguuaagcaagauauuuuuauguuuauaucuggaacuuuaacuugccuauuuauuuuaucaauuuacuucaacacaggaaaguuuuauaagaaaaaggcucucacuggauauccauguguuuuaaggaaaauucuaagucaacuuguccauguaucucaguguagagacuuuaaauguuaaaucaccuccaugcuuggauuuuaaaaacaauuuugauaauuucuuagugugauugugauuguccauuaguuaguuauuugaaugccuuaauccuguuuguuuuuuccaugagaggacagccacuuuccagauacaugccacuuaaaauuauuaagaauauauuaugaugcagcuuuagaaagcaguuauacauaggcaauaacacuuagacauggaaugcaaaaguauacaugacauauugcuuaucugcacuuauuaucauuuugggacaguaugucuucuucucaaguaaguguuuaacuuagaguugaaucugcaugaugaggaggcuccaaaagauuaaggcgaauuggugagaugagaaaguuugccacucuguuuaucaauaaaagaaguuaauauuguaaaacaauauuugccaucaguaacagcaaacccaggacaacaguuaaacaguauuuuuuuuuuccuuuuuucccaagcuggcuuugaauuuccaaauucaacuuacaaauuagcauccucguggugugaugcaauuguuuaaaauuuaaaacuuuuauaggauagaugauguguguuguccaguaucaaaucucaaaacugucuaaucagaagcuauguuugaugugcauguaagaaaaugaaaugucacugaacauaguauuuagguaucuaaccucgucaguguuccuggguuacuuaauagccguuaaauaauggugccuauuacgaagcaugguaagaguaaaaggagcaggacaacguacucucacccacugcucauuuacagaaguguagaugcuuguuuuuaaaucguaucaguaaaucacaguagaagucagaucauaggaaguaaguucauaaaguaauuucaguccacauuucccugcgcaggccgccuuccccuuuugcagauauuuugaggggaggggaugaacaaaguuuuuacaguuacagugggagcugaaagcauggcaucagaaaguguauggggaugggaugucuucucaugggcugugguugcugugagcagggcugccuucccacacaaagaacagauugugguuuaacucuuuccguggucuccuuuaaugugcccacauaguaacugaauuguucagaucucugcuggaaaguacugaucgguuuaauuuccuccauggcauuuggcuaugccucaugcugagauguaaucagcuacauucuguauuauaaaauuuugaaucauucuuagucggcaauaugucagaauacuugauaacccuguuauugauuaagggagaaguauaccugaucuggaucugaauggaaaacuguuacuauguugcagucuccugcacucaaaccuugaguauucuccuacaaaggcuuucauggagaucugaacgcugaggcagcuucuuuguuggaaugccauuaguucacuuuggauaccuuuaucuuaggaaauuagucacucugcuagacccuucccuccacgugcuucagaguaacgaacccuagcaaggaaauucuggcuugggauauaaccuauuagagaaacuuauuuugugguuaggaugacagaacagucagcaugaccagaaaaaaugguugugguggaguucuccuuugcuucagugcuuggcuuauugcagucacaucgugugcaugugugggaugcuguucucuaaacagcaauaggccugagcuuguguggccagcuuucccuaagucaggaaguagugaaacacugacuccauuuggaagucaccugaaauauuuguagguagagaugaucugcaugcaaugccugacagccccaugccuuucaaaggcucagauaaaacaggcagaaaaaaaaaugcugggccucaagguaaacuacuucguucacagucauauaguugggaacuguaugucagaagcacuugccaucucccaagcacauguaugugugaacccauaguccugucccauguuccaucugugcagcacaugaauuguagggauuccacaaaagcaguaaccgacuaggguacacucccggugccacugugccacagcaugcagagaaacaaagagugaaaaguuggugccaaguugccauuuuucauuguucaccucagauugauuuuuaagggguuugaauaauugccauacuccugugaucgguuaacaaauuaacugacucuguggggcuuccucgucuguagaagaagccaccacaaggacauucacagucuuuuguuuucaacuuccaaaacuauuuaaaaaugugugugugugugugugugugugugugagagagagagagagagagagagagagagagagagagagagagagagagagaugaaugcaugcuggaagcuaauguugguggaacagggagagaaugcacuguucaaguauggaaaccuuguguucagaacacugauagacaagcuguguccuuugcccacuuucccucacuguauacugguuucucuaguuaccacucuuggaauggugcuguuucaguguuggaauguuggacguuugauaagaaaauggaucaaguuuaauggcgcaugcucuuugugcccccagcagccucuugcugagagcaugcuccaaagcgggaacuguguggcauuacagugagcaucuacaugcuuuguguuucugugccaccgagaagagaaaugaacugugccaucgcuccugccuucugagaagcucugcuccuauuuaaaacaaacaaacaaagacaaacaaacaaacaaacaaacaaacaaaaaaccagacuacuguguuccuuguaaaaugguacugcauagugcuacuuggucaaucaaaaauuuaacuauuaaauuuggugccaugcgccuuguuuuaaagguguagaugcguggcaaugagauaggaacaaggaggaauagaaccagagcggaaacagaaaauaaaaccuuauuuucuccguaggagagagagccaguuugugaauuuugguggggaggggguauacuuuauuuucuucuugaucucugcucuucuguuuguuuaaaauuagaaaauaauguuauuauuuuuuaaguaaguuuugcugaguugggagauugugucuuucuuuuuuucuuuuauuucuuuuauuuuguuuuucuccuuuuuuagcauuggaaauuaaacugacuguccaauucuucuuccccaucuucugcaggaugaauuccacccauuuauugaggcacuucuuccucacguccgugcaauugccuauacuugguucaaccugcaggcucgaaaacgcaaguacuuuaaaaagcaugagaaacgaaugucgaaggaugaagaaagggcagucaaagacgagcugcucagugagaagcccgaaaucaagcagaagugggcauccaggcuccuggccaaacugcgcaaagauauccgccaggaguaccgggaggacuuugugcuuaccgugacuggcaagaagcacccgugcugugucuuauccaauccagaccagaaggguaagauuaggaggaucgacugccugcgacaggcagacaaagucuggcgucuggaucuagucauggugauccuguucaaaggcaucccuuuggagaguacggauggagagcgacucaugaaguccccgcacugcacaaacccagcacuuuguguucagccacaccacaucacaguaucaguuaaggagcuugacuuguuuuuggcauacuacgugcaggagcaagguaggagcagauuguucuuucuucuagcaugguaaacacugcgcauacaccuccagauacgggaucucuggcuuggaccggaguguccuggaggccuccagauggcaucugcccucccccauucccgggaaccguggugcucccaguagugcuccagguccacggucaugugggagccauggagaugggcauggagcuuccguagcuggaagcguccacauuugaaggaaggacagaaggauagacagacagacagaugcagaguagucuaagaaaugcagcugauugaacuccaaauuuugugcuaggcuccuucccacggccaucugaaaaugcaacaugacugauggcagccaaagcgcuguuuaauaaucuuuguaccagucuauuaccuaacgagguggaugaaccuuguucaguagucuaggggcgggugcaccaaaaaucaaauuagcauuuacuauuacaaaauaucuaagcuggccauuaucaaaauacauaucugacagaggccuagauuuauguuguuucuguauuucuaucaacacauccuugggauugugcagugcuugcuguagauuuaaagcaacacagcucucguuuaaauaacuuuuaauacuuucccagagugaccagggaacacucucuauuauuaguugacuuggaugcaaauucauaaagcuucccaaagaagaagucacagcuuucuugacagagcaucacagagcaaaccagaaaguagacugguuacacugguuuaaaauaaaucuccaaagaauguagaaaccgcaugccggcccauguuuacaguccucgauaaagagugcugcaaauguggcccggacugugcagcauaggcagugggggugccagggagguuuccguuguuaaugagccguguuucuuuguuguugcugguuuuuguaggaaggugagacuuuugacuuuguuuucuucaaaccagcaugucaggauacaguccacauaggaaagccccauacugaacgugggcucgauuuugggcugccacagauggugggucauuucugaacuuggccuggugggagggaagauggccugcagacagccagguggcagacaguuauccgaugcucauuauauaaaugugggguuuaauaaauagagguacguuauugucauccagaagaguaagauaagaaaacuaagcugaugacucagacuuuggcguagaacuuacugugugucccuuugccuugauuuucccuugaaugaguucuggagaucugcuugagugucauuuccaguuucguacuuugauucuaaauaacaguguuggacaucaucguuuggaagugugucucuuaacaaacaaaaacaccacauuuguuauuccccuguguuuagaacuaaaauucaaguaaugaugagccgggggaaauauacauuuucacccuugauguccuaaaauaaaaacuuauuaacacaugacaacuugauugacagcugucucagaggcgacauuguaaggugggcuacaugcauguguuagauugacuauguguuguaaguguggugaaagucucugguuagaagggaaaguuuugcaaaguggaucauauaacucuagucgggagggaagaacugugcaaugauucccccuuuaacucuugaugguuagccacgaaguggacauacgugccgauuuaucccagggcagucagccaaaucucuuuguuuuguugaacugacaauagagacuguccuuuggauuuaggaaaauagacugaaaaaaggaaaaaaaaagacauauauauaaaaccauauauauauauuuuuuuucaugacaccagugguuaugacaaucaugauguuuugagccaaaucuuagugacuguguuuucagauaaaauauugauucaauaugaacaacguuuugguauuuuuucuguacauucagucaccuguccccucuguccccucugccaccugcccucacaucauccccucuuaacaucuggucacuucuuacaagagucacagcccagugcuuuuccguuuucucuuuuucaagauuuauaucuuguuauuugugaacugugaguugacugucauuucucaccguagcugauuaaagaaagauaagucugcaaacaccccgggugcuucaucucacaucauaacuuuuuguuucuccucuaaguacaugaaaucagccuuacuguucuuuagaaauuagguaaagaaaagaagaaaacaugaaagaagaauuaacacagaaaaaaaauauuuauaacagaaugagcaacaaaaugacguccccuuauccguccucuccccuuagaagggacugggagaaaaacaggaggaagaacagagagaaugccaaagaugguugccacuggcaccaggauuggcaucagacccucuuuguuuagcucaggaugccugugauuuguuaguuggcauccgcauugcaguguggagugauguuacaauauauugacaauuuccagaucuagaaaugucaauaguccucuuggcuauuugcagaucacaugcuucgucucuaauggaagacgagauagagacggauggauaauaaacuuucauuguugaccaacuucccauugcuucucuuucucccuccuucucucuugguucaacccacacguacccuuucuccuucccugcaacaucaucuuuucugaaauguggaaagaguuacugaagcuuugacacaaacuauaaugcuacaucugcaucugauauaguuuuggggagauuuuauauauuuugaaaucauuuuugauacguaguuuauuagguuuuaacaucacagggcaauauuuuguucaaagcucaaauucuuuguuacucagugucuccccuccauauagccugguugaccgcaauucaguccauuuuaaucuuuuuuuuuuucacauuagugaaugguuauaugaaauuuaguuauuuaugaaauuaucugccuucguuuuaccuaaaauuugguaacugauuugggaguagcuguauuuaaguccauaaaaaaaaaaucaucugaugcuauugauucagagggcugcgcuucggcuguuccguugcuacaagaaccgccauuuuguuugugaagugccaggcgagggggaaaaaaaaaggcagacacuguguuugaugccaauaaugguugccaguggcaccgagguuggcaucagacccucuuugucuagcugcugaaugccuuugauucguugguuggcauccgcauugcagugggcacacuggaaaguuuuugacaaucccugaaugaaagcuucgugcucgucugcugcagcaaagcuuggcuaauagaaaacccuuccccuuuucuucccccaaaggcuaaaaaaaaaaaaaaaaaaaaaaaaaaaaagauuuggacagauuaaggaaaaaucuuucuaaaaugggcuccauauucccaaagauguuaaagauguccaaugauucuuggccaggugguaccuauuccccauauugucuuuguuauugcauucauccaaacaaagcaaagaaaacaaaaugaaaaccagcaagccuugugcaguauaccuucccaggacgucccguccuguaaacuacaggggaggcuaugucaggugugugaggacaugcucaguguagugauguaugagugcacccauuauaacuggcuguuucauuuacauccccauuuauuucuuauuuaauuucuaguucucucaguuucucagccuccucauuuuuuaguagucuguugagaggcccucacuucccucucuaguuagcaauguguacagugaacacgugaaaagcagaaaaccuuaaugagggaaguacaugcuaaaaucugauauaaaucagucacuucuggccccuucaauucaauucugcaacaagaucuugugaaaauccuucguacacgauuccacauacuuggggagugugaaguucggaggguggggggcagacaacaaccauaaggcuagaguaaucucaguucaaguuuccuagauaguuaacauuaauauugcuuccugguuaaccaccauuaucucauuaauuaauaagaagaauuagcaguucuacccaaagggcuacacagaaggaaguguggccuaugggaggccuugagucgccagacuguguccugucuggagccagaagaugcagggaugcugguguguguguguguguguguguguguguguguguguguguguguguaaagggcuguggggagaaaauaaggacugggcuuuuucugagccagggaggguuuuuaaagaaaagagaggucaccacacaaaguuuaaagaccucuaaagauagugucugcuguuaugaauuuaacagaugggaguuuaaagcaagucagcuuaagugaucuuuggaccccacuuucuacucuuauuagauauguuuuuggagcauggcagaguuccgcaguguugcuugcuucuauccuggacagggagcacccuuuaaccuuguugaaccuuuagcauuaauugugaugcaucgcaucggcacagugcagcaccuuuuucuuuuucuuuuuuugcuugauuguuaaacgauaucauaauugaggcguauuuugaaguugugaaccaugugacuuguucagaagggaaguuguaaucauuauugucuuugaaacagagcccuuccugcuugucacauggcauuagugaggacgcacaugcagagagugauuuucccccuucagcuaccgcagcuuagaauccuucuggguaacaauuauuucuuuaugaaaagcuuaaauagauaauuguuugcaaguugacagcgcauuuuaacauuuuaauaauuuucacuucauuugcagguauuucccauugugggggaaaauaagcuuucauaacguguuuaaaugaggcugcucugcguagugauuuggugggcuugcauugugacaucagagagcaugaauuuuguguguaggauaacuacuuuggaugaguguuugauuuagggaaaugcuguuuuaaguuuucccacccugguacccuguccuugacugaacuccugaacucugguaugcauuuguuuucauucuucuucauacacaauucagaagauaaagaaggauucuuggugguaugccuggccccuaggcuuaaugagaccuuuguuagaacauauauuguaagaugagauacuuagcaauuuucccacugauaaggacaaagcagagucaauggaaccagaaguucacccucugugccaugcugucccugccccaagauagcuuugccagacaacucaagaguuaaacucugaggcccuggcugccagcuggaaagguuggcaucuguguccugauauggcgaggcaagcuucugcauugcuguuaacauggucucacuuuucaaaggcagaaggaagagagaacacaggagagacagagauggggauaggagcaucauuugcuacaauucguguuuucaaauauucagacaaugcaaggcacuauuuucugaaggcaacaaagguugguaagguuggaggcagagaacagaaugaauuuugaagugaaaaaauauguauauacauuuugcauguuuggagucacacacuuuguacucugugucucccuugagugagaaucaaaauuauguccauugcauaggaaugguaguaaucugggugggugggggcacugaauuccguagugacagagagggugguuggguauuacaggggccagcacccuguucaacacagugacauaugugagccugcagaccuccagugugcauaagugcauccaaauggagaaguauagauuuauggaggauucaauaggauuuuaaaguacacauagauguuucuacccuaaauuuggaauuugaguacaaauuaccaaaaggaaaugaaagauuuaauauccauugacuuuccuuaguuuuaaucugauacuccaguuugaauacagucuaagauacucaacuuaguagggucuuuauucucaugagccuugauucugcuaaguuaacaugaaaaaguucuacuguuuguuuugugacauucuucuugcugucuccgcugaacaguuagaauacagcaccugaagaugaagguguuuauuucugagucugaaucuacagucuacaguccuaguagcugagauacuuuaguuuucauuuuuguuaucacaauggccuacaggacaucuaaacuuaucuucaaaggaguaauuacugccauguuuggaggagacuggugaggaauggaaacagcacacaaggcucgcacuaaaacugauugguacuaaagagcugcaaaugaugccacagaacaaggccagucuccuuuaggaaaguaccuucuaguaaaguuucuuuuaguuuagggaagaauagcauuuuauagugcagcgguaaugggaaucgaacucaugacccucugggaguuugucagcccacaugcuguggcagaguagccaguguaacucucaaaguaaguguuucagcuuuucucuuccaaggaagaauccaaggccccaugguuaugggauugaaaacgcacguugguccagaaaugugucucacacccagcaccgugagaagaggugcuucuuuuucugcugggcucacuuuucuguggcagugugguaccuugucucauugaaaaguaacuucuuggguucuugaauucuaauuaugugcugugguuaauuuaacagaauuuggcgguuaggauuuggcuuagagaacaucaaaucauccaacuguaggggaacuugugagaacugaguguauacagcagggagugagguugugggauuaucuuguauuaccuggaaguuacaggacgugagacuaauaauaccugaaugguugggcuuguuggcuguuaaguuauucagaaaauugggauaaauggcuaccaauuaaccauugagguggagagaccuugaggcugaguugagggcuacacauuaaaaaaaaauucuuauaauuuaagcaaagcagucuucgauugccauucaugugcaucaguacauuguuuauaauaaaacacuuagacacacagucucucugguugugaugauaguuuaagcaggacacuguugaugaaucacagacaaauuaaagaacuuugaauaaagacuauauaauugggaauauggagugauggaugaaguaauuuuaugagcugaaaaguugccuggagguuguguauuuucagaaucccauuuuaaggcacuucagagcaugcauuaaguuacugauacagcacaaucagaaaacagaauuuguucaaacaaguacaaagugaaaaaggagcugccuuugaagaacgucguaaaugcuaaguucaugcaguuuuaaaguuauagucaccuucaaguauuucucaaaggagggaauugaagaaguucuaagcacuguuuuuuuaaauacacagacauauuuacuauuauauaaauucaaauaugucuuucauaaaacuaaaaaaaguauuuaacagguacuaauuacuauucagcaauacaaacucugauuuggaaggaaaguaguuuuuuuuuuuuuuuuaaagcuugauuuuguauauuuauauuggaaaaaugcagacaaacauggaauaguuuuaacaguagccgcuugagaguagggaaaauaaaccugaccaggcauagagauguuaacaaaguuacuugaaauagaggguauuugguaauucauauaaguugcagacucuacuaguguuuguaggaaugcggguaugaaggcuguacccaucuauuagugaauucuaaagugugaaaaauguucuugcuuaggacaacuuguauuuuauucuucugacaucugcaguuucuggauggauuagccuaaauuugcuaugcuauguuaaaagccuuguuuuaugagguuggucucagcuucuggccuuggugucaggaacucugcuacgggaugcaacuugccuuguuagguuuaauugaccaaagcugauguguuaaaacaauucauuugggcuguaacuuaugcccuggcuaacuugcuaccugaaucccuugaccuugacuugucugggucaugaaauggcugcaagcuguuugaccuuucuauugugcaguaaugucacuguuuccucuuauucuuuuaugguaauagcugacaaacaggccccagcccauacuuuacacaccaguggauucaaggcgucccucugcaguagcuacaucuucuguuugacauggucuggcugcagaagugacuuuccuuuguuugcagacagugauggggacaaauuugcugcuuugccggcuaugguggaggugggggauuguguucuggaaucuggagggauuugaaucaauucuuuguggguuuccaacuuguguguuuuguguugacuugucacagugcccuucccccauuccucugagccuuacuucuuagucccuuccauuuauggcuuccuuaauaauuauuuuucaacacuuuuagcuguuacaguaagagcauuuuauugucauuauauagguuaaagcgacauauuuaguuaugcgcauggcuaucaggucacuaaccuuagaacaacuaaccuagacuuggcacuaucauuauuguuuggcacuggaaagauuagaagugagcacuuuaaaguggguggacuaucuuccacaacauguuagaguuuuaagggaaaccuuuucuuacugagguaaaugguuaaguuucaugacauaguagugacccguagaagugaaugugaagauuuuauuucugagggggcuuuuggcaguauauaaguuuaauguuuaccuuaaugagcauaaaauuguuuuucucauaaaaaccccauguucaaaauggcaaauuuuaccuugguucccauucaaggcagugaaauaauuuuauuuuaaaaauauuggaaaugucuucuaaaacguuaaaaaacacagauauuuuuauccuacuaaucuuuucguugccaaauaugacguuauaguucgugauuuuuuccuauauuuuccagauuaaguguuuaaaaugcaaaccguuacauuuuauuuuuaaauuauuacaggaaagaaggaaguuuaaguuaagaugugcaguuuucuccugugcugcacacuguuugcaccaacagauacgauccagugugguagugaggcccugggaaaacacuagcauugaggguucuuguuaaaaaaaaaauuguuuucuacaaauaguggugagaaacuuucuuuaaaaagaaaaucuuuuagugguuguauuaaacugucuucuuguagggauguucagacaucaaggaauuugaaugguuuuaaacuuuaacccuguugauaaugcaucuuaguauucagagggcaaggaccugaucacaaucccagacucccucuuauagaagccugucagagggggacugagcccacaggccuuucuguucauucacggguaucccacagguaaugcacaccuggaguggauauugaguucgugggucacaugccagcggaguugaggugugaaggauuuuaaaaaaacauccuugauguuuuuucagacauauuccucagaucuuuagagauugcuaaagugaccucagcuguugaguugaagagguucaguuucugauccauggauaauuagugggugcugggguaugcacauguguguuuggguuucaagaagagaaaccaggggaaaagaaagaaauuccugcuuggcaggaauugaguggauggaugacuuauggaucgaggagggaguuaucuuccaauuacucaaaauuguagguuagugauuaaucuauagaugaaaaucugucauucuuugaauuuuggauuucuuuugcaguucagaagaucuacuuuccuugugcuuucuuaggauuuauaaagaagugucuucauuaggacuccuauagugaaguagcagacagacuggcugacagaccacaaacuacuucauucucacaguucuggagaugguuaguccagggucaguguccagggaaagcuacuuucugggucgcugauccucuccuccagugucuugucagaaaacccacugggauaucucuucaacccacuaauuucauuggugagggguccauccuccugaauuaauuugguaccaaauguguuucuuaauaccaucaucuucaggguuaggguuuaaacaggaguuuuggggacacauaaacuguacugguuuguuuucuguugcugugaugagaucccaugaccaagccaccuggggaagaaaggguuuaucucaccuucuguuuccagguaacauuucaccgcugaagguagucaaucaaggcaggaacuaaagcaggaacaaauggagggaugcuacuaacuggcuugcuucuuuucugacuucugcucaguuagcuuucuuaucuagcccagucccaccugcauagggauggugcugcacagaguggacugggcucucuaauaucaguuaacagucaagaaaaugcuucacagacaugugcagaccaaugugauagagauugucuccaauugaggcuuccucuucucaggugacucugucaaggugacaccaacuacuaagcaguauauaagcauuuagucucuuaaacauaggacaugccuaugauuaacacaguucugcucuugccuuuaugagcuuuguuacuuuggucaagucuuuugauuuuucucuuugauaaacuaggauuucuaaugacuauuuuaggauuuguguaaucauguaaguagagcacucauuuaauagccauuauuauuuuuuuaaauauuuuuuauuacauauuuuccucaauuauauuuccaaugcuaucccaaaagucccccauacccucccccccacuucccuacccacccauucccauuuuuuuggcccuggcguuccccuguacuggggcauauacaguuugcguguccaaugggccucucuuuccagugauggccgacuauuauauaaaggaauauaguguauagacuaccugagcauggagggaaggaauaugugaauauuuaaacaaguacucaucacuguguuaguagcuaucuccagcaaaaauaaaacauccuaaagagagaggaugggggaagcaauguuccagcaauacgcccguguauggguccuugcuaguaagaacuuugaagguaggcauauacaguuagcugauccuauaagguuuugaaauacacuuaaauuacuguaucauuucaggaguccucagauuuucuugaguuuccuuaaugcaucuaggaauauuuuagggaaaggaguaaaaucauuuucuuuguggcuuccugaaucaaaagcuugacccguguuugauaaagaguguccuagucaaaccuugaagugaacuuguuacccugcuguggaacguggaucucuccuguguaucaagaugaagucacccacacuuggaagagcuucguuuacauuguagauuggguuggacagaaguguggauaugacaaggcugaacggcuaguuaaaaugagcgagcugcuggucuugagacucucagucagaaaggucccgugacccuuaguugggucagagccucagacaguuuaauugcuuacguggauuguuuugauucuauugccggcugacucuucaagucagccuuccuacuccuccuuuuuguggcuuuccgaaaauuaauuaaaugaccucuagagggaagaacuuaguauuuauugcuuagagcaauuucacuuuuacuaagagcaacuggaagucaaaggagaaaugguuaaaacauuggcuucuccccaccaugagggaucagcguuugacuuaggugacucugguucguuggcuccccaugggcguggagcuaaauugguaugccagauuccugggcaacgggaugauccugcucucuguggccaguggacuguuccucucacucacuuugcagagcaguuuggaaacuguggagauuaagagggaaguaucuuaaauuauauguuaggcugaugguaugugcagaagaaacauauuccuacaugaagggcuugaccaugguguuuaucauagaccuaauggcucuagucagggcucagaaggagaaguuguuccacacuugucuaguaguuaaaggguaacuagggugugcacaucagaacauugaucggcuugcuuggauucugguccagaagugcuaaugaucugugcugugccuuuucuuuuugagaagagacuggcauucaguugcuguucacaggauacagagagaucuauaaaagugaguuccuagaacacaguguauccucaaguuuucaacacucaaaucggauugcugcugauaacauuuguaacauuuguuacugugucuucccaaugcucuugaagagcuuuguguacacuucuaauagaaguuaaugagaugcuacaaugagaacauccacauggauccuaaacacuggcuguguucuguagcuucucagaguugcugcagugucucuuuuauuccuaccacgucaagcaucauguugcaggguaugaccuguaguuaucaugugcaauuuugguuccauuuauagucuccaaauaagggaaaagcagcuuauaguaauaugaggaucacuggucuuacaauaauuaaauagacuuguuauacggcauuaaucccguuuggaacaguuggaaugacuucucaguacuaacaaacacagcauuagggcucacaguuaaucugcuuuuuguauccaacauucguauaauauaaaacauguguauggagaaacauauuuuagauuuaagaugaguucaugggaggacaaaaugaaauuguauuagauucuagcaauaugaacacaguuccaaauacugauaaaaucuggaauucauuuagaaugagaguagguagaaaaauauuuuuagcaacuugcaaguuuucuuugcugaauaccguguuuguauucuuagaauuggauuuuuuuuugcugagauccaugugugguagauguaugagacauacauguaaugugaacagaaaccuuuaugcagcuauugaugccuuguaaguugugguuaugguaucugucauugguacaaccucuggucuguccuugagagcugaagcagacucaguuuuaaagucugguccgaucugcuucuguaggucaugggaauggugcuagugaaagauuuaucuuucauucacuguucaaagaacaucauuacgguuuuguugaaagggcuccuggguuaggauuauguuuaugucuccugugguacaagccccaugaggcaggguuuucucaucaguguagacuuccuuacuguccuugaauguuccacacuugggaugugaguucaucuuuggugcucuaguuccaggaaacgaaucucaggaaggaugaaguauugguccaucauaggacagauugcaucgccugugcagaggaguguggaaaauccugugauuacugagugggguacagccauuuuaugucacgugccugggaccagcuaccacauugucagggaaaaacacgauguagcaacaguauuagaucaugcaaaugagacuacugaauaguaauaguuaugggcaauauuuuggaaaacacugauuagugacaguuuuauuacagcaaauguauguaucaaguccccagauuucauuguaacgcacugaaaacagaugucaaagugucccaaacagaauuucaugguuaaucuacauauugcauggaaagugcaaacaaaccauuuagaauucuguuauuuaauccuuuuagaaggaacgaaaauagacaauuuagguuuucuuccuucuuucuuuuaauuucaguuuuuguuuucuagggacugaggauaaauuauuuuucuguuuguuuuuuuuuuaaagaugcauaugggaggagauauguuugccuauggaugugauuuuacguaguguacuuuaaacuguaacuuucugagcauaaggucuuuguacuauagaaaggaaaaauuaggugcuaaauuauuuagugaccuggcaguggaauuacuuucuuguauuucuuuguuuacuggcagauuucauucugggccacacaacgaugcagcugaaaugaaagagaaagcaguuagugacuacuucugucaugucucugggggacuuugucucucagggacucaguuucuagaggacuucucuaagaccucuuaacucuggcaucuuaggaauuuggccucugguuaguuuggccaaggggcagggcagucuccaccaugauaaccagcucugaaagaguugauacccuugcuaaauuggaguuuuaauauguuuuauuuauuauugaguauuauguaacauuucuaugugguuaauucaaaguccaauaagcagaugguuuaggucggucuauacuuaaaaauaaaaaaaagguuacucuuggaguagccuuuauuugguaggauuuuagugcagaggggcgggguguguguguguggggaggucucaagagauuacaguucggaauauugugcuuaagagacccaagccucuuugguuguuuauguuagucugacugcuacagaggcagaauaagcauagcuaauaagaaguaugaguuuaugaaaacaccagccacacuuuuuaaaagaagcacagacaaaagucacaacacaucgacuguucucauuuucacuuucgugaaauaaauugacucaagggucuucuguuuucucucugcugucucuucuuaggaagugcuguaaggaagucaggccgcagccauguuuuucaggggaagcugccuuuccauucucagugguuggcaaacacucccuuaaaguuacagacagcuagcuaauaucacggagaugcuaacagucgggaaacagaaaagaaucuacuaaaaaugcaucguuaagguuaagcuuccagcaagauaugacuugauguauuuggauaaguguuugaaauugguuuaagaaaaaaaaguaaguugagaguuucauauuuuaagaaaaacaggagcugucuugaggaguuggugugcagguugcuucugaaucccggcgacuuucagauuaguuugauaauuacucucuccauucccucugggccauguacaucuuuuaucucaguuauauauuuuuuuuaaaguuuaagacaaacauaauauaacugcucuuaucuaagaaaugcuucuaaggcuucugucucaguucaguuuuuagaaaacgaaacacuagguucaaugucaaaggacccuucaauggauauuuuaagguaagagucuuuuuuaguaugggaaagauggcucuugaguucacguuucacauguuaucuuguccccuggaguauggcgaacacuggacugaagaggaggcaggcaugguuaaaaaaaauuaaauacauguuaaauacacauucuuccaaaaaguucauuucuagcuugauggucaugaaacaaguuuuaagguauguuucucaggcacaguuguagauagauaaaugcaugaauaaaguuggauaagaguguaaggcaaagccauggccaugaugugggagugucccaggaagcaacggcauuuauuuaacgagcaaaugcauguaaauguagacuguguauagaauaacaggagaauuacaugugguuauugaaguggugaaagggagaaccuucaaauuggguaaauuguauaccgggauuugcugucuuuauuuucuucuaucuauugauuggucaguguuucaaacugucauucuacguauacauacuauaaguuuucagaaugagcaaaaugaaaccaaauggugugcccaugccagucacugagcguauucuugaucaugccaugggucugaaugaugguuuuauuguucaccaugugguuggguccauuaguuuuauuugcuaagcuuugguuuucugagcucuggagugguauugcuggucuacucagcaguucugagaucaaaucagaaaaugccuguaaagugcuuagcaccacgccucucacacugcaggugcuugauaaggcauaaggcauuuaccuucagcuggguauagugcaaacccagcucucaggaggcugagacagguggcugucugugaguuccagcaagccagggcuacagagugaaacuaucuuaaaaaacaaacaagccaacaaacagacaaagagacaacucaucccaaaucuaaaaucauuaccaguauacucugauacuaaccagcucacacaauguggacauauaguagcucuucaauauuuauucuauaggagagugcucccgaccuuucucugaggagccuagaagaugaaguguccccuucgcgggggguagaauauuaauuugaggacaguuaauaaagugagaagaaaaaacucugaaguucgcaguuuuucaaauauuguaauuauggcgagaauucuggcagauaguaugguugcugugugauuucugaagacuucaucccuccugugcauggcagagaacuacaaaagguuaccauccucaugccagcaucuguagguaacuuacaagcauagccuucccuaggagcauaaagacaugcuggauaccaguaacauuucuuauuagaauccaauauacauagcuauuacucauuauuccuaaaucccuuuaauuuagguuauaagaaaauugcugacauaaaaggauuuggaaacaacacugaacauacccauuguuaccuaacagcaaguacuugggacaaugguauuuauuuacaucagaaacaagacuuuauguguucauacacuuuacuaaugauaugcacauauauagugcuuacauaucuauuuacaauauguauucccuuuuuauccuauuaguuuuaauccuaguuccccaaaucagcugagaagaaauauuucaauauuguauauaaguuuauucucuggagaagaauuugacuguuuugucuuuuuaaauguuaaaauuauuugauugauuauauaauuuuaagugccugaaauauugugguacuagaaucuuugccucaauauucacuucauagaaaucuugccuuguuacucauuuaaugguugguagcuuuucuaaaguauguauuauguguguguauacauucuccuauuaaauaugauuuuuuucacauacagagcuaaugagguaagcauuuaugaaacuauuaggguauaucuaucuaucuaucugaaucaucugguguaaauauacaaagugguugagagcacacucacaggagaguaauacuguaccuguuacaguuuuaguauuuuaaggaggauuaugacuuugcucgaguaauuugcaaguagaagagaaaagaucauggucgcuuguacugucgaugagcagcagaaagcuccuggcgguggagcaggcauagcuaccuaacugucucagccucuccuaaauauagcuagcggugcugagcuugcugggaggagacccugagggacuguaauggaaaggucauagagaaggugagucuuaggcaguguuuucucaggggcuuugugacaaaacaaaacaaaagggaagauuaccaggagucuacaugugugccuugcccucccucgccaacgccgugcucugcacugaguacguauguguuggacaaacuggaucuuuugguaaaaaauuguuaaaagaauuuaauaugauguuuuaacacagaagcuacaaugcacaggaauaaauguccuugauuaauuaauuucacuuuuuuguugcuauauaguaccauuaaauucuaauuuggaaaggauucuuagacaccuugccucuuagaauuuagugagcguuuuuuaauguuuuuuuuuuuguuaauuuuuuuaauucaucguaauauuuuaauugcuuauaauccugagugaaaaaugucagucuuauguaucaauaauuuauuuaaacauauuuuacgauugaccacauaauucuguaagcaauauagggagauuauucuacaaacauguuucuaaaauucacucuuaaaguuaguugaauucaguuuuuggucgucauuauauuuaaaaagucaaguuuggaucuccagaugaguagagaaaauaagaguuuuggucuggugagcugugucuuguugucagacuaaaauguaguaugauauaaauccauacuuugguugcuaaaggcaguaguuuauuagagcuccaugaccuaaacaaaaugaagcaccuuucuuuauugaauuuuucuaauagaauuuauuuccugcaaaugauucuacuccagaauauaguguuucuuccuagguaauuacaaaauaaaauaaaauaaaauaaaaaauacagggaaccauggcaggccuuggacuacagccugcuuucaguucauagucacaagagguaagaccugaagauacagcagaggcaggcuuggcaguccacaccuuuaaucucagcacacaggacacagagacaggcauaucucugugaguucaaggcuagccuggucauuguagugaguuccaggaaaauaauugcaacauagugagauucugucucaaccccccacuccccaaaauaaaacauaaggcuuuaucgcccuguuggccuguguuucuuauaggguguugcucauguuuuuaaaauaaugcuuauugugaguguuugcauguguuaugugaccauguauaugcucagugccuuaaaaagccacaagagggcgcuggauccggaagagcugguguuacagcacauuguaaggcucugugugagugaugggagucaaacccagggccucugcaggagcagcaagugccuuccaguccccagaugacucaguuuuguauuucuuguucuuuguaagaaugacucguguguguguguguguacauaaacacauauacagagacauacauuuauguaugucauagguuuuguugaguguguaucuggauguugauucauacauguaacaggauuaugagcauugacuugugaaagucagucuaucucagcuaaaaaugaagcuacuuugcagcaucagcaguuacucaccgagcagcccagacuguguaucaggcacugugucaggucuacauugugucauuacaauguagaaaagacagauauuucccuaaguuuacaguaguggaagaaacuuuaaaaauuacccacauuuuucuuaaccgaaaagcauugcccuuaaguuuguaggaaaugcuuuuguccacagaguaaugguauuaauuauacaaauacagucuccagggaacuacacgacgguuugugacaauucuggaggaaaugagaguggauuguuaggaugagcaagugugagugucuugcccugaugacuagaccugucuuuguaaggcacaguaacaaagcaccugcuucucacauguggcaguaggaaucucuucucaccuggagugggcagagcuagucaggauacuuucugugcugugcccaucgugggagcauggugggcaaugcagaagugagaccaagaagugcuggucagccgggagguggagcauagacuaugcuccuaauggcaacugccuuaaauggauaagcaguaagaaugcgugugagguuaggggacagccagucggcucuccagcuguauagcaucagcccaguggugggccacagaggaaggagugaccaggaauccauggagcuagaacuugccagaagcagucaugggaccaagcaucaaaagcugagaauccucaauauugggcagcagauaaccccauucuuacaguuucuuagcaaugcgauaugaguucuagcaaguguuuuaaagucccagggucuucaugucuuaugcaaaguagaaguaauacuaagcccagaaguuguugcuggggugcugagggcuuuaaugaccuucuggccccaguaccuaacuccuccuaccuaacugacauacaguagcaucccuaaggugggucggagucucugggcugagguggcuuucauugugcccaggugucuggcagacauuuaguguacauguaacaugagucaccugugucacucacuaauuucauuuuaaaaugagacaggacacugcuauggacaucaggcugccuuugaacuuauagugaugcuccugugucagccucccaacuacugggauuacaggcaggagccaccaacccaagcuucauuuaaugaucaaaaacuacauaagguagcuacuuucuuuucuuuucauaaugacaacucugcaguugaucuaguuaaaaagaggcuggauuugaaccuauauaguuuguuuccagaguccauuuuacccauccucuuaggcagugaggauuccucugaucacauaggguacaggggacaaauacaaauguuuguguauuaagcaacacacucugugugaaaggccacaaacucauuuagcguauuccccuaucucagagaagauggacaugcucauuuguuuuuaguguuugaccuguaaaugauucgaguuguauuuuugaauuauuuucucaguaagacuauguaguaugagcucuuucucuacaaaacuuuccugaaggaaaaagauacauuuucuacaaaacuuccuuguuggauuuuuuuuucuaagcagaaucaauaccucauuauaguuauuguauguucuggguacuugguuuauagaagauuuagacaagacuugaugaaguuuguguauacauaccauaagauuuuacuucuaaauauucucuuguuuuuggucuaaggaauuauuuucuuccucaguguggagacagaucuuagagagaaagcuaaugugauaguagacuccagaaaagacccuaccucaagaagcuggggcuaucuucugaguuuuauuauuauagaaguaagagcaguaaucacaaaacagcuauaauauguugaaagcgucccaugugccuugaauuaauuaauguaaccuuuacaguuccucagaggcccaaguaucacugucauaacggggagaaguugagguuaacugcuuaguacaugucugaucacauagcuagugacagagccaagguuugaauccauaucugccccaucccaacucauuucaauaccacugcacaguuucauuuagaagauguaguucacgagggcugacauucaaugauagagcaaaugcuuagcguguuuaaggcccuggguuugagacccaccaacaaacagauggugaggaugaugaugguagguugguagguacuucaaccuuccccaacaaagcauuguuuguuuguuuguuuguuugacaccaagggauauaaguuucaccuuauaauuguaugucugugaagcaguuaaaugauugucaccaaaccccagggugacugugccuucagggagaaagaauuguaugauuuuuuuccuucacuguucucaguuaaacauuucuuccagcuucuugccuguuuuauguauaugucugucuccagaaacuacagcucuuuuccuuggucagaagcaaaaacaaagcccucucuugguguuuaaaugcauuaguuuuaaguauuugcaaacaugaguauagguuuuucugucucccuauucaguuuccuuucagagagguuugugagaccagugagggcucaggcuggacacuguuagugcugcacuuggccugaaugaggcguccauugucccaaaggacagugcagcccuuagcuggggacacacagucaggaugcucuaaucccgggcuaguuacacagaagcuguucuguccagacuggaauguagcuguuaaaauagggggacuuugauccugaacaugaaguagguacaaacucuaaugcacuguuguguugggucacagcuggaauuuucaguuuuuuuuuucccugauuuuuuuuuuaaaguuccuuaaaucuauuucuagugauagauauuauuauuaaauauaugagcauuauguaaaaaaaaaacaaacccaaaaacaaagaaacaaaaaauaauuuaaagggagcuaaugacugaaaugacauggaagccuagcuaugucauuuagacaaugggaggugaacucuaagugggacuugguguuuauauaguuauuaacccuuuagccagguaggaguucuuuugccagacuagcugugagaugucuguaacuguauaaacagcuacaaccuccuaugcacuggaagcacccaguauccuagggggcccugugagagcacuucucuuguaaccuucugaacaucuuuagguggaagccauugcgguuaucauuagcaucucgguagacagcacuuuccucacacacagauuuugucuucaucagguuucucgggagugaaaagggcugggaacccaggcauucaggaggugugugccaacagcucaccuggcuguccgagguuugggacaaggccaugugcuuucagggaguuguuucuucaucuguaaaagggucaaauaugucugccauccuuguaagaaugaaagucagguggcuggggauguaucacaguagaagugcuugcuuagcuugcaggagacccugggcuccacccucaguuuaggcauuagcaagaucuauaauaagucaggucuauaaucccacacuugggagguagagacucaggaggucaaguucaaccucugcucuguaacaaauuccaggccagccugggauacaugagacuggccuuuaaaaacaaacgcccagacaccucuguguaugcuuuuaagaacaccacacacacacacacacacacacacacacacacacacacacacacacaggcuugucuuaguggcaauacacagccuuaaggucaugcucacauauuucugugaaaaaucacguuaaaaaggaaaaugagaaaauugguuucaguacaaaaacuuguuaccguaugguguuaaguugugcauuuuaacuguaacauuaaaaaguuacauuguuuguagguuuuguguguguugccacacaugcauuuuaugaaaaccgcauauauacuguugcugaugacagaaauccuguaguacuuuagagagaagacuuccuaauugucuuugcucccacuguuauggaaaaaggggcugucauacucccguguauguuuacugugaagguauauaaucacgcaacuauggaaacauuuuaucaauguauaugguuuaaauaucuauaauuuaauaguacaacuuaaaaaggcacaacuuaacaccauacagcagcaaguuuuuguacugaaaccaauuuucucauuuuccguuuuccucuguguaaaucuacaaaaucaaauauuuaagaguaaagaguuaccacaaaguuuuucuucagagauuuacauuuguuuucuaaaaaaaagcauauugauuuucuuuuuaaaaaagagaacagauauuugccccaucuggugcguauuuuacauuucuuuagguguucccaagugccugguguaguaguucuuccguucuguaaccuuauuuuccuaaagaagacaggugugcacacacacgugugccucugcaccaggaaaaugaagcucagggauuacaacaaaguagucagggucagaagugacccgacaugcccuccagcacgcuguuuauaauugcugugguuaguucuccgucucacuguuuuuaccuauaaugucaaaacacaauuauauggaguugguauguucacuaauagcaguuuaucucugcaugguuuauagacagagucagaagccaacgacuauaauuacauccauguuucuaacuuagcaaugagcuagaaaagugugguugaaguacacaguggcuguagccccgccaguaggaauuacaggguaaacucagugcuccgcauucuuuugguuuuacaauaauuguuacuuaaauuuuguuuucuggauuuuaccacugucuguuguguuuauaugaccacauaaagggugguugaguucugugucucuguacucuauucuucuugccuuccuccaugacugacuggcuauccucuggcuucuucugacucagcagacaguccauuacaguuaauaguccucagaagcagccugauagucaugcucuauggaacccagaagacuucuaguauuugcauuauauguuuaauuggauaauuaugggaaccauguugaacuguuaacaacugucaagccuuugauuaaucuuuucaguguucauuggcaugguucaaguuagcaaccacaauacaguguguggugugugugugugugugugugugugugugugaugcuauugcugcuguuuucaugauuauucaagagaguuaaaaauaacauuuuuuaaaaagaaaaguauaaauucccauuuugaaucauauaacuuauugugguauaaaaagcgacacaguuaguggguugucaugcuuuguuuacauauaaaacauuacuacagcuuaaugguucuagggaaaguguaagaaagcuuuauuucuaaugaucccauggauauaaaaugugaacagagccucaucccucucugaagauguucagugucagguggguuucaaccuuccuggacuuuguacacaucuucugcucucaguugagaagcucuuugcuacaagagacgugugcccuggguucccuaaagccuacccgggcugcugccugguccccuccuuuccuaacauugucuggugaaggguuagacgucuuugugugcugaugcaagaagacaccagccagugaucugcuucauucuuuuaagucaugucauaaauucaguacuuaagacagaauccagccuuaugggaaacuguuguugcaucuagcuuuaaaagaaacgaugugugaguugggaguagaggagccugagcuuaaugugacuaguuacauauugcugauaguguuuccuuaaagaguuuagggaggcagugaaucuagaugcaggaaaccuaagagagagagagagagagagagacagagagagagagagacagagacagagagagagagagagagagagagagagagagagcacauaacuguauagguauuggucuuacaccauuucugugaaagacaguuuccuuguuaccaauauuuuauuuguaaggccaccaaaguacaaacgaugaugcccaagaccccacacuagcaugugggcagagccaggcuuuggauacacacuuugugaggcuguuuugucugggcagcuccugagcuggcuuggugagaccaguccaggcugggcuaacugcaucaguagacuuugugcuagauaggcucuuccuggccuagauucauuccucucccuggaaaauagcuucuaccugucagucccaggguuugucauccuaaagugccaucuugcauuauguuuguaggccuggaggcuuggaauaagaguuuuagcugcucccaaagaaaacuacuuguguugaaagcauaccuugaugauuuaaucaaauauacaaaggaagaggggggaaagggguuguuuuagaugaaaaaccaaaccaaaccaaacauaacaacaacaacaacaacaguaacaacagcaaagccaaguccagaagccaucucaguaccauucucuccucuugaguuggccauuaugagacuguuggcuccaguugggagcuuugggaauacuggaccucccugugagguucaggauggccucuucagcauacuagggcauaguagggcagcaaacugaaaguguaagaaucaaauucaaaccaguaguagugcaugcuguggacacaaaugccuacccggagaaguuuaguacaugcacuaugggaagcuaauuucucuuucuuuucauucuuuccuucuuuccuuccuucuuucuccuccuccucccccucuuccuuuauuauuauuauuuuuuauuuuuuugcuaaaggaacucuuuuuuuugaaguccuacuguccaagcuaccuucuaugcaaagcagacugauugguauugccuugauuugaggcaagauuccauaaacucuuggucuuaggcagcuaagcaauguguuuaugugaacggccaugggaggguaaugcaguuuuaagaacguauacuuaacugaaagugggauuuccagguuucaggaugacaugcuuaaaaagugacagugauaaguagacaugauguuaggauuggagaggggaaguuugugagaucuggcuuccagugcuuccugcuaucugcuuccaucucauccuauguacaaugaaagcaguacagauuuuccuaaagaaacaucucugugauauguauaaaugggcucugugggcuguaauauuucauguuuucuccuccuuuccuuccuccuuccuucccucccuccucucccccuuucacccuccuaaucaucucuaucuccuuuucuguaugugugcauauauguaucuaguuauauuuuucuucacccucauacaccaagcugaaaaaauugcugaggauaagaaguaugcuuuauucuuaacacuuguuuaaaacauaguucuacuaauauauugauuuauuuuggaugguuuugcuugucuuaaauguucuggugaaggccuucuagacugaguuaacacauuuccaucagugugcuugcaguuuauaagcagagcagguugcugcugcuagcacagugagcugcaggggagacgguagauccacauccuaacuggagcuuuggcuuucaccugcagcucuucaccuccagagagucacaguggaaaccaaggucuaaaugccuccgcuuagcagcuggugaaacuguguguuaguaauguuucgucugagugucugauuuaggccccaacuugccuuuccccuugcuuugcucacuaacccccaaaccacagguuccagauuguacccacccagggccucagcucuuucuccugggccccugagauggccugagcacacacccugaccuaccucuuauacaguguugaguguugauucauacuuacauuucaggccacuggacugccuaguuuuggggauuuaaaauuagacuccgauugcaugggugcaucuuguuaacagcacugcaacacaagagucugugugaacucauuuuuauuuguagcuccacagcaucagaguccuuuuuacgcccuggcuccccugaaccuuuguguuguacuaagaauauuuuuaccaacugcauuaggaaaugucaaacaguacaaaucaguugaacuucucuuagcuuucucugggugaccaagagaaggacuggcuauugugaucaauguauugauucugaucguggcagaaugaucgauuugcuccucuuuagcauugcuuuucaguuuaguagcagaauuccuggucaggaggaacugccccacugauggagugaagcaagagcagaguguggggacagagauuccuuuguggucacuuugucacacaaaagugcgcuuuugugcaugauaauuuaaaaacagaacucucaagugacauuuuuuaccucucaagguaauuuuuaccauuguuuugagucagaaaagggagggcacacuggaugcgccagcucaggggaggucagagaaggaggguuauggcuugagaacagcagcacacaaaaguuccugcucuaguugaagugcacuugacauagacugaacuccuugucuaaagcuugugcuuuacagcuaucugcagagggcaucugaaauuccuuugguuucuaaucuauggcaagugaacaagaauggaugacaaagggauauaaagauagagcucaaacaagguguuguuaauucuuucuuucaccuaugauaacuaauggaaagcuuaaauuacuaaauucagaggaguccguuguugcuacuugccaaauuguacaugcuugugcgucugucuaauucauauugggaagccacaaacagaagcgcauaauuuggcaaaacaccaaaaacaugccucagcacacuucuggagauucuuccaaaugacuuaaugauucaggaaugugugugugugaggguguguguguguguguugcaugcuguguguuuugaauguugcagagaugcuuagaauaaauuauccuagcaaacuauguaugcuauaccugucuuggggguuggaggacuucccuccaaaauucugaauuguggaaagaaaagcaaagcugaauggcagguuucuuuuuaacacacacacacacacacacacacacacacacacacacacacacacacacacgcacgcacuuuucuuaaauagcaacucagaguaagcaaaacuuuauaacacccugaaggaaaaaaaacacuuaagcugaaaaauuacuccuuccuaaaguucccaaaaccuuuugcuuuugcuugguuguaggcuuuuuccuuuguagguuuaaggcugcaaagagugggucaugccuguaauaucagcauaggaggaggcugaggcaggaggaucaucuugaguuugauguuagcagcuaccuggugagacccugucucaaacuugaauaaucacccccaagguacuuuuuuugcccauuuaaaguauguuauuuaauauuuguuuuccacuuuacaacuuggagagaggauugagccagugauuaaauaccucacccaauagagucuagagauguagguugagaaugucuuccucugagucuggagagguggcuuggugguugacaguacuggcugcucuuccagaggacugaguuuaguucccagcacucacaggguagcucacaaccaccuguaauuccaguuccagggaucugacuuccuuuucugggcugcugggggcaucaggcauacaagcuggaaaaacauuauauauauaauaaaauuaaagauuggugucucuuucugucugugguauuguuuuucaggacauugucaaauucagagaaaaugcuugucugucuugcugcugccacauaaucaguugcugaguguagcuguaauagaauauucuugcuggauuaaauaauaagagcugcagugucugagccuaugcuucuagcaucguccacagcagaacacucuagugagucauggguugagcuagucauacguuuaacagacucuucauuuuugguuaugaguaaaauauuuuuguucuuuuuucauaguuuuuuuguuuauuuauuguuauuuugaguuuuugagacagggugucucuguguugcucuagcuguccuguucacucuaucgaccagccuggaacccagaggucauucugccucugcuuccugaguguuguaauuaaaggcaugcgccaccauagacuucaccuccauaguuuuguuuuuuguuuguuuuguuuuguuuguuuguuuguuuuguuuuguuuuguuuugagacaggguuucucuguguagcccuagcuguccuggaacucacucuguagaccaggcuggccucaaacucagauauccaccugucucugccucccaagugcugagauuaaaggcgugugccaccacugcccagcucccuccauaguuuuaagaaagacuuuguguguguguguguguguguguguguguguguguguguguguguacuggcaaguguuugaacaucaccuguuuuuagacuuuuggcguaugaggauuagagaaaugaaguuuacugaguuuacaaaaguaaaauaaaaacacaggugaggguuggcgagaaguaagaggcugccugauuuauuugcuuuuagcaguacuucauauagcugcuugggaacauggcauuugccuccucggcugcagcagcgguucaguuccuggucugcagcggaggagagggucgcccugucucuuagaucaacacacauaacugagauuaagagacugaggauuuaugugcacagacauuauccuuggaggucaugcuggugacugggauggcucaggagcugcuaccgagccucccuguccuggcggagcucccuagucaugccccacaaacccggucuuccuuguuuacugcaacuccaaugauacaucacuauuauuugucuuauuacaacugugagauugacaguugcaaaaacucuagaaccaguaugaguuuaaguguguucucugauuagagugcgugaaugcuggcugacgaggaaguugacaucagauauauggaaaauggugagcucgggaguccucaguuaguaugagacacaggcagaguugccugucugggagcugagggguccugcuggaggcuuaggccccaggaaaugguuuggaaggaucaauagcagggccacagcauccaaucugaggccacucagccagauuuugaugacauuuuacucauggguuuguuuuuuuuuuaaucaaagguccugucagacuuacucuccaggaagaguugguuuccucaugagacaaugaucgagaaaacaauacucuauuuaucucuuaccuaaauaauguuuucaaaaaguucacugcauucauuuggcuuucucauaaaaugaguuccuugagcuauggagcaggccuggcuuccuccuuguguguuuucaagguuauuuauuauccuucuagaugcugucggaccgguagaguaccugccuuuacuaacaguuaggacuucccucuuuagucuaugaauuuagacaauuuauaugccuccugguauauauuucucaaaaguugugugauccucucggcaugccggagaugcguugcuuuuuaaguucaagccuaaauuuucaguagagccagccauagcaguggauacuccagaagggagagugaggagcaguucuuccuuuaacugcagcuguuagaaaaaacaaaagcaacucagaccagcacagaaguaaauuuacuuaauuaggacuaaggagugaggguggggcucuaggaaggcaccccuucugacaguaggggcucuugguuguugaccucuuaagccacugagagauucugaaaaacauuacagaagacuguucuuaauauuacaugauaucuuuguguauguguguacauguuuaugugcguguauuuguguguggauguauacacguguacguguguguauguguaaaugaugccagaaagagaaggagagaguaagauugcauaggaagaacuaucaguaaaaauaaguuuuaaaaaagaauauuugcauuugcuauuucuuccuuuccuauccuuccuguagaucaagagaucugcaggagcaucagacguuuggacauaccaaguuagcuuugcagacuagugaccauccaccuacgauaccuccuuacauacuuggcagauaauguugcccacugacugcaucucgcacuagggccuuaucugucucugggccucagagaagaggacagaggcugcuucccugagcucggucuugguguauaccauucugcuguacuguggugaaccgggucagacaccaaauccuggcgcucugccuccagggaggggacuuuuccuuugcagcccagagucaggaaacaugaacauuuguauuuucaagaccacauaccgaucgcugugcaggaagugguggagaugggugcugggacugagaauaccugggaacugcugagucucagcuacccguucuggcaugcuuuuagaauuucagccugagaguaacacugauacgugcuuagggguauuuguacaaaauucuuucuuucccuuucaggauuggacagaccucuuguucauucuacuuaaucagcacaaccauguucugugugugacugugucuugggaaacacacaacggucuguugccagauacuucaguuguguuuccuagggauaccuagcauaguaaaggaauuuaauaauugugcaaaccaguuguuaaaaagcaacucgaaaguuauuuucagagggagaauauuuucagucauuaacucuucaaggcugcuagcuaccuuggaccuggccuuccuggcuuacagaauucagguccauucaggccucacuaugugcgguuccuacaggaagaguguugauaaggggggaauuacaaggugugcauuugagaagaaggcccugccuugcagcacaguuggaaguggagacaggcugaggccucugaacacugcugguugcuuacugaucucaucgcuggccagggcuggcaucccugcuuuccuugauuuagaacugacacucucaauauaaccggaacccacuuuucguccaggcugacuaaaucuuccagguuggcaaaguggagugucgggauucccauuguuauguuuauccuggauuucuaucuuaaguugugguuaaguaacauauuuacauaaaucaacucucagagcuggacucuaacacaagccuuuugcugagaggaaaaacuaauuguuuuguuuccugagauuugcuuucauuuuauauaacaagcucaaaggaaguagaaguguuguaugguguugagacugaacuauccuggauuuugcuuuuuacaacagguuuauuuucucucucucucucucucucucucucucucucucucauucucucucgcugguugcugcugcagccuauggaugcugaggagguaaaguggaaaggacagaggcuaaugcuauuagcacaguggccacaugcuuuuccaggacaguuccuguuuucuuguuuucuucgacaaaggaaccaaaagagcugucucuguuauaaagauguuacagaagaaggccgaggccuucaguguacaggugcaaacacuuucaacaggaacguguuaaaaugaaaacuacucgugauucaugcaaauauuuugcagaugugauuucauuaaaaucgauagcccagaaaaaaauuuuagugguuaucuuucuauuaaugaauucauguuuaguuuaagcuaacauauuaaaaugacacauuucuucuaaaucauggcacaaagcagauggaaugggggcuacccuaucuagaaaucaugugcucuaguuguagguuucuucagcacauggaggagaaugagauguuagaagccauuguagguucagaaucuacaaugacagccugcugguuccuagugugagauauuaucuggauaguauugaucaugaacugcacugggagauaaucggacucucaaaugcuauuuuucuuuuauggccacugauugguauuugccuuucaacaauguuauuauuauuuacucauguuuuuaaaaaaauacaagaacuucgugacaaguuuuucuuuucgcauuuaauguguucucuuacuaaauguauuagcaucacuaaaguguaccuaaaauguacauuuuaaugcaagugaacccaaagggaaacaucaucuacccugggugacaguagagaaggacacggggucccauucauuaugagcaggauacuuuucuccgcagcuugauucuggaaagcauuuugguuuguuuaacaaaauucuuacugagauuuaaaguguacccccaaggugcccugugcccugugcccaccuugcuccauggaacgacagugugguagugcagccaggcaugcgguccccuuuuccuuggcaucccuuugagcggcauaagauccauauucuagucucugagagguggaagugugucuuguccagcugaaucuuuuggucugauuuuuuccccccugguccuaauacauguuuauuccuacaugcgacagaucugcagucguguuuucuuucugaguuauaaugacucagaugucauaauuaaucugaugagcaggugggguuauuagcccugugcuucacuugcuaauagcuccacaguuuuucuaaaguacucuuucaacuaaggaggcauuucuucacauagaauaaacaguacagcacaaaagccucaguuagauaacuauccgugggcuugaaaagcugccaagcagauguuguuauuggagcuggcccaggcgagauugggccaggcagaugcucauggggaggggaguagggggagcaaagggggaggagaaacaagugaguggagguugcagggaggaggggggugguucucuaggacccugacaccagguugagacagaugggagguaccuuugugucauauguguuacuuccaugcuugugaccuuuaggcagacacaaaugagggugggauggacgaggggacccucugcaaguauccacaugggagugcucauccagcagucggagacuccugguuugcauuaggggggcugugugcaauuucugaagggccuacggagaccgugcuucauaccuauccacguauguaauggacgugacauuucccagaacacacagguuucuccuuuauugcucuaaauuagguugugcaaacuuaagacaaaaggcugcucuguuucccaucacccuuucuauaauuuuucuuugcacauuucccacucuggauuaaaauggugcaaaguaaccgcuuacuuuucugaguuuaaaaugaaucuugaggucugucagcuuucuaugaaguaaauguguggaagguuuuuuuuuuuuccuaagcugaucuuguuuugguucucugccgugugugugugugugugugugugugugugugugugucugugugugugugugcuaaagcuuuuuaaaacucaucucucacuccccuucacuagauuaaauucuguaaucucauuuuucuuugagcugaucucaagccaauggucuggggauuuuauagccaagggauaauuuuugauaaugggcuauuaaaacacuugcaugccuacccugucuuucaaauuagugugugcagaucgucuuucuugggguggggguggggggaguccuucccuuggcaauaagcaacugauuaugcuguaaguagcgugaaagcuuccuggaagguuugugccgggugcacagguaccuuugaaaggacaaauagcaugguagcuguggcaggagccgaagcacugcccagggguucucuucuccucaugggagggaaagucuuguuuucucuuauccagacgggcguagugucucaacaccaggccaucuaauaguuuacuuagugauggaagugcagugucuugagacaguggugugaggucaugugguuuuuugcugcuguuuaugguaugcauauuaauggguuaaaagugaauaaaucacaggauagaggucaggcagcaccuguauaaauaaugagcuugccuuucaaaauauguaauguaaaauuaaucaaauauguguagcucgccacuuaaauuuuguucuauucaauuaagcuuccuuuuccuccucuagguuguuuuuaucguuguguuguguuuuuuauaaugaaaggauuaaaggaaaacucauagguccugagaaaguacacuuucuugucaguauuugguuugagugugacuaggauuuugcuagcagaagaguaaggucaauaucuuguaguuaaagaaugcaucuggccaggugugguggcguaugccuuuaaucccagcacucgggagacaaaggcaggcggauuucugaguucgaggccagccuggucuacaaagugaguuccaggacaaccagggcuauacagagaaacccugucucgaaaaacaaaaaacaaaaacaaaaaacaaaaacaaaaaacaaaaacaaaaaacaaaaacaaaaaacaaaaaaacaaaaaacaaaaacaacaacaacaacaacccccccccaaacccaaagaaagaaacaaacaaacaaaaagaauguaucugguucauuuuuuuaaaaauaaaaacauuuauucauucauucauucauucauuuauuuaauguauauaaguacacugucacugucuuuagacacaccagaagagggcaucagaucccauuauagaugguugugagccaccaugugguugcugggaauugaacucaggacuucuagaagagcugucagugcucuuaaccauugagccaucucuccagcccuccccccacucauauauguuguuguuguuguuuuuaaacauuacauuuauuugcuuugauuuuuuuuuuaaaggggaaauacaccaugguguguauauggaagucagaggacaacuugugguugguucuguccuucuaccacaugggaucaaauucagaucgucaggccuggcagcagggcgccuuuaccugcugagacaucucacuggcccugauucugugucuuaguuuuuuucuuuuuuauacaaagguuguacuuacaggcauauuuaaaguagcaugaccacauggaucacgaaacucaugcuauguggaagacuuggcacgagagcuuuccuuuuaaauuguaaaguuaggcuucagacacgucgaaguucucagcacacugcuaucaugugugcagaugguaagaacaugccugucucaugccugcaucuuuucucucagucuguguuuuuguugcuccacaacaugacauguaucuggugaauccccucuuuauuauugguaguacuuuaggaaaaccuuucuaaucuggcaacuggaucuugcuggagaguaguucugaaggaaacaaggggcuggguccaaugagaguccagauccccagacucaagggcagaagaugugcccagucagcacaauuuacuacaauauuuaauguuucauaugacaugcagccuccaggaaacuuccacuguucuuuauuggcaaaugcugauuaaaauuguuuugaaguauucauggacugagcuaguguucaggacaucagaucugagaaugcacguucaguccguagacagcacaugucaguacuucccauagcaaacaucuugccauguaagucaucauuuaaaaauacuggauuacaggauuuuuuuuuuaaaauaagaacuauaaauagcaaucacuaauauaucaagguacagacuauuaauaaucaguauaguauauaauuuuacucuaccuuggucuucuuuauuuguaaugauuuauuuauauuuuaugcucauugguguuuuaacugcauguguaucuguaugaggguaccagauaccuuggaaccauggauaccagccaugucacaacuccaugcugggaauugaacuugggcucucaggaagagcuaccaguguucuucauggcugagccaucucuccgucccuaccuuggucuucaaccuuagugccucuuuauuguguauaguuuagacauucucagcuuuuuaauucaacauuugcuuaguacccucugcuuaccuaggacugcacuaaagguuggagaaguauaaagaacgauaaaguguugggcccuguucucaaauaguuuauaaucuaauuuagcaauaaaaacauggguauaaaacuagccaucucacucauacagaacagauggcagacggugccauucaaguggggagaaggcucuacuggaguguaaggaagcaguucaguuggccaaaagaaucgaacaaagguucuuagcuggaggaaagagcggccaacccgugaggccccgagaucuuacaggcuagggcuagcauggagguaagucacuaggaggagugucuugcauggggacaugguucugagugguucuagaguucuuuucuggaggaagugaaggaaaguuguccaaggccaugcugaaacucccaucaaguuguuucuaacaggcagcuuauauauucucuaguagacaaagcuguagaauagaccaagaaaggagaaauuggaguccauaagauuuuaaaccaggcugucucauuuucauacacauccugucauagcucugucuuuuccuuuuauaaguauaggauaugugcuuucucauucguuuauuaaggacauuuuaauugaggaccuauuacaugcuagugauguuuccaaacguguccuacucaguacuguacaagacagauaccuugucuacuuucggggcacuuagcuguccacuggggcaggaaaaugaaccaaaucaaccauuucauaaacgagcaguuuuaauuuggugcuugcagagagugaacagugauguggauggagcuggagcugaagucggggaaguuucaugagcccagggucccuggcaaagccuucuggagcaagcgacuuaugucagugugagaauaaccaaguaucauagugcuucugguaauuagugacacagugugaauauugcuuucccugaugguuccuguaaagcguuugcacuuaagaggaccaugcagggaaaguucccccguuuuuaccuauuagaaagcuguguaggagaagccuuucuuucccaugccccgcugcaggcugcccuugaugaguuguucugucccugugggcagguuuaacuguagcggacauguuuaagagacaugcuacuuguaaaagauucauacuagaaaaucuugcuuauuuuuacagaauccccuucuugcuacuguguuguuuugguaucccuuauucaacucccuacaaucaauuucucugaagcagagcuuccaggaaacagauuugccguuucugauaaguuggccugcuucuauucuaccauugauucccauaaugagaacugcguaaucaauguuguuuucuuccuuugccugugugcuaggaagcucagagcuggaaauuuguguucggucaucugcuuuccucucuaucccauggacagaauuuucugucucugccuuuauuacuuguaguccuauuucauuuuauauuaguggauacuugccgucuuugguuagaugcgacaucaaguuguuacuuaaucagcucucugauuuggugcucagggucugacugagagcagaagucccaggaaugcacugauucuggugacacuuaggaaaggggacuuggcgacgaguggucaggaggucagaagacagagaaagugacaguagccacagcacuggauggacacugaugcugucaucaaugaggggaugccaggggaggaguagaugugagggaaagaucaugagugguuuuagggagaucauagaccgcccuauugcagcagcuaaguagucaccuaacaaaacaaaacagaagagaacaggagaggucaagggagacauuaugacuaugguugcggagcugaauguuauggaagcguuggaggugggccugaggggagaguuugggcccucaucagaggguaugguuagugauuguuggagauggauccacaccugugugcucagcaugucugugucccacuccuuaccuacuagaugauggucugauccauccuccaggguccagcggagacauuuguguuucaguaagcuauuuuuccuacucuggcuaggcugcuugcucuuccuccuucaggcucuggcagaacuuuguguucuccgucauuuggcuucucacacagugguacgaaugcccacuuccaacugagccuccuuuuuguauugagcggggacucguacagaaugaagugucugcggcaucuagaucggugcucagcccugagcucgguucaugcuuguuacaugaguaauugaacuaugauccaggccauaagcaagagaguucuuuaccagaggugccagaugcgacuauauccuuaccaaagcgguguuuaacccacugagguccacagucuucaacuugagguugaugacuuaauugucauuucuacaagaugucuaccugacgucccuuuuucuuggcuuauuauagguagcacacuccuccccauaucuccaaggggugaggagguggauguggcaagcaagaucuuggguaucccguaggggaacacuagccuugagguauuggcuucacucuuaggacccacaucaccuccagaaaggccauguuucugaauacagaagccuuuauucuaucuacacugggacuggcuucaacaugucaauuugaggaggacagaaauuuuuauugcaucauagagaucuucauagaucaccuauggucuauagucuacagugggagguagccaccuuugcccugaaucucaguacaggggucauucuauggugcagguacacuuuacccaaauuaacauccucuaaucugaggacccauugagcuauuuucuccacaagcuugcagggacucucauguugucugugugccuacucuugaaacauugaucauaacuggauaugcucaggcuguugucuggaaaggacuuuccuccauggaaggguuccaggcacaggaacuuguuguguuagggacgagaaugguggaaccugacuuuuuaaacauucucuugcuuggccuucugaggugagguuuggcccugagcagccugugcaggggggaguuuguacuuucuuccagcuuucuaacagucuggauguucucuaguuggaauuuaaaaaguccuaucuuucagaauguuugaaauaguuuucuauucuacaucuuagaauuauguucuguugaaaauaugaacagauccaagacaaaguauguaauucacacgggagagggcagagccccacagagaccuugaaggauuagugcaaauggcucuugcccugugucccaggcauuccucauggacgugugcacucaucucugauucuucucauuuuccuaaagaaaccacagaaauauuccuuuuacccucuguguggcucggcucacagguagcauguguuccucugagcuguauucuucugcccuaucuuccuuuagucucuuccugccuagacuauuguuuauugguguauccuugugaguuaaaaccacaaaugccccuaauggagaaauugccuuccuuacaucuaagaauggcugucgguuaggcuggaaaaauaagacagggauauacagggccaccuaagagagaaaaacaacgcuggacuucuuaaaacuuaacauauaucuggugucaguaagaauacggaguugcuuuuguuuuugguuaauuuugaguggccauuucuuuauuucuagaauguucaguggaaaucgguuucccuaaggccggaagucuaggcuagaggcaaaaccuuugaaguuugucuccuuucuuccuuuguacaucagaauaaaucaaaacaaaacucuaaucccguuauuacauuugacaaccauggaagguuucuacagugugccaggaaaaucaguuuuucucacuugagcuuggaguuuuuaaggcugcuuuaaauuuuuccugccuguuuuaagauguacauacuggcuaguagcagguugugcagcggaccugaugagaguuaagucacugccaaaaccuaagacacuacacaccuguagaagguaccagcagacacuacauaccuguagaagguaccagcagacacuacacacugcagacacugcacaccacugacacgcacaagguggacagggcacaugguggauacuguacacuguggauagcgcucacaccucacaccagggauacuacacaccguggauguggacaucacacaguguggcaccgcauguaucuggggcucagguuuccuuuuuguucaugaacuuuucaguucugaacaugaccuuuugugucuacuguuuagucuucuguaaugggguguuuacaguugccugccuuuagggaguaacacucuauuucccccuucauaguuuugacucaauuuauguuagaauacuuuuagcacugucucuuuuccuuagacaaauacauagagaguaacuggcucugaaaaauaaaagggaauuuuauuuuguuagacaaugggaagagaaggcuggaaguggaaacauuuggaguucuccucugcuuccucagccauuucuucacaguacagagauagccacccuucagucaugcaucaaaacaacacccuguucaacauaguuuguuuuagaggcaguacaaauaacaaaaucguguuacaggugaugacaaaagucuacaacagccuuaucaccacuagccuuuuccuuuuagggggaggugagccagauguuuaaacaauauggcaggguaugugaaugccgcaggacuuggagaccucgggaaagaaaucaugucugcacuccuaguguuucacaguuucagaccccugaccuagaaacaguuuaaacagauguuuaguucaagggauuuaugucaauggugaauucuuuuauuuauuuauuuauuuauuuauuuaaucuuauuuuauuuuugucuuuggaaauugcugccuugaaaaacgauacccuuuuuuucuuuucuuuaacuagaaaaugaaccuuuaauauuucaaagcuucuaguuuugugcuaaaacucuugacacugaugcaggauugaaacaguggaauggccuccucucucauuacuguugaggcaaaugaugcaugucaccucugucucuccucccaccucugucucuccucccaggugguuaaacccagacuggcaacauuaacagaguuuccuaaagaagacaagacccuacaaacccccagagaucaugagccagcauacacucugcauagcucuuccucuucaugccugcaguccaggccuguuuccuucccuccaguuaagcuucuuccuuuagguaauuuccuccaaccagaacccuguccucacagcaaagccgcccuuauggaagugucgguuucauaucugagauguuuuugugugcguuugcucugcuuugacuugcacaaggagaaagaaagcaguuuuuuacuggaggcgaaacagccaccugugaaaacuaauugcguagguagagguuugaugguaucucugggagagauccagccggaagaaaaguaaauguucucaaucuaugcggaagucaccugugugccaaacugacccucuuuaucaaagccaagacugaaaugucccaucaagcauggggcucauauuuagguggugagauggaguggggagccaggggccggggccauggggaaggcagguauagucuguguuccugaacagcccugaucaguuaaacaaaagucaacaugguggacucuccacggccucuuuaggggcugaauaugauguccguggugaauaguuugaagcgauaguaugagaugguaccauuuugaguuccucauuucucuucucucaccacucuuuccccuugaaaauuucuuuuuccuucucuagugcuguagauuuagauuuauuccuugaucuuaccauucuauuauagcaauuguuugcaacaaaaagggcagagcuagcuucagugcugaggcaggcacauagugccaccaucuguggaacccugugucuggaugauugucacauaguuagaaagcagauccaucaguggcaggcauaccgccucauucugccaccagugcaguagacugaucuggcuguucgcuuggcagggucugaucugucuugagagguucuacaucuuguuguccuaagugugugauggcuauggucuuggcaugaggcgugcuggacaaacaugccagcauguuuucuucauuuuucagccagagagggcugacagcacagaucugaucgagacuccuccauggccucccucuaugggaaaccaacacuagaaaggacagauaauuuucuauuauauaaagcacuacaaaguuuagagagauuuuuaggaagaguuacaugaucuuuagaggagcccaauaaaaaaaauaaauaaaucuuuagaaagagacaaagaaguuuuccaaaagcuacauaaacuaaauaaagaugugaauuaaaaugacauuuacaugauucaaaaaaaaaaaagcaagccuuuugcuuggaagacuuugggcauauuuuuuacuguucuuggugauaguuugcuaaguguucaaguggggucucagugcauuuuacucaugcugagcugucucaggaaacugaggauaagcgaaccagagggcuuucgcagagucccugcgauccucacugacuggaaagaagcuggaucucugaaguacaagggacuccuuaccucagugccucuggcuccucccaacccauccuuccaugcuagugucuuguugguucuugccagagccaacagcucucuccugcaucugugaccuaggaagccuuccccuuccagccaccaccagagccucuucagaagccaaucccauagaaagcaaaccccucugcaggcuguauuagaaacccacuuuuaaauacauccccagucaaccugaauaucugauucuuaccaaugcauuucuugagaaaaggucccuccaucuuuucugagcccauuggguccuugcuuauaaggacauuuuuaauccugcagagcacccagucacugucaaguauacugugcuaucacuaugccuaggaauucagcgcauuugauauauaauagauccugaacauucgucagauugccaaggaucugcauuuaccaugcauuuaucaugcaauuaccaugcauuucuaaaccuauagguagccuuugagaaugcaauguccuucucaagcaucagucucugucuaagaacuaucguuuauuuaguccuuuucagagagagagagagagagagagagagagagagaacacacuugacaugaaacaugcaagcgugugucugugaauauggaggccagagcucucucuaccuuuuuuuaauuuuuauuuauuuauuuauuuggagccagggccuuuucaccuaacuggaugucaccaacuggagcagacuggcuggcucccguacuuuuuacagggccucuuaucuuugcauccaucccuaacugccugugcauggugcuggggaucagagcucaaggagucauggauaugaaaaugcuuuguugacugauacaucucuucagucuucccuccucauuuuauuuuuaaacaaagaauaaugugaauugaaauaaaacauggaggaugucauugcuucuggcuuucuauguggcagugaguggggagggaaccaaaugcucucugagagugagguggucaggguuucuacuccuaagagagucuccacagucaugugugcugagucacagcuuuuggaaagucucuguguuuugauggauaaccccuuucucucugacaugauucucauuaauuguuuauaggcuguaggguguggaguagggagauacugaucuacuauguagaccuccaaaugaaggcauucuccaaagaaggguuagugacuugagcaguggauucuguguauuagguggagaucucaguuucaaauccaguguguguguguacaagcacacucaugcacaugugugcauguauguggcaaugugugugcuuacuuuauuuuuauaauguuuucacauaacaagcuuucaaagagaaggacacccucacuggccugauccaugaagacaaaguagagaacaugccuccuaguucacaaauaagaacgcaguagaaaagcaaacaguucagauccugcgaccuuuucccccaguaguuuccccaguucauguugaaccuccagcaaaguccuauuuguauuuguuucuguuguaagauguccaggagaaacugaaaaagcaggcugcuggcaacagcaacacaggauaacaaucggaaggcagcaagguacauccucugccuucgcucaagaaguguaugaguuccuuuaugcccucuuuuugcucugugacaguaguccuggccaugugcaggagugcucucagauacuuagaccacacaauccugccuaccugcaacauuccauaacuggaagggcugaguuuucauccuaacccugagaacauugcuccugcacuuguaagcacccagugucaaacagccuguuguuuaaauugcaugguagaauauguuuccgguuagagcauuuaugagauugcaguagacgcgaauggguguucacagucaugguacccuugcucccauugaacucacaucuuaagugagccaucuaagaguucucuuacauuuacuguguccauaaaagagcacucaggaugcuugacaacaacaauagcuacagccucuggaaacauaaaugaugugcggggguggggagaaagucuccucuguucagacaguuuaguaaauugcauuauuuaagcaaaaccuaauuaugggagaggcugauauaauggucuaagaaaaccucgugguuuucuuaggaugacaucuuuaccacuguaaugagucacucugcccauuuguguucaauucaaaggacaacaaacuauagcagguuuguuguuuaccuuaucccuggaauuagcuguuauuagaggguuccugaaguuuuucuuccuuguucauucuauaccauugaacuaggcaguagggaugcuggugcuugcugaugcugggaauucagucugauacccagcuuguagacugucccucugcagcugugcagcagcuggagcaaggcccagcuguacuguguucuagagugccacucacuuuuguaugugcauucucuuauuuaauauucauaacaacuucauaccuguccccauuuuaaaagugauggaccccuguuaaacacuuuccaaaggccaaacaauuugcaggugucaaauuuggacaaagaaccagagcaaucugacuuuagagcuguugcuuccaaaucauuaguuaauacuccuuagucuauaaagcgaagaaccguuacucauguggguccuuccuccaggaucuucuuccacaccaaggcagcuugacuuucaacugcacccuguucagggaggguagagcauagucucaucagaagugcaggaacagcaaagcucauccagauagagccauggaaacucaguuccuggaggcaggguuugggauggcuugaggaugcugcagcaggcagguuuuacaaacugccuccggaaguggugccauguuggagcacuccaggcucccuccucucaucugcuuggccuugccccuuaggaccaucuuaagaacuuauggugauuaaguaccuguaauucuuaucauucuguaacugcccaacaagcuaguguuucugaacauccuuaccaucugaugcauucacuuuucuucugguaguuaguggucuagaggcagaaauaugaguaguauauuucagcuuuucuucuuucuacgucaguucuugccaccaaauuuucuucuaucacuuuugcauauauguuuucaucacugugugccacaaugaaaauuauuguauagacugaagguaacaaauuuuauguuuuuaaagggagaaaacuuuguuaucuagugaaaaugucuuaggaaacaauuuacgccuaaauguucagacugagugagaaaugauucauaauuuuuuuucuuuugacuacacucucccaccuugaaaguauauuuugggguggaaugaaagcucaaaauugaguuuuuuuuuaaggaaaaaaaauaaaauuaagaaguacuuugcuuccaaauccagcugugcuggaguuuaaaugagugcuugugucaauuuuauaugugaauauuguaaggguaugaccuauggggaaaggagucgagagugaacuguuuugggaaaauguuuuuuuugcacaagguguuugcuuuuuaccuuuacagcagccugcacaggcagguacuguuguuaccuucagcuuauggaagaaguaacaggccuccuggccacagaagucauguguacugaaccuaagcuaggcacuuggaaucuagaauguaaguauuuuuauacaacaccuuaauauaacuagguaggaaaaaauaaguuguuccuguaauccgaggcuuguuuuagagaaaguugaguuaacuguuuuauaaagucacucugaauguacuuugaccaucauucauauauaugauccccagaaccagguagguguuccucagcacauaguaggacugcccagugagcuagacuguuuacaaaaaauuuauaacaacugugugaaagucuaaaacuuucuacauucccaacugucccauagugauaaaaguuuaccuugauuuuuguuaucuuuuaaaaggcuauuuaagggggcuaagcugucaccacuuaguaagcacuuuguauaaaucaaaccauguguaacuauaaacauuagugaccucauauaugaugcugagcagucccgugccuagccaucaguaugcccaggaccuuuauuuuauacuuaguuaauaugucacugaucacacuucuuuuuaaugaggacugggaagcaaggugacgucagaugcucaaugucacuaguauauauuacaauagagaauugaagucuaugagauuggucuuucuuuauuaaagacauaccaucaauuugcaggagacaaaaugcucagcaaaguucacacuuccucuaauuucugaacaaaaaguuuucaaguuuuggcuacucagauucugcuaaguuuaguuuggaauuuggaggcauuguuaauacuuucuuuuauaaacgaaugcuuugaggcccaccacuuaaauaaguuuugucuaaaguacacuaaagaguaaaaaaaaaaaaaagaaaagagauuauuguuauuguuuguuccucuagcuccgguuugcuagcaugcauauauaaauauauucuauguauauauagcaugcauacauauauacacacacauauauauucuauauauauauauauauauauauauauauauauacauacauacauacacacauauauaacuauguauacagaauccuaagcaaacuguauuuaaaaaaaacuuuguucaaaugaaggaggccaguuauucuuugaugagacauugcuaagugugcuguaauacuauuauuuaucucaggaugcgguauauuguugcagaugcuaauauagcagacaaggcuuugcauugguggaggggcuuuugagugccugcagagaggcagugcacgggagaacuguaaaguaaauuagucucaucaguucaugucaacucagcaaaggaucaugaagugcaaccccucucagaggcaugcuggaugaacucagugagucaugcagggccgcagcagcuuggccuugaagaagagggcaaauauuaagguuugagguacuguggagggcacugugggggcuuaugccugguuugggguagaagagaugucuuaaacugaccuuaagagaugugucauuuaugagagcuauauuagccaaaggaaauagcaugagcaaaugucaaagggcaaggacguccaugcuacccaguguggcuggaagaaagcacagauauggaggccaacacuuagugggagaauuuagagacauaaacuaguguuaccuuguagaggggccuugcaugcugcugggagaaaucuguauuccuucaugaauucagcgaggcacugagggcacuucccacucucccacuaguucuuagauuaucucucaacuuggcuugugcguuauuccucacugucagaggaucaacauuucccaugaaaagcugucuccucugcaguagagcuucuuacccuacucagaaaugaaccucaaccguuucccucugcauguuuccagcauuucuugaaacaaucacuuugaggacugucaaauuauccagcuauuaucuaauuggugacagugguuuagucccuuugcaccaaaggacuggcauccugcaagcuucuuucuuucagacauuugguagagcaucacagauguuaugcuagagguaagauacaguguaucuacaauggaaagaaaaggccgggacaaaagauaaguugaauagucaaagaugaguuaucaccaucaggaagagcaaacuauagcaccugauuagacugaauaacggugaugacauugacuuuguaguuguagugaaucuguuuaaacuuuuucauaaguguaaugaaugaaaauuaugaagcauugauuaaaaaaaaauacagcuuucucuuggugugcuuuucuggaaacucaccuuaccuuccugccugcuuugugcucugguggguucucucuuccuuccagaacuaccccucccccucccccucccccucccccucccccucccucccucccucccucccucccucccucccucccucccucccuccuucucugggcuuuucuuacuuugcaaauuucuugacagguuuacuucuuauaccaguuuaccugaauuuaucgaaggcaagagucacucauaagugcaaccccuuuuagcaagcagguaaaaaggcagagccuuugugguagaaggagagaacugacucccccaaauugucuccugauguccacguguacuucuccacacugcacagaauaaacaacaaacaaacaaacaaacaaaacccauguaacuaaaaauuagaaaagaaaaucagaaauacuugagagcaauguugaaaagucuuuuagauuacugagccauggacucaggaugugggcaguggggagcuccuacuacgccugccucuugcaguccugggagauuuuuuuaugcuucuccuaggagaagaaagauuacaaaguaggucguauuuuuaauucucuguauugugcguuagggagugaaauaguuucucucacuaagcgauaaggauuacuaguuuucaaaaccacaguuuuaaaaacagaguguaugcacccuuguaaaucauguagcaacugacaaaacauacugauaagugcaaaaaugaacugguaucuuaacuaccaugcaaggaaugugggcauaugcugaugaaggugucugaaucccaccgaauucauggagcuuccuauuaauucucuaguaaugcaacagaaacaaaaauccaggccugcuucuauuuauuuuccuacccagcuggguauuugcaaagguuggaccucucaagcucuacccugcccagugagcuccuguacucccuugucuucugggcagauuuugugugcuggcugcaugggcaggacaugggucucuggaacagacacauagggauuagcugagcuccccuggagucccugggcccuugggucguggaaagaguggugcccuggugugucugugaccucuacuagugaagugcugcacagcucacugauagcacucccagcagccugacugacugguuauucuggucaggagaaaauagcaccgacaucacgugauccuggcaaaguagaccacauuggaacuuagccuuugaauacccaaggggcuggcagcaaucucagggguuggcugggagccccauugaguucacuaguaaucaguugacugcagagcuggacaagcugcucccguuuuuuuuuuuuucugacaagcuccgucuaaaagaaugaugggcaguuugccauuaggauuuuuuagcagaguugcuaaugauuaacucuuuagcuacgacacauacaucaugccucuccuuauguguuggcaugcaguuagauaaaacuuuggaggcaagauucuaauuccuccugcaaccacuguaccaggaauuccucucuuacacaacauacacccaacggcgaggaaaaacaccccauagagcccuuuauaugcagauuucaaaggaaugccaguagacugguuuuccuugaaguuucuaauuuguugcuuuuaaacaaaaugcuauaaucuuuaaucaccuuaaaugucaugcgcuacaccucaggcauaccuagggaauagauaucaccugcaagaaaacuuuggaaagcuuuggcauuuaauauuuguucaugauuuuauaaacacauucauauucucucguccaaauccugugauaaguauuauaucucagcaaagaaguauuuguagucaguuaccauaaguccagagaagcagauucuucuugaucaggcagaauuccccacggauugauaggcuuuuuacuagaaaagaggugauuuuguaguaaccuuuauccuguucucuacgugcaucaaauaaaguccuguuccugggguugcacgucuuacgugguguaauucagcaaacguggcauguucacucuuguuuuuuguaggaaguuuuuucuaagacauauauucucuuuucaacagaagcucuuacaggugacugguaccacuccccugggagcagguugacuacagcaggcgugaugucuugucaguggauuucagaguuaguuuaccagaacauugcaaagccaaauagagccuaaauaaugccgggcacuaacacaaacaccugcauaguuuuuucucugagcuaacaucauuuuugaagcauauaacaauccacugaaguuuccuggaaaaaugcugccuuuggcuuauucuaacuuccuuuauuucccucuguguauuucaggugcuguuuagacauugaaagguaucaguuuuguuuuguuuugguuuugcuggcauuggguuauuuguuaauucuaggugucagagauugaagcuaagcagggagaacugagaaaggcgucucccuuggaugugauuuaauguccagcuuacccuugggcacugaguacuguaaagccagcgcuuucucugcugccauugccagugcuucuuuggcucucaauuuaugcuaucccuauuguuaccuucccucucacucacucuucuuacugggggucaagcuucaugguuguaaacuaucagcugaguaaccugggagguuacauguucucuuuccccguaguuccagucaaguugucuaggguaccugucauugguuacuucugaaccaaucucuaaaugauggguccuucauugguagcaccuggucuccuguucugagaguagaagacgaacccaggacaugcaaacuaggugcuuggagugagucaacaaauacaucuccccagagggaaauucuuacuuuugauuacaagaaaguaguggacuuuauccaaacaacaccuuaacaggcaaaccaacuaaccagauccacuauagaugaaaaggauuacaguuuaucaagaugcuacuuuuuacuuuagcaggagugaaauugguaaugagaugacauucaggcucacagaguaccuuagacaguaugacaugccaugggacacguauguuuuuauuuuggaccuucagaguaauccuaugagauaagcauuuaaauccuccuuuuaugaaauaggaggcuggcaucuggugaaauggaaucacuucuuugcagucacuaaggaguggggagagccacuacaugccuuuggccaccuugucuuagaguugauaucugugccauggcagucggcacucugggcucaaggcaaggcagaaaugucuagauggcugguaagguuuucugaggaaaguaguucaggcuuccuuccuucccucccucccuuccuucuuccuuccuuccuuccuuccuuccuuccuuccuuccuuccuuccuaauuuccuuagaagucugugguaaagcuaggacuucuguuaguaaguuguuggugguacuauuuccaggaagacauaacaaauugcugcauaccucagauagagaaucaacagcagaccaaaaugaauaccaccaaaguuccauuuggugauccacugaguuuuauuggguguacuuccaggagugugugugagguguaacuuuggggaacaaaaaugacggaaagacacugacaucaccaaagcccacaccacucugggugauuucucacacacacacacacacaaaaaaaaaacuggaaccaaguaguuugucaggcuggagaaugucuuuuucaggccuagguagucugagccucugcuagacagcuaggcuggacucugccucuuccagguaguuuggcuuggcugaucauuguggucauugucuccuaaagacuuacauauggcugaagggggaggagcccaaugaauuugauauguuuuagagacgcccugaaaccaccuacuuguuuauuuccugugucauaaugaugcaggauggauuauuucaccucucuguagaacacccugugucuuaaugagcugcccucuaaaauggaaauuuuaucuuggaggaaauugccacacaacaauagugucaccaacuugacccaccuuauuggauggcugaugguaagacucugaacuuuagccagaucugucugaaaaauggugucaguucuguuaggaaucugggagauuugugcuguauguggguaaaguuacauguacuuagcauuguaccauagauuuuacugaguagcuuaacaguuaauccuauauuauugaaauacuuuugacaagguuguaagaccuaguuuguugggcugccaugucauagucacauaccauaggcuaugugacuuaagcaauaggaauuuacauuuuuuaacuucugagagcuggaaguucaagagcaggauguccccauagcugagcucuuguggaagcauucuuccuggacugcuggaagccaucuuuuuacuguguguuuauguagagagaaagagaaaccacugauauucaccguguaggcauuuugcuggaugcuuuucagcaugucucauugguuucaaacacuaagcugcuagcuuugcuuaaacacuucaaauucaaacucugagcauguuuuguuuguuuuuuugucugauuuuuguuuuuccaagaaauaguuucuccauguagcccuggcugaccuggagcuuacucuauagccaagacgggucccgaacuuagagauccugucucugccgccucccaauuguuagaauuaaaggcauguaccaccaccaccaggcaaaauccagagaaaugaaaaaaugugaccaagaucaaacagccaacauguaucagaaguagacaugauuuugaauaccacauacguauguuacacauagcagauaugagcauugauuguauaauccaggggcggggugugcagauagaggcuuagaagcucaagugaggagccauccaggucuguuggggaaauuuucagugagguugaacauugaugucacagaguaaaugauuccccagaugagagacagaggagcacucugauggcuggaaaacuaauucauaugauggcgugguggccuguggaucugcuguggggauguggagaacaggaagaauggacuucaagcucacaaagcccgaguucaaaauccaagcgccuugccaaugcucaggauuuggauuuuauucuagagcucauggaaagcuacugaaagccuucaggggaaauacaagugucauaauuaggucuagguuuuggacaaacaaguuuuaaaaauacaugugcugauuagcgagcuugaguuggaaguccagcuucugcacuccuuaggaugccuugcccccucuuugcaaccucagacuccucaucucucacccugcucugaagugauacccgcagcgcaguccugccuggccugugcagauggaaugaucacucccuucucuguccugcuccgugauuuauguguagcucuuauagcuucuaucacagcacaggguaacgauguguuuacaugucucucccacagcuugacuugaaggaccuugugagaagggaguauguuuuugcugguuuguuucauugcuguuuugcuugcaccaucuaugguccuuggcacaucacagggguuccuguuuguugaauauaacacauugaauuaaggccacucugagcaugaggaggaaagcaagcacagcauagaaagaaaguggguguagucugggugcagggaugaggaaucaggaugauucugagguuuuuaacauaaucaucugcaggaauuguuaacuucccagagagggagggagaaccacugaacugggagcuacguuuucuaauuuuguugguuggguagggacauuuuggugcuauguagcagauaaauaaagguacacauccgaauuuagcucuguuggauccccaagccuuugaagaagaaguuugaugaagauuugagugggugagcauaucagggacacaacuuugggggaaugcugccuuuuaagggacuagguagaggaauugaaauccaaagagaauaauucaaagccucugagaaguaggguuggaaacaggagugugcagagcaguugagcacauccuaggcugaacugugggcagcaacuuuuaucaugggggugggguaagugaguguauguguguguagaugugcucaugaguguaggcaucaguggaggauaggagagaaggucagaucuccugggucugcagccaccagucacaggcaguugugaacaugagguguugugaccugagcuuggguccucuacaagaccaaacagcggacaggcauuagaaguggacgugcauugucaauguacaugcauaugcugcaagaauacuggcuaaauacaauucugugguuuacuaaucaaugaagacaguggauuuucuucuucuuuuuuuaaaauuacguauuuuccucaauuauauuuccaaugcuagcccaaaagucccccauucccucccccccacuccccuacccacccauucccacuuuuugacccuggcauuccccugugacaguggauuuucaagucaucuguaauauaauuguuuuccuuucauauagaggaaaugaauauuugguugaguuauauuauuuuugaguuucucucauuuaaaucagcugauucaaaauauauaaugauggcuguaauauauuugauuagucuaauauauauuuuaacuguguuuucuauuguaaggccauauuguugcugguauuuucuuuacaaaauucuuauacuugcauuguacaaccugaacuuuugugcaguggaguuguuuaaacaagaucccgaggacuugaagccauuacuuugguuagugcuuucaugcagcacugugugcuuaagagauguacacaaaagcaguuucuggaaauauuugcuccuagucgcugcaccaguauauauguacuuucauauauaauucaggaaagaaaaaaauuauugcauauaauagcauaggauuacagcauagagguacugauuuguguauucuacuucagugcacuguugguucuccagagaccacugugcaguaauuuucacagaaccagacaguuuaauuuugccaagagaguccuuccaaagugcuguccuguguuuuuagaggcggugucauuuuacccuguccuuugcagagagcccccucugcagccaggacucccugcagucuggguucaccuuuuacaucucacuccuaccccaggcuucccuaguccuuccauagauaaaccucucugccuuuuaaaaugcugaagggaagccagagacaaaaccuggaccagucugguuggguauuguucuuaagccugauuugguaaaucuaaccauagaugauuuccuggcgggauauacagauucaguucucaaguuuaucuuucugcauuuaaaaacaacagugacaaaaaacuaaacaaccacaaaccccaagcucucccagauaggcccuuauuagauucuagggucuggagggugggauauuggguagaggagggugacuaggcagccauuacuucaguacuccucccaccugauguuuuccauaacugcuucaucuuugguuuggaaauuagagggucuacuuuuaggaaccuuauaaugcuaaauacuacuuuuugauaauauaaguuccauauccucaaauaauugaauguuuucuuccaucuauauguuaaagugaaaauuuaaauaaaaguuuuuuuguuuuauuuuuguuuuguuuuguuuuguuuucugagacaggguuucucuguguagcccuggcuguccuggaacucucucuguagaccagguuggaccuugaacuaacagacaucgaucugccucugccucugaagugugggauuaaaggcacaugccaccauggccuggcuauuaucagucuguuuuaacaggaugguucucacaagaucugugucuguaaggaggaaaagaaugaggucuaaguuuuuuauucuauagucugauaacuaaaauaucugcagacguggauaaaucagcucugucuuuacauaaccauuggauuccuuucaagguacugucuccuaaccaacauacuauacaaauaacuucgguuuaauauagcuauaucuugauguguuuagauuugguaaacgcuccuaucuuucaaacaugcaucauuuauuuaaaaugcauaggcauauguucagaacaaaguuauuuucggugcauauauauucauuagccucuguguaaaagugcauuucaaggaacaaccauuugaauguuuauuuuucuuuuaaaacuucccuucuccuccaucuugcuuuaauugaacucugagcuugaaugaacucuuuaaagccauucccauggagggaagagcacaugcaaacgugcuugacugauauaaaauaauuucuuuguugaucauauacccaugcaugauaagauaugcauaagaagaaaucugguagagaaguauaaauaauacuuaucuuuaagccagcaucugucaucugcuucagcagacaguacuugcuuucuuccuagcacaaaaagggccgggagauuuauggagcagcuuugucucugcucugugaugcuuaaucaauuuuuauuaaauucuaaauuaaaacuuggcuuucgcuccagugacaucucugauguauacaacacggagaaagaucaugaggccccgcaaagguuaagcacgggugguccaaagccccagucugcugcuccuucccggaccucacugguaacucuggccaaguucuuggagggacguaggagaaucaggagugcagccucagcuuuggacuccccaguuuccuucagcucguggguauuuguaguauguuuauaguacucucaugcauguccuugcaucuaagaggauauaucaguucuggcaacguacagauaaugugcucauuuugcauuccaaacacucugauaaauuaggacucaccaguuauaauugcagagaauuugaauuuuuuaaucuucauagaguuuuuccauauucaagaccugauaccgauaugaacauuauagcuuuuuaucuucccugccugaauuuccugauaagcucugcauuuggaauguucuagucuuuuccuaaaaauucucuuuaaauaccagcgugugguagaaguccagucaaagagaccaguuuaaaaaugaccaucuuacuuggucaaaguaugaaccaaguucgacccugcuuagcuucugagaucagaggagauugggugcauucaggaucguguggccauagcuuauauucuaauguauaugaagaauggagucuugugccaagcugaacuuuuuucuucugcaggaaacaaguuuaacaauuccaguugugauuuuuuuuucuuuuagauucugcaucuauaaggagaggaagaaugggauuuaauuuaaauuuuauuucucugcugaaugcugauauuuuuguuuuugaauuuggcuuuucuuacaucugguacacagcagacuaaccuguacauauuauuccuuugaaagcguauguuuaugggcgcugauccaagagacgcuucuguaucuacauuucaaaguggaagguuucuugaagaaaagaggggggagaacuaugaaauuuguuguuaauuauuguuuauguucugggaaauauggcaagcuguaaacuuacgaugagaagaucuguguuuuugaauuauguaauauguuccuuaggaggcaugggauugcaggagaaccugggagccaaucuuuucaugcccagugaaaauuaauaacucaugcagcuggucccugcccaucacucaucuguccuucaccacauuuauauuugccuguugcacaccaccauauccuaguuaccagugccauguggacccagaaaugcugauauuuagaaacuguauuuaucgcugggcagugguggcgcacaccuuuaauccuagcacuugggaggcagaggcaggcggauuucugaguucgaggucaauguggccuacagagugaguucuaggacagccagggcuacagagaaacccugucuuggaaaaacaaaacaaaacaaaacaaaaagaagaaauuguauuuaucuaccuauuacccagggcuugguuagcauuccugacuugucucguuuuuaguaucaaccugguacuguagaaacauguagguagaaguacagauaccguguucauaguucaguagcucagcucugaaaacagagaaugggcagggaauggcccaguauaucuggcccucaucuccuggaaguguauuuggucucugugugcaccacccacguggccuucuuuuucugcugguugagagaaagccuuuggacugaucccuaguguugagcaucccuaguggaaggugucccugcucaacuugaugcacagagagacuuugaggauaaagaagaguugguccuggcuuucucacuucagaacuguaucuuacuaugcccuggccaaagccacucgacuugccgacuguggaucgaggagaacgcucugucugccuucuguguuucuaaggggugauuuugaguagaugaacugaggcuugggagagguugccaaaugagguggcgaugauggcuaaagagacugcgacuucgggagugcuuucuggcagaaguacaacacagacgguaucauguuuuugaccauaguacuuuagacaggcugccaaguguuugugaugagauagggcuguuacuauacuuugcuuuuaacuuuacuuuugcauacaguguaucguucuuguuuuauaaacuguguugcauacuuuugucucucuauaaacaagugaagcuguugaguuuuuggacaaaguuugaagcagucuuguguugcuucuaugcuuuaugcuccaaguugagagcugaauagugagaucuuuuuucgcaccauuuauaaugcgaugcacauuuugaaggcaauuuaaauucuuuugacuccccagccauaugcuucaaaauggaagcauucuacaugucugaauagagaacuagguagaagaguggcucacacaugcccagcaaagucugcaguggguuauuguccucaguggggcaguccagucucuuagaaaaucgccaaguauuagccccagcuuuguugaaggaaauuuaaaauauuuccaaggcuacacaugaucauugauauucagaauuuauacgugugaugagacuuuauaacuuguccagcauauuauuugaaaaggugucaauauggagagucauaaacuuguaagucuaguuugugauggaaagacaaacgcgaauaggagugagaacugcauuccuguuuuguaaucgccguuuuccccuauccccuuucaagaucauauucuucuucguuccugccaccgaccgucucgcaguuuauuucuaggcugggagaguggagugaauacucucguagcacauaaacuucuccauucugcuucucuagagaauauuuuucauuguuuucacaauccauucugcccggguagaaaacaccagaucucuccaauauuuggaagagaguuuauacuuucucggguagaaauauccuguugcuaaacuucuuuuuucauaaucacgcugauguguuguggucaugcugcacugaccacauggaugccaucauagaaguaauuuaacagauguuuggauggcuaggcuuaugcaccuuuuuuuggaguuuagggggcugguuucuuacuauauaucucaggcugacuugaaacugaggaugcuccugccugauccuccccagagcuggaauugcagcuguagagaccacaccuagcauuuacaugucugagguuaggacacaggcuccuucccauucucauuagaacugucuucuuugucucuuccuuccauuucuaucuuaguuaaccacgggcgugugauguuagauuacauaaaaaagcaauugucuuuuuaacuuucaccagaaauggggggaggguacacugaccaccuaugagucauaccuuuuccugauaacaauugcuuauaggucuauugaccugcaccuguagauuuagaauggcagcacucuugauguguguacaguugcuuguacacacacacacacauacacacacacacacacacacacacacacacacacacagagggagagagagagagagagagagagagagagagagagagagagagagagagagacaugguuuucuugucuugcucucuguguaaauaaaaguuuuuaaagauaaauuaauguucuucucuguagcacucugacaauaacuuguuaaaugauugagauuuauuuugcauuuuaaggagauuucuuacgaugccuguuaaugggaugcguucguuagcauacuugaacaaucagcaguaacauccuuucuuauuaaaagcugugcuauauaacucaacagcuucacaauacuuaucccuugauggacuuucaccacuaacugaccucagguuguuugggaaacaaggggaauggggacugaggauuaagaaccaauagagagagggaaagaaaagaaaccaggaacugaacuugguuuauuuuugagaaguccauggguugcuauuucaguugggugaaacuguguuauuguuuaucugugcuuucuuccccuuguggcaagagacguggugaauagacacucacucccaaagacaccaauuccaaagcccugacucaugagcccacaaugaaauacgaggaugcagccauuuccuaccuuuguuugagagcaaauggauuggcccaggcggaugugggccuaggcugcagggcuuugcagaaggaaaugcuuucgguggcccuucaguacuagaugcucucuaacaaccccuuuguauugcccugcacagagcagugcagugugaaaguguuccagagaguauacagaucuaguuccggggccccugcuugugcacuuagagcuucuaugaggcaggggaaguagagagagacuuucauugcuucuaaggcagaggauuuugaaugcuuauuauacaguguagugaaugcacauaccuaucgcuugcuagcaaauuccuacgugguugcagcuucaacauauaaccaugacuucuagguaccuuacagcuuggccccaucuuaccucuucugcaacaguuugccuaagcucuguuacaauguugccugcuuucuuauguuacacugaaacugaccaugucaccaccaucuagcauucaugggucucugguguuuguguucuggaaucucucuuucccuggagaguugcagauuccucuugcuuccuuauuuugucccaagucuguccaaguuaccugugccuacagagucucauaucucuuugucauuccucucccaccucccaaacugguugcccuggaacuaccucucaugcgauacgaauuucggucuuuauuacuguuccugaggcuugcuagaguguuagccucaugagggguuagagcuugagucauuuugugcucuuuauuccaaggccucaaauauaguagaauucauaucugucugugccuagaacuuggaggaaaacaggagaucugaauaaaugaagacccacugugggccaucaacagauggugcuagcuucuucucuugggccauuccaggcauugcugcacuucaggaugacuuaguuucccaucuuauauguggaaacaacgauuugcacacucagaagcauucuggaggucuaguuaugaggaguaauucuguguagugaaaaggcaaaauaccaacuuaauguucugagaaacaguacagggguaacgaaagauaguguguacaguggauggugcaucucucugggcccaugguuuuucuugugugcucugucccugggcacguuuucagugauaaugcuuggaaugguuuugcaagggaggaguaaaagacaguugagcaugugcaacaugcagaauagaacuuggggguuggggcaggcacaguaaagucagaagacgagacaaaugagaaauggaagcuguauguugucauaauaaccagugucuuuucucagacaugauaguuucuuucuagaacuuucagaacugugauuuuauuuuaaaccuuugaacuuauucagucuggaaagaauuucuucugucuaugugguccguagccuacagugugguguaugggucaguggcccuacuguugggcugccuagcaagucucugccaagaggauagcauaggccgaagugcguuuuccagugugaggguauauaggagauaaggaggugggaggggggagaggggacuagggagaaggggagaggggagauggaaggggggaggggggaggagagagggagagagagggagaggggaaaaucuggauguucuccaggaaggggcuaggagagaacucgaggacaaacgcuccuacuuggaacacacaccaaauacuggauuuuuuuuuuuaagagaagccaaaauuaaacccaguagagcuuacuguuugcuaaucagcauguguuuacuuucucuuccaaaacugaaguugccauccaauacauuuccuacccagugcuaugaaucuguccaaauaaacaugggaaguagcgaaacaaugacaccguacggaaaaacgucuccucguucauuaaauaggauguaaaaugcccugggauuuaauccuagccgcaaagugaagacugacacggccugguucaugaagggagggggguggcuccccucuugagucagucaacauggacgggcaggauucuaagggaacauacaauuauaccaugcuguccuaagccuaaaugaagauggcucauuucaguccaguuucacuuauguucacugugucagaauauuugguuguaguguaaucuucugauaacauaacuuaagcaacagacaguuuuaauuuccauccuaaacuagagaggucgcugacagagguuucagggugacauuaagagugaauuucucuggaggacagaaagaagcuguggaaggaggcuucuuuguugcggucagucuugaagaguacaguaggaaacaaaauccauaaucaacauuauagaaaaccaucaauucauaagacugacaguuuacuuaggcuguuaggagauagcucuauauagaaagaucaugucuuuuccacacgugugaguuucuauaaggaacauuguuacaggaauauggauggagacauaguuauuccuggguuuucauuaacaguacauuauaaauguguuuucaaguguuuagccaagucuugggauugcaguucagguuccuuuuaggaaauaauaagauaucaauuaguuauucuuuguugugaacuuaaauaaaaugcauuuagcuuuugucugaauguuauucaaaauuccuuguacucacuguagcagacuccagcggauagaaacuaucaucacaguggccacaaaaccauaacacccacagacuugggaaaggguacuugggcugaagagguuugggagguuggggugguaggacgugguauugagaauggacugggggagcuaagaggaggguuggggguacccaggauaacuuaccuacuugucugacauuuucaaagaacaaauuuaauagaaguuauuuuagaaaaaaaauccaaaccaacacacacacagauacucugaaauaagacaagagcaacagcagaaaagucucagguuugcagagcuccagcccggagauugagugguggugugcacuaaggccaggugcuccuucugguccugcucuagacuuccucuccauaguaaagcccccugcccccguccguuccuuucaggcccaagugaugcuucuggguaucggcauagcauaagguggcugaaguauuagccacccacuaaaguuagaacccuuccaccugcacagguacugguaugucauauuuuuaggaugagauagccauguugaacaaaagcuacaugaacuugcuuguugucucagcaauccagucagauuauuuacugaaaaggagucuuaaaccuucggcacuaagucucaguuaagccuauguagaugucaggagagggaccagcguagcagugggagaaagccuaagcaucguacacauuccccgaugagcugccuccccagcuguacacagcauccuuccaacagcagggaauaaaauacagaguuaaugaugauuuccuaaaagguagugucuuggcuucuuucaacagucaacaugaaucuuaacaaacuagucaggauaaggaagccacuuguucugugugacucuuuccgcuaacagucacgucuacuaggaagcacauuuagauuuauauaucuguacauuuccugguauuagggaauauguaggaugagaauuaucuaugugucccuuaaauuaaaggagaaacugagagguuccagcacggugcuggaguucagccagggagugggaaagcagugguggcuccccgaacuugaauuucaggcagaugcaguuggagaagcgguucguggcauuuggggaaagcuguagagggagaauauagugauuuauuggccaaaaggaagagguccuguguggaacuaugaaaccucaaaaauggaagcuaagcgcaggaagggcagagcuguguuccaggaaagcaucuagcaugucucugagagaacacaggaacucaaaccuuaugguagguaaaggcagagccccagugggaaaccgcgcagaagcuuccggaguuccucagagcaauggggcaguugacgucauuuguuccuguugccaacucauaaacuagguuugauuaaaaaccccauucgcuuauuuuuacuuuuuacauaggguguuuuacuugcauacaugucuauaccacaugugccuggucuuguggucagaagaggguccucugagacugugguugugagcugccacuugggaacuaggaagagaacgcaggucuuuuuauuaacaccugagccaucucuccaguuuauaugugauuuuuuuuuuaauauugcuuuuagucguagauccuguaaugucccacuggagucaaauggucauuuucugcaacacacauauuuauuaagugccugccaucuguaagucccuagcuuaugaaaucaugaauauaaagacugauauauuugaauucugagaauacuaaaggacuuaaggacuagaaauuaaauuguagaaauuaaauuaagacauucaaauauucauuauccaaauguuuuuuuuuaauucacauuguuugauccaguaauuuauuauuuuuauuuuuaauuuuuuuugagacuggguuucucuuuguaucccuggcuguccuggaacucacuguagcccaggcuagccccguacucuggcaugugaccucacaaucccauauucaaauguauuuagaaauauuuaauguacauuaaauauaaauauuuuuaguuaguaucuuaugaauugaugugaucaagaaauguuauuucaguucaguuugcuuaaauuaaaauaguaauuucagaugaguaaauaaauuuuuaagaaacaaauuaaccaugggucuucuuuuucuaauccucuccuuucuugugucauuacaccaggagggugccccccccaccagcccuuuuguuacacagaauccaguccucuugcauguguuuguggucugaguuugaaacagaggaugcuaauuucugccauucacccugcagcaagguccuuugucauucuaaccccaggaccacuuuuccugaguaugacaguucacucgucaaagacuucucugauggacuuucccaaucacaagagguuuccuaagcaccuuucccuuggcaccucacacagucuuagagcaccaaucuuucucgcuuuggaaaugaccguccaguccauagaugcuauaugucagaugaugucacagagcaggcuuccugcuuaauaugcaaaacaguguggugaugauccaagugccccgggcucauucauucauauggaaucuauagacuagaaguggcugcagccccuaagcucauagugcuaauuaaugccguuacuccuuaugcucaccuuuccuuauagaucuacaauagacauugagauacaagggcugggaggacggcuuaguggguaagagcacuuacugugaaaugaagaggacagagucaacuccuuaccacucacauaaaaagucaggcacugccuacauccccagugcagggaaggagagacagguggaccccaggagcuggcugcuuagucaggguaagaaacuucagguucagagagagacugucucaaaaaacaagggcuagaagaagacacccgaugguuccuguggccucugcgugcauguucucgggugcauauacguacacaauaugugcauuccuccuaucccuacccccauacaacaacaacacagcuaagcagcgauccucagacuuuaucauagcuuuccaucauaauuugccagauuuuuguccccugaaaauauuuugauuuacuucugagaaauuccuucuuacuugaaaauguuaguuuccaguuacuccagaaaggauaaaaauggugguucgcuuuuguuuccuuuuggaaagagguuaguuuaaguuguuuuuguguguauuucauauauuuggugcagucuuugccuuugcauauaaaauucacaucaguauaauuugcugacaagcaguaacauacacugaccuugggcaaugcccuaaccuguacuucucuuccuugcccugguuuucuuuccaagugauggccuugcuucagaggcagaauucccuccuagccugcccuacugagaugcccgcucagcaggaggccuuggcuucugcuucaggaaguccuacaagaggccaggggcacccugacuuauaugaucauaggccccaggaguugcagaagagaacauggaagcaaacaaauuggacuaaugcuugaguaaagagaaauaaauaguucaacucaucuuaagacuuugucauuguaugugucagugugugagugcaggugacuguagaggacacacaugacagaugccccuggagcuggagcugcagauacaugcacugaugggggugguuggacuuggauccucuggaagaguaguguaugcucucugcuguauccagaaaugcugagacauuucuccagucccuacaugcuuuauuuuauuuuuuauuuguuucgguguuggaguuugaaccaaggaucucacaaauacccagaacaugcucugccaccaaagcaacaccggcagagacaaaacuuuuaaauggaccucuagauguuuuucuucacaucugccagucgucccuaucugggcagagucugugauguacgguaagcccaguggccuuuuauguagucuuugcuuacuggcaguucccugaguguaggcgggaugcuggugccgccugccaucuuugauaggggcaaaugauucugucuauucuggagccaaaagacaggcaggccuagaguccagcccauguugcuuuggguugagugacaauucccagagugacagggacauaaucccaaaguagauauugucuggagucucauuauuguccagaaguuccuuuuggaugagcaaaugcagccagacagaaacugcacgaacgcaauugacuugcccaucuuggcuuuuccuucuuaucaucccugaggcuacuccauccucaucuugccauauagauccuugcuucuuccggcucugcaucuuuuaguuaauuacaaaugaaaagauaagagcaaauggcuagaguccaccccuaacgcuccauccugaucagaggcugccuuccccuccagaccuuucuggucuguuguuguuggcgaagaccucguuucuuucucaggucuuucaggcacaccauggccuuucacagccuauaaguccuguaauacuauauuucgugaagaaaggaaaaaugagauuuuucuccccuccuagcuuuuguuaacccauucuuguuuugggcuccaacaaaaaggguuuuuguuaacuggagcuuaaaaucggccagcucgcaaaguauucucccuuuuuaugcaaggaggauuagcuuggcauguucugcauuucccuuguaugagccauucccguguccugucauaagguauauaauuacugcacuucaccaucggcgaucauucuucaguuaagaccguuuuaaaccucucauuaauauaaaucauaccgggaagguagaaaacacaccuucaaaagaaauggagggcugggggguucauccguucuuuucacaauggacccagaguaaacaauuuuuacuuagugcuuuucuucucuaagcaaucaaaauagcuuaugauaaaagaucagguaccuggauugcacaaaugcacagugguuuauucacaggguugggcuuccugccucauuccagacucguuuucucucucuaucacccuuuaacagugaagugcauguauguauaauccccuacucuuucagaguuggccuucugacaucucucucucucucucucucucucucucucucucucucucucucucuccucuuccuacccccccucggguuuguauacauagcaaauugucuuuauuugggggcuuucauugaagcccuuuauccuaaucagauaauagucugaacucaaaaaccgucucagagacugauuugucuuuccugagugaguugcaggcagagcagucaaacaggcauggucggcuucugaucauucgugagcguuugccucaguguaaguuaacaaacaguccucucugguaccuacagcuucucacccuucuugcccgcagcugccauuuuuacccuccgagugugucaucuacggugguagcugcugccugcuuagagauguuaggacaguugaugguggcaagcucagccuguggggcugcuggggcugccggguagaggcguuuucucagcucggggaaacacaucucggauauuagcgauucuaaaggcccaggcuguuggauguaaacugugcucaccucagcugacauguuacucccuucucucuccucugagugucugacuuaugacuacagcuucuguuggcuuucacuuuguccaagagcccccacuuuuuguacuaaagaccuucuccaguuaaguuuuuccuuacccuucagcuugaagcuuaaaguaacuuuccuucuuuucucccuugcguuuuuaguugagugccugcuaugugacagaacuuacuguguaggcucuucaaauccaggggauuuucaggcagacugcauugcugauccugugaccucggagagcccauaggaaagaauuuucuggaugcuccauuucuguuggcuccuuagucugcaugucuaccauacucuuugaauuuuaguagcauuuauuuacuucauugagcagauauuucuuaaugccuuuuggggagacucagcaagguuagagcaagccugucuucacugaugcacuucaacucugugaagacacaacacaccucuucugucccaugcaucaucucaugauacaguuggcauacaguuguuggugggugaaugaaggcccgccaugcuuccuacccaccaauuucuuccaguucuguuccgucugaauucuuuuauguuacuuucuuauacuaucuuaaaaauaacaugaaaaguuagagauucauucagacccaucagccaucccuucgaaaagaagugagucacuaaaagugauuuauuuuauuuauauugcuugcucuucuuccaguacucugcgggcguagugacugcaggcgugggaauaggcccagccuaggacuuauggugguuuagggagggguuggugguauagggcaaguccugggcuggggccuggagcugggaggguaggguggggauccaggacauggagaggaaugcagaugaagagagaagagaguccaggcaaagcaugccucacuuaaacaguucauguuaggaaagcuagggaccuccuuucuucuugcccaacguuagaaaagaaucuuccguaugccgcuuuuaaaagaacgugaaguuuaaauuuauucguugagaauuucauacaugcauguaguguauuuugaauaacuauaucucccauuuuguuaguuuaucccccaaaguaucucccucccaaccacccuuagcacucccaucaccaucuccucuucuucugcuuuacccauugaguccaauuagcacugccuuuaugcaagcggacauggaucacuuccuguagaaaccuaguaguccuaucuuaaaaggaaaauuacucaucaacuuccugacuaaggguggggucuugucagauucccccugcccccacccgugcuggaauuuggaguaguuuggucuugcucagaagucacugagguaaucaacugcugugucuucaugguugcaagcagccaugucauguccaaagguccuagcacucuucauccuccggcucugacauucuuuuuguucccucuucugggauguucccucggugucggugaggaacgggguucuauagauagaugaugugagccugagcacccauaguaacguauuuucaacacagccaguuaugaaucucugcuuuaacugacacccacuggaaaagugaagaguggcucguucuaugggaaaaaucguaagaauuucaaaggcaguuuggcaacaugaccauuuagugcaacaacaacaguagacuccaguggcuuuuguacacuaucucagugaagacucuacugcagcuuccuuccuuucauacuguagaaccaggugugaucaucucagaguuacagccuuuugguguuccauuggaagcugaagaguguauaaaccuacccuguaaauaccuggucucacgcuugcuccaauucuucuuaagccccacuucuuuacagucagaauuccuguuggugucacucauaggacaguugaguuguaaugaggguugaauugugcuuuggugggaugaaaugaaaaccaaacuacuccgucagcuguuguuucaggaggagaauuugcugugguuugggcugucgacugaccuauaguuuggagcauuguugauuaguuaauuggggauugcuuggaugaggauacagaaaugauacaaaguuaauuuuauguauucccauaugguacuaaaggguaccuuuuauaaaacaaaaaaaccacacuguuuucuguguuccuuucccauaaaguucuccaagguguuuuuaugaguagguggcacauauaauaaccaucgaaauaaaguuaucacugaaagaaacuuuuaaaagagaagaguaaaagaauuucuaacauuccaaaaaugcaucauccucauuuuaucucaaguacuaaaaacauacauucuccuggguuacacguucguucauguggaagagaaaaugcauucuuuuuuauuauuauaauuaaauauuuucuucauuuacauuucaaauguuauccucuuuccugguuuccccuuugaaaauccccuauaccuuacccccuuccccugcuccccaacccacacaaucccgcuuccuggcccuggcauucccuuauacuggggcauauaaucuucacaaaaccaaggggccucuccuccuaucgauggccgacuagacaccauguguuuucguugauugguggagaaaauacauucuuaaugaacuccaguaaaauuaaacuaucaauauagagaggcaagaugggcgaaagagccaaacuguaagauccuuuuguuauaugguggcaaaguuuggcuggaaggcaaacuuuuccaugagaaggguuuccaaaacaaauauacuccaauuugcaagcaauuuaaauuaauaugcaauuaauacaucucagagaaauuaaaggaggaaugaaaugcuuacuguuagccacaggacguguguggcuuguccaugugugcucaaguaggacauaggaugcggaaacagagacacauaaaguucaucuugaucauuugaaggcuuugacguagguguuucucuucuuacaucauugcuguugaagucagcuucagcgcagcaugauuagagugacucuguaacucgguguuauaaauaagacagggaaaauaaaguuggaugacucaccuggugaaauggagaacaaauuaauuauucucacugaauuaaaggaacauuuuacauagucaagaaauauuacgucaaggaugaaaugaaggcacuuaaugguaaaacauuacuuaccauaugcaaagcucugggcucagcugucagcacacugcccugcaacccccaaaguauuaccuuaaagaagauuugugggaaaaaugcauacgaucaauuuaaauuccucucaugguagcauccugaugaugucaaaacucaagaaucugagugaguggggccucacauucaugcuuauguaaguuccgcuucagcacuaaguuggcuaaguucuuggucagccucuuuccucauccguaacagucucuaccuccaugguuuguauguaguaggaauaaagucaacuuuugugaaacuuguuuuaaaaugguugcuuauaauuaagaccuacaaacggugcucuuuaucaaccaugacgugccacuagaggggcagguaucaaagcaugacgcagcacucuuguuaauuucuauucaucauggauuuagguucagagaaaauaguuuauaaaauuccaaaucagcucuguuuuucuuauaguacauuaacauuauauuucaaauuuauaaagguauuccuuuuguuuuuuagacauuaaaguagaaguuuccaauuuuuugcugaauuuaaaaauuuuaaaaauucccuaauucauucaguaauuggugaaaacuauaauguuuuaaaauaaauugaauaacccuauucauuucuaaguauuuuuggauauauacucuaauauucaucuaaaaaugugacuagcagcuaucugauucauucuaaguauuugcucauagaaaugaaggucaccuuacauguguuguaaggacugguaggcguguauauucauuguuuucuugacaauggcucuauuuaauauguauuagccaaaauuguucuucagauaucauuuauuagcuuauuaaaagaaagaugauucauuucuuaaugaauuaacauuuaaacuuuuaaaaacaaagccaaauuaucauuaaacgaucauagaaaagucauaggcucuuuaaaacguauaacauguaccucuucaauuaauuauucuguuaaugcugaauaaacaacaauaggcaauuuaagucaaguaauggagucuuuaaagucuaaagucuaauuuuaaaaguauucuaaaucauauuuuaaugauuuuauugaacuuuaauuacacuaaaaauagucuguauuucuagagaaugacgaaauauuuuauuugguuaguauaaaagaaaaaauaaauaaauaguaagacucacuaugguguuguaugccuuuaauucugucacucaggagucggaggcagguuuaucucuguggguuccagaccacaccugaagauccaggccagaauaacacaggaaaaucuugucuccuccucuucuuccuccuccuccuccuccuccuccuccacaacuaccaccaccaccaccgucaucauaauaucagcaaaaccguuaauaaauaguaaacaugcauguuggccuagaccccuaaaaccuuuguuugacauuucugaauauauuuuuugguccuacguaugcagaauuccagcaaaauccagagugaauauuuggcaaagcuaggccugcuuuuaagucacaggccaacuuagcaugguuguuaaccuuuugcuauuuucauuccagacuguacuguugcaggcagugaaggucuuucuuuuuuuuuuuuuuuuuuuuuuuuuuuuucccaagacaggguuucucuguguagcccuggcuguccuggaagucacuuuguagaccaggcuggccucgaacucagaaaucugccugccucugccucccaagugugugcgccaccaccgccuggcgcagugaaggucuuuucacagcuguugcucucaaacagcucagaaagucuccuauucuuuuggagugggaaugcaguggucguaagggugaacuuagugacagucccuggacucuuaaaaugucuugcuuauuuaauuaauuacuuauuuaucugucuacuuaagagggcuuuuuuuuuuuuaagauaaaagagugcuugcuguauauauaaaaauccaauguacuccagagcaagguuguccuucaccuuuaaaagaauguuuccaauucucacuuauacaugcaaucuaaaaaugucaaauguauagauaacaggcuagaaucuuaugaugagggguggugguccuugggaaggaggagaaacucaaaggguuggggauguggguucccgguagaaugcuugcuuaguguaugagucccuggguuuaauaccagcuaacacacacacacacacacacacacacacacacacacacacacacacacacacacacacagagcuacuaaagagguaaaauuacauaggacagacuuaagcccagagaauggauauguagcauaaggacuguaguuaguccugaacauuugcuaagagaguaaguuuuuauaaacagaaacaguuucuguaaaagcaaacuuuaugcaauugaauaauuauuuaccauucucuaagauguugccuaccuauuuuagagguaagaggaauguggccacagucaauaccaaucauugacagcuaggacauggcagaguagagaauuaugaucauuuauguacuuuugggggguagacaauuucaauucagauacucucuuugcuucuuagcuaucugcuuuagaaauaaaaucacauuggucuauuauuagagaaacaaagcuuccuccugcaguuaucaaguagugacuaaaaauuagcaguggugacagugagcagggucuucaacaggugaugcuaauuuuuccugguugccuacugguuauuuucuaccuuauuucugccucuugugugccuuuuuuucuguguagacauauuucaagaacuauuaauuguuacaggaaauuuaagagugagugagauuagagggacugcauugaggaagaacaauuuucuuuuuuuuucuguuucucugaguuaauuucauucacuauuguuuuagguuauuuguaggcagguggaggugaguagaggcccuuuugcagagagacagauuuugagaaggacaccuauucguggcaucgcagacugagugugcugauggggcagaggcgauacagggcuaggaauggggcucuagagguaucugguggauucuuagaaccauuuugcauuucuuugugaggaugagaauugguagguuuagaggaacagagcuagggcugauaaugauaucuucuuuuucugccuccuuucucucagcuugaugugucagauuuuuaccucuugauguaacaguccuauugaaauauacaauaaaguaauuaagaaauaaaggaagucacauggucauuaaguaauuaguggcugucacauguguacacuguaaaaauuugaaacauucaggacucauacuuuuuaagccguguucucuuuuaaauguugcauauagggaauauggaugggaacuagacuugcugaaaugguuacaaacagguacaauucagcaaaacagugcuccccaggaguuaauuagcacuguucauugaaauuggagucuuacagagucauuugccauaaggagaguguuaucaaagaguggacccacuuggugaccaagggcaguaagugguucccaacugcucuuucugcuucagaagacagacuggcuuuccucaugauggaguaagacuuuuaucauguugucucugcucucugaguuucucuuaacuuuguaauucaguguuuagaguucuaggugacauugcggagagaccacggaaaggaggagcggaacuuugcaauguacaaagauagagaaaacgucggauuugagcugguccacagaaaaaguuucuauacuccauguacugggaaggcaggucuggcagaggcaccagaagggccaaaagcccagggcaccagcuccuauguagcuagaguugcugggauuaauauuagaauguuugaagaugugaugucagaugaugcagcaacguuauucuguaggucgaaaccuuucaggcuauaccaucaaaugccagccaguuuauugccuuaccaaagucccuguucacaagccugugccauguaacuguuuuuucugcccuguuuauuccaagauuaaaaucaauguuugaccuagggugaguucucaucuggaggcuggggcaaggguuuuaaagguccuuggaguugaguguaacacuugugccuguuguuggaggcuacacccagucuuuacauguuaccugaguuucuuacuguccuuuagcuagugaggacccuuuucaugcuuuaaagccuucucugccuuguguucugagacaagcuggagaagagucuccuuuuaaagagcucauuugauuagaucaggcccauacccucaaguaugucaucgaaucuaaucaagggaguacaaucuacagaguccaucuuccuguggguauccaguaggauuauagaccagagcaggaaguugcuaugauccccuuagagaccugccuuagagagcaggcagugggccaucaugggugucuaaacaagggcaucucaugcuccaagcagugugcaauauagaaugugcaauauaggaagcucuuuggaaaaauagggauuguacauagauaacaaagaaggaaguccuugaaauaucaaacucucugaaagaauuagugugcuggucauggugcuucagggaucaagagaagcaugugacagcagcuacguccccaaaagccaggaguugauuucuuuguguguuuuggagggagaaggauugucaggauacuaagcauguagacuuuucuuaaacaggaaacuuuuaucuguaugugcuuugauuucauuuuaaaaggaaauucacugcuucuuuuagaucauuuauucuaaaaagaaauggaaggacuacuggaucuuucugauaaguucauuucagaagugagaaaauucugagcuuaaagagggagagggaccugaucacugaguaacuuuaccaauugcauuuagagcagggacuggucuagaaugugaggagggcauuagaguugcaucagaagggagcuuguucaguuacaucauggcuucuagcagcuuguuaggauuuaccaggaaaugccaugggaggaagcuguucuucagcccaacuagacuauuauuggaagugauggagagugagaccagccgacuacagaccaccucugcaguguuggguaggcagagaagcuugggaagcaguagaggacagugcauuuggaggcuuauauauuugagauguaugacuuuggggaagauauuuagucuuauuagccuugauuucaaaaugaggcuauuaugcccauauaaauacauaauaacagacuuacacaucaaaacaguacuggccaucuuaugugaucccaccuaguccagagaaugguuguggacucugggugugagaaaacaugauuagccucguagcugccaugugaucaguacuggccauguuacuaauauugcauauuuaguuaacugugcuauuuuaauuauucugaguuugggauuuaggaagcucaacuuugcaaacgauaagaauccuuucauguugaguuacaggacagccaccaugguaaaagaagaggauuggauuuuaaaugaaauaugugaaugucuaacagaagcugugaucuagaggguaggaacuccugguaugucaacauuuggcuugauauaggaauacacuguuuaauaagucgcugcagauugaaguccuagaggagcucacagacuugaagguaggaaggagauggggagguagacagaguagcaguggguucaauuuggagaggcaggaggacaggcuucuguauguguguagcuuucaccacaagaagagugggacccuugagguguagacacucuuuguauuguucucauuucuacugaugagaaggugaagaagagaagaagcaaguuucacuuugacuucauugaaagaauugagaaguuuguaggaaugaauaaaaagcuggguggggccaggggaaccgugaagaagaggaggaagccuaggaaguggcaugcuuggugagguagaggguucgguguuagaaggacugaaauggagcugcuggcagggggccaucauuggaaaggcuacagagucguuguucugagaggcagugggaagagcuugguucccaagcaaagcucuuggcuucccuugggcucugguucucuguggauguaggagaggccuugccuaaugcuguuugagggaugccauggcuuucaucuggugaaauagcauuauaaacgauacucaaagcaucucuagaagccagggauccacaguguuuuaagacacgcuggagaugcuuuugucuugcuucuggugcacauacuaaauuaaaucagccuucuuucuguggcuuacuuugcgguggaucugcaucacugucguuauuuuaaaaauuaguaagguaaacccuagacguguuuagacaucguugcugaggagaagucaggaucauguuccuugauuuugccuuuguucuaccuguaaggaaggugagcccucuagacauagcagggacacaggucugcugcuuggaugcccuccugagcucgaggauggagaaacauccuugguacagaucuuccucucacagagaaggacuccauuucucagguguggaagcagagucauuguguggguucugaugaaaugagucaagcuuccagcaggaggacucgugauagguuacuuuaugaaugccacgcgcauuccacuguggaaaaaaaggaacuugcgguaucuuucuguuuucuaauuucuuuuuucuuuccuccuccuuccaauuuuccuccacuccaccauuaaacaaggccuccugcaugcuggcuaaacauacaagcuacugcuacuauuacuaggcaacaucccuagcccuuuagcccuuuauuucuuuaaucuauauagugugauuuuucucaauguuucccccuaacucccucuuuggaauguugguaggcaguuggaguccucucuagcuuuacuuccuauuuauuuacuuucuuagagugaaaccucuaagaaaaaucccucuguaaaauacuguaaaccaaaaccaacacgaaugaacaaagucuugcccugaguaaguacuauggcaagaaguggagaguuguuugguauucuuuaguggaucaucgucuguaaacuaaauuagcaagcacgaucuagcaguuuugauaccauagccuaaauuauaucuuaucuggaagagugucuuuaagucaaaaauuuaaauauacugucacaagaugaauggcuauauuaauauucuucugaaaacuauuaaagcaaugcugguuuuggcuaugugccguguuuuaguugggguuuuacugcugugaacagacaccaugaccaaggcaauucuuauaagaacaacauuuaguugggacuggcuuacagguucagaggucauuaagguagaaacauggcaacaucgagacaagcaucgugcaggaggagcugagcguucuaccacuucaucugaaggcugcuaggaaaagacucacuuccaggcagcuaggaagagguucuuaaagccaagcucauagugacauaccuacuccaacaagaccacaccuaccucaaugaggccacaccuccaaauagugccacucucugugccaagcauauuuaaaccaugacaugccugcauaauaaauacaauuuacuaucaagaaauuguuacuuagcugggccuuagguuuguugauuuuguuggaaaugcugauagucuuaaguauacagaaucacaagaacaaaucaguuguuaggcauggcagaaggcaagagucagaaauugugucaugcucaagaggauucaacauagggaagaggcuaacaccaacaaaguuucuaccaacuugagcaauguguaugugugauaguaaccaccccuucaugaggaacgagcacuugagaaauguuuuugugaugggagaguuaagucaauguuuuucaguugaagcuacugggggaaacagagaaggauggcuuagguccuuagagggcaggauaugcuacuucacaaauauucuacagggccuccaugagcaagauacacagacuggaauuugucuuuugauacuauuuggagggaugguggcuuauugucacauugaguucauguggaaaagaggcagugcauuuuacaugccaaagaccugacuaacccuggacaguaguaauagccucuuuugggccucaguaaggucuccaguaaaccaaagaccaaaaucacauaucaggaaugaaggggaacuguagaauagccuuauggcacccuuggucaucagucucccagcuggccaggaccuuagcuaacauuugccuacgaguuccuuacaguuuucccaggaccuucagagucccauucugaugucuggaaagucuucacaagcuacacugaagccuugcuggcuuggacgcaguggcagaugguggcaucuggguuucaucagcugcugcuuguggagccugggcagagcucugaagacaggcuugcuuugagguuauucaaagucagauucuugaaaggauccuggacacaaagcaaccaagcuuuuguagaauguuaucauuuccauuucuuaucugacccgaauagcauacucugaagaggucugcccccauuuggacaaacgcccuuuuccuuugggaacaugucugccuuuucagggcugcucaggagcucacaccucguuauucuuacugacuuccugaguagggagauccuugccuccuucugaaagugucccuagaucuuggugaugcacagacucucagcacacauggaaguaagggaccgggggguauuagagcaucucucuaaccaaguacuuagauguaaaagcuugauaugcauacacacuugcuuaccuuaauuuuuucucuucacccagagggacucauguuucuuuuugaucucagugacauauauguuuuaguaaguggucccuaauauuucagagacugaagcaggauaaacuaauaaauaauaaguauugauacaguuauauccuauuuuaagugauacaaucagcauaugauguuucagaccaagauuucauggcccuuucagaauaacauaagcuuagagcaaagauaccauguauuuugcagcaguauuaaguaauuugugaaucuuguaucuuauuuugguuguugguguccacaucaaaaauaauuugcacagcaucuaauuuaaauccugugugcuuuaaauauaaaacaguuugaguugaacuuaauaauauguaaaaugcauaaccuaagagaaauuugcugccuguaaauuaauacugaugucucuucaagcaucaguuggcgauuaaacaaaacagccaauuuaguauacuuugcacuuaacauaguuauguauucuaauauuauggaaaccacacacauacuuuauuucagucaguucaguagauauucugccaauauuuacaaaugugaacagggcaucucugcuguuuuucaggcuguugcauaaacccaaaugccacugugggcagcaugccucuucugagguucagauuuugggggcccaucuugucuucaaucuuuucucuccacucgccagcacaggcacccucagacaaaguggaaaaagcaaaguuguugaccaccagcuaugacuuucccagguagauucuaaugccucaucgucauaagacaaaaucucaaugcuaaacuuuuuuuuugaaacgaacucugaauucuaucugaauucauuacaauuuaaaauguaccgguuuuaucaccauugcuaagagugacgguaauguuaguaguuacucugcagccaccacaugugguguacuuacuuacugggcugggaucugggcacuugaaacaucucaguucuaggacagaauccuugaaagaaacucugaaguauuggguuauugauuuaaguuauaaagcaagcagauggacaagucuguugagaauucuuuuuuaaauuacacuuuuuuaaggaucuugggagauggcuuggugguuaaaagcuuauaaugugcuuccagaggacugaauuugauucccaacacccacauccauggcacacaacacacaaccaccuuuaauuccagcuccagggaaucugaugccucugguuucugggcaucugugcucagaugcacagacccacaccuggucauauguauacacauaguuaaaaaaaaugagaaaaaauuuaaacaacuaugcuuugauaauaagaauaauuccugcuuuuuaaaacacauauguggcagcacaugagaaaucaugaaugacacuggcaugucaacucauucucauucauuguucagaaaaaaaaaaacccucacuguuaacaaauggugcaucuuugucuagcuccuugauaaugaucugugaagauaaucuaauaauuuauuaauuagcagguuuauuguuccuuaugguucuuuaccccaccuugugcugaagaucuggcugaggccuucauaccuuguaccacugagguauaucuucagaacaggacaauaaaaucuuucacacaucugaucuguuuagugaauauuucaccacuaaauagacaaacccuuccuuauuuaguuaaccuuagucaaucauauauuuuuuaaaauagcuuucagcgaguauauguagaaguucacccagucaggugaucauuuuccauguuucauuuaaacuaauacauggauaaaagagauuauauuuuucaaccuccucauuccauuuaugugcaccguuuuugcucauuuuuguuauuacaaaugcacuaccuagucuacuggaaacuggcacgaaccauggugucuuuggagauuaagugaaaacggugguggccguuucucuuuuugccugcucugccuauugccuuguuaaugaacuuggcauaagaucacuuuuguccaacuauguaccuugagaaauuaacaguaauucauuuacugaaaauaauugcuguguucagagagcagugggaaauaaauguccuucccacccucccuucuuacguguguccuuuuuauucuuacguuuaauccauuuuuaucucuccuuuuucuguuucagugcuggaauugaacccagcuccuuacacaugcuaggucagcauuccaccccugacuccuuguguucacauuaucuuacugaacauacacucauaccauacauguggaugcauacaugcaaacauauuuuaugugaguaggaucagucuaaguugauugcguagggugacugacucccuuguaguuugguccucauucccgugugugcugcacuguaaaauaagcaacuucuauucugcuucuuauguagagggauuggugaggaacaaggcuguggucugcuugagucagggagaguguggccugagagaggagggcaggggcucuguuggaaccaucugagagcugacgcauagucugaugguggcguugggaaguuaaaaggagagaaaagaccugaguugguccugcagugcuacagugcauuuacuacuucggguucugagaagagacggaaguaagaacaguuacaacuccuagaaauauuaggacaaagggaaccaugcuuucucaccagagagcacgaguauauguguguguguguguguguguguggcagggcguaggugggggguguuagcugagcgaaggguuccugcagaugguccuaaguggaauccugaaaugagucugggcagagaccuggaugcucauaugcuguuguuacacauuaaggacuuuggaucucauauuacgguuuggaaaccuuaacuuucaggagaaucugauguguuucccacauuuccauguagcugugcucuccgaguguggucuuugugcugguagcauuggcauccaucucgugaacgccugugaaauacagagacaaggguccugcucugacuccaucagcccccgacagugguucagaaacugcuggaauaaguucugaaagugacucuucuguauguuaaagcuggagaaccucugauguggaugauagaccaccauuacuauuguaaauucccuauuugaccuaggauggcaaguuaucauuuccuacggcuuaacuuacagaacagaugucccacugugacuuucugcuaaggagacuucccagguagugagaggucugcugugguauuuaaaaagacagggcgauauguucugucucccuucaaaagcaaugcuuauaaaagcacaaauggucuuaggcgacucacacggggguggcugguggaauuuucgguucuuucucacauuucacccaagugcuuuuguguuuaugugucuggggcuggaauggggaagaaggaaguagacuuuaucuaacuugagcuaauuauucucuaggcaugaggucaccagaccaugaccuuggguaaaacauugcaucccuuugugccucaauuucuuaucuaagaaauggggauaaugauaccucccucacaggguuacugggauaagucgcauaugaaaggguuugggagugugaaguguacuggguguaguggaauuauuuuguuaucauuuuuaaagcauguauuaugugaaguuguaccaguuuuuuuaacaaaguuuuuucccccccagaggaguuacaaacuauucgaucuaguucaacuaaauuauuuagcaauauuauuacuaaauuagaaauauauuugaauuacauggagaaguuugaaaugcucuaucuuauauuuuggguugauucuuguuaguuaacuggcuuuuggacuuaucaaguaauuuuaggaauaaacccauuaugagguuuuaauuuuaauuguguuuuauuuuuuuucuuuuuuauccauugagagaugauucaauuuaauaaugacaggaauauauaaauauguauguauguguguaucuaccuuuccagaccaggaagaaaguauaugaauaauuucuaaccagcauuaagccacugaaugggcuauaguaagucaucaagccuuaaagugaauuagacuacuuuugcuuuuauuguucagagagaaauauaucgguucuuagcaucagucuuuuaguuugcuccuuccagcaguucauggacaguccucauagcuggaggcccaggucucauaugcauuuguuaauuugggcuuguuuguauucauuaugaaggaaugcccaguuaccucuugccuuugucuucacucucuaauaaugaugcuuuauuugaauucacauuaaagccauacacguugaguacccauuagaaugaaguuaccauuaaaccuagggaacauauuuuguuauggauacuuacaguagcugggagguuauuuaacugcucuccuucuuucuugacgccacagcaguuucugaagugucuccucuguuaggaucuucucugugucucauuguuguucuuuuaauaacugcguucacucuucuccagucucacugggaaauacagcaccaggcugacaugacaggugucugucagcugagguggucuagggugugaagcugcuuaggcccacugugcuuaaugaacuuccagcccugaugcucagcaccaacuucagugacuugcuuuacccugacucuggauucuguuuucugucuccagauugaucuuuguacaguugcuugcccugaauacccuacuuguccaaugcccuuuuucuuugucucuaaggcggauaguaggguggucacagcccccucuccacuauuuucacuguuuuucauaguugugacuaucauuuuaagucacuacaauuauuuuauacuacuuugcuuuuuaguguagagucuacacaacugucauaucccaucuguuucuguauguuuucgagcuauugauauaggaaaggaaguguauuuauuuuaagaaauuccucagaugcaccaacaucugaauucagguuguuuuguggaugcagcuuuuuaaaaugaaauucuaauuuuagguuaaaaaaaaaaacaacauucagguaguauuacuaugaaacauacacauaacacuaccacuacugccaaacacccaaaccugcuuuacccaaauaguuaggguaguggggcuaagaguagucuugcuucugugugcauggaugggugugaaaaucagaggaccccuugcugaagacugccagccuccuuccaccacaugggaggaggcaugucuuuaucugcuaaguuaucucauuguccucaaucuuguuuucaaauuagaaaaaaaguuaacaaccaucucuuuuauaccaucucuuuuccuaguuuauaauuauuucuaauaugucagaguauauaaacagaguaauaauauaugcguguaauaaauacaugaacaugguuauaacuucacagcuauaauauauuaaaguuaacuuauuuugaacuauuaggggacaauuuuuaaauacuguuucuggcuuuaaguccaaacagaaacgaaaugaugagaauuccagcucuuagccagacuuuccucuauuuuuacuuagucaaagguaacaaauucauagaauaccugcaguguacaagagagcggcuaaaaucauccacaucuggauggacguaacaaaaccugaaauaagaaggaagaacacuucaggacccagccaagaacacuuacguuugaagguuaaaaauauucuuccuguuuuuucccuaguaaaagacuuuaaacaaaaguaacgagugagcgaugcuuccgucccacuuauuguucccaucucuucuugaaauguuacuuucuggccucauaugaauugcuagaucauuauagucaauuugugguuuuaacaaccagaacugacuaaugaugcuauucauguuugguuggagauuaauguagucuguggcugucgaugaguuguauacacgcacauguauguaugcauguauguaugucuacacuuuagauauuuuuuugcacaaccaagaugacaaaaaaauagugaggcugucuaggguuucagggucuggaacccaggguucuaaucuuuaaguuacugcaaaagacauuuaagaacauucuuauuaucaugcauaagaaccuguaaagcaaacaaacaaccuugaucuuguugaugaaggcucugaagcagaaggugucugcagugcacuguguacuuggaaguaccccgcaguguggaugcccccaguauugggggcuguacuugguaacuuggaugcuuccguacauguuuaauuucauugaaguuuucaugcuggaaaggaagcgaaauauuguauccuuuuuccaaaggaaaauguuugugguguugcuaaaaugcgaacagauggcguuguaaagcuuuggggagaagugcagcccuucaauucaaauugugaggcaaagucggagacaaacacguggccaccaauuguuguagauauuuauaugacuuaacucaagcauguuaaacaaaacacuggaaagggagaguuuuuucccccuauuuuuacaguccagacuucacgaaguauauucugaagcaguuagguuuuauaacagaacgaaacaaaacaaacaacaacaacaacaacaaaauuccccaaacaaacaaacaaacaaaaaaacccagagugauuagagaacagcuuagugguguaagaugcauucuauaauuuuggguuucacaguggcuacguuuacccagaugcagugugacagccuauuagcaaaaucaacagaucugaacauggaggccucugcucuuuccccugcucgcagugauuugcuucgcagggaggccuugcagccuggcuguagcaucaaccucucccccguucuccgcaacugaucagcaaagcguucauuaccgccgccauauccaaagugacgucuccgugcaggccgcccgcugugucauucauaaccacaaaacagaccgaaaugacuuuccuucuuuuuacaacuugcaaagaguuaauggacugugcuggcccccugccagaacccuuaagaaacuuuauuaauguguuaugaggccaggacaccauagugugggauuugguugguuauucaucuuaaugaauaaaaauauguaugcacaauuaaagcugcauucccgcacaguugcuugcuaauaaauguugagucuuuguugggauuccuugccgcauuuacugcuaacugcggucuucuuaccucuaugucccaaagucagcagcggucuuuuaaaaagaaaucuccauuaaaaaaaucuagcuauuuacccuauacucuuacuuuauuuaaaucauuugacauauauaaaagaugaauuuauaucgguuagucacacaauagagauggcauuuuucaaaucuuauuuuuccccccaaaacgauuuucuuagcauagucauuaaacuggaggaccucuauacccuuccauuaauagaacucuugaagggcucugugaaaauaauaaauaaacaacaaccuuuggguaaauaacaaguaucaagaggaagaauauuaugcuucagaaauaauaaaaucugaacuggcuucuacaaaucugaccuuaauuucugccaccacuucugaggcauuagaugacccacgugacuuggggugcagggagugaagacucuuuuccacuucgauuuccaccauuguuuucacugcuugccaucuuuucaaagugaggcacuuggccuugugaauuucacaguacugugugaccaggcccacugaagcaaggaagucuuucuuguuggaggacuugauguuugaggacaugccgaagaugguguuggaggucuguggaacagugggaacuagcuguuccccauacuuguaggaaaaggaucagccuggcagccccgggaaaguaccacaaagacgacauuagcaguuacauacaaagaaaaauggaagucaucagacuugggcaaugugacuuagcaggaacucacgggauccuguggaaguuuccgugacuuuggugggagauugggaaguuuguggguguaagcaggguggcagcugaugagguugcuauugaugugaggcuaccaugcuuacuggcccuuggccuguacugcagugugccagugcaggcuucaauuuguggcgugccaugggcagugggguuuucuggucucugugcacauuacaaaccccaacuucagcuuaccacacucagcacccugcacucagcggcggucgcugucaggaaaauuggaaaguuauaugucaaaaauugaccaagacgccuuguaacuuguuuaucugcagugcagguuuuugguuuguuuuugguguguguguguguguguguguguguguguguguguguguguguguguaucuagugguuaacacucaaacuaggaagaauagucauuuaaauuggauucuagagucagauuuucuuggguucaauuccuugcuuucucauguauuagcagagaaugcuugguucauguuccuugaucagugaucagagcccacuuuccuuguuccugugagaacagaaauccauguaugaccuggugaaaggugguggacauagaccagcugaccaguggcucucacucggccugauuuaacugcacuaccgcuggggaggagacaugaguguuuuaagucagaauggguagaauacucgucauggcuuuacacaucugucauuuauccacacugcugcccuuucaggcauagguauccauuuuauaugugcggcacuguccuguguacuugacaguacaugaaguguacaacuucuagaaccucggguucucuuugagguuagaaaauauagccauuuugucaguagguuugucugacagguccccaaacucuugaguguuuuuguaaagcaacguccuccuugccaaguccuuccucccagaucugaauccuugugcaggaggcgagcaaccaucauuuggugaaugauugauggauagauuauuguuuuggaauuuggaaacucccaaggaaaaaaaugacaagguagcagaaucucugccuaaaaccucacgaaaguaaaucacaguggcucaagcuucaagaguguuagucggcaggaaagccagagacgccuuucucuugaacacauugacuuuaucagucuguguuuuaguggcccgucggcacaugguugugauauuuaccauccugacuacuaauuuagaaaagacuaagggugccuaaaugucuuauguggagagucauucauagucaugaugagaaauuguccugcuguauacauuuucauggaggggcuggagacauagaucaaugguuaagaggacaggcuagucuuacuagagcacucagguucaauuccuggcacccacaugccagcccauaacugucuguaaguccagguucuguugcuacucuucuggccuccauagguaccaggcaugugugugguaugcauacaugcauauagacaaaacacucauguacaugaaauaaacaaaucuuaagaaauuuuaggggaaugcuggagaacaaagaguacgcauaaugcacccuuggaaagggcucaggaagucucagugaguaaagcugauugcguugugaccuugguuuggauccuaagcauccagcuccaagcugggcauggcucgcaccugucaucacaaugccagaaggcagacucaaggaggaucuucaaggcuuguaggagagccaguguagccguagaggaaaguuccugcaucagugagagacccugccuccccagacugagaugaaaagcuaucgaggaagacaccugaugccugucucuggccugcacacguuggugcucagaugagcacacaugcauggacguguguacauacgcaguauugcauuagagagaugcuaggccuucccccauuacaauggggauggaaaggaaagcaguguggggccauauaguuaaagguagaaacgcaggauacauagugacaaaucacaauaaauggaaugagugccaccacucugucagcuccauggaacucauccuuuaccucugaauucuggcagcacaggugguugcuggauucaaccgaagcuaccucaucacugccaaugauuacaggauagcacauggggccuaaggugucucacagcccgagcuuaaacuuguggaacucccuaaaagaaaagcccaauggucucauuauugcaacauuugacaucugggcacacagcauuuuagcuggauuucaguuuugagaggggagggguggugugcagagacagagguagagacaguagacauuuuuucuggggcuaguuccuuuauuuguccuuuacaauuuuuuuuuauauauuccuagcaugaagaaaucaaugcaucuuaguuucacacagccccccucuacuuccugcuucuuccuucauuuccucauuccuuuccuucuugccuuugucccuccccccuuucucacugcccccuuagucagcuccugugccuugcagagaugaaaggauucuggguuuuauuucacuuuucucaauuaggugggauuuguaauauagacaguuccucaaauucaagguguuugcuggagaaaagcaaaaaaaaaaaagggggggauucuuuacaauguuauuugaaugauauaaaaggaccacagccucuaaaagagaagccaauugaucuugccugcguuuucuaaacacgaauacuggguuggggcucagaguacaggcacauuucaccacugcaaauggcaacuggcccgugcaugggcuuccacaguaaagugugaucaagaggauuucauuuuaccuucucacacagaucuaaaugagcugcuuuaauuagcggaaggcauugaggguucaccugugacagggauggaauuuggaaccagaucccuguguucgcguuucuaacuuguagccuucaaauaaugcuuugugguuucucaagcagcuuuagggagcaaaacaaaacaguacguugugguaccaucucuuauccgugugggaaaugcccuugggcucugugacagucugcaucccugcccagccgcaguggccuuugcccuggccaggcacaggccggcgacauuucaggaggccgcuuggcagccauuuuagaucugcccgcgcagagcccuggcugccaagagcugcagccacuccgugccaagacacucuuggcaguggagauaaacuuuguagagauacacaguccagaaauaucuuauaauuacaaagcacagggggcagaauguuuuuacaauacagcugugcuaauguaaacauuuaauuuggcagccuucuccacccacuuuucaauuaaccggguuuaugcagauacuuuagcucuguaauaaacuuuauugcuacuucucuuagaguacaguuuaugaaacacagauuugaggggcuuggggggggggcgcuguccauccauuuaggaaagcacacuguggauguuagguugccaugaaggggaaguguagcuuucugucucgaaaaugccacaguccuggcuugacucaaagaauugcuuugggggaaaaaugugggggcugucuccuuuggcucccaaagcaugcaagaagauauuaauagaaagagguaaaaucgcuuauguagcugcauaaagacacucguguuggugaucauuaaacaggguaaauguccccugcaaugcaugagacggcuucagagacaaauucccgauaacaguucuuacagauauaauuauaauaauugugugaucgccgugauaauuauucuuauagacugaaagaaauaauuuucuaucuagaguagcguucaacuguucugcucacaaagacagucaauagaucuuuuuuagcuaaccuaaaaaaauuguagaggucaugggggguuuuccagcuaaauuuagaauuaauugacuuuguaaaaaaagacccccuccaaauaaggaauaugacaucauagucaacgaggugucuuugcagugauuugcuuauacaguucuccaaaauuagggaaagccgugcauacauacauacucaugccauacauaccaaugcauguucuuuuaaaacagauuuuaaaauguaugauuuccuguauuacugcuuggaaacuuugucuugguuaugaucuuuuucuuuuuaauuuuuuucuguucuuuagauuuauauguaucaguguuuuacauguaugcgagcauaugcgagugcgugugcgcaugcguguguguguguguguguguguguguguguguguguguguguguguguguaauuauguguaugagccacaggcaugcguaauaccuguggaggucagaagaccauuggauccccugguucugggguugugcacgguugugagccaccauggggaagcaaaccugaguccucugcaagagcagccagugcccuuggccacuuccccaccccugguuaugauuguuuuuuaagguagcguuuuuuuuuuuuuuuguuuuucuuuuucuuaaugguggguguaguaauaggaaaccaguuuuuaugguguuuucucuuaggacuuuuuaagagucuuucauuuagucuuucuccagguccuagaccacaugaucguguuuuaacuugagauaauuacuaauuugauucucuaaccucccaacuagcccauagauucuuccccacugaagaugguagagggcagugaguguuaagcuacucuucgcacauccugucucacuaguacagcuuccgugcagcucucucauuggccgucucguugauucgucaccuuuacccgugaugcuuugcagacggaaaccagcacuuguggucuguugcuuguggucccaacgauguguuaguagcugaaaacagugaacagaugggaaguucugaugugcuuuggaucucuuuggggauaaugucaauuuauuuuuaaaauauaugaagucuacuuauuuuuaaccuuauaauuuguuuuucagagacagggucuuacuauguaacuggcccaacaaacuauguagaccaggcuggccucauacaggaaucuaucugcucugcuucuggagugcuagggcuaaagguguaugcuaccacacccagccuuacuuacaagcuuuaagccaaaccauuuauuuuucccaagugacuagcuuuaauaacuauggaaaggaaugauauauggaaggaacauuguugguuuucaauucucuaaaaauaaacaaauggccaaaugcauuagauguauuucugucuguugcugaggacugaacccauggcuucaugcaugcuacccagucgguguagcucuaagcaguucuccagccccagcaucucacuacuggguguuaauuguuuguguaagcugguagguagcucauuauuaucuuucuuuuaaauuguuuugucuuuccuaagggaauggaugcuuuucaucccauuucuccauggauaggauauuuaagauaacgcccuuucugcaauguaaacagaugccccagacuguaaaagauauguuaggauauggucagugacaacuauggagggaaacggcacauguacaaccagcccuaacacaguguuaaagccuuauauuagaaugggagggaagugauguggacccugcaggguggucucauuagguggaugcaaaaagagggccaggaagaauauaccagaugaagggaaucaagcacuuuaaagaugaaauuggaguuugucugacgucagaguaaggacauuucaguaaugaaagccauauggguacagagcauggagaccugcaauuagcaaaacaagggggaggagccuuagaagguaagagcugggccaacaccuggaaguagggcuuugaggugagggguuuccagcaagucuuucugguucaucugguucgcugaaaugggagagagugggcaaaagguccugcuggaauaaggacaauaaggacuuugucauucaaaugagagcaggguuagcuauagaggauugggaaucgcagacaaugaguaguagaauuuagcaaaguggagcugguugaguuugcccugggguuacaggcaggaaggaaccaggaggugggccucauggaaggauuuucuuaggcagugauaguaccaaagggucccacaguagagaaagagccauccacuuuagagagaggcaccacaaaacuucucuuacauagacaauggaacugguccccaaagacaaaaggauggaccuuugaugguuccagauauauggagucugaagucaguuaggacacccuguggcugaugggacaagcgguggugguggucaggcaucccugggcucugaugccggguggaagauuaauuuugauccuuccuuaugagguggagcucagguaguguuugaauauucccuuuuuauuuugcuucucaguguuacuucagaacagcgucaagcauacuagguccucauuuauuuuuuuauauuaacuuuuuuuuuuugagggagaaaauucuucaaggaugaaaguucugugggauguuucuuuuuccaguuugagagagagagagagagagagagagagagagagagagagagagguguuugcaauaucuuuucaauuuaauuuuauuauuugcuguuguguuuaaagaagcagaagcuacucugaaauuuaggugugaauuuuggagaagacaugaacaguuucauaaaaaaaugaaacaaaaugugcccaaccacugagugcaccccggggaguaaacccugcccucaggucccugauucacccuguuaguagcagccagugaggcucaguuuacuggcacagccuccucugcccuuccucuccgugugagucccaaccuuagcaggcaaaggcucagaagccuugggaugaagcuacaucaucccacaguugagccagcuaaugccuaaguacaaacaguagccggcaguaaguggguguggcccugcagcuuccuggagugucuuacagggguuugucuuuguuuguagaugucuggguccugcaaauggacucccgucuuuguucaguaugcaacuuugacuacguaauuuucuuugaguuaaaaaaauaaaccaguggaaggcuugcuaguuaaagaucacacacacacacacacacacacacacacacacacacagccuucagaagcaaauguuugugggcauaaccagacuccacaacauuuuuuucuuuaaacucucuuuagcccuugucaucuuaagaugugccuuaugccuuaccacuucccugggaaauacgacucacaggagcaaauuacguuucugagagaguccaggaggauccuaguuaaguagauuagggucuggcauuccuuuuagcuucaucagucauuuacagcagaggauggacacuguagccgucugcgacuugccaauuagcugggcuuuccccgcuguuucugguuuggcagggaugaggugguucacccugcugcacugcugccugccaaggacacauggccagcucccugcuuccugucuuccucuuuguguccuggccuugccuuccagacagcugccagguuaugguugccaaaaaccuuccuuccuucagaaaggucaaguaaccucaaaucaccuuugccaauauuuguguuuucuuuuuaauccuucugugcucaaguuggagaaaacuguagcacugaguggaacuuagggucaccucggaucucuuggaucugaaccugaagcaucccugagccaguccggauggugcuucuaguacaguucuguucacagcucugugaagugcgaucgaguucaggaggguucaguguggaucugagugcugcugcuuuuuaggauucucaguucacuugugaucuuuggccaaagccugaugcauugcauggcaggaagagaagaauguggagauagguuuuggcuaaaggcuuacuuuuuuuuuuuucuucaaagaacuugauaguugcaaaccugucuuugcuuuccuguuuggugucugugaauaagaguuagcagccuguccauggccuggggacagcgagugaauuagcaggagcuugcaggauggaaguaccacuuccuuggcccuggcauggcuguaggaaacacagucgcugggacugagguucaagaucagugugaauaaguguuuugaaugacacucaccacucaccaaaugcaugcacugaacaggccaugguuacagaaugggacaagcaagauuucuuguuccugggcagcauauggucacauauagaccuguccucucuaguucaucucuucgaauuacuucaugcucaucuuucaucaaaggacacggccacuaguagauaacacuuuuuagaagauugaaggucuagaacauuaauaaugagauauuaccuuuaaguaauuuucugcuuuaaggucuauguuuuuaugaaguguuuucuaugacacaugggaaccaccacaaccauugucuauauucugauguccauuuuagaugggaaauuuuaugucucuuucauuguuucuuccuuccuuccuuccuuucuuccuuucuuccuuccuuccucucucucucucuuucucucucucucucucucucucucucucucucucucucucucucuuucuuucuuucuuucuuucuuucuuccuuucuguacuagagauugaauuuggggcuuacugcaugcuaggagagugcucuaccacugagcucugccagcgccucuaauacuuuauaaggcaaagagagcuaccuacugauucuuaugguguuugcugacugacagaggggagggcuguguccugcccaaagacucagagaaaguucagcaugguccugagauuuuuuuuuuucuuccuggcauuucauguaaaauuggacacgugaucuuucuccuaagcgcaagccuaagguucuaguauguguuuuggacuugcagugagaguaacuuagcauaagccaccucuuugucuugcauugcaguagccuuugcagaguugggcccaggucacccuugcaguuuuacaauuucuuuucuugacaucuaaacucugcuaaaaaguugcagccucagggacaccugccuuucugauguaacuaacaaacacugcuaacuuagaacacauguucuucagaguucaccuauagccuugagucccgcauuugcaagcucagcaucuuucauugaagacagccuaauuuucuuaaauucccuauuuugccucuccuugaacuauugucuuuuguaacaguaauaaggaaaugugguuauggguuuaauugccacgaggcaauuguccccuagaggacucaguagaauuuuccacucuauaucugagggcugggcuccaucaagaugaucauucauaaauaacucaauuagaguaauaacaacaaugcauuuauuuuuaugacaacuuugccucggagagguccuaucaagucauuguucuaauaccccacuagaaugggauaaauauacauuucgaaaguuuuucuauagcuccuuugaaguagagaagugaggcagaaaguguccuugaugucccugaggucacaacguuucuagggccaggacaaggaagaaugcaggugaggucucaugucacugcagggucucaagccagacaggaaaggagcaaggcccagcauccucuuagaauugcagaugaugcuggagaaggugcuugcaaagccccaaaggccuuguugcugucuucauccccuccuacaagagagcucugugugguugucuagcuggcccuuaaucuggagaaaggguuuugcacauuuucugauugacuagauccaagcuaccuguuguguucuucaguaauauaggacuaauugaaaguuuacauuuguauuucucaauuuuaaaaccuccuaugagauugauaaccaaguuugagcagauuaggaagucaaagauucauucucaaugcucugcuuaaacugcaagccaaaagcuuacccaacuaguggguugccugcuuguuuguaugcuuuuuuuuuuccuugcaguuuuacuguagacucuauaguugcagaaugaauauaaugaauuuugggcugauuuuuauguuuuaguggaacuaggaaaauggggaguaaaauuaccuuuaaguuccccguuggauuugaagcaacucuaguggcugaccucccuggggaguagacacaauuaacuacagcaucuuaacacuauuguuuguuuuauuaugguuaaagauaacggaucuuuaugcucuugguucaaguaucuaguguccauagaggcuuggguaugauauugguccccagcaaaggaaaccucuuccaaauauagaaguuccaaguccacaggggcucugcuuuuugacuucuaacgggaaacaaugugaacuuagguaaaguauacacacauguuuuuuuaaaaaaauauuuaauuguaguuucaaaauucuugggugaguuucuacuuuucauuuuguccuaagcaaaagagcgacauugcacuuagauaugucccuggaagccuucugggaggaauaaugaccuugagacaaccucaucaccucuuguugugccuuaacccuaaugaauguucagccaaaaacuaauccagguaaacagagaggaaaaagucaaucaaugcaagccuguuugugaaauagcagaggggaaccgcccauccuuuaacugagcuguuagccuugccccugggccaagggaauacugacugcccuguaacuaucucacuugcauaaacaggggaaugagaaaagcaagaaguagaugcuguugccaaauguucuccaaggccauuuucugucugcugagacucuacucccauuuucuuuuuuuuuuucaauaaauauauuuuccuuaaauuuauaaguuuugccauacaaugcagggacugauuaaaauaauucucagaaucaaauuuaaaauagcuuaaugaacauaguguuucuuuaaaaauacuuauuuuacuuugugcuuaugcguucauuugugucuggugcuggugagggucugugcacaaaugagugcaggcacugacagagucagagagagagaacuagcuugccuggggcugacaagggauuguggaucagcugaugugggugcugagaugcuaacuuggguccugugcaaaaguagcaaauguucuuaguugcugagcugugucuccagcuccuaauaaacaugaguuuucaauggauaaaaucuccacaugcuguucaaagguaacugacaaacacauaacaaacucgcgugauaguggacaaaugagacauugucuuauuagguuucuguuguugugauaaaacacuaugagugaaagccacuuggagaggaaaggguuuauguccccuuacuuccaaauaacguccaucacugagagaauucaggucaggaacccaagccagguacccagaggcaggagcugggccagaugccauagaggaguguugcuugcucagccugcuuucuuaauaaugcccaggacugccaauccaagaguggcacuacccacuaugggcuggucccucccaaaucaaucauaaagaaaaaaaaaacaaaccaaaaaaccaaccaaccaaaaaauaaauaaauaaauaaauaaauaaaaaccgcccugcacuguggguuugccuacaggccagucugguugggacauuuucucaguugagauucccucuucccaaagccaugucuuuugucaaguugaccccccccccaaaaaaaaaaaaacaaaacaaaacaacaacaacaacaaaaaaaaaaaaaccaaaaaaaacuaauccagacagacauaaaaagaaaacuugguuauggugagagugucaaaugacucagugaaguauaaggacaugaaaaugcagcugcauagcauuauauaaaaauccaucaagcuccuaauuuuuccagcucaaagacauacagccuuguguggggggaacagcauucaagaaagaagacuuuguuacacuggagagaaagcuuguauccugguaaagagaagaaagaauaaguggaaauugaugguuggagcuaucaaaagauguccuagaagacugucuuuugagcuugauuuugaaaacuuaauuauguuauuaucguuauauaucaauauguagcaagaaaggccuugguguauaagaaucaugcuuaggguggaaugggggcagucauuccuuuccuuuccuuuccuuuccuuuccuuuccuuuccuuuccuuuccuuuccuuuccuuuccuuuccuuuccuuuccuuuccuuuccuuuccuuuccuuucccccucccccucccucuccccuccccucccccucccccucuccuuucuuucuuucuuucuuucuuccuuuccuccuuucuuucuuucuuucuuucuuucuuucuuucuuucuuucuuucuuauuuuuaugauaauaauuauuugaauauucuaaguggcaucauaguuacucugacuuacuuuuuuuuuguuuuuguuuuuguauuucgagacaggguuucucuguauagcccuggcuguucuggaacucacuuuguagaccaggcuggccuugaacucagaaaucugccugccucugccucccuagugcugggauuaaaggugugugccaccacgcccagccuuacucugacuuauauugauuaacuuuauugaaaccauuucccuaaaguuaucauucaaaacacuaauuauuucauaauugcaaugaauuuucauguuucaguucaugaagguuguagauuguaagcuuaugcugugacuuuagauuguaaaccuuuuauaguucuuucaaacauuuuuuuucaguagaauaaucuugaucuuccucuaaaaauaaagaaaaacuuagguaagcuguuuuuuaaauuauuuuaucaauauaacugaguggcuuuccucuugugcagccuugguuugcaaaaggaaguuacucucucuccuuccuguguuuuguacuguuaaaaaucacauuaguuccaagcuaugcuguacacucagcuuucgugguaaauuagguucugcaccgaaaacuuggggacagaaguucuuugaaccacuuaucaaggaacugugggaacauuuaagccaauaucugccacaaucagugaauuuccuguugcccaagugacuucuuugguucuauuacuaugauaaggaugugucagaaacagcagccguugauggacagcugacaggaccgccuuuucccuuuguaggagucuguucuuccucaucuuacuuacucuuguuaaagucacugaugagaccuucagauuauuuagagauauuccauaacaucaaugauuuaaguuccaugauguaauaaaaaguaaagauagcucgauaguuaaucacacauaaccaauaugugauauaaaagccuaucuuuuauuuuucuccuguaagcucauauaauguuuuaaacauaaacauuuaaaugacuuugccaaacuuuguuuugaagaccgggucucagaguacaguccugauuggcuuucugcuuagagcccugccuguagcugccucugugcugggauuaaugguugggucuccaggcccuucugauuuuuaggcuuaacauaaaggagacauuuuuauucaaguaaagaauauuuuagagaacauuucuaugauaagcacugaaaaagguaaaaaugggacuuuggaaucauugacugaacuaacugcuacaucuuauuugucaagaaguuucagacacuuaaagaugaaaauguauguggguaaccaaaacaacccaaauuuaugauuguuauuaccaccucuguaauuaagauucaaacuguucaaguguuucuagcuaccauguugcuuccaagagaauuguagcuguucauuuagacuuaagugagcaccuacugugugcugagaguuaugaucagcugcaaauaacacucagaugggucuugauccuacgaguuuaaaacaaagcaaacagauggguacugacccagugguucauuaccauugucaggacucuggagggaaaacagcaauacuuaucgaggaggguuuauuggguggagcaauaguaauuaaaaugcaauguccauuuuuaagacuguugugguuucucaccgucaguguucaggaccaugaagugccauuccagucccccacuucaccacauuuggaauuuagucaguucagacuaaaccucuaucucuuucuuaucuggugaguuuuguuuuuuuuuuuuuuuuuccuuuaaucugacuuuuuuauucucgagguaaugucuuguauugcaucucaggcuggccucgaacucacuaugaaaagcccaagcuggcuucacacucuucaacagucuuccuggcuccgucucccaaguccugaauuuacuggugugaaccacugcuggccauuuauacagcuguaacugagugggagagauuaaagcugauucuggccugcagagguuugcugggggucagaguacagauggcugaggaaggcaggaguccagacucaggucagugugggggaacauguucugccuggggaacaaagaucacagguaaaacauuagaaaguaguguguugguuugacuuuaaccuagauuaaaaaaaaucaaguuuggugaaaauacacgaaauggcacagcaccgaagggccgauggaggcaaaacuggggacacgcuggaacaggcgugaaagucucugccaggcagggaacuaauacugaaggguuccaaagaauggagcguuucucuucccacaagcuccuuuuaacagaauaucagaccaagaacguaaacauugauuucuuucuauugaaugucugcauugaguuuuaaauuccccucccugauuuugcuuuugagucugcuuuucauuuccagcuugcuccacauacguuucucagagugcaagcuucuuggcuaccaagugggagagaauguauuauguaguaucucagaaagccaaaaucucucccagauggaagcgagcaucgccaucucagcccggacccuccuggaucuggccaggcuucuuuaagggacgucacuauuuuuccguggcaaguggcacuggcgaauuguuccuugaaguacacagugguguguucguggaguauugugagauaugggcagcauuuaugaaagauuauaaauuguacagcucucuucagaaacuuaaaauacagcuggaaauguuuugcucccaacaaacaugcaaucuucauaaaauugggaaagaaauguuuugaauaaauaauguuuuaguuuauuucucuccagugugagaacuuuuuuuuuuucaucaacaucaugccguagagcuccucccccuuagagcuaacacucuuacccuuauguuuacaguaugcuggugaguuccacuugauuuuuaagcaugccagauugcucugucuuguuuuuaaagauagaaaacuggauuugcucccggggacucuuuccauaacuaggccaguuuaaaaacuaaacaaggauugagucaguuaauuaauuuaaaugagauuacaaaucaaaaacauauuaugcaaucuugauuuaauuaccacauuuuauuuacuuaauugaaaacacacuguagaaaguuagcaaucuugacaaugaccggaauggcgucuucaaauucuauacauuaaaggccaugaagacagaagcccaggugauccugguggcaccccuggcuuccucaguaucccucuguaucagcagacgacacuggacuuaagcauagugcagagaugggguuuuauuuauuguccuggucccuuuggagucuggugauggcuaugcagugcuacagcuuggucccugugcccuggcuccuuugguaggcaugccuacuuuguucuccaacguuccugugauguuucucccuuaaguuucagcacucugagauuuuggcuaauuccauguggacaaauuucagucuggggcucaaacaaauccuccuucuaauccuugggaugugaggcuuugaaccuaaucucccuguuaagcaaaaaaaguaguccuuuauaagaaaguugaagaacagaauuagcacagugugugagggagcagaaauaagaguguauuaccagucugcucuguagcuuucuuuuguuaacgaaguuacuuugcccauaaggauccuuugcacgguaacuucuuuuuaaacuauacaguuugcugaauuauauccucagagucaauauuccaccaaagcaaggagaugccaagagugcaggccuucaaaagugcagcgaugcugguugaaaagucuguuuuaauguguggaggaagccaucuuccacaaauacuuucucaguucugccagaaguauguggaguuauuugauaucccauuugcucaaaacugggcuucggggaagagguacagauucagcaagagcaugucgagaauucuaucacaaagcagcagugcuagcguaguauagauugucagcuaaauugugcagugaugggacuccuaauagaaaaugugauauggcgaugagauagagagagaccuggggagagagggguuugaacuucaaauggaaugucccuuugggaagagacagggaggggguuuccuggcagcggggaggugagauagagagacagaagccuaaagggagaccuaaaaggggaagggagaaagacagauuccccccauauccaugaggauuuuagaagugggaaaacacucuguuuaugcaaguaucuuugcauugcuuuaacaaacauuuaauaagagggaaagaaaauauuguaaagucauaguuguguaccaccucugcuaacaaaacagcuguccucuaaaacugaagaguguuuuaacugugcuagagggcaaaagauuccuggcccauguuauauaauggagacugugauuauguaaagccaauuuacugucagccuucccgggagucagucuucuggagucaccacagacuuagggguggggcaagaugaccaggggcuuuguucucaggacaguucucuucuuguccuggaaaacagccacaauauauaucucauauauaaguguuuauaaugagcgauauuuuaaagagaagagaccccuauggucucagaucccuaugaaauucccugguauucuauggcugacaauggacuuuuuuuucccuucaccugcuuaaagcaaagggcuaugauaaaggggccuuuaucaugcaaugacuaauuuuaguucuagcuggaagcuaucuguaaguuaacagguuaaaguuuggguuucauuuacuuuucugauaucgcucaauauaaaagcuauauuguuguagaaucauauaauuuuagagccggaagagugcccauaauuuaccucgcuuggucugucuccucuuuuugccaaaaugaccuuaaauugaaguuguccuucucaaauccacucucuacauucuuguuuuucauucuuuuuaauuuuuuaaaaaauagaugaguuauuuauuguauuuuaugcauaugagcauuugccuguaugcauguuuguaugccucuuucucauucucucugacaggaccuuggugcucaucccaggcuggccuugaacuuguucuguaguacaggcaggcugugugucuuaucuuugucugggaugggggauuuacaaacaugugacaccacacccaagaacaggcuuuuguuuguuuguuuguuuuuucuagguggugcccuagccuaagaauaaaggaguuccuggaaaauuucuugggaguauuuagguccaggcuuucccuggcucccauucuugcuuucggauuccaacccauccuuguuucccauuguuggugagagccaauaagaauuauugauagaagugcucaugggacuccucccugcuucucuacucaauugucccaucuagaaacuguacuguuaccugaucuggaguugugggaaugguuucugugucucucucccuucaaccuuagguaauguucugucagcauggaauggccugcgacacacaucuauaugucugucacacuccaucuguccucugggcauuggguuucacuaagcauuaucgauauuugcccaaacauugagagaucaggcaacaaauaagccaaacauugaucagaugcucaaaaaggauggcugaucaugaggaugucagaauuagcaaaggggugagugacaucauagguucaggcucacacgucaaaugcagggggacaugagcaugagcaggggacacacgucucaguauuagcagaggucaagucaaggugccaugauguauauuaaaaccuuuggaacucuuuuguaguuacggggaacacgaagguuuagcacagucagcuuggaguuuuauaaagacuaucucugaagcagaguaaaguaguuacuauauguauaucggcacacucagguccugucacaccaucucuauuuauauuugcgacaggguuucucuguguagcucuggguguccuggaacucgcucuauaaaccaggcugacuugaacacagagaucugccugccucugccuccugagugcuggguuuaaaguacccuaccaacuccuggguggagaguucuuaugauacuccuccaagaguuagguuuuuuuuugugaugugaccuuggucccuuucccuaaggagaaucaagcugcuauuuuuuuuuuuaauguauccuuacuuuuauugaagugaauuaaucuuuuaguugaaauuaauguggaagcuaguauacacaaauguaugaguuuuauguauuuguggggguguacuaagaauaugucaccacauguauccauuuuguaacauuuaacucaguuuugacaugucucuucccuaguuugcauuuuuuuauggugaaaacauucacagcucucccuuccugcuuucugaguggucugucacugucccucuaguagcccugccuuccuaugugacugugacuugaugcucccuaucugcccuucccauuccuccauccccaaggacuuauucuguguaucccuagcacauugggucacuucagagcuuuaaggagaaauaugauacauauauucuuuucuucaaacaacacaauauuuagugcuggcaagaugucucaggggauaaaaguacuuacuuguggcacaaaccuggcgaccugaguucaaaccccagaacuccuauaauaggggaaauccugacucuacaaaagauagucucugaccuacgcacaugugcaugucguuugaccucaugcacacacacuaaauaaacagauaaauagaugaauguuuguaggucauuaugaacugaauagaaauacaccaagcauuacugugugucaaacacugccgagcuucugauucgaaggugcucuuggauucuuccuuacuguuguuuaagagccaugguccuuagugaucugcccaccacagagaguagcaguuagucaugccaggaaguuacuacuuggugaaaaucauuucucaggucauuauugacuaucaccauaacuauauuggccuaacuuuuaccagacucugaccagguuaucuaaaagacauuuuuguagcuuggugguggggauggaccauaaauuugacucagaaccacuucucuuuagcauauccaguagugaacaagcuucagaugauaguaacaaaaauuucaacagauauugaagacaugcuuuuguuuugauauauuuuuuuuaauucuucaaaugacuugggaugugcugauaaauggcagugagaagggaaguugggggaagaucagguuagguucccagaaacauuuaaucugcuguaggaucacuuggcuuugugcaauuucaagguugcaucagacuguaagaagcaaggugucuaaauauggcacaugggcaccacuuagcacaaguguuuuagaacaguaaaucacuuccuuaggcgagcucguguuagaggagcaagaguagucaggcugccuuucaccagggagcaaaagcucuggcucguggcuguguaggccaugaaggagcuccagucuuuaacccaagggacaggaguggccacgguuaaaaccacagucuagagaucuccucauuucaguugccuucuucccaaaagaauaagcagcauguuuagauucauacuugugagcagagagagcuggguggccuguacacacuuggaaucccugacaccaaggaggcugaggcagaaggguccuuucagcuggacugugagauccaucuggaagacuccuagagaauuucagaaggaagucauacuaggucgauuuugccucaaaaauuauguugcaucaagcccaaaggagaagaaauauagaaaauauagagucauaucaagaaguagagaauaaaagguggggagaaaguggggagacugguuggccagcuucuagguucaccauuuucuuugucguggcaacaaaaucuuacuggacucaaaacagugcucugggcagcuccuaacccuauuccugccauccuuguuccuuaacagcuuaagccuccaggaagguaauuuugucagcuucuuguaucuccaucuagagcauggucucucccaagagcucagggcagggcuaugacaccaccugccaccucaggggccagggacaaagguacugacuaggacacuuuggcaugggggcacagacccagcauagauaauucuaggugcuacaucacuguggagauaacuuagcuuccuccuuuuuucuuuuucuuucugaggguuaguccacuuaaaaucuugcacauuuuaaugugcccauuuuguuaauaauaucucuugcguauugaugguguaggauguagcugaacuagguagggcuccaugcuugguauggcacaaucuuuccagagauuuugagguagaucauauuauugcaguuuuuaugauuaaggggcaagguucuacaagcuaaccgauuuuguacaggaucacaugacucgagaggaacagagcuaguauucaguauagcauaaccucccuuacacacacacacacacacacacacauacacacacacacacacacacacacacacacacacacacacacacacacacagagagagagagagagagagagagagagagagagagagagagagagagagagagagauggaagugguuaaugaaacuuuugagacuggaguaauuugaccuggguggugauuugcggggguuuuagauguggucugaaaaauuccuucucugaagucaaccacaauaacaguucauucuuggguucucugccaacuauggcucccugguuacuucccucuccugcaguuggaauuaagugacugaucugaggugacaucagaggggacugcaguguuagaguucauaguaugaaaaguaagggugucacuugcccucucugggacccuuaucugucuuuugggggcacaguauuugcuauuuggcuucaugaggugguacauauuuuguaguaugaaagaaaaccuguuacugggggcaaggggcagcaagcaccaguucauuguagaaagcaagcuugugacaaaauuauucagcuuucucccaaaucuuaugguguccauagugauuuuuuucuaagcaaauagugguuuuguuuuguuuuguuuucuagagugaauagugauuuuuuuucuugaagacacagauguacagcuuuuggaaaugagaggagaauguaacuuuuaacacacauaagaaggggaggggcagggugagaaaggcugccccaguggggcgugugacacuguggacaugaaggaugcacccuggcaaauaagcagauucucggggaagagacacuggucuuuauucuacuggacagaaguuuagcaguagaggcaaugaaggugaggggugacauuuugcagacauuguagccaaacaugauaaggcuccuguuuaaaguccauggcuucuagugugaggcugcccugccacucaccugcguaggacagcugcagucuuuucccuucuugcuguuucuagagucucuuguuggacaguuuguacguguuaaggagcuccagagaggaaaucgaaaaacuauggagagucuggccucugagucugacccuguaaguaggaaucucaacagguuagacucccuuggaaagguaaacucuuagguaaccuauguacuagacaagaggugagcucaaagcugaaacagcaggggcaguaacaaaacgaaacaguuuuaacacuucauugcaauuguuacacucuuaguuugaaaaguggccaguguggccuucucuuugaaaggaacaacaacaacaacaacaacaacaauaacagcagcagcagcaacaacagcaacaauaauaacagcaacaacacucuucucuuaauuuauaaaugucagucuugccucaauuccacaaaaaaaaaguaagagaaaagaucuuggagaagagaacuggcuucuggcugcaggagaagcuagccagugcagucagaucuuuccaguuucuuuuccuccauuuugugaaguaagaaucauggugaaggucauugugagaaucacaaaaauaaccgugcuguuuucaugaaauuuacuguagagcaaagggaaaaaagggaaauaggauagagggauuauauucuucuucaccauuaagucugaccuaggaagcaggagucaaaggcagaaaugaauaaccaaguuuuauacaggcauagacuagcaggguguuccgaccuuuaggauugaagagcaguuguaguauguuaaccacuuuccuggcauaaccacguagcuugaucaacaacaaaaggagucugcuuuucugcuuaauuuaaucccuuccuugcuucaaguauaagggcaagguuuugaggaagagacuuaugaguuuauagcaguuggugacaccaccaguaccacguuuuguugagauucacuauugugcucaaaauugccuuuuuguaggcaagcagugaaggcugcugaaucugugccauccauuucucuggcauauacugcaagccuaguguguucacgccaugaacggccccaggaagacaaagagguagacaggcucucugccccuucuuuccuagugugguguagcuauggagacaaaaccuaugugcuagagccaauaaaagauuucauagcaacucucugccaguaaguguguaagaacccaggccagaugacgcagauaaaugcagaggguucauggagguagaggaucaagccaaacacaguaccguaaauggguuagggcaggcacacuggcugacagugccuguccucugagcccuuucugugguguugguaaggaaugacauaggacagagcugcucugaaaugaagguggccgucccuuccaccuuaucuaagagccugccuguaucucgcagauggagauuaaauugauccaacaauuugcucuccgcaaagccauguugguuuucuaccuaguaauuuaugcuuuuccugguguuugcaaaucgauugcuauuaugggaugcaggcagaacugggccgggauccaguagguugggggauuacuggaguggauagcugaaccugccugugaaaacccagacgagacggcucuuguuucucugucuuuuacucucugaagaaaugcauagucuuggguuuuuuuaaaagcauucuuaauuauuuuuagauuguaucuuuuaagggacaguaucugcuuuauuucagauuucuacuaucuggccuugcuauuugccuaaccuucaaacgguuuuaguggcuuuguggccagaccucucauugcaggaaaaccuuccuccacccucaaagcauuaugggccaguaauuguucccuuugagaagaaauauguauagacauuuaucuagguuggugaauaaaauguuccuauggaacagcuugggaaaguauacuuuauuuaaacacuucaccucauuguuguaccuuaaaaaaauuuuuuuaaaguucuacuaaguauugugaaauucuuucauaacaaauuaaaaagaaaacauauucugugauuucuuuacagauucuggacaaucaggaaguccaagccacagugauccugccaagaauccuccagguaaauauguguccccggacgugugcacccugacauuguuggagaacaaaggggcccuguauagaucaacagccauaauuggucagcugccugucuuguucuggcaggcagucggauugggacaagaugugauuguguggaggccucugcaacagcgggaacggcuucucaccgcagccaucuuuguucaccugagccgcgagaucuuauuuauuuguuuauuuauuuguuuauuuauuuauuuauuguauccuuagaaacugauucaaacacaugcuuagcuuuauguuuuaggcauuugaaaagcuaaacaccuuuuaaucauuuuuaaaauaaacauucccugcccccagaguacccccaaacaaaaaucugguaauuucuguucuuuuauaguuuacccacuauguuuuaagaaaguuucuacugaaugguuauguuuuuauaaagugguuuuugcaggacuuuugauucccggucuucaguguaaggugcgucuggucuuuaguuucagaccugagccugacugcaugcauuuuagcuauacuggggaguuccacucucucaacaugcagcaugcgacuuuggauuuauaagaaguuuuuuguuuuuguuuuuguuuuuuuguuuuccaugagaaaaucauguaaaauuagcauaaagaauaauuucaaauuuccauuaucauaaaauuuuaauuguaucugugauuuuguuaaaagaauguucuaaagauauucuuaacaaaacaaaacagaaaaaagcaaaacacaauaaaccccaaauagccacaccuccccucagucucuccaaaaaaaccccucaccugccauuucauuagaauaaaccacacagugcaaaaagucagaacugaaguuucucaggcccucaauugcuucgaaauccugaugccuggcuaauaaaaaguugaaauaccucaaguauucccaaaugucaggaaaauagacuauuugcucauaauauuacuagagagacauggcuauacauauuuucaguaaaauccaaaauccaaaaaaauuucuuccuuuugaaacuuacauccauguuuuucuuagaaaauuuacuuuucuacauacacuuuaaguaauauucuucuuaaaauuauauuguuuagaaaauauuguauacucugaugaugaaaauacuaauucaauguuauauacuccaaagguaaacguauuaaucuaauacacauuauauucuccgacaauaaaaagcacuaguauauuuuaaauuuacacugaauugauuuuaguugguaaacuuucuaaugcuacaaacugugagcagagcauaaaauauuuaaauuaaaaaaaaaaacuuuaaaacccucuacacaguuuacaaaaaaagaaaggaaggaaaggaaaggaaaggaaaggaaaggaaaggaaaggaaaggaaaggaaaggaaaggaaaggaaagggaggaaaauaucuucaggagaaaagggcugguaagccuuaaaagccagacuaaacaaaggcugugcuauuugcaucugaacaacuugauuggaauuaaugaaguagugaauaagaagugcuuuucugagcaugugcagagucucacccaaguguuguuugcucugagcaugcgcagaaguucacccaaauguuguuugcuggagcugggcagagccaggcaggugaccuuugugugcuuauguaauggcaggauugcauuuuuaguauuugucuagaagguugguuaaauuuuacuuuugcugcauaccacauagucuccuaaauuuucugcuuuuguaaagcaaauugaaacuagguagaacacauuauuuucucccacuuuuauguuuccuugggggaaauuuaauuuugauaacugucaaaaguuaagauguuagaauacaauugaacuaguuuaaauuaaaauuggaauuuucuuugaccauuaaggaacauccaucauuuagcaugcuuuuugcauaucaucauaugcauauuauuauagaucuuaguaaggaauuuucauuuuguuuugaaaugacauuucuuaacauuauaagaauuaaguucuugauaagagcaaaaauacauucugcaauauuuugaaauaaaccaggcuuuuggaaguaaguaauaguuuucaacuuuaaauacaagagaccugaauuuaucaaaguucuugucuuguagucagccagaauaaaccuuaucagcaaccuaggcauugguggcucagaacuguccuaggacacuaacugucuucuuuucuuaguucugucugaacuugguugaacuauaaaaucuucacacagagauuuaacaucucaggaggugcaagaagucuguuuauuggaaaauuccgacuagcgccacauucguggauacugaucauccccuugcuuccacgagaagcugggcuucugcaggugguggcuuccauugccuguguguugcugcaggauuuccacuaagagauauggaaaucauaggguuagccacuguuuaugacagugcgugguucccagcaacuuagaaaaaggugucacagcagcucauggaaucuguuccugaccauugacaugaagguggucucccacucagugcucucauguaucuguugaccgucugccgccuucuccacucugcuuggcuaucugacagagguucuacuaccuuccugauucugaacuucuguuuuguaauauacaguauuuuuaaauauuuacuuucuaaaaaaauaguuaauauacaacuaauugguuuuauuagggcaguuucacacaugucauuauacuuuguucuucaucccugccuuccccccaucccccuuuccacucuugcuaacccugguguccuucacacuggacuauguaccuugacagguugcuuuguagcuauauuccuugcucuguggucuuuuagcuuucccaacugaaucaccugcuuacuucagggugggaggaaaucaagagaaaacaggaaucuggaagauuaauuugggcuuuguuccaaguugaugugucaguuuguaguucaagaaggcugcaguuugguggaauccuugguugguagagcaguaaagaaauguugaauccuaaauuuucagauguaacuuuuuaaaguguuucacauuucauuagccagaauuuucuauuuuggaaugaauggguguacaguuuaauagccuuucuuuuuugccagaguguguacuuuguugguguguguauguguguguauguuuauguguguguugauauuucauguguguugacauuauaucauuauaugagccuuggagccauaucuugugugaccuuaagucagccaccuugaaucucuucuccauagcaaggauagacaugacuaauuaaaucacaugaagaaucucugucagcugcaguaauggaguugugaaugcuuucguguaagaaauuguuugagucauacaaauuugcaaguuguucauuccccaaagguauuuuguagauuccccccauugaagucauuacaggagagccacaaaucuuacaagaaccauuuaguacugccugagaagauagcucagcaucugaauugauacuaggcaccuucugggaucacuggggcccauguuccccuaaccuuucacucuguguuuuaagccuuggauuuuggaguguacacaacacucucuaauagcuguugagauccuaaagcacuucucuuugcuauucucaugaacagaucguuuuuuagacucccacuaccuaagaaaaaggagccuuccuuugauuaaaauuagaaugcacuguuuaaaaguucauacuuauucguuuucauauccucauuuauuucugccagucaagucuuuuaaaugggugaaaauauauuguuuaauaauacugaugaauagcauuaaacuuugguauaguguaauguucaacaagcuauaaacaagcuuucuguucacaaaagaauagcgagaaagacccugaaaugaacaguuagcagcaguuaauaccugaagauagggaaagcuuuuaaguaauuuaaaaauuagaucugugccagucaaaaaucaaaggauuuuuuuuucuuggauuugcuucagaaacauauuucauuuucuucucacuuauuuggaaacaugacacuuaauaaagucuuuacauauuuaaaaguaguucaggauugaggacaaagaacaagcagaugagggaaguguuuauucacaauauauucugaaaaaucccaaaaaaggucuagcccccaacuacuaaguuuuauaggcuacauucugggcuuucagacguaacccacucuucaaaaguuggugugcacagcaguuggcaccaagccaagccuauacuaugaaguuggucugguugcuuguaauaguuaauuuucuaaaagaaagauaauuuagagcuaucccaugagaccccaagagaaggagagcucucucugguucuacauucacucaaucacuuauuuuaucaggcacaaauaauaucaguuaccaccagcuaucaaguucaggauuaaauauuacacucucaacaaugagguucuugguuugagugggcuaaaacaaggaguggaagccuucaucuucccuugggaauuugggaauauauaucauuccacacugagugaguauccuuagcaacucaagaauuucugaacuggccauaaggaaaaauuccaucugguagauacuucaucagcaucuauuuugugccagauacuaggcuacauacuguagacauuuaaaaaaaauaugaauuucacuuaauucucauucuucccaaguuuugucgguaaguguauacaguauuuuauauauacugaggauuacauuuuguuuacugcuucaacugaauuguuuuaguucaaaguuguagaacagcauuucugcccauuguggggagcaugaagggugggaagaacauaagacauaaauugacguuucucuccugaaucaacuucuguccuuuucaaucaucuugaggucaugaggagacuguaggguucagccaacuucuuaguaacucggcuaucugcacagaauaccuggauaauugcacguguuucauaaaaaugaguguaguugauuucuuuguuuuaaguuaugcucuuucuccagcuugacugguggagaaaacuucgcauagaaagagcuguucgaucuggaaauaaauagguauuuuuuuguucuguacuuccuggauaucaaaagcagaguaaagauacagggacaaggaagugagguagagugggagaguagaccaggcaaggcugggguggguuuuauaauggaggcaaaagaagugaaugcuuucagguucacgaucggcuagaauuggaguuuuuagauggugagucuguugcaugucuuuuggcauugaaagucagggacacugacuuuauugcauagcucuugcuauugucaugagaauagguccuaucaucucucuuuggggauugggcaacuuuuccccuggcaagacuuuaucuguuagaccaucacauugacacuguagaaauauuuuuucccgguugcuucccugugauauuccuaccuccugaagccaccaguuuuuccauuccccuuaaaccuugucugucuauauaucucuuuucuuucccuguugacucuuacuaaagaccugugccuuguccuuuagauaagccuccccaaccagaggcuccucucuuccuuguaccgacuggacaggaaaaaccaucaacuuuuuaacuaggcuuguguucuuguugagucucuugaacucaugacuuuuuaggagcuggccccaagugguuccuuuccauucugugccaguuuacaugugcuuugucuuguuuucuuugugacaggcucuaacccuauagcccccauugcuuugaagugguagcuagcuucccguaucagccaccaagugcugggauuacaggugugaaccaccaugucuggcugauauuuuggaguauuguugauuugagcguacucuguuuaaaacuugccucuucauuuugaaaguaauaccucugcuagaaguccaggaauugguguuuucuuaaguguuuauaacgacauuuuucuuaaugagaacuuuugccuuaggcuucuguguuuucaguaccuccuaugcacuuucagacugcauucucucuuaguuuggccaaagguauguuguuggagcagauuccucuucuaaugucucagaccuuuguuuccaacaauagguuaaacuugauucccgagaugccucauggguagcucagauguaacauuuucaaaauuaaguucaucagacuugcuagcuugauaguuucuucguucuuuuagaacauccccagucacuuuugcuaggggaaacuuguaacugucucaggaauaccccccuuuuaccuguauauucuuccuugggcacugaguucucaauucuguuacuuuagcuugagaugugaaaagacacucuggcccagggaacuuacaaaagaaagcauuuaauuugagguuauagagucugugaccaucauggcaaaggagcauagcagcaggccggccagcauggugcagaggcaguaguugagagcuuauaucugauccccaagcaugagacagagaguggggugacuuacugggaauggcauaggcuuuuuaauccucagagcucauagguagugacauaccuucuccaacaaagccacacuucguaauccuuccuaaacaguucuaccggcugcaaagcaagcauucaaaccuaucagccuagcaaagccauucccaucgaaaccaccacagucucugagcgugauuucuugccugaauccuuguaauugccucuucuuuccugugcuucuuuucucuaacccugcgcacgaaucugucaugaagcaugaacaugguuuaaaagccuaggguggcucgcugcauacaaaacugagugccucacguaguuuuagaucagcaaauucucaaccucugggucaugaccccuuugaggcuugcagauauccugcauaucaaauuuuuacaguaugagucauaacaguagcaagaucacaggugugaaauagcaaugaaauuaauuugugguuggggaucgccaccacaugaacuguauuaaaggguccuagcauuaggaagguuaaggacuacucuguuagaugcugcucaguacccaguccccccaucuccugcuuuuacccccacaucauuagcugcugagcucuguccaaugccacagcuucaggagccccacugcaaacccaugcucaccuuagcuauccagacucuuucaugcauccuaugggauuuucccagacaccacuggguaccucuguaucuacuccauucacagcuuuauccucccagccuguuuacaugucucuucuaauagauaauuuuuccaugaugacuauaccacucuaaucuaguauaaaguaaucauagauauauuguucaucaaaaguucaugugugaguacuuagagauuguuguccaacuucuuucccuuccuuaucaaaccugugugagagcugaaaggaccacuaugaagucccaaguaguuacuggcagauguagcuuuaaucaguuuuuccccauggaucaaaacuuuauuuggauguaauuuuaauacaggaccaauacuuucccccauuugucaccacacacagccugcaggcuauacuguguguagggguggggggguguggggguguggggaaugguaucagaagugagccaauggagggugaugagaguggagcuugggccagcgaggauguaauuagggcgagcauaggggagggcguaauuauaauuagggugagcuugugguggugguggugggggggaggcacauaaccagaugaguuuagagagggaugauuuaagaggucucuaggaagugggaugaggucaccuggaaagcaggcucccacuacugcaucauuucccauugcccagaaucaccugucucuuccucacuccauaauauuuuacaugccaacucgucauugaauaauucagguugagacuugucacuuagccccaguauaacuuaaguaaaugagaaaauauugucuuucuaccauguaguaagagagaggacagguugguucaggggcuagucuuaguuauucaaguuauuuuuuguuguuguuguuuguuuuaauuuuaaccguguuaagggucuuuguagugucuaaaauuaaguagccaugcaacauggauucugaauaaaaauauaauauucugauguaggcacuauugaugcugguuagcuggagcuaagaaauuaauagugauuaagaagagaccagcaucacugaggugaaaucuucaggaaaguguuuuaauauacugaugaaggcacucagcuuacacugucccuaguucaggaagaaaacuucccagaaggcuugacaucaagaaauuguaguuuguuaaauuuuaagagcuguugcuggaauguauuuuucuuucauuguugaaugucuugguucccacagagagccagaauucccaagcaaaagucaaaaguaaccccgagguuagguugugccuggaccucagggcacuguuauaaugauuguuccuucagccaaguagucuguauuccucucacagugacugccugugucuaaaaucucuucucaauuuaacuuuccuuuccucucucuguguauuucuaagcacuaccuuucuaguuugcaacucugaauuaauaaugcaaaccauuuuccuccucacagcuggaaugugcggacagcucuguggugcagagugggcuccaggcuggaugcagucucugaaggugcagcuuccuguucucuguagccuacccagggcacgguggcagcucugguguggaaagggggaugcguccuguaauguggcacaggcagaaugcauggucgcacauguggaccucucacuacuaaauugcuauguucucucugccuuacaggcuuaaaaagugcauuugaggauaccgggcagcucuaccagacucucuccuuuuucuuucuuuuacccaugacaucacaugaaauaauuuaagccaggacuuauccuugacaauuugagucuugcuaucuuuuaacuaacaaugccaaagaaccuugaauaauuuagaagguuuuguuuuucaaaguuguuaagaauuucugggggagggggauauuugacauaaacucaguuucagagaccuucccuuuuagauuuuuguuuaauaaagcagcaauaggaccagauucccguuuugcuguaugauuauuagcccauuaaagggauuuucccauauacucuggacuuggauuguuucaugucuccacaguccccaccccccccccccagucugcccucccccgccccacccuguggcauacccaugucccccugguauucaggagagagacgacagccaucccgucugacuuuuagguuucaccuuuggauuaucaguuaaaucaaaugcagggcuguuacugccuacugugcaagcgugaagacaggagauuggaucccuaguacuugugugaaaagagaauguguagugugcacaugcaccuagaaccuuaguccuggaggaguagagacaggcagagucccagaguucccugggcuugcaagccaaguuccaugagaaaccuugucucaaaaugcacaguagagagugauagagggagacaucuuuagacugaccuauggccucuauucccaugcucauacucacgaacacacacgugcaugaacacaugccaacagacuuacacacagauagguacgcacccaaacacacauagacacacacagguacauacacacacagacaaacauacacacagacacacaugcauacauacauacacacaaauacacagauaaacacacacagacacauacacacaaacacacagacacauacaaauacauacauauggauaaacacccacagauacacacagacagacaugcacagaccugcacauauacacaaacagauauacacauauauauguacacacacacacacacacacacacacacaccccaaauauacuuguuaaugccauaauguuuugucaauugcugccguuccugguuauuuuguagauugucuuuaaugcaguggaucuuuaauuuucuguucucacauuccuaacuuaacuacucucuagccaagcaggauuuuucuugugcagcacaaugaagcauucugcuguuuuuuugucucagcaguccuaggugauauccaggagucucccacccacccauacacacagacuguugcccuucauucagagagggagaaguagcuaggaauguuuaagacccagauguagaggaaaagacagaggaaugaaugaauggguauaugacugagugcagaggcuccagaccuucggggcauuacucuuaauuaaaagaaaauaagcaaugucuuuucaaaagaagauaauuggugcuaaauuauaauguguguuuauuagcaaauauuuucacuuuaauuaguucaucuaagucauuauaauaacuuccugaccucaauagcuuaugguuuugccuugggucuaacccucugacguguguuacagguucacauucuccugguacuguguaaaauguauuauuccauuuuuuuccuucugcugccaaggccccacacuaggcucaauugaaguucuuuuuuuuucgagacaggguuucucuguguagcucuggcucucuggaacucacucuguagaccaagcuggccucgaacucagaaauccgccuuccucugccucccaagugcugggauuaaaggugugcgccaccaagccuggcucaacugcaguucuugaccaucauaaaacagcucuucaggcuuuccaugucucuugucugugcucuuccacccauaguuaguaucuaggaugucugcacccugugacucccuccaugauagacuucuucagacucuccuuucuuuauuuuacaguaauagugcuuagcacauugcuaucaacaaucuauucccgucagugaguucugaacgccuugcgauuauuauuacauucuuuuguaagcuucucuuuacuaagguaucugagccuggccagagauuguacuuugcagugcucaagacuugugacauggaggaucagaccauauauguucaacaguauaagcccaggcacagugccaggccucagccagaaaacucaggcauuucuguggggauaugaguagcaauccuuugccuuguagguaaacugcaccccagucaggacugugcaggaggaggccgauugagagguguagggcugauaaaauccuugauucagaaucuaggcuuaaagaguuucuuuucucccagucaaaugaauugucaagaggucuucuuuacucuuuugugcuuuuacuuacuaacccagagagaauguaccacaaucuugccauacuuugcacgcucacaaaaggaagauccuucugguaagauaacaucugaggccgggcggugguggcgcaggccuucaaucccagcacuugggaggcagaggcaggcagauuucugaguucaaggccagccuggucuacaaagugaguuccaggacagccagggcuauaaagagaaacccugucuugaaaaaaaaaacaaaacaaaaacaaacacaaacaaagauaacauuggagaaggagccagacaaacaagugauauccuguaguaguugggaucuucagagaccuuccagggucugcugaguguaucuaauucucuggugaugauuuucacgggaguaggaacaaguacccuguucugaaaaucuggcuacuuuuuguacaagauaaacuggaacuggaguuacacaugauugugagccaauguauaaaugcuagcaauugaccccaaguccucuagaccagugcucauaauugcugagccauuucccuagcccuugcauauucauucuuguguggcuucauugucagcauggucaccugguagaaugucaacuaguuagguggugggaagggagaacgcagaauccaacuccuucucuuagaauccugggcgcuguuccuguuccuggaaacuuugaugaauacgacuaauaagucacuacuucucuaguaauuauucacccaccuggaguacuuuaccacauuuucuuauuuaaucuucuuaacuccgaguuuagugcuuuuggggagguaagaauuguaaguauucgaagucauaaacaucauagccaucaucauugucaucaaaacagcaacaauuacaacaaccaauggccagccugcuuuuuaaggaugagguagaaccugaagugcccaaagccugguauguaauuaacacucaauaaauguuaacuauuauuugcaucgucaucaucguuaugguuacuauuuugugaaagugaguagucuuggcugagucucugagugaggagacaggauuccagaucuacuucugcucauucaacaggccuuacacucagcccagauuaaagacuuugcuuauguagccaacagagagccacguacugcaccaaguccaaacccaaagucuggacgagguuaaauggaaacaaccacacuaauaggcccuugaugaaaaaacaaagaaagaauguauuaguaccaucuagaaaagugugucugugaauaugagaaacgaggggaaaaggaagagcaguuuauucagauggaaggacuugcaugauaaaugaaccaaaaaauauacaguuugaauaaacauggaaccauguaagagggaaaaaguaguaaaagaaguuguuuucaugcuauuaaaaucuauaacuggcaggcagacacccagccugggggaggugaucgugggcacagaaaacuaacucagguuauuugcucuuaaaagcaaaggauuaaaacguuuaaauaauggaugguagaagaugagaaaacuucaaacucauuuaugccaccuuuguagaaaaaucagcauuauagaaaaaaauuagaauugaagacaaaugaggaaaauuuguaugagcuaagaaugacuuaacuaugugggucugaauagcuaacuauaucuaguccacagucauggaaagagaucagcgacugaauauauucaguggaaauguuuauauuucaaagcugaagcagaaaaucuuuugaucacccuagaugacuacagaguuaucugcauauuucuguuuuucaaagugaaaugcuagaagauagucaggggauauuuaaaauuacucgaaaaagcguuugcauuaaaguuuuguguucaaaggcaacagaaacaaauucguuuuuguuuguggcccucuaaaauuaucuauguuuugucauaauuuccccccugaaaacccauuccaacuggcaauaauucaauuuuuaaaagugucagagaaguagagguaacucaaaaauguugaguuccuauauauacaaguauaaagauuagccaucggauugauuaugaguuguacuugauaauuacuguaaacaauauuacaaauauaaauggcgaugugaagauuacuuauuuuugagcauagucauauugugguuacagauuccaaguuacauauuuaaaauuguggcaaaaauauacagaacauaaaguauacccuccuaaauuuuuuucaguuaugcaauuuaguagugauaaauguguucccuucaucauagacacauucuugagaacgucaucauuuugcaaggcuaaacucuacccauuaaacaguucccuauugcuccccagccccugacaaugguucuacuuuaccagccuuacuguccuauaucacucuuauaugugaaggcauauggucugagucuuuuugcaguuaacugaucuccagauuacauuuuuaagaacugaaaauaggaggggguuggggggagaaccaaggaauggcagaccugcuaucucuuuuuagagauucaguaaagcagcucuuugcugagaagugaacuuucaggaucuugauauggucacgggaguguuuauuccuuaaguuuuucagauagcagacaacugagucaugggcccuacuggugaugcgguacuuguccuucggauggcacagcuguauuccguugaggauguuucacacagggcucacaagguugcacuuguguauacuggagcuuuuuuuauuggcuuauuuacuugggacucaugaaggaggugaagcaucuaagaacuuaagucugcuagucucagaaaagaguaagggacauuauucuucagauuugucacuguuuccuaaggccuggccuagugugacaccaaacucucuccagcuguguacccaucuggaccugauguuauuuaagguucagucaccuaucuguucugucuggaguggccauauccugaagugcacucagaucgcccacagauucuaauucccagaacauccugcaguuguaugggcucugacaugcaccagagccuugcuuucugcuguuuggugcauugcuaaccuagugguucccaaacugcuacacaucugaauuucuuguggggaauguaacacucucuccuuguccaggucucgccucaaaggaauuaagucagaaugauugagguuggaauccaagcuuucauuggguuuaggauccccaggugguuacaguugagcaaauguugggaaacugcaguaggauaauugcucuguuucaggguuuccaguucuuugcaauuuugguuacuuuuauuuuaccaaguaauugcucauuugggcuuucaaagcuguggucaguuuuaugugcgauccucucccaagucagcuuccauguuuaugucuccuuguugagcuggugcguuuucuucuuuuucuuagccagccuugcaaauaaguuuuuuuuuccuuuuguucuuuccaagaaauuauuuuucuuucuuucuuuaucaccauaauaucucucuuuucuuaaaaaaauacuguauauauuuggguauuuugccuguuugcaugucuguguaccacuguauguuuggugcccgaggagaguguuggguucccuggcacuggaguuacagacagucgugaggcacuauguagguccuaggaagagaauauggguaaagcaguaaguucgcaucaccacagggccaucucacccccuccuucucuuuuuaaauggauuuuucuaugcaauuuggauuuugacuuuaguuucauuauuuuaagaucauccguucuuuauccuccucagccucaccaucaaagucauuagcagacgaaugguggaguaucuguauuccuaugcaguagagcuggcucgagcaucaaagucauuagcagacgaaugguggaguaucuguauccuaugcaguggagcuggcucgagcugggcacuggcucuguguugcacaaguggcuuugucuucacccugccauuguaucuuuccccaagguucaguaagaacauccagaaacucuacuuaaguccacgacaguuuuguuuuuccccucagauggauuugauguuuggaugguaaagaguguucuugcucucuuucuuuuuguugcuuucaauguaguuuguaaguucucuuuggguuuucuguguaguucauuguuuauuaauuccaaaguauuucacaagaguuacucauuucuuuucuauugucaauauuguuucucaaagaugaaacagucugaccuagagaagccuccacuuuuaaggauuugcucaaguuaccucuguaguagaggaugugaucaacuuguuugaaagcuccaaggguauggcaauacagaacaauuugcauacauuugcaugauauaguuugguuaauagauaugcuaguuucuggaagagcuguacuaacucuuccaguauuguuguacuuauguggaguuugugaauuacuuauacuguucuacuuauuaacauauuuuaugccuucuauuuugcuuuguacuuaguacaaguuucuccauuucuuuuaauaccucaaucacauuccucuucuguuuucuguuaacuuuauauuaaauaucuacuacuauuucucucucuuucucucugucucugucugucugucugacugucucucugucucucuguguguaccugugcuucacacuaucacaugugcaugggacuugcuuuugcacagauuuccucugugcucagagaagaaaaauguggaguagagaaccugcuuuagugugucacauaagugaccagagccacggcuacugaacuaaguuccuuugcuuuagagggagaucuaucuuccacuuccacagacgaaagagaaggaacauauacacugugcuacacuaugcagagcaagugcucauuaguuacuauaaaauaccucuucucaaaaagugaagaauuuccuagagugaauauaaaauuguauauuugugaucugacuucuuaauucagucacuacucagaauugauauugaaggauaaucuuaauucuaaauuaauguuagcaggacaggaacauagcuugguggcacacuuuuguaccauacaugcagcccuauugauucucugauaccacacaaaaaaaaauuaagaucagaauuuuaggauaugaaucuugacuauagacugagacugaauccuaauucaaaaaaagcaucuuuguaaagauuuaugucuccagucacuaaacacuguucccaacauuugccuuggaaaguucaaggcaguugacaagauagggcucuaucauauauaauuuugaauauagaaacuaucucagaaguagaaaacaagucaguuuuccacacaguuuugucugagaaacagacacaggcuagaagaugauuucaucagggaguuuccccuaaaccuuuaggaaggucucucaagccaggccucaagccaggcguuguuuugucuuccgauccguuuugugauucguccccaucacucugguaugauaauuucacaggaacaaaguugccacaguacuccuccaaacacacauagaaaacucagagggaacugguuuaucauuaaguggacagaacugucuuccuugaugaacauggaucauaauucuaauacuguagagcaucugcgaaugauggaagggaccauuguugucucauagcaguuugauaagccaaaggccauuguauucagagaaaaauauuaaguggggaagauuaguaaggcuuuauucaaaugacaagaaaaauauucacaaaaaugucuuucacuacaauaguuuagaaguaauauucagcauaaauguuccuguuaguacacuccugguuuacauacuuuuaguguuugacuuuauucuggauuauauuccuuuuguuuuuccaaaagcucuauuuucaaaguucuugacaaagaaauaauacauauguaucuguugucccacugaccccggaaaauaaauccaguuuuucuaaugaaguagauggaaauuacaguaucccuucugagaugucuugcucagaucaacuugccacaguuaacgacaagccguuucuagugagccacacgaggugcugggguggcaaacuugcagugugcccggggggaaucuaacuggcagaaaccuucauagagagcagccggguaguuuugagcaagagcuuugggagagcauauucuuugaccugguaagccaucuucugagaacuccagccaaagggaaucaugggaauugcugacaaagauuugugcgugaggaucuuagugguggugcucuuuauaguauuuguuaaaaaugggaaauaagcugggcuaugguggcgcacaccuuugaucccagcacuugggaggcagagacaagcggauuucugaguuugaggccagccuggucuacagagugaguuccaggacagccaaggcuacacagagaaacccugucucgaaaaccaaaaaaaaaaaaaaaaaaaaaaaaaaagggaaccuaaaaugccaaacaguaagagaaugaccaagagaauggucauaucaaguaugcagugucgucauagaaaccgugcuucuggaacaggaaaggauaggacaucaaaaggaaaauuuuagcauauggauauguuuaaauaaauuuuguuuuaauuuuuauaaaaccacauaauuauauguauuagacaugcaggagaaaguuuuaugaacuggaaggaaauacuaaaaauauacccagcacuguccaagucuguaaauaccggagauuuuucuuuuaacacuagauuuuugcuucggggacuugcauuuuuuauuaaaagacaaacuauuucuagauguuagaauguuuuuguggcugucauugagacucagaucuacuucuggauucaaccauagauguuucugaucaguuugaugaggcagaguagagcuguguacauaacaccucuaccagaaaagcagcagugccuuaguuguggucuguggugcugagagaccugugaggucauuuccccacauccccuuggcucccauaaaugaggaguugcgucaucuucuucuguugauggaaacaaacuguuggaaucaaaggcuagaugacaccuguccuuugaaagcacagugugagaaaaguuaacaugggggaguaaaccuggaaucugagggauucaaagggcuuuuuaguaagaagauauuguucuuguuucugcuggugcuuuuauuuuuaacccagcaugagaauucucauguccaguggaggggcuuggacacaacacaacucucuagagucagagaguuccuuaucucuaagacggcaccaucguugucauggcccuuaccaagcuguggccgugaagguuuuugcacauucacugggcaugugcugguuaagcuuaacauugcagucucacauugcuuuuuaggacuuuucucauuggaugguaaaucuguugauggagccaggaaacaguuccuggaauuauucagcauaaguuuaaucuaccaucuacauuaacugccuucaaauacuugaagacggcucucaugaauuuaauaacugcuuucccugugguuuggguuuuuuuuuuuuuaauuucaagaauagaacacaguagaccauaaaaaugaguguuaucauucuucccuuagauuuucuauguaaauguugcuuaacauuuaaauggugcugauuauaauuugagauauuaacagauaugccauugugucccuucuguuauugucuguaaaggagguuaaacacuauauuaacuucugaguagugauuuacuguuguuuugucagagaaaaauaaaaaagaaguaaaauaauguaauuugauauugccuuugagacucuuauguuuguggagcucuuuauuucccgacucaauucuuuuuuucuuaaagagcauagauguauguaaacacagcaucacacaaaugcggaguuguucuuucuuccuggcuuaugcuguuguguaauauugcucuauaaccauuaagcagcugcucugccucaaagaugggcacauuuccuuugguccaugaagggaauuuacucgggaaucucuccaaauuacuugaagauaucuggccuuugcaugagcuguugagauuuacaauagaccacguuccgugugagacuguguuucucuaagucuccguagccuggaggcuaccauagguuuuauggccucagcaguacccuggcguuuugcugauucucugacucuauauuauugcaggguucuaggcccacugagagaaagauccuucccaguuacuugcccaaguauuugucuucugacugcuggggcaggcacuuaguuacccaagcgcugggcuguuucuuccucucggugucugacuuagaugacucuuguucaucgaaaagguugugcuguguauaaagacacaugaaaugccaccaccguugccugcuucccacccaccaccagccuuugggcuuagggacaguaggcauuauuacggcugcuugccaguguucccuucaucagaucucuugaugugcuaugcagcaacagagcucaguggaugcuaagggguugcauuuuaucaucuggguucugauauauuuccauuauuuuucauaguuugguagaggaaaaaaaagcuuucauuuuuacuuguagauuucaaguucucaccaccgaggaauccccaucaucuccuguuugacugccuagcuugcugcaaaaaaucugccuggaggugguucauuccucccuugugauuaggcucaggcuguccccauaccaccugucuuaaucugugugacuuaggaacauguagagccauaacuacucauaguuacaaugaaaaguucaacuuagggucagaccuacuacauucugagauguguaucacaugauauaacucauguaaauaugcugaaauguucaacacuuauucucuuauucauuuauuaguuugugugugugugugugugugcgcgugcgcgugugcgcacacacgugcuggaugagauucagguugucaggcuuggugacaggugacuuuaucuacuuagccauuuaaguggcccucuuucacacaucuauuuuugcaagcauuuuuauguucuuguuugaauccuuugguuauugauugaacuauaugccgaagguuacacauuaagaaauacaacagagccagaacuauaaucugaccuuaaguguuaguuuccuuuuucccaaaaguccagccuuuuuacacucacaugucaucugcaaauggauugggccagauucauagcuauguugggacccaugugcugcagaauagacagacaugccuacaacaaaccccucaacaaacaaguucaugggagggauggagccagcagagguacccaucgauuuugugccaacuauagcuaucuuguuauaagaucacuaagcuguuaauuuaagaccuugguuuuaaaagcugaauuuuaaaauacuguccuggguucguuuaguaguuacucuauauauagggcaaugagucaguugcccagggagauaugcugaaaaacaaaaccuugucacuccccuaaauaaaggaacugauaauccaacaaagaauuuaauacuugaaaacaaauaucuuggaaaaucugaauguguaauguguaaaaucaggacuaaguaggugugaugugagcagagaggaucugcauuauguuugccagccagggucagaggaagcagaggauggggguagggcagagaaugucaggguguguuaucauucagcaggacauguagaguugaaagcagcacguaacaggaugagcuagagaguaggacagugauuggcugcagagauguuaaauaaccggugcccuucugcuugacauauuaaaugcguucaaagucaucuuuaauaagcuggucaaccaaacuacacaaucugcaguggccuggagcauuaaaaccucuuguucccauccaggagaaugguaucaaugcuacccccuucuuuuuuccuuuuuuuuuuuuuuuuuuuuugcauuuaugacgucuaacaccuuuuagaguucugguugguuucucagucaucucugaaacaacugaaacaaauugaacauagugaggaauucauugcucaguuucuuaaaauagaaguauaucaguuagggacauuuuguuuuauauauauauaaauuuuuccagaguagcuacuaaauuugagacucagacuuucucaucaaaugagacauuguaccuccuuuuugcucuuuuggcuuuucuaaaaggcuaaacagguugcgugugaagccacgcucccacaugcuuggcucuucacaucccugaugccugugcagcaaucaauucuuaggcacucuggguggcugaguuuucuaagcaaaacguuauaacucauaagaggcuguuuagcguuuaguaugcacggcucagugcucaggguguggcucugcuggaagcugccacuguuucgcucacaucugaccacuguuuaucauuguuuugggacaggaucucacuuugucacaacuugaagaaucuucugccucuuccuccugugcacugggguagugguuuauuacccugugcuaccccgguuacugcuguuucuuucuuuguauugauaguaacacuaggaggugggugauuuucuucuuccuuccuuccuuccuuccuuccuuccuuucuuucuuucuuucuuucuuucuuucuuucuuucuuucuuucuuucuuucuuucuuucucucucucucucuuucuuccucucuccuucuuuuuuuuauucucucauuuauagacaagaaaccugaaacaaaguaaggucuacucacauggccaccaucucuuagcuggcaaacucaggccaggguuugccucccagaucuuucacuugaugguucccugugacucuccacacaugugucaccucccuguacugaaucugauucuuggucaguuaugaagcugugugugaaaugcaaucuagugacagagucucagacgcugggguauucuguucuagaaauacuucuguuaugaacuuuucagacuucuauguuaucuuugugguaguuuaagcuauucacgaucuuccaacucucaucauguacucuugauaggaaaaagaauuguaaaacuucuggacaccaugcaaugaccuaccaagcaagcuaggguuuccccgggguccuggaccgagccuaugcucgcugugugcuucacugcauuugcaacaucuaguuuuagggggaaaaaaacgaugaguggaauccaguaguagcaugaguaaggaaaguguugaaaauugccaaagaaaauuuaagguucagagauucagcuuggugcaaggaaggauucacugugucccaaggguuuuuuguuuuguuuuguuauuuuuguuuacauaaucuuauuuuuaugaaugguaccuuauuuauuuuguuaaauuggauauuuuauuuguuuacauuucaaauguuauccccuuucccaguuuccccucugcaaacccccuaucccauccccccuuacccugcuucuaugagggugcuuccccacccucccacccacuucugccucacugcccuagcauuccucuacacuggggcaucaagccuucacaagaccaagugccuccccucccauugaugucagaaaaggccccuucagcuccuucaguccuucuccuaacuccuccauuguggucccuguccucaguuggaugguuggcugugagcaucuguguuggucaggaucuggcagagccucccaggagacagcuguaucaggcuccugucagcaagcacuucuuggcaucagcaagugucuggguuuggugucugcaugugggauggauccccaggucgggcagucuacggauggccuuuccuucagucucugcuccacucuuugucaaguuuugauccuugguugaauggcccuggaacaaggcuggaaauucugguagcagcagcucacuguucuuuaaucagggaaggauuugugaaagaauagugcuuuugagagaucuuugaagcuuuuccaaggcggugcuaauugugaugugguugugguuuuccuuuucuuucuagcuccuuccccccucccccauuuuuaauaggucgacuggcuuuccagguguuguagaaugagaugcauucagagcgugucccagccuuccuucucccugucuuccauggcaaacaggauccuaccaauuacagauuuagaaaaggaaugggaaauuccauggguuuucuguguuauuuauauuuccuauuuuugaaaacagauuaagcuuguacuuggguuccacucuuacgugucuucagaauaagcauucccggcgguuguucuagucuaaagaacaaacucuagaacuuaauugguaccuuuacccucugcguguucugacccuuuuccuuugaugcuuguuuucaggguaccucgaggacagcuuuguaaaauccggagucuucaauguaucagagcuugugagaguauccagaaguaaguaaacacuuuucucucuacacagguacacagaaucauuaaaaucuugcacauuuuaaaucuuaaauauggugugaaaacugacuacuuaaaaguaucugaauuuuaaaauucaugauucagaaaaaaaaaucuuaaauuuucuaauaaaauaaccgaagguauuaccugauuuuguaaacauuuccauuuagccuuguguucuguaacgcucauguuuaggcuguucucauuggucaucauauugguaucccuucacuugaguucucugugaccauagaugggcauuuauaucaaaggaagugugauuaauuaaauguacccuguguuguuaugauaacccacauacguuuccuguagauaagugcuuuuucaguuauggcgcuuugguggggguuggaaguguacaggaauacacacucacaugcaguguguaaagggaugcagaaauuaacuuugcagauuguacuccgauauagauagaaagcauuguuaguccaaacaauguccaguuguuuacagcagccaccucaccugagugccauucuuggucagcuugauuggguuucucuaggguaaacucaccugacugacuaccuaagccaaggggaagcccuguugauuaccagcucuugguuuaugccagugugagcagacacauccaaggugccaguauuaaugcccuggugacagaaaaggaggugacuguuuucuuccugauccugucuuugauuuagauuguucaggucaccuugagggcuguguuuugacuucaugcuucgauagaaaguaucuagaacugaugucacuuagaugauccaguggcaaguccagaggguccuuguuugucuuuauuaccaguccucaugugcacacuucuguaaucucaguacuccaagaggcaggaggauugcaauaagcuuguagccagcugggcuacaucgcuaauuccuggccagcuggggauauauaacaauucccuuucucaaacuagaacucaaacaaacaacaacaaaaucuguuuguuuguuuuuuuuuaauuuguaucaacuccagaguuuaugaaugagggccacaaccaacuguaaagaccaaacauagugagcuaagaauuuaagacuagccaagcagcuguagaguccuccuguuugggaacucuugucucuaagcugccaggugacugucuuuugaacuauaguuucucaagugacucagauuugugagcuuuccagaaaaaaaaaccaaaccaaaacaaaagccaaccaaccaaccaaucaaccaaccaaccaacaaaaacccauguuuaucggagaaugacauauauggccacucaagaccuuauauaccuugucucuucugccaggauucaguguagauauaagugucauggguccaucuaccugaaggcagcaucggggaugacagguacauauguguaucccaaaagcgcuaguguauguauguacuucacacaagccuucugaugaucuaguucauuguucaaggccacaugugauuuuccagaaauccccuaaggaagcagguauucaaaguuguucuuuagcagagauucugaacugugaaacuauagagcacaggaaaacauucccuccucuuagaccauuuuacgaaccccauaauggguuuugucccuucuuauaagaacaguagagccguccaucagaaaggauucacguagugccccauuacagauagcccuagcccaaguaugugaaaagaaagccacuuuggaaucuucaagagcccagaaugauauuuugaaaaaaaaaaugggaauuucaaacauaaaauauaaauuaaaaauaccuucucauaacauuucagaaacaagguaaauuuuaacauguuucacucauuuauucuuaauuuauacugucauuucuuagagguuuuuaagcugugugucauaacaaacauuccugauuuguaauuaguacauuaauuauccauauucauuccuuaguuaauuuauucagcaaacauuuacuuucuccugcauauguaaauagaugucucugagauucuugaaaguucuauucuccuaaguguuguaauauauucacacuauaaucuuguuuacacaguugaacuacauuguuuaugaaauagggguuuaugaagucaaacuucagcacauaaguuaagucuuaugcuguguguuacagguacuggcuucuugauucauggccugcccuugguacuauccucuagcauuuuacugucauguggccuacuaauauccaugcugacauuagcuaaugaagccauuccauuucaggaaucacacuguugaaagauauuaucuucuuuuuaaaaguugguuaaggacagcuucuggccucuaaccuuuagaaacccagguucuaauguguauggcuucuagaaaaacauuggcauaccauagccaagauuuguagcuuuuggcuuucuuaaagcucugucuagaagaggugcuaagagucauguuuauaucugauuugggcucuuccagaggauuaaaagcaggaagaccuggacggcuugcucuucuuauauucucucguguugcucaggaaucuguguguuguuugaaguuuuuaaacauguuuuuuauuuuuauuauuuguauuacuacuacuacuacuacuacuacuacuacuacuacuacuacuacuacuacuaccaccuuuucaauaacuucacauuuacugccagaaugcauucuaaguuuuucaguuuucaguaugggcuagcccagacuggccuggacucaauauguagaucaaguugucccugaguuuauggggauccaccugcauccuccugagugcuuagaugaaagacauccaucaccauaccugacccugacguuuuuuuuuuuuuaaauuaccauuuuacugcauacuauaccuagcaugcuucugacuaaguaaacuguaguuacuauuaaacuauagugacuauuaaggaauguauacccauuagaaagaaacuugccuaacuaaugugcaauccuaaugccacuacaaaaauguaucuaaaugauacaaccuguagaguuccugucaauuuuaucgauacacugucaaauaacucauauuucugaaguggccagaacaaagaaaauauuuauuagagaguaaugcacauguauauuggggacuucaggcaacuugucucuucuggcaucuucuggauuagguaaggauauaaccaaaagauugcugucaccggucacauaccuggacuccacaggaguccaacuccacucugaaagagaggcauuuuuguuuuaagagguaggagauuguucacauucuaugagacagucagccaccugccucuaacgcguaccuugcuucucauaucucauagaccaccauuauacaaauacauuguaaggcacgugguuaaugugaagaaagaaauucuacauuuuuuaaacuucuggcauacuucaggcuacaaaauacaucaguacugcaacugucuaaauaauucaaauagccuuuacccuuaggauaaaaaauauuuucucuauaaagaagguucaaguauaucaaauaauuuaaacacagcgauuaaaaucugaacaacuuaacaaaaggcaggggcucccauuuuagagcugaggcucuuccuggguguguagaugcuguauuuuaguagagauucugucuacacaauccuugauuaguucucuuuaauaaaacaugugccuuuuauuuauacuuuccuaagaacaucuaaaguugaucuuggaccaacagauauuuaaauccagucaaauugauagaaaauacaccuuaaugcuacuaaaaguuuuggaagagaaaaaaaaucuuaaaaauuagugauccuuuguaguuauacauucagcugaaggcaguuaggagaggcuaugguagauugugugcucaaagaguggacuugaagagcucuaaaaucagucaccaagucuccugaacacuuucaguagagcuacugaaggcuugaggguucaguuggccucccaacacucugccccuugaccccagcugccuaguucuccacauuguauguuguuucuguccugacuuuacuacuacagucacaucagcuuggaaaagucuuccuucagugccuugauccuucuucaaagucuacuaccagauagggcuuuuccauagucagucagccagucucucucugucucugucucugucucucucugucuccauucaugucauuacuguccuuuccuucugcaaauauauauuaauauuagaauauauugauuauguuacucauuggaaaaguuuuuuuuuguuaucuaaauuuucaguguauuuuaaaguuuguucaaguauuuuguuugcucuacaaacugcacuguuuguuuauugaacacagauguauuugagaauauuucguauccauugcaaugccugcuugugauagacacaggcacuagccugucugauucucagccugcgcaccuaccugucugacccuuccuuccuuccuuuccucccucccucccucccucccucccucccucccucccucccucccucccuccuucccucccucccucucucucucccucccucccuucuuccuucuuuccuucccuucuuuuauacacacacacauucauauauucauguguguauacauacauguauauggaggccauaugccaacaugggaucgucucucauccuucaccuuguguuuugagguagcgucuauuauugaacuuuucugaucagggagugcucccagaaugggaauuacaggugaacagccuugguuuucuauagaugcuggggauccaaacucagauccuguccugggacuuuacccauggaacuaugucuucagucuccaaacaauagcauuuuaaagaauaaacuuccagcgaggagguucauuugucugugccugcuuuuugcacaguuuugaacaguuccaucuuuaccaacuacuccauuuuaccaaaaaaugauuggagaggaaauagauucgaagacaugugcugaagacaugcuucuggccugccucugcucccacugcuuuauccccuaauaaucacacgugcuagcuuuuucuuuuuucuucuucuucuucuucuucuucuucuucuucuucuucuucuucuucuucuucuucuucuucuucuucuucuucuucuucuucuucuucuuccucuucuuccuuuuuccuuuuccuuuuccuuuuguuguuuggaaagugaggcgcacucuguauaagcaacaggggguuuggacugagagccucuuuuuauccugagacccuaacauauggagugaaggugcagugaacauuccuuuauaaaaccugccugcauguguauuuguaaaacaccuuggcuuuuauuucauacucacaaacuuuacuuaucucugccacaauucaagauuuucuuaaaucaaauuauacacacugugaucuuauguuuguuuauuuugucuuguuugagacguggucuuacucuguacaucagacuggccucagccuugcuaaauauaguccagucuggccuugacuucucuauucuccugccucaaacuccuugagcuggcauuacaaguguaugccaccagacauugcuaaccaucauguuuuuaaauucauuuuagggcugaugucaaaacucucauaagauaauaagcuuuauuugucaaagccuuauauauuuauuuaguuaacaaugauuuaguucagugcaagccacucauuuggugcuaaguaauaaggaaaauuuauuuguucugcccugccuacaucuacagacuggggaguagcauauauagugaccaaucauaugggggagugaaugaagaagacugggugauuguaaccagggaaagugguguccagggaccuagagugagugucuggaaugcucagacuugacgagguuucugggucuuaucugcagcauucaggggauaucaaaucuuaagguaaagagaguucuugcccugagccaugaaaaaaaaaauagggauuuuauauuugaacagagguaacaaugaguaucacuuacaaucuuucuuuaaaacuaauuauuccucagcacccauaacccagggaacuggagucaacuucccaaucggagaaauucccagccaaccauacuaucaugacaugaacucuggugugaaccugcagaggucgcugucuucuccaccgagcagguaaugacaaagauguugugugugcuuucccccuuugugcagucagacagacaaguaaagaaggcaacuagguauucugcuggcaacacacaugcuucaaaauuuugccagaaucauuuguuuugauauucucgcaucagguguaaccacugucaccuuuuaaagucuuuuauuggggggagggggggaaaugaaguaugacguuuuuugucuuauggcaugacauaugauccugcuaguuaaucuuuuggcaacuuuuaaagugaugcugggaauuguaaagauggccgugaggugaaguucacuuguugcucuuauagaagacuuggguucuguccucagcauccauacggugacucacaaccauacugaaacuccaguuccagggaauacagugucauucucugauuucuaugaacgccaggcacgcacaugguacacauaugggcaaagcauacauacacacaaauuaaaaaaaaaaaaaaaccuuaaaaagugugauacccucauagaggcaaaggggaggggagaggggguuccagagggggaacugggaagggggacaacauuugaaauguaaauaaauaaaauaaccaauuaaaaaaaaaguccaagugauguugcugcagugaccauuaucgauagccagcgcauccagaugacuuuuaccguaauuacaccucuguacuuggguucaugaaacaugggaaaggaugucauuccccuagccuuaaaaugaaagccugauuugagacugcaguauuuaauuaauugagauucucugacuagaucaguuaacucuucugguaccaaggaaagcaccagccacucugaaaccgaguuagccagccugugcuggggacgacacuaaagagugagggucccuggcuuuuagugcucugcucacgcgagggguuuacugacucuggcacacuguaacuuugauucaagauaaauauagagacauagaggucuuuuuauuuuuccuuuuuggguuuugucuuccacguauaaaguccauuucuggagcauucauuauauccacagacuagcgcaaggauauacacaaauauucuccccccaaaaagugugcauuaugcuaauuuuuagaaauaaaagacaaucuggaaaaguauuuuucuagacuuuuucaguaaugaaaguuaauugccucuguggaaauauccauauuuauguguuuauaaaguaaggccaauuuuauaacauuuauaacccaacuauauuuucauguaauuagauuguauaucaagauaauuggguuuauuaucacuaaaauuaucucugauauguugaaguccuuaaaagcguuuugaucuuuuuaaauuuaaaaugugacugaggauuuuuacauuuccucccguggguccauauguugucagcacaggucuuuccccauggccacucaguaucagauccuggguccuuccaaauaagccgacccuaaauaagucgagccuaaagauauuucuuuguuguuccuuguggaaauaauuccucccccuuucuuugucuacuucugccgacucaugguggaagagaauuacauuaaaaggagaauuuaaaaaaacaugccccugucucuaaauuuggauacuuugauagagacugaagaaaugauaucauuucuaguaagcuuugucaugggaaguaauugucaugcucaaucguguguacucagggauucuuagccaacaauuaacccaguguauccacaaagagacugagaugugaacaggcuucaaggacucggcauguagugcuguggcugggagaccuuccuuccuccugggggacuacuucuguucacuuuuccgggguaaacucacugaauuucuccauauuuacccccuaacccccguuuguuaaaaaugggggcuuagaauacaugcauuuuaaaagauaaucuacaguuccaaacuuuggugacauuacagcuuuuaacagugcaugaagugaauccaggagguauuuuauugcauaugaacacagguaccaggaagaauucuuuuagugaagaggaguauucauugaagagucaaucauuagcuguucacugggguguugguuggagcacaccaaaguaaagugucccaaacuaucacuauaacuuuuagucuuugcaguagauauccacuuuucuucauaauaagucauguuauuccauucaaguauaauggaauuuucuugaaguauaccucuugauuugucaguaaucauuuuucaugguugaucuuaagaauaaaggacccguaacucagucucuuuaaggaagaucaugguauacuuacuuauaacuaguaaacuucuagaaccgguugucauguuauuaauuacaaggucagcauuaauaauuaauauuuaauaaguaucuucuucaacugcaagccauuuagcugagagcuuuauagguauuagcucacuucaucuucucaaccaaacucuuuaaacuagguuuuauuauuuccaccuuacaggugauuaacugagcuuagccagguugagguaccugcuacuggagcuaauaaauggcaggccaaacaugggauuccugaaccuuuucacugcccagcuccagugccuuuaucuccaaacuaacaacacaguuuggcacugucuguggcuguguugugcagugaacaguauuaauaucaaaaacauaagauaagucagugcaucuuagcaaaauuuguacauuagcagaaaagacacacuugagaauucacuuucagugacuaaguuucccugaaaaaaaauuugaauagauaacucuagcaaacaguuuuguuaagugggcagauggagguggugcacacggaagauacagaauauaugcuauugcaaauguccacuauucccauggaugucuggaauacccaccauucuuucaauuuaauucuuuaacuuggauuuauggaaguuauuuuucauuuuaaaaacaaaugccacaaucuucccagaaaugccauuaaugucaucauuauuauauuuuaacagcaaaagacccaaaacuauaucuauagaugaaaauauggagccaaguccuacaggagacuuuuaccccucuccaaauucaccagcugcuggaagucgaacauggcaugaacgagaucaagguggguacagagagccuuccaaguagcacuggagucuacagcacugcuuauugcauguugcacuuagucaccauuccuggggaaccaguauggacuaaccuugaacuaauuucauuaaccuuuuuaaagauaauuuuaccagaguggucacauguuaucaaaguuacaaaaaucccauuuuauuauacuuuuauguucauacaaaaauggacucucagggccuacaaguaugucuucagcugacuuggguccaucaacacuggacaguagagucuugacggaguggcaaguugagauucugugagcucccaucauuuucucugugagucuguuuggaagaacaaauuuuaggcaguuggcagguagaauucucacuuacaggaggcuguaguuuauucuggaaguagguggcacacagauaacagaucaaaauauaauuuaagagacugagucuaaguuaauccacucgcuuccuagguagaccuaugacucaguucuagcaucauugaggaggagcauaauuuuauauaaguaugguuuagcuuucugggauccaacuuggucuuuauucuugaaauguguuggaucuccuguguuauuuaauaaaacauauucaugccuuucuauacaauaagaagguauuaaagguguauagacaaguaagcuaauuacagcuuaucuugguucgucuguacauaugugcaaauaaauuuguauagaagcaucauaaaauguauuuguacauuuuuaaaaaucaaauucuguguuuaaagauguaaaaggaauguguuuugcccugaugguuuucagcccagaguguaggaauuuuuuuuuuauuuuuuauuuuauuuuuugucugugagcuugagaagcuauaugcagagaaauguuaacagacagcugacccuggagcauagcauuuauagccaaugccauguccuuacuaggauuuccucuugcuccucagaauuucaugcugagugauuuuuacaaggaugaagccuucauggugaucuagacuaacaguugcauuaccuuucacauguugauauuuuaaaaauauuuacuuaucuuuauguuauaugugugagugcuuagacugcauguauguguguguacaaccuggcugcacuuugggcaccuauggggaccagagaggccaucagauccccuggaacuagaguuacagacauugcugagaugcuuugagagugcaagugcccuuuacugcugaccugucucuccagccccacauuuaaagaauuuaacuaguaaagaugaagggacaggggacaguuacauggaacagaucgaagcagggugagguggggaagcaauggcagaauggagguugguacuguugaugggaaagaaagugagggauaugucaagcuccuuuuccagaaggguuggaaaaucagcuggccaguuugggcuuugcaacacucccccaauccacucuucaggcaguaagcacacuugaucaggaggcauuauuugaccuuucugcuuccucuccaucaguaaccccccaguguucucgggagaaaaucaccagucccucauuugaccacagguucgcaguagugcuuucguucccacugccaucugggcuaaugacuuuguuuggguuugggaauacagugcccaagaaguggucuuuccuaccccuucaucuggcaaaugucuugauauccuuaacggccccugaucuaccgauggauuucaucauaaauuaguccuucccgcuuuugugccuuggcagcugauauugcuccaucguuguguucauaauaggucauuuuguauuuauuuauuggagaaauuguuuagauacauccauauuauuaagguaacuguuuugacugugguugucauuagcaccaaagacaagagugaugcaugguccccacagucaauauuagucagauaaacgaguccuuggauaaagaaccaaguuucguaagugaaggcaggaaauaacagaacuauagaagugaaaauaaaaauaaaacccacacaucuucaugcuuuguuccuugcuuuacaaacauugucaguuuacucuaaacaaagauguauuuccucugucagaaaauuauuccggagcagauccuauugguaguaauaacaacacugagagcuuacagaugaguguguugcucaaauguagguguucuuuauuguagagugucacucugugagaacagauuucuacuuuguaaaaacugauuucccuuccagcucuucaggaaagccaaucuccugucauauuauaaaacaguuuugaaaaguagaagggagaccgucacucuuucgcuuuguaaaaaucauugcauugucuugaugauuuccuauugucaagaugacuaacacuauuggagaaggcuguaaaagcaaauuauaauaagaggaaggaggaagguucccuucucuguguguugcuuaaaacaccugucacuugaaauuugaagacccugaggacuuuguaaugugcacaauaagccauugugggaagaagacuucaacuacaaugaaaagccaggggagguccagcaccaucuucacaaacuugcuaagaccgaggaggaggugaucuucuucuuagaagcaaauccauuuuuuaaauuugcagaauaaaaugcccgagauuguucuuguccauccucauaccauucuugaggcguccuugucauuugggaaggcguggucuaaggcacuggugagugaguaccacuuccagugcaguuuccuggcaguaccuuacaguuguuuuccacacaaaacccucugugguacacaguaacacgcucugguucaucaucauaggcuucuguuuauaauuggcagggaugcuaaaaauucauuacucuucucuggauaucugccucaauagaugauuauuaacuaucaauuaaaauaucuucuggccagcucuaccgaagcugaauuucgaaacagaagaauaaaaaugaugaaauuaugggcaauaugcuauaaaguuuuuuaaauggugccauguaaccaaguuuuuaauuuuuuuuaagaauuuauacaaaacagucauaccaaaucuagcuuucauaguuuuaaauaauucaguauacaaguuuuuuguuuuuuucacauuaaauacacucuuauauugaaaucauaguguauaacuuugcaaagaucgacacgacuauuuuuaaacuaaauaguauucaguaauguuaaauauuugauagaggacuauauaauuugguuaaguuucuucucauugcuagugauagaaauugaauuugucagugucagugcuuaguggaaguggcacacgccuuuaaucccagcacuuggaggcagaggcagcaggaagaucauugugaguucuaggacagccaaagucuacacagguaaacacugucuugaaucccgccccccuaccucccccccaugaaaguaacaaugggcaugaagaacauagaguaaccauuguauucuuuuuuuuaaggucuagaauguucucuuugcuuagucucuacuaugaauacuuaggucugaaaugucaguuuucuuuguucgggagggugggggcagagcaagcugaagaugcuacccagucccggugccuauuuuccaaccagucuaccccugaucuguggccucagacuuaaguauuucuuuuggauacuuuuuuuaauccuucagaucuuaaugauucugcucaugaaauauggagguuggauaugucuuugauuccaacauuuauccacaaaaagaucucuugauaacuugucuacauuuaguuacaccucacugaaucuacugaggagcuagcugacaucccuggaaaggacuagagcaauccuuuuaacgcaagaugaagagugaugcaccucaugguuuuuccucugcuucugcuuacucucauggcaccacaucugguuguauucuaaugcccaguaauuuaacggacugaugauuuacuuggacauuugaauuuuuuuuuuccuugagacacugucucugucucccaagugcuaggcuucgugcuugguuacuugauaccuucaaaucauaacgcaucaggaucauuuguuccuccuguucaacuagccauggcuuuaucuaagccugaguguaaaaugauccaauaauacacuuguaauacagaguugaaaguuucugaauggaaaauauaauggcuccucaaucugauaaauaauaaggcaaucuguaauuuuagauaaaauagcaacuuaaaaggacucuucgugcaguuaaacuuuaggauugagauaauuaggcucauucaacauuuaucagagucuuaucauaugacaaggauuuuuauagauauugggcacacaaauauuauuaaguuagaauauuauuaagcucugguccugcuaaacagaaaaauaauuguuauuuauuaaaaggggcuuuaucaaaaauaaguaaagugagugacaagggacuaucuuuaugcuuugaaaccaacucacuucugaagcaccgugagcuauaaaucuuuacauaaaaucaauaagacagcaccuuagaaaaguugucccaagcuauauacugauuugccauuaguuagaauuuuaaauuuaacucuugagaccacguagacaucauguuccgauuacagcaaauucuuggaaauauaguuacuaaguuuuuaaaaauauucaacagcagacaaugcagcuccaugguagauagagugccagcugggcauguacaaagaucuuggguuccauucccagcagcacgcacacacgcacgcacgcacgcacgcacgcgugcacacacacacauccuguucuauaaagaacucucugcagcacaucuuucugaaguuuuguauauuuguacguucaugccacuaacuuugcgaauauuuuccucagugaaauagucucuccugugcuaaccuucaguuuguacugucuaacgcucucugagggauagugguagcccucaacaaauggauucaagcaaaggacccgcaggaaaagugggagcuagagaugaacguugucucuugaguuaaagaagaaauaaguaaggguaccuggagugagguaccaugugagagaaacagauucaagaccaguaccacuuaaugugaguuugggaaguguuccuagacaugcuagauaugaguggucuacuaaguuuggaaaguucugguuuaacucagcucaaacucuuuucuuugcugacugaauauguagaguauuaaauauacuguugugugcuguugcuuuccgggagaggcugcugacuugauuagcaugcuuauugugugugugaguucagaagccucccucccccacacuagggaggaguuagagggagcauuaaguccaaacuuugggcaagugccagaacgcagacuuucuguuugaugaaggcuggaaucucaagguuucugugggcuugggagcugagugagcccacagcuuucaugcuuggcuggguagcuguuccccgagagucauuaacguuaaaagcaguccuggagaaggcagggggugaccuggcaggcaaaacuuaccagcugccucuggggacccacugaccaccaguucuguuauguucuuggaguaggcaucaccacaaucaaauagcaaaucuucaaguaucaauuucuuuuaacgugaaaaguaaaaacggagcuaacauccuuugaugggauaaaugugcauaggagcggguuggaauuuaauguauaagcccaguuuuaaagcuuccuucaacuuccugagaaaguauccgaagacaggauuuguagcugagugccuucuccccccaccucacuccaugccacuuugguaucagaaagccaaccucagagccccccaccaugucuggauuauuuccaucaucuacacugcugaggguggaaaaaaaugaaaagaaaagaaaaucacaugaccaucuuccaaacagaaaggagaacaguaaauuguuccugaaggcucucguuagaguuccucuuguugccugcuaauuaacagauaucugucugccuuucaugugcuugaauggagaccggcauguuggguggggcaagcuugugcgcguguuccaagggcccauacuggcuaauauggaaaaguugagcucugguuucguacucuggaaacuuaaugauuuaaaagcaccaauuuuucagggaaaaaaaaaacccuaauacauaauuaguuccaaauaauaacagcuguuugauaacgcaaugaaacagaugaaaauuggcaaguaggagccccaaagacgcugaguccugggguaucucgcagaguucuacggcauagucaaacuguaugcuuuaacuugguuuacguguugauuuacaguugaagcuggagaaguuuggaaagucagaguaacuggacuagcaauaaccuacacagugagaacuugauuuucuagacagaucacaaggugcugcaacccuugugcauuauucaagagaacuggacagggccaguuucucuccaggugauaggccuugcucagggggaagagacccagccuuucccucacaagucuccucaggaagagaguuuuucuggagagcuucaucgaugauccuguuaggccuuauagaauaaaacaagagaaugaaaaugaaucugugcauuucucaggguucugaaagaauucucagaacacaauuguuauauauaagauauacaaauacacgugccuaaaaccaaauuaugagggcugggauuagagacuuuugccugaaaguaucacaagugaagugguuuugaggaguaaaugugaggaaucaggggugcaggggugacuggcuacaaaccugaaggguccacuacccuguguaaacugacaaugcucugccagucuugcauuuuauauuuucuagcaauuagagaauaugcuaaguaaaucaugcuguuugcuuauacauacuucuaagaguuucuuaacagguuucuuaacacaugauaccguuauuaguuuaacucagauacgcucugagguuaagacaccauaauauauuaaagguucuccuuuugaguaaaaauuucaacuuggcugcuaaauguuuuauuuucaaguaccuguuuauccuuuaccaaauacccccuccuucucucaguaauuaaagagagcacguacauuuaaaguaugcauaccuaagaaaggcaagcuucuguuuuuauuugggccuaucauuuauugagcacuuaauaccuguuggaugcugaguuuaaaauagcuuuaaaugccuuuagaaaauucccaccucugguccagcaagaugguucaucagguaaaggcccaugacacacagccagaaggccugaguuuccccaaagguuccauagaguagaaggcgagaaccagcucccgcaaacuguccucugaccucugcaggcucgcauccacucucuaaagaaauaaguaaauauuaaaugcaaaaaucuuauuaaaaauuccacccuauggcuuaagcauuuauuauuaaccauggucauaaugguuggaguuuuuccuacuuauagaaaaagaaacuuugaugaaaguguuucuuuguguucaguguuucggauuuuaaaucaguuguagucugagaguuugccagugucaguggucugguguuugaaaaucugaaaugcuucuagaaauaacuucaugaugucauugcggaaacuuccauaccugacuucauguuuuggguucuagccuaaacacaaauacacacacacacacagagacacacaaaauauuauguauauaaagcugccuucagguauguguauaagguguauaugcauaaauggauuaugcuuagacuugcauugcauucuaagauguucuauaauauguaugccaauauuccaaacucugaaaucccaagcgucugaccucaggcaucucacagaaaggacacuugacccgucuuugaguuuuucaguuuucauuaauauagauauuuuaaagauccaaagucuuccauugcuuaaguuagcuuuuaaaaguuuacuuuaaauacacucacugaauaccauaauaauuauauuguuuaugugcuuggaaacacugaauguuuugucuuauacuucaggaaugcccagaucucacaaauacauguccuguccuguuccauucugcuacaagcaaugauugauagagacugaguuauuauacagaaccuuguuaugggaucagugucuccuacuuugaaaacaagugacucagccagacagcaacauuuauuuucucuaagugacuggaggccuagcaauaggggaccauuauccugugacaauauucuguuucauugacauuaucucgaaaauguaauugguccauuacuaaauagagguuuuguuacugaucaauuucacgugauuucuaaaaccauuaggauaauaaauaugccaucccaguaauuucauugacagaaugguuuuauuuucuucauuuacauuuauuggggggcagaaguauauauuuaaacaccacuaccuuuguuagcuaugacuccauuuucacucuaagaaagauaaucuaugugcgacaaucaugcuuacauugagcacugaacagacgacuguaacauuuucauuauuuuuuuuuucuacuugcuaagccauaucgaaucauauguuuuuccccccaagcaaucaguuugcuuucucagauuuuauuugaaaauaaagguccaggucauuucuaggacuuggaggauuuccuguaaaucuacuaaauuagcacaucaauuaaauugcccuaacucgcaguguggaagacaacaguguccauugcuacgggauccuggggguucuugcaauauaaguguuccucaaugcguggcuguuucccaaauguccaccuccaaaaagucaucuguaaucuuguuaaauuagaacacuuccaguaucuuucugacuuuuacaguuaagguuacagaauugauuuuauuuuauaguccauggcucucagaugcuuaacacuagcaagaccccauggcuagaaugccccccagggacugcugaaucgcagccguuuauuuagcugugcugaugcuuaaacagggaagagggugugcuuagcaucccgcauacuuguuuggugguguucccccccccccaacccuugcuuccauauuuuauuuaccgacauuacucaagauccuuuauaauugucuguuaaauuggcaauagacaaaaagcaguuugaaguguuuuuaaaaagcaauuucauuuuucugguauucauucucgugacacuguucuuuaguauucaggaaauuuuuuuuuucaauuuauuuuuuaaaaagcagccucaggaagguauuuuugaguuucaaagcaauuucaguuucagcuuugcacuggauauagguguaaccuagauacguuuuuaaaauggagacacgguaaaguacaggcuuguagugacaugcuacugcccugugcuuggguuaaaauauacaagagucuucaaccaucacaaacgguuucaaguugcugaagaauacaguaaguacugugcucaagugugauuaggacugaauagcucaguacuuaaagcaggaauuccuuuauuuagcacagagccuaccaugcuuucccccuuaagaacaacugauuucauuuuuacaaaguugaaaauucagauuucaguugacaucuuaccuccaugaugcagccugccauuuuccugccaguuaguuuuggagugcgagacuccucgaugcuggugaauagaugcagggcugccucacagacuagauucugagcauggcagauucucugaaucaccuggcauucccaucaugcgacugcagagggauucaguuucaucauaggguucagagcguucugugaacuuguaguguguagaugguacuuacccuacacuuaccacacgacugugaacucuuccaucuaccagaauauuagaauggcuuucacauaaucgcuuuacuguguuuuagagaccuuuugucuuuaacuuaauuuucaguguuccaucuagggcuccacccuagaacuuugcaaaauaaggccuuuccuucucauggugugacguuagacacaagauccauuguugucagcuuaguauuauuuacgauauucuguggagcuacaaucauauuucuaauuuuuuuuguaaaauauuuuucuaaaaguuuuuuucuaauauuuuuguaugaauauuucuauuacuucugguggaaguaauaaccuuuuagaagaaauuugggaaggcaaaauauaaagugcaaauaauaaaaacaguugccucuaauuguaucacacagaaauaaaaucuggauugacuuuuacuaauauuugaaagaacaguacaaguguggcgucuauguaguuuuaacugccuuuucuauauguuuuaacuugagucaugguuuugcacugacgagcccauaugaaacgcaauuuuauucuguuaaguuuuguuacaugcuuucacuuguaauauauuggcagcuuaccguguccuucagugucugcugcugcugcugcuguguguguguguguguguguauaauguugguuuguugccuugguuuuuuucauuuugagauagggucucuaggaaccugggcuauccugggacuuacuauguaacugagggugaacuugaacucucaaaucuaccuccuaagugauaggauuagcacuguguguccuuaugcccgcugagauaugcguuguuaucagguguuugaguuucugcuugcugcugaauuugcaggugauuccugaguucucaccaucacugcaaugaacuccacugcguguacauccuuguagcuccuuuaagcccacucuuuucucucucuuuucacugucccugagcuuuagcaaacuguagcaucauagcaagucaccaaguagaagcucaauaaagcuuaaaggaauagguacaucuuauuguaaaauagauacauauuacugaaagauacuggguuuaguuuuaugucugcuucuaagccuuuuuggcagauugacagagaauccagaaagguugugaucaauucccaccuauaccuccagugcguaaguaguucucccguugcagagaaagcuaaagauugcucugugaacaguuuugacuucuuuucugugaaauguauuucugaagcagucucucugguguuugacuguaucccugcaucuuuuuaaagaaucacuuaagcuacuggguauuauaacacaucucuucuuccugugagcuugcguagcucuauuuuacugugaaagaaauggagaaaguggaaaagcacguugggauugugccgagcuuuuaaguaaagucauagccuacuguguucacgcauccuucuuucucuccccuccucccuguuuucucucccuuucuuccucucuuccccauuuuuuucuuuauccuggagggcaaguuuccugccugcacuauuugaucaguaggugaacccugugaaagaaaauaucugucagucaucacagggaaagcaacugaaauaaauacaucugagcucuggaaugagucugaaauaaucaucaggcugcuucagccuagcuuugcugacugugagguuuuacauaacguuuauggcacuguaaauaacagguagacguuucucuccucaacuuuaucuuccccaaggcaaaaucacaggaggagaaacuguggucugucucagcauuuaguuggcaaaccauguucucugccuucaccuuuccucugggcacagagcccaagccauuuccuugucucaaaguugacuguggauuuguggccugaaguaaaaauaccagauuccagcuccagaaaccaucccacacacuugauucgggagccucucauuuauuaucucaucuauucuaaauaacauuauuauuuuaugcacauaguucaucuuuuuuauauugucuuucagcuuccacucagcauuuuaauggaaagcagaagugccccauuguagaggauagcucaucuuucacuuuuaguguuguguguuacuugacagcuucaaugaaguaauggauguguugaccaccuauaacuucauccaaaaaugaguuugguuucugaagagguuuucaguguucaccagagugguguaaaccauaaaauuuuuuuuaaauguauaaaagucuaagacuuauaaaaguccaagguauaaggcgaaaugaagaacaccgagagacuaacaacuuaguaagauguugcuguaauauagucuugucagacucccaucagcaaauggccuuugagcuaaauguucucacauagaagcuuuguuucuguggcuuggaucauagcacagggucagaguguauguauauauauauauauauauauauauauauauauauauauaacauuuauguguaugugucuguaugugugugugggagaaaaggggcaagauaaggggagagaugucuuaaaaugcucaacaaccuaauaguguaaaaaacaaagacgauauuaugaaccaugauuauagcuuuuaaagcccagaaauaaaacauacauuagcauucaauaccagcaaacaagaagacagacaauguugacugauaugcauaaaguucauaugcauaaaguuaaacuuguuuaugagucugacaaguaaguaaggaggcugagaaauauguaaaauaaucaaacuuuugaaacacuuugcugcaauuacuucuuuguuaguuacauagaaauauguuuuucuaagccauagaaguggcacagcuauuauuauguuacaauuuagugucauguuaagcuaaaaauaacagcuaccagaaauguagggucucucgugugcuuuuacauaauuaauuugaaacagccacagaucugaaauguuauauauagggaagaagaauaggaguuuuaugagaaaagaaaugguuuguuuucuagguaggcuauagcaguuggauuggaaaccuuaguuuacuugaccauauuggagaggcuaacauaugguuccagaaugcaugagagaagagcagguguccccggcaggcagguguuaaaggugguuguucaagcuugcccuagaucacuaguugacuuuacagaaguucugcuaacagguggcuaagugauuggagugccaugugacauuuauccagggagcaacuuagaugacaggcugcuacagacugaggaagcgggucuuugcuuugaugaagaaauugccaaaacucacgucucauuaguguuuccuaggguuccuuggaagugaacaacaguuuaauuaagggcugacguaaacacauuucugcacacuuucccugcagcauuuuaucacauuagaaucgaucaaaauuguugccuugggcugacuugaacagauauacaucuggagcuccauuugugcaagcugcugccgggcugcguacguacgcugugcucgcugcagcucgcuccuuuuguagcugaaauuaccuuguugggagaugaguugaccuaacuccuuauuugcuuaagccuuuaucucuuugaagugaugcugugaagugaaugacacaucagagcuuaggaugugugcaugcuacagugccaagaacucacaguauagcuaguaaaaaaauuauaacuugguuugcaaaauacuuguuuaaagauaggcuuaaguccaucuuuaaacgucuaucaguggcuuacucaaacuuuuguuuuuguuuuuguuuuuuggucuggaagcauuuuauuuuauaauucacuauauaauuagcucuaaagccauagcuaauuguccaauuaugaaucaaagcacagguguggacagcaaagagcauugccuucaacaugcaucuuucuuuuugaaggcuuagcccuccuagacuuuugucacuaagacaaauccuugguacaaccuaauauuaucaggguuauaauuauuuaaugaaauuuguauuuuccauccaccccuuuagcuggauugugagcuucaccagaacaugggcagggagacuuguuucacaccuugaacuuuguguacagcugaacccccucacauuuuggggggugcucagugguugccuuugaugucucucuuuggcuucuuuaaccgcucuuuuguuguuguuaaaccauguuccacuauaaacuuuauuuucccccuuuuauugaaaguaaauuguuucucacacaguacauccuuauuaugguuaauggaguguguauuugaagcuagccaucuuggguugauucugcucacuguucugcuggugaauaucccaucucacagcuucucucacucauaagaaauucgaaaacaagcuaccuagacaugauaccugccuuaccucuuccagguuuuauuugaauucuauauuuuuacuacauucaucccuaauuaauaugaucuuccguaaauauauauauauauguguguguguguguguguguguauuacauauacauauauguccacaaauauacaucauauauaauauuauauauauauauauaauguguguauauauguauauauaugauggaacagauaaaaauuagucaucaaguaauauaagauuuggguguaagauuacuaaugaaaucucggccucagaauuucuuacgauuuuuuuauugguugggcuuguguguaugugugcaaaccuuggccugcauaugguagccagaggaaagcuuacagcagccaacucucuccuauuaugugaguucugggguugagauucagaucaccaggcuugauaugaaugccagugccugcugagccauugugcuggcugaaagccucaaacuuuuccccaagggggauuacgguuugccuaaguguguuaagguggacaggguguugugugaguagaaugggagagaaggaauguaacuuaauaaguggcaaaaaugucacacaccgagagugagagagggcagguagcacauuccuuccacccccaaguucacugugaacuuuccuaaugcucauuaaggcuagggcuauagcugguggcagguacacuuguaugugcauggaguccaagcucuuaaaacauugaggaagaaggauucugaguucaagaccagccaggacuuacauacauacacacaaacauacauaauacauauacucacauauauauguguacacacacacacguaaaaauauauaaucuaggaaaaauaaacagaaaguucgucaaaguuugggacaguuuucuuuuuucuuuuuuuuuuuaaauuagguauuuuucucauuuacauuuccaaugcuaucccaaaagucccccauacccucccccccacucaccucccccaccacucccacuuuuuggcccuggcauuccccuguacuggggcauauaaaguuugcaaguccaaugggccucucuuuccagugauggcugacuaggucaucuuuugauacauaugcagcuagagucaagagcuccgggguaacuccgggguuaguucauaauguuguuccaccuauaggguugcagaucccuuuagcuccuuggguacuuucucuagcuccuccauuggggcuugauccauccaauagcugacugugagcauccacauauguguuugcuaggucccggcguagucucacaagagacagcuauaucaggauccuuucagcaaaaucuugcuaguguaugcaauggugucaacguuuggaggcugauuaugggauggaucccuggauauggcagucucuagaugguccauccuuuugucucagcuccaaacuuugucucuauaacuccuuccauggguguuuuauucccaauucuaagaaggcgcaaaguguccacacuuuggucuucauucuucuugaguuucauguguuuugcaaauuguaacuuauaucuuggguauucuaaguuucugggcuaauauccacuuaucaauguguacauaucauuugaguucuuuugugauuggguuaccucacucaggauaaugcccuccagcgggacaguuuucuaaggugaggucauuuccuuuguaaaugagguauuccuaaaucagacuucuaccuugucaggccuuccuggcuuuugcuucuuucucaccaguugugagcucuuucugcucucuucuugcagaagcaccagcuaccucugucucuuucucuucgguggcauuaucuuaugcauuauucaacuuacccuuuauuauguauguauuaucauucaacuuauuauauauuuauacauuauccagcuuuguuauucaacuaauuuucaauuuaaucuuuuuauguauuauucuuccuucuuggggaacaguagguugcaaaaagcacagcauuuguuuuucuagacagaaaggccacugaaagacaucucucccauauuuccaguccuggaacacucuuuauauaguauaugagugcauuaaaaauagaaaugauaucauucuuggguugaacgccuaauagaccacagaauuucaaaacaaaauaaaaccaaaacaauucaaguuuuauacauaguuaaaaugcaaugucuagagacccagcucugaggucccagcauaaauggccuuuuacccugccuccccccagucgacugauguauuguccuuugagagaaauucacuuuuugccucugaguguucagcauagugcugcuuccaucccacauagcaguauuucuuuauugauuaaugagcccagaauuaauuuaacuuaaugggaagacaaagaaaugaaacuaaacucuagcacucuccugcuuugucgaaugucaaugcuucugcuuguccuggugcuccuucucagucuuguuccuauucugaguuauuuuuguuguuaagcaggagauagcuuguaguccuuuucaccuuguggauagccacugucgcucugcuucugcuaugucuccuuuguaauccucugugcucugcacauggaaauacugcuauuauuaggcccaugucuacaagagccaugucuacauggcucccuuaaaguguagacuucuaacaaccgcuuacaaaagcuaaggguaucauuuuggccaagaaaaguuuuaaaucauuaaguuaaaaaugacaaagucacucaccaucuuacauuuuuauaguaauaauacuugacuugucccgguaugaaaggacacucaucugagcuugucugguugcugugguaguucggaggcucuucuuguucuuugcaagugguagagccagaauggcucccuucuguuucugaauacacagagagcucucccuuuacaugaugugugcugugcucuaucacccacuccaggaagacuuggaaaacugacuuguacagcuucgguucuuuuaaauuaaccuguaggcagagguaaacauaagagucaauauuaaguuacugccuuuuuuaaaccaucugucacuaaaaauuugaaauggagaagcugaggguuuaagagcacuggcugcuuuugcagagucccuggauucgguuuccaggacucagggggcgcuccuuaaccuuuguaacucuaguuucagggauccagucuguucuccuaaccugcacaguucacaucguacaggcagcacuuacauaaacucagacaaaauacucacacauuuaaaagaguccaucuuuuuaaagaguuuagaacacuuuagggcaaaaaaaugcacuuuguuaucuaucauaaggaaugaaauagagcguccucuucuaacaauuuguguaucuaacuucugcuuugaguaggucaaacccaauauugaaucauuccuuuuaaggucacaucguucuuggggaaaucucaguauugucuuuacuauuuugaagauaacagccaaaauaaacuuccuuucucucucuauuuuuuuuaauuagguauuuuccucauuuacauuuccaaugcuaucccaaagucccccauaaaccuugcuuuuacaccccuuaguagccgccuuaauuguuguggcuccaugaaccacuuucuuuucuuuuuguccuuuggagaacuauauuaaaaaccugaagucuaauagauuaguggccacccauuagucagaagcauagcgucugccuuucugcagacugguacugccuuaagugccagcacgcucagaacacauacucaguuuuauuggaugccucuuccagaacucagacaauuuuuuccaaugguaaaauacaaauggcaacuagucucucacaucuauaacacugggaggucuucuucuuauuucagaacauugugaauaaauaauucuggucauuuuuuuaaaaaaauguaguguuguaguuguagugguuuucuuuuaacccucuucuucuaaaccuguacacagaaauagucagaggugaagucagaugguagugcauguacuucaaaagugaugcagggagcagaugaggaggugagacucuugaugauggcugaggcugucuacugaauacaagaaggccauuguuaugauggcuacugugcacacauuuaaaauucuugaugauaaaauucaaauuuuauaggucgugucauuguuagagcuccuuaauauaaauuuauaagccuccauaaaaaugagcauuaguuaagauguuagcuccugaguuaucucccuucuauuggugcuuguuggauacccuggugagauaugcugugugaugcaaucccagaauagccuggguugagccgggcuuucucagcaguccgcuuugauuuaccugcauuaauucuacuugcuuauccaaugugugggugcucuccccauuuuuguuucaaccucucaucuucuauauuuugggaguguuaaguacuuauggaaugggugaaugcaaccaugcguacuucucauggcguggucagcagcaucuuauaauuccuuuuuacuuuacauugccucacucuauagaagcagagaggcaauccaguucacgguuguauccccagaaacugauggcguuucuggcaugaauuaggccucuaauccauauuugugaaaugaauauauuaaucacaaaucauguuucuuuuuucaaugggccuccauaaugagucuauuauagauauucuaacuauaucacacaguuucugggagauauguucuaucuaaacagucuauuuauaauauguuaccccucuauaagauucagacaugagagcuuguaaucagucuauguucguaugugucuuucccaaugauuaucccccucgguauaggucccuuggacuacucaggaauaucauguuguccuaccacgucugaauaccuuuuucucuagaccugugaucccuauguacauuuuggaauuggcacauggaggcuuccauccuuaaccugaggcagaggaggacaauacucggcaccagaggcugggaauauaacagccaaugccacagugccucuguucucagcccacacacuuccucuccacuggugacaacuguuuccacuccauuuuccucuucacuaacagcaaaugucccuaagucagaaacugccuuuuauuugucuuaacauccauauuuaucuggaaaauagaggaaccugguaaacauuuguagaaggagcaaguugagaauguauucccuuuguuuuugcuaaacaagucaaaauguucuuuguaaaagauguuaagcuggguauuguuucucacacaucagugccugguuaccccccuugccauugucauaacauagucaucaguucaaauaauagcccccaaauccuuaaagucaaagcugcccacacugggccacagaagaccuucaagccugcagcauauggauucucagauccucagaguuucuuugacggcacuuuagguuagcuuuagcaaagaauguuucuaaaagacauuuuccagcucuagccugccugggucuuugaccuuguguauagauuucucuaaacgggugagggcgaaagaauccaacaguauuaagaaaugugauguguuaucaugacauggcacuccuugcuuaaaugaagaaggccaggcagauugaaugugucacuuucuccuuacagauaugucuucuccaacuacaaugaagaagccugagaagccacuguuuagcucuacaucuccacaggauucuuccccaagauugagcacuuucccccagcaccaucaucccggaauaccuggagucgcgcacaguggugaggaguuugaagcagagaggaaaggccucuugaccacacaccaaacacuuaaggguggaggggaaguuuauugucguugcuauggugacaauauccucuccacccaaaagacaggguugcuaauggacaaaauauuuuucuuaccaguuuaggagaaaauauuuaagauuauauaauuuaacaauguggccaaggacugauaaauucuaguauggucagugaugcaggaaugaugccugaaacagagggggacccauauauaucugugaaauuauugggauauuauucuggaaaccuuaggaaaucaauuauaaguauuuuggcaaaaauguuauacaauuggaaugguauuuaaaagaagucauuggucuagaacuaaaaacagaacuggaaggagccagagacuggaggaagaaagacaagaagaauuugcagcgaugaaagcaaaagaugcacauacauguuuucuuucaaaaugaagggagacacuucuguuguguaucuuggguuucuguccuuuucaaaagaucagaauaaccuuuauuaguaagacagccauuuuuacuuucauuuuuaaauauaaaauucuaucugcuucuaucaggcccacgacaguuccugaacuauccaaagauuugaauuuugaauugugccaguucuuagaaagaguuuuugcuuuuguuuuuguuuuguuuuguuuucagaauugcccagacuaauuauuucuuaagcccagaagccaaaauggagccaccuguauaguucacagggguuuauguacacauguuaacaaaaucuauaauuaaacugagcggagauuaagauuacuuaugacuguggguguaguuuguugguagaaagcgugcuugaggaccuagcaugggauucaaggaaaacaaaacaaaacaaaacaaaacaaaacaugagacaauaagaaaaaagaugcucaacuuuuugacaaacauuugcauuuccuuaaauuauacuucaagugggugugcaucuuaaagaaacacuuaaguagaacuuguguuuuuaagaaguguuugguucuucuccacagugcaucugguagaaggaugacacagagagaacguuucaaccguguauucuguugccauucuucugcaaguccuaaggaccaguaugcuagaucugacaaacuaaauuugugguucugcacugugcacuccuaaauuuuuauauccugaguguuuucuuugagggauguugucagugucucuuaaagcuuucucccucucccuucuucuuuuucacguaaccacuagguugaagaugaugauuauagacacucuucguuuguagucauuaaaagaacuuaguuuucacauuguuggacuguuaucuaaaauauugaauacuguauuuucauaugacuuggaucaagguauuaaugcaauagagauuuaaucuuuaccucuauauauuuguugucuuaauuacuaauuauauaauuauuuccagcaaccgaauagaaaugaaggcuaaaguacauuuuauauuugauuuaaaaauuaauuuucaaaacuauacauuaugaucauacuauuguggaaagcuaccacugaacauuacaggcaauacacauuuucuguaacacguucugcaaguagaacauacuauuguaaaauauguggguaaauucauguuugccccauauaaaaauuuuuaguuaacauuuuuguggcuucuauucuugauguucccucauaguaacaacuggagucagaauaagauaaucaugggauaaauaucuuuugcuucugaaaggaaucaccuucauuuggaggagugcagccccaugugccaauguucaagaguauuuacauagcaagcagaucauuauucaugaucugacaguuugcucuguuaacuguugucuuccauuuuaaacaacugucaacuagguuguauagggagaugauuuauuugaaguugaauugcauuucuauuuugaguuguaguugaaaacuugugcgucuccuucucucuaauuaaugcuguaacuugguccagauuuagggagacaaagacuuuguaguugaugaguauaccuugcauggaaauucacuuacuuguuguugauuuuauaguucuacccuaaucuguacaagagcuuuuuuuuuaaaguuuugcuuguggaucuggaaagagagauggguuuguuauguaggguggaguuaaugucuuuauguccuuagcagggccagcauugagaaaguaaaacaugaaagguaguuuguuuaauuaugggaacaagugaacgaauuuucuccaguguuaccgcguuggaagugaaugacgggggaaggccaugcacugacuagccaggcucuguuuucuguguucugcagucaucucaacucgaacuccaccuccgcccucaccguugccauuuccgacgcaagcuauccuuccuccggcaccuuccagcuacuucucucauccaacaaucagauauccuccucaccugaauccucaggauacucugaagaacuacguaccuucuuaugacccauccaguccucaaacgagccagguaaaaauaagagaaaacaagauagauagaaccugaggggcguggggcaggucuacuuccuuccaagugagagcuuagccaggcggugugccucaugggccaucaagccucacaaucugucuucagaaagcuucuugucaacucgauaaggguuuuuuguuuguuuguuuguuuuguuuuguuuuguuuuguuuuauugaaaggguggcugaaugacagguaggaagggcauugccccaaagggauacauucaugaagaaguuugggguuuaauguuuuuggguuuucauuggaagaaaguuuaugcagaauguucauugccaaaaaaccucugagcucgaguuugcaccuuggaaauaccugguuugacauagagacaaagugcuuauuucaggcaggagcaagguaugugcuaaaauaaacacccacaaaagagcuuacagcuguauuuacaggccaguuauucggcauuaacaucagcuuugguaauguaaacauuuuucagcagccuuugaugacuccuugacucuuuacagagacgugacuuauauuuaauaaaaugacauuucuagcucugucugucugucugucucugucucgcucucucugucucaacaucauauagugguuuuaggaaaucauuguguaaguauaguaacuuauugugcauuucucaguuuagaugcaugguuucuucugugauaggauguugcguaggcuucugcgcagggugauuuuucagccagcuagaagaucuuugugccaguaaugagucuauucauaguuacaguauccaggucucuguuguaauuuugaucuuaugucuaguauuuuuuucuguuucaucuauaaaaagaaagaaagaaagaaagaaagaaagaaagaaagaaagagagaaaaaaugaaagaagaaaaaaaaaccuugcucauuuacaacaacuuuuacgacuuugggaaaucuauagaacauuuuacuauaccacuguuaagcuguacuaagauuagaguauaugaguauauguguauuaaauauaaagcucagggaaaaaaccuuuuuguauuaguuuguuaaauaaagcagaaugauccuuucuggaugcuuugauuuuaaacauaaaauacugcaccccuuguguggcuuagaaaguuaccuuugcuuuuaguuuuacuaauuaauuauaaaaucaaauauuaacauuuuggaguuaaacacauguauuugugccuuuaaaaaaaguccacaugacguacugaugaugagacugcagacaauuaaggaagugggggaagaccuugggaugccaguuuagaaacgaaauuugcucccagaguauggauucaaaagucuguuucauaguguauuuugcuagacucagcugggaacagugcacacaaggucugauuuuaauuuguuuagaauuuccaugaauaacaaagucuaauuaagacauccauuaaaaguccuuaacguuaauucaguguggaaaaucuuagaguuccauuggauuuuuuuuuucuuaaacugaugucuuaauuaggcacuguuagggggaaaauuaugcaaauuaaaaucaggcccuuaguguuacgcauuucuuuaauuauucaguacuuguuuuacauauauuucgauuucuguauaaguuaagagugcauauuaggugauaaucugccucuuuugucucaguuuuuuuccucuauguuuucaaaguaaagaugcagcuucuaggagagcauccugccccccucucuguuggaagccaacaguuagaagaaaacccgugagaguuugauauacugggagagacgauaacuaggcuagcccacugcuggugcuguccaucuucagauuguagcuucacagguuuaaaugggugugaaccugaagaguggaagguccuuugacccugguguuuuagagacgacugcaugggcuuaggcacucuuugucccuuuucuuacuuuuggaugggagagcaccugucuguuccuguagacagaguguacccugcacaaacuuagcaucagugauggcguguguugagauucuagcuauuugacuucuguuucagguagguauggacuguuuuggugaacaacaugcagaaacacuuuugcaguugauugcaucacucgugcaagagagagagggacagacagagggagagggagagggagagggagagggagagagagagagagagagagugagagagagagagagagagagagagagagagagagagagcuuucuucuuuccaaggacauacacaaagcagucauuuauaauuuuuauaaucuucccauagccagaaguugaucuugucacaaaaaugggucuuuauagugaauggcagaauuuuuuuuuaaaagaauguuauacccauuuugaugguuaauuuuaaacuuaaagccaguugauuuguguuucgggguaagacuguugcucugccccuuuccaaugcuggaaaugcagugugagcaacaguucucaaacccugucgucagcugcugcuuuucagggccaugcugaucuggacucuuacgcaaggagaugccuucuccucccaacagccaucuggagauuaauuccauuagugcugcaccaauuauaguuagacagucaugcuauucaguggaauauuuugaacaagauauaauucucccauagguuuccacagagaaaaacuccaguuuauuuucccaacauaaaguuaaauacuuaagagugcccaugaugaauugucaggauauucagaguuaauuuuuaaaaauaaaaaggaagaaguaaccccucuguaaccugcccaaacucaauccauaccucuaagucaauauauucaagcgcuauuaucuaucuuucucuaaagaaauagucaguuaugguguuuauguugauauuuagacaugucguguuucguugauuucuuuauuuugcaaaguugggauuauaaagaacauacacuuggggagaauacgcgccaggaaauuguuagaaagaccaugcagugaagugugaguauaaauaacacuggcacucucuaccuggaauaauauauuccaggcuuucuaauguacccaaaaucaauguuuuugucuccuaccaaaaaaaaauuauugagugguuaaaauucaaguaaucauguauuuaaauugugaaacuggagagagcauuuucuucauuaauucccaccaaugucuauguaacucuucgugcccagcaaagugagccacaaagggcagugugcauucgaugcuccuuguguccacuuugggacaucagagacauuccuuugaggauauuuuauucugaagcauaaugccugacuuacuuucacauuuuauaacugaguuugcaacugaaaucuuagaugcuuuaaauuucauucuguuugcuugcaucagcaaaucauugaaaguagacuggacaccuuggagucuaaauuaccugaaauauauguccuguaauaccugugugcaagagagaggaagcuggaauuuuuacaugcauaggaaaugacuguacgugauggaaacuacauaguguuggacauguuuccuauuucuugacguucuugugucccuuauuguccaucguucaguaggagaacauuguaccaagagggaaaccgagaaggaggagcagaacguuggauugcuggguucuuacugcagagaauucaguaaggaauuccacuguagcuuuaccucagcaccaggcuccguguguguuuuccagccuacuacaugagagggucaggucaacuggacucuuaggggugcuguaaagaggaagucaccugugcaaagugcaacgaugaucaaacccuucuuuaaguacugugugugcugcugcuuacuauuaaacauugaucagcucccagcgcaggccugagagggccuguauggcgacucucuacccugugcagaauccccgaguguauacugagaggaguugcuggacaggaugacugucuuuuggauugcuucacccggcguucuguuuuuguuuuguagccuaacagcaguggucaaguaguagggaaagugccuggccauuucacaccugucuuggcacccucuccccaucccagugcagugcgaccugugacccugaccaugacagauacuaaacccaucacuacauccacugaaggugaggcagcuucaccuacagcaaccaguaaguauuucuguaggaaaugagaaauguccaucgaaggcaccauuggauauaugauccaagguggcaaacacagggacguucuggcuaccugaccagauggagauuucucauuuaaguggagcuagcaggcauguauguggcccagcugucacaugcucucucuuaucaaauuucuauuaacacaucauauuugacaggagagaagcauuguuguuuuugaguaacagcuauaauaaaagugauaaacccaugccugcuuguucaagguagacauugaacuuacaccaacaacacagcacaauacaccaagguuuuuacaucccccaaagagagauuagauaauuauuacuuauuggagcauuucuagaaaccaagccccucccccaagcgaaaggaguuagugucuccagaagacaauuacauguuuaccucaguguagguuaugucucugcgagaaguaguuagccauugugcugcacaggcaaggacacugaaguuuaggauaagguauguguaagguacccacacuuacaugaucgacaauguuuucuuuaaaucuuuugguuauuuuggcuaucauauuacaaucauacugaguuuuguuggcauggccauagcacuguaaaugucagacuuaggcaguauccuuacagaacacacauuguaaaugucagacuuaggcaguauacuucuguagcacacaucaguaagccaagugacuccuccacuucaucauguagaauauucggaauuauauacggaauagauuuccuaauggcuucaccuaaacuuccagcuucucagagggcgcugguacgcaccgauuggcaaauggugagauuccaucugagaggcacuagcauguuccuucccugugaugggugccuuauaucccaaugauuuuucuugcauagagcaagggcauucuuugugcucugggaacucccuuaugggauuauaccgucagagacaccacuggcucuuagucucuuucccuucucucucagccaucagaaaaacauucauuuuuauuuuuuaaaaugacuucuagaaacuuuucaaagaaaaaaaaggauaacauauuuuuucaccuuaggagcacaguccauacucaucauuuauuuagcagaauucacgagcccuuucaaacugggaaguggagauaggcuuggagugcaccuuaccucaucaguggugcuuggaaauuagcccacuggcaaagagucccaccccaguaagcacuucucugaaugcaaagauggaugagacuuuucuuuuaaauacuuucuguguauaguacaaucacuaagacacuauauguauguuuuaaaagcaagcaucaggcuucuuugaccuaagugcgacaguuuaaacaaaagcacauaaaaaugauuuuuaaaaaaacuaucucaggauaagugauuaauaccaaaguuccagaaacuuauggcgcugccuacuuugaugugaaaaccauaccugaaguucagugggggcucccagcccagguaacccacaguccuuugacuggugccuucagcuuguuugauaaugaauugcuuguauacucaugcagagguugguccaaaagagauuugauuugccuaguaaaauuucuaaaacauccaaaagaaaucucuagauuauauaaacaugguuuuguuuucacuccaaaguuagagaccaaggaagccuguuuacaugauuggggaaaacaaacaacaacaaaacaaaacaaacaaaaaaucaaaagaugagcccauauauggugcucacaacguaagagcaaaaggcuucucuccuuauccuccagccuguacauugaaaucucggggugugcuggugaaagugaaacacugggcgcugauggccagcaccccuuauuuagcagugauuagaacauaaccugagagcauccuccauguuuuaaaaacuugaccugaaaagcaucaaggucaauggugcacuuuuaagagaacacgcagcacuaauauauugaucuuuaaaagcuagccuuuuuaaaauccgugucugaauuccuaauuaauauaaugguuuuaaaccuuucagaccuccuagugugugacauauguuacaaaaucaguuguuucuguuuacucugagaugauggagcagugggcuuaauucuucuuuuccuuguaaaagauagauuuagaaaugagaauuuucugugggaaguucacaccaccagaaaaaaaaaaaguaauuggaaacuaaguuacagcgacgucaagaacaguccccugcaucugcucuaccuagagcucaagugcaggaaaggucaugugcuccucacuggccaaucacaagcacuuuguagggguuuuugguuuugguuuugguuuuuuuuuuaccgguacagauaaugaaggauuuuuucuuucuuugucaaaaaauuuucuaccgcccuugaggacauuucucccacuaaauagaagauggagcuaagucauucucugugcugcaguccaacuguguuccucuuuuagaaaaguauuaguaauuuuucuuuuuuuaguuccacaucugcuuaacccugucucuaaaagcuacuacauucccugacaaucucugccuacuuuuacauuaagaaucacagguagcuaucauugauugauccauuagacauaggagaaaaguguaucuaucaaaaaggacuccagaguagccaggccucagcaucuagacaguaauauagccauagcacacacugagagacauccacaccgaaagauagguugugauuuauugcguagacuuuuuuuaaaggggggggaaauaguugauuugaauucaauuaccguuucuuucccauuacuugcuggucacugagaugaaagagaagagaaauggagaaacccuuuugguaguaaaucccacuucucuggguuucuuauacauggacaggguguucguucugacaguucacaauuuuuaucuuuguuuuuguucuuccuuaaucagccuacacagccucaggcacaucucaagccaaucgauaugugggacuaagcccaagagacccauccuuccugcaucagcaacaggugggcacguuucccccagguggaauggggaagccacgcuuugcuucggcgcuuuucuccauguugccucucagaucuggacucaggauggggcucacggggcuucugagaccaaaauugaucauuuuguuuuccaauuuuuuuuuuccucauuuguccucugcuucuuacuucucuggaguuucugaaacuagcucacagccucuucugucuuccuagcacacagugacaacacucacaggacuguuguaccucagccagacuguaguguccugcugacuagaaccugaggacuuaccagccuauguggcuuucaaggggugacaugggaagccaguuggagaaccagcuagagucaguacaucauuuguguuuggagcaauuuuguuuuccccagauguuucacuccuccuuuguaucuuaguccaggaggaggauguguuguacagcugagcucacaggcuacacauuaucccuacucuaauaguuuacauugcuucgcugauuucagaugagaugaaacacuuuuuggggggaggggugauucugccuucuuacaucauuuauguuucaaguagcauuuuaaauuucacaucucauuaaugcuguaaauuuaaugcaaaugaaguguuuacccaaacugugaaaaaguacagccaggauuaaugguggcuuauaaacaaauuagccacagucagaagaaugcaccacaccaacacagaaaucccaugauucuaguuauagggucacagaaauacuuguaaacacuucagaaccgaagccuauuuuaugaagcauauguucgcuacucuuagcuuugggcagcagagcagucugaaaugaacaguaugcaaaacauuacauaagaaaacguaggcuguaguaccuaggacugaucuggaauagacaccuuggcucuucguuuguuagucgucugugcuuauaugaggucuauauguguaucaagcaugugcaguuccaugugcccacauacuccgcucuaggauggccugucuggaguuugcuuacuguucuccgggcauucccuuucacaggcccaggugaucagcuggguaugguaaaggucaccacaugcggaguucagagaaaaccguauagcugauagcucauucaagauacuugacauuuugcaagguuaaaauaacaaaacagaacacacgagaacugacugaagacaucuguauauaguuauggaaauaccaaauaauaauuaguggcuuugccagccaauggcuuuucaacagaauucucuggaauguugcuuuuuuuuugaccucuaaaagugcuauaauaugaaugaguuauaauuacgauaggucuauuuaacaaauguaugugaucauugugcuuuuuaaacauaugcaggauuuauagguuuuggaaacauguucuuuuuuuuaaaaaucauuauaaauuuuuuucagaaauauuuuugucaugggacuuuguauucuuuaugacacaucuauaauuuccaguuaauuuuuaauugaaaaaacaugccuucguuauuuaaccuuuagccccaaacacauuuaggauauuauaaccaaucccaugcauucagaagcaauuguccucuuuccuuguucuagaccagggcagcuuuaguuuguaucaauuaaaauuaaugucaggguccccugcaaugacaacuacaaaaguauauuugugccaaaauccucucagcauuaucuaaagaugcaucaagaaagcuuaggacaaugagaacauagaccuuaauauaggcagaaaucugggacucuuuuaaucugaggaaugcauaggacagacaugccuauaaagacuggcacuuguuauuuaagugaucagugcugaauaaacaccacuuacaaugugcauauauuaucugaguucuaauguguuugcuauuuaugaauauaugguguauauuaauccuuggaagugaaaagcuauauaucccacaguuacaauuuguaaauacugaacagauagauaacuuaucuaucucguauguaauggaauuuugauuuaagaaaccaaauacauagugagcuaugauuuuugaggcaugaagaaaacaacauaaauguauuucacaugauguaagcacaccacccaauuuaagcaccaguuaaaaucuacuaucguuauccuuucaaauuaagaacugcagcaaugaagcuguauacucacuguacaggaauggagagagcgaaauaguuuaaaugacuucaguaaagguuauucuuccuccagcagaaaugagauugauuuacuguguccucucauuacuuuacgaagauuuagaagagagcacucuucuaagggcagcuccuaaaugcauuugguuuaaagcucucagugaugaaugcaaaggaaaaugaagggguauaugaaauaaaagugaucaaucauuuuauauuagcuaggagaaauucaaaauuagaaaggcaguggcuuuaggccgagggagcucuuuuaaacauuccccauaaccuuuuauauacauggcccuuuaaaaauaaauauugucaccagguacauucuucaguucccgcggauugcuuaauaaagauguauccuuucagcuuaugaaaaguauugaugugcauuguuccaugcuauuuucccuuagaaaagaacuuuaauauagcuuucauaaauuaaaguuaauaaauguaagauuauugaauaguuuugacugucuucagacaaccuucccacaaaaugacguuacagaagggcuuucaccguagcuguuucucuuacacgcucacacugacauuucaauggaaacauaaaaugcuaaaguacauccauguuggcaaaugaaacccgugcuuuuaugcuuaggugcuuguuacacaguuauuagucauugcauaucugcaaccuccuuuuaauaaugauuacuucugguuaaugccaguuccuaacugccuugaaauauuaguuuuugugauuuuuuuccccuucugauguuggaauuucaccuaucaucuaaauacaauaucucacuugaauauaaaaaaauaaagucacuuaauuacguaaaguguuucaggaagguuuguguaaagaaguugcuagcuuagcacuaacaauaacccucccuguggagaguaagccucagcucauauaacugaucaggacgugccuugaugggaugucacugccuugggcauugaggccuggcgcuggccugucuuugggaucauuaacuggcuuacuguauuugccagugauguaggagaaaucuccaaaccagaacuguuucaccuagagcuucuuucugcuauaacuuuuguguuggaagauggugugguggcuugaagaacucugagguccugcuuuagcaaacugggcucugcucucugcugccaaacacuuugucuugguucggaacacuuucagaauguugaacacaccuucucugacuucccuguguagaaguccugcuuccugccucgcaagcacucugugcacacuccuuccugucaacagugacugaacucuguaucccaaauuuuaucuucgugaggaaaugggaacccucuagcagaauguuagaguuggcuuagaagguauagacauuauuuuauaauucagguuaacaauguuaauauaaauggauauuaugagaaaauucaguuaaauuaauaccagguccuuauaugcuaagcuucauaauuugcuuacuauaauaggaacuuuauuaauuuaaaauaaucuagcuuauucaucaucaauuacaguucaguagaaggcugcuuucacagcagaaaccuuaguaauacacaccaaugacaccaugacaguuugacaagauuuguuguagauugaaauuaaaagcuuguagcuaaaacacuuccugugagccauaagagaccccaccacacaguuauacgaggccacaccagucuaaccagccauugaauaccucacuggagaucauaggcagacgaaauagggagcugccuuugccuuccuuaaauaagacaauuaagucaaggaagcuccuaacuguaaaaacauagggcuuggucucagucucaauaggauguccuggcugccugugcuaucugugacuagagguacuggccgagugccuagucacuguggguuuuauuggugcuugagcuucaacauuacaucuccugugugaccauguaacgcuguuauugcaaguucaguuaucgacuaguuacgcugaagcugaaaugguuucaacacuuuucugggcagaauuuggaaguacuuuucauuacacuaaagauuucuguuacacaaaauagcuuuuaaagaaauugccucuguaggauuucuuucuuucuuucuuucuuuuuuuuuuuuaacuaaaacaugaagugaaauccucuuauaauauuuguccuggcaaaugacaaagccaaagcuuggaacauuaaaaaaccagcauugaaaagucagucauuagaagcaagcaauuggaaaaggacacaaguggacuaucaacaggcuucucuguagagcccggaagcaggcuaucaacacucaggccauucuuauuguggcuguuaucauaauugacagcaugacgcaaaagccuaucacaugacuucuggguagguauguaaaugguaagaggucacuuuucacauaugccugaugaaaagggaacagaguuaaaggaaguuuuagucagucuaauggcuaugcaaauguuuagcuuuagggcuaguuuagaaauugaaaaaaaaaaaucuuccuucaacuggcugucuuuuauuauucauuccuuuacugacuuuuccuagucaccaaagacaagacucuauauauaccauuuuaauuaaugacaaaauaaaauuauguuuaaugcagccuuaaauuucaaucagcaaaaacacuggaaaaaaaggcucuuagugggaaaauucuaaagaugauauuuacaaacaauuugagcugcacaugaagcucaggauaggcaagagagagugacagcauggugggguggggacauaacaggcauguuggggugggacagugacagacaugguggggugggacagugacagacauggugggguggggcagugacaaacauggugggguggggacaugacaggcauguuggggugggacagugacaggcauggugggguggagacaugacaggcaugguggggugggacagugacagacaugguggggaggggacauuacagacaugauagggugggacaugacaggcaugguggggugggacagcagcaggccagguagggugugguaagaacccagguuuaaagucaggacuuuggcuguugcccucugacuuugaacaagccuucagaaggaaaaggaacacaucccucuagcauugcuagauaccuuaaaucuuacaggccugaguaguuuccauugaaagaaagaauccuuuauuuuccaacucuugaacauaugacuuacagucagugauuuucguggacuauuuauacccauuuaacuuuauucugugaaguaucaagaaccuuggcuucagauauugacacugugacuugcagguaccaggguggucuugauuuuucuucuucacaguuuccuugcagucauuuuucuuguucauuaaagguccacagcauccauccacaguuccuuccaguugcuccauagcaaguaguuaauaguaacagaggaaaauguugcccauccaguccaugaguggacacggacacucaaauggcgguccuuuuuguacucuuccauugcuccccucccccaaccuguugcccugaucauuuuucuuacuuuuuuuguucccccaaguugcuauguguuuaauaaccaaagucccuacaaauaauaauaaagggcuuucaccugaguauacagacuugaauuuaaggccauguugauucucuguggcuaugcgcaacuuagcauacugagaguauaguaccuagguauuuccacuuaggaguuucugcuuaggcacauuucucauuuuaaucaauuaaaauccucaccuggcucuggacucacugugugauaacagaugaccuagaacuucugguucuccugcuuccuccucucaagugcuagaaguaaaagcaggcaccaccauccuugguuuuauauggugcugaggacgaggggccaaaccuagggcuuuguguauccugagcaaguacucucuugacagcuacaucccagccuccuugugcagauauuugaaagaaaccagaugguuuccuuccuaucuuuuuuuuuuuuuuuuuuuuuuuuugacacaaucacauccgaauuguggcaggcacaaaguuucccuucagaaggaggaacuccugucugagaacauauguagggaugucuucauccuuacuccuuucuuacuuuuuuuuugaccccuaucucuguacccaucauuuuaugggggugguucuguuucuuucauuucuuguuucuuuuuuggaauacuggggacaauggauuuaacaucuuggcuuuauagacagucuucuuuuguuuugguagguacauauaaauuaaauaaguaaaacagcauguggcuauguauucuguacagaugugcguauuauuaagucugacuuuuccaguguaagaagaauuggaaccagccccuccccuacacagucacaugguacuaacagacugagguucuaagcucuguugcucauggucuuuuaggcuuaacugcuaugggauaggagaucaccucuuauauuguaaagugaaauacuuagaaaacucacacuuauagauguuuugaacuuaugaaaauguaauugagauggaagauauauguuucuguaccaguuguaauucaauuuuaaaguuugauuagaaauaauugacaguugaauuuucuagcacugagccuuucucagaagaaugacuaggccaguggaucccagcuuuccuaauguuuuaauacaguauucauguaugggaauccacaaccauaaaacuacuucauugcuacuccaacugaaauucugcuacuguuaugaauauagcauaaauauaugauaugcaggauauuuugaugcccaaagagauugcgaccuacauguugaaaaccacugagcuagacugucacuacucuaaauuucaaaacaguuauugcuuauuauuuaaaaucucuuuaaagcuuaaggagaaaauuaggguuugcaucuuuaaucaucauaauaaaauauuucacauguuguccuaaagaagcuuaaauacauuuaguuugagucuuucaguauuaaaaauuuguccugaauuugcuuggugcaagugucuugguuaagcaagaugcuuacgaaccugauuuuuuagacaugccugucagagaaaucuuuggugaauaauaggugauuuuuauuuuaguuauuuaacuguuucccuuuccuacacuccuuagauuuuuugcuuuauuggguaguuuauuaguugaaagauuguuaauagaaaagauaauaauuuuaaaaggagugagaaagaaauguuauugcuuaaguaauaacuugguucaaaagggugauaauauauaagcuggcacaaauauuugucuccucagacaccucagaaguguacacacugcugguccauaauauagacaaagacauccaaauucuauuuuguaauuuauuaaugaaugaaaguuuauucgauauuaauuaguaucuugccaacuucuuuggcauuaaauuauuuuuaaauauaaucuuuggucauuuuguauauauguaaacauuuuuccuguuuuagaggaaauauagcuuuaaaacauuuaagugugugcaugcauauauacauaaaugauaaauggaaaugacgaguuugguuuagcaucuuugaaagaauauguaggaaagaaaggcaaaacuaacuaaauaaauaaaugaaaauguugauuuuaaauguucaggaugaggcuagagauugcccacuugaaauuuuuagaagugguuauagaaaaaagcaaucugcauguaacuagccgauuuacauaaguguccuuccggaaagaugguagucucucagccuuuucucagauagccugugaguggcacuuagaaucuucagguuuuguguggaauugucaacuuucagagaaagcagaguucccuagacacuagccuguuggcagucauuagcagcauuggaugugguguuugccuaaacauacauccuauuucuugaaaugcuaaccuaccccacacgggcauucacuggugaguggaucagcaagggucuccuggcuugaacucauaggggccaugcucuucucuuucaagguuucuauuuugaaaugugccccacuuauuucugaagauaaacagcauggcccagcacauugaauuccucuugaggagguccacucagagaaguuaaaaaaccaaugagucaugaaacaacccaaacccugcacuacuggauaggccuguaauccucauccucggaagguuggggacauguucaaggccagucugagcuacauagcgagauucuguguguccacucccccaagaaguguccccucaaaagcaagucucacaaaguugcuucccauacacuauagacuaaacaacuuuccuccuuugaaacagcagaaacaugucaucucuuuaaaaaugacuaaguaucuauuuuccccuuuguacaaauuauggccugcuucuggaauaccuacuuuucauuguauuucuuuucuguugugacuucuuuauagcauugagcugagcagaccccacccacccggcucucuguacaucuuccucugucugccugagcagacuuuuuccaguucuuuauaaaacuauuuuuacuuuaaauagcaaaguaguuuaaaggccccuucagaauuguagauugcauuuucagaacaagaacuaucguccugaaaccucgggcucuaucuuaggcugugcagaaacuguagucugacagggagucguccacuuuuuaaagcaccguguuuucaggacagaguuaaagcaauuugucccaaguuuaaaggcuuuuuggcugcaguuaccaucuagaaaugaucacagaagaggggaagagaggcaagccagguuagugcuuucagcaaggcagccucucuccuaugugagaggcaguuauuuauagccugccucuccgaagguuaaaaaccaugaucuucuagaugguucgcucccuccccaccccacccccugcaacgccagauaaguuuacuuucuuaagcauaaaaauaagcaauauaucuuuucaauaaaucugcuagcacuguagggcagcuguuaaccaaacagaacuggauaggguuaccgggaagcauccuggaaaguggagccaaugugcagaucuagggagaauuugucucacucagguccuguucagugccuucuccagcuucuucaagugcagggacauauuuacaaugccaugacucugaauuuuacauaaaacucaagcucauuuuuuacucuuuccgaacaaugccacuuuaggaaaaaauacaguuauuaacauggaaaaugggaagccguccagcuucucuaccugucagggugaacacagggcggggcucuuuuccucuaaacugcaugucuccuguuuugcaaacugcaugcuuuacagauauugauuauuucacucugcacagaugauuugguauguugcauagaaaaaaaaaagcacauuuuuauuuccuuucuaaaauaaucucucuauugaacauuauuaauguuuucuuuuauuucagcucaauuuauauucuaauacuggcuaauuguuauguucuaagcacuuguuucucuguaugcuuuaauuaauagagaagcauauugcaauaacuuuuuuuuucccuaaggaaaagucuggaaguuuugcuuuauagaguaauauuuuuuguuuuguuuuguuuguuuuuuuguuuguuuuguuuuuuuaauucuguuuguuuucuuuaaguucccucuugggaaaguaagaguaaugccauguucaguacuaguuugcauguguucauuuaaauacuaaaaacuguaguacugcuccaucauaucugacugcuagguuucaauugacagcugaggauuugugacuggaccaugaaucaaaacggcaggcauuuauaccccaguaccagugaggauacauugggaauuacuuggcaaagguaacauuuuaauuauuuccaacccuacacuuacacuuaaaaauuacauggccuagaguguuuguuuuuaauuaguugugcagaaaauauguuaaaaguuuaguuguuuggcuuuacccucccuauuucccuaacccucugucuaauuccuauuuaaaugcagcaucaaaugaaucuggggacuaugcauauuuuaacgaucauuggaauuucucaauacugucaaacguuugggacaauuuauaacauuuuuuggugggaguaggaggaguggaauuugauauuuagauuuaagggccuagaaaugaagucauagauuugggggagauuuuuucugauaccugaggauaaaacagugguuuucuauauuauaugcauuuucucauuucaaaucuuuccucuccugcuaacucuagguccuucuuacaucaguuauucaucguucagugggggaaagacuagaagagaaauuucaagucagucaauuuagccaucauucacagugccagugaaguuuggaauggaaagauuauucaacaguguaguaaaagaaggaaauuuaaauaguuuucauuccuguuugcguacugauguaauugacuuuauuaaauuggcuaagaaaauuauuugaaaauaguuuugauaucaucauaugcuuugguuugaagaaauacucguaagguaguugucaaucuuuuuggagcagcuugugucaaauaaauaguuuaugguauaauguauauuaaagcaccgagaugaacauaggucguaagguaauccuugaguuuccugacaacagagccaacauaguugugguccucacccugauggugauccucuguuuuuaguguuugugugaaaccagcggcugagauguuaguuaggagagagaugcuugauuccauagugggugauggaaccugcugugggcucauggagucugauguauucauuuacucagauaaagccuaaaagccuaucuggauuuugguuuuguuuguuuguuuuaauuaaaaaguuauauuuauucuuuuuauauaugagcguuuugccugccuguguaucugaacaccacauguaugcuuggugcuugcagaggucagaagagggcauuugauucuuuggaacuagaguuaaggaugguugugagccauuaggugggugcugggaauugaaccacaguccccaacaagagcaacacguacuuuuaacugcucagccaucuccagcccuacacucauuaguuaauuuaacauuaacacuuaauuaauuuaacacuuaaguuauucaaauaugacuuuccuuuccccauuucuauguugguaguaauaucaucuuuuaaauaaaucaauuguucuuccccaagaaauauauauuaguacagaaaaaaaacccuauauaguauauacuuacaaauggaagauaaacuugagaaguaucuuauauaaauagucucaauaauuaaugauacuuaauuaaaaugaaugaaaguggcuugagucugaauuaguaagcuauuuaaaguuaauuuaauuagauuugauaacacaauguuuacauuaguuuauuaaguaacaguccuauacuucaugcuuugucuaucagcagaauggcccagguucacaaggacaacaaauuaaauggaagauacucauguuucuaaaugcuauucuggcugucagaacuuuguaauagguagauuacugacaggucuucaguuaaucuagaauaggauagugucuuugaagugcauugaaaccaaagugaugugaaacuuuggugauuuggggugaguaguucuggaaucagaacuugguguaccccaaaagaaaagauaacccacacacgggaaagagugaccacagucacugacagcccuugcagaagcacuguucaucuugaagcucccauucucaucaagaaaguugaugugggcaagcagcuucagaucauaaugaaucagcgaggaggaggacuaccagaauuuauugauuucauuuauucuccuucucugaggauacuaaucuuccauugaauuaguggauaaccaugugagauggccugacugaccagcaaagacugggaguucucucuggguugcaucugcucuucuugccacgcuucaagaagggacauaguuggcguuucagguguaucuauacauucugcagggacucacugagucaggggcaggguuggggcuguccuaaguacugucuuggucacacucacagcaauuuugagucuguacaucacaguucaaaauaaguguggacagaugagacagcaaucugcuuugcuuugcuaccauucucaaagacagacaugacugcaggaugugguggagcuugcuuuuagucccagcauggaggaggcugaggcaggcgagucucgaguuugggacaaguuggccuacacaugauuuauaaauggugcccugaaguuguuuuuaaaacuugauggauuuucauuucuagauagaauacugagaagacaaauccuaacugccuguaccacugucacuuucaagagagacugggacaaccgaagguguagagucaucuuaguaguaggacaauauuagggaaagagcggauuuuucagccagaggcaugaaugacugagcuuuaauaugguagauaaagaacaggccauaguucaugcuuguugugguaacuccucguuguuuuucucaugguuguuguuguugaugauuauauuuugacuuaaaauagaacuagaucacuuuccuuuuuccuucuuucccuccagccucucccagcuacccacucuccagucccccaugguccucuacucucauugauagccucuuuuucuuugauuuuuguuguuuuauacacacacacacucacacacacacgugcacaaauguuuaugcauaaagguaaucauggagacuggagaucacaaccuauauggguugugaccccuuugggaguugcauaucagauauccuguauaucagauauuuacauuacaauucacuacaguagcaaaguuacaguuaugaaguagcagugaaaguaauauuauggguaggggcaacauaacaugaggaacuguauaagaggggucacagccuuaggaaggcugagagcacugcuguccauaggaaggccagagcaaagcaggcauuuggauuugcuuucuuuuguuggaauugugcgugcugccaccugguuuguccucucugcuuucuuucuugccuggaccacuugcccccucgacaugcuucccuaucaaaugcagcuucuuuggaggguugaaaugacaggaacugugugcauccugugugagcuagagagcuaucugccugccacauccaaccccagcucagaaacccccuccggcaccaaagcugacucuugggucaagcuuccacugaccuucuagguuacaaucuucagggguuuucuugcuucgaacuuagcaugugugaaucagucucccucccccucccgcuuuguguguguugcaggcauauacaaucacaaagcuaaguaagggcuuacugaaaucuagagagagugacauuucccgccuaagcaaaugcuuccuugguaggguugaugcagaauaaaaugcugaaggucucgcuuccuugucugucgguggauucaccuucuaggaggacuauaggugauggcaaggcacugcaacuguucuuuuccucuuccauccaugcacaaguucuguuguuuuugcacacgugaguugugugggugugaacacagaacaguuacuugcucucuuuagacccuagccugacucuggcacucucagauacgaagggacaguguaaucgaaugcaaaaagaacgcuggaggacaaucugagaauaauaaaaauauaaguuauuuugaaacacuggaugggugauuuaugcaaaagagacgcuggauugaccguuuccucuucccuucucgcccuuccaccccuuuaagaaaacgcaaagccacaagugaguaguuguauguguuugauggcuuauauaaacagaagaagccuucagauggcuaaaauaaacacgaguguguuacagaaggauauguuuacacgaaccauuugcucagccccugaaauaaugaagaaaugaagauuugacugaaauaauugggaggauuuuuuuuuuccugcuuaugaugccauaauugaauggcaccaaagagacuuuuaucagugguuuuccauguuccauguguucccaguuccucucuuugaguugaaugcuucauccugccauuacuuuacacguguuuuuguaagaaauugucguuuauuacugcaauuccagagaguugcuugauuucccaagagaaguuuagcagccaguaaagguuauuuggaucuggcuggucagggggagggcaaagcaaaggggcagccgugugcauggcaugcucaguaguuauugugaaacacugcuuuucuuuauaaaauguauguucucuaucgaaagacuaaaaaccaaaaacuuaaagauaauuuucaguagguugcaaacugcauucacacguguacguuuauguagacagguaagugucacaugcgaugcauguauguggacaguccuguuccuauagaauuaagcuacuguuuacuucagcauuauuuagacuauccuggcaugucuccuagguuagcauuuccugcucaggauuucuuaucuugacacaaaacugcaguccggggcagcuggguuguuucugaaguuccuugggauggugguggugguguguguguguguguuuggggggcuggggggaggaggggaagcuggauucccaucucugaaucuucuuuucagcuguuggcucuaaaguguucacauuuuuauacagcauccuggggcccuagcaccacuccaggacuaauagaaaugcugacaagcuagguggcauaggugaguccuugguucaaggcugagaauuaugaaaucuaagguugcaucugagcaggguuugguaccagggcagcugcuguugucauccuuugcuuugaauagucucgugaaagcagugacuuucuguccucaucagcaucauuugcaccuguugggagagcaaaacugaaggcgguaguauuuuauucagauuauccgaaaugguuuucacucacucgcucacacacacacacacacacacacacacacacacacacacacacacacacagugucucugucucugaucuggcuauuggaagcaguguugagacaucauuuucgccuaccuuucuccauuuauaaagagagauuuguccaacuggccguuuccuuuuuaucuagacaaacucuucagaacacuuccuaagaaauuaauuguauuccagccagacuugcaugcugccaucccacaggaaaugggucagcaauccauuaagaugccauuagauaaucuaauuuggaacuuaaucucuaaauuaaccaugcuccauacuugaagcauacuugagagaaagaaaaaaaguuuacguuugaaucgauaggggagccgaagcgugaagaaggcuguuuguuuuuucuguagcuguggucacgucucaagccgucugguaaccaggagaaaccagacaugauguaauuccagauugaacuugaacuucagggacuuagcaugggggaacaaugggccauaggaaucaauaauguccauuuuccacaugauuaugucuggagcuuucccgucaacccuuuuggauggacaguguggccaaagcgagaugauccagggacaagauguuagaggaaagagaacaacuuucuccaugguacuuucagagcagcgcugcagauuccagcgggauuagaaaaguucccgcucugcagugaagugggagcucguucagagcacucuuuguucgccuagguaggacaaacuuaaucuuccguuuccugucagaugguuuuuggcagcagagccagagagggaggagcaggauucagaacauucucaaaaugcaaaccuuacugguuaacccuuuugcagcuaaaggaagugugcuaaaugcugaccuuguuugaagaugguuuaugcaaagcaccguguaaacacgcacacucucugcugaggaagucagcuccauugcggcccacacaccaucacuucauuguugugaucaaggagcuggaacuagguguacugugaaucaggucauauuuaaauaauagagccuagaaaugaauguauuuuuauaggaaaugcuacagcaguaaagacaaaagccuguugaauuuccacauggggaauaauaauauuuauguugcauaucagaaaguguagaaauagaguuuccucuccuauuuucuucguucugggagcucucugcauaugugaacacagugaaagggccaaugucauaaauauaauuguuaacuccuugacaucuuacucuucagaaaucugguauaaacaaguccucuucuuuagaagcaaaacuguaaaaauaauacuaguauuugcuuuuaagaaaaaucauuugugaaagagucuccuggcuuuuauacaaacucacauuucucuuucauuuaguaugccuuuggggagccuuucugugaaaagcacuauuuuggagaaccggaguuuuuuuuuuuuugguagggaaaugucuguaguugaagaaucacuuaugcaaauaagaggagcaguaacccuuguaacaauagcauugaaaagaagcccagggguggagaggaauacagacuagagaaaggcuggaaaucaacaugugggcuucccuguggcauggucugggaggaguaaaugacuacaguuggccuguauguuuuuauauuuuaauuggcaauaacauccgguagcuucauaagugugugugucuguguguguguguguguguguguguguguguguguaugcaugcacgggugucuuguaauugauuuguaguuaacaacuucauaauuuucuaucauagguuuuuuagcucuaaaauaugagcaaaaucaaaucuuuaaaaaauaugcuuaauuuccugauugaggggaaggauugcccuuuaaaucuuauuuacauuugacuguuguaagcaaguaaguuuuugugacuuuugaagugccuggguucccuuguugaagggccuucuaacaucauguguggaaggaagccucuauaguaaaagcaaaggguagcaaugaucugguucccuagacagcugcgcuguccccaugugaagucacuauugcgugucgucuuuugcagaugcaguacuucacugguauaugauacccccuuuuuuuuuuaaauuuggaaaauacuuucacuaaugcgugcuacaaugaacccuugauccagcgucccccagaagcaaagccgucugaaacaauugacuauaaaccaaugagguuugacagccucccauuugauguuauuuucaaaaguguggcuccccaaggauuaacaauaaagaaggcuauuuaccuacuuaguuaagaaauaaauacacuucucuuucauuacuaugaagugcuauugcuugcaguuagauucauucuaugagccaccugcaguuuaugauauuugguguuucccagagagcccacuggggcccuuugcagagcagguaagagcuagcgagggggcuuucugaugcagacuauuacaaauaguuauaaucauuagaaaucaucuugcaugcaaauaggaucauucauauggcgauaaugaucauuaaaaaugggaaaaauaaaucaaagaaauccaggaccucuauaaagcauguaguauaauucacuuucacucuggccccuuguaaaagggggcucaaaagcaaauuacugucauacauccacaucugcacacacacaaaacaaaggcacauauuauuuucaguuggaaagcaacuaacauuggauaaaucaauuacaguuacuaauguggaauuauucuuguucaggagaucucaugcaucuaagugucagccauaagccauuggauaucauuuauaauucaccugcaguacaaauauaggaacaggaaauugaaauguuuuucacagagaguugaaguaaagaguauggguaagaaugcagauuccagggcuccaauccuguggcuaagaccugggcuucugcuaccuaauacaguguacaguugggcaagacuucaggcuucaauuuccucauccauaaacuaagcaugaauguugguuguuaggaugaaaaaccuuaagguaggucaaucacauagaccauguauagcaaaucacucaugcuguguaagugcuauugaucggaugccgucuucuuuguucuaauauauuaauagauucaaccugaagcaugcucauuuauucuguccacugaugugaaugaguuguuuuucacaagaaagcaagcagcuaguuaagaugcaagauaguauaucuagacuuaacuaacauaccugagccaauucuuucagacuuuuuuuuuuugcuuuagcagagaaaauuccuuccugcauguuuuuggaaaagauauuaaaaccagcauguuaguaauuuaucaaaaauguccuuuggccaaaagaauaacagguaacaccugaaacuggugcaaaguaauugaaagcaaauuuuucuaaauuaccauuuucuguggucuucaggcucccaccacuaucuguuaacaauauggcuacuuuaauuauacaacagacuuuguauaaaccuaacaaaucuuuguucucuauuacuuaguauugcucagguuucuuaaaagaguuccuauaauccuugaaggaaaaucaguccaucagucuaaauggccaauagugugauuccccuggacaguauuaguauaauuagaaugcugacauucuaugaccuaauauuggaaugcuuaauucauucugaaaugagcacugauuaguaguuacguggauugagccauucuuccaauaccucucacuguuuuaaugaccuaagacuaauaggugaaguguguuacuuugguuccugccucaacuuaaugacuucaucuauguuuacuugacacccugugguucugguagguaauuguguuaaaagccaaagaaccaaucacuuuuggccuugaagccacugucacaggaugaauuuauuuauuuauuuuuguaaugaccaacagauguuguuucggcacucacugcuguuuuguucucuuucuuugagagauaaagaaucuauucacucuguuaguggaacaacuuggguuuauccagauuaagaaguagacauagagugaguuuuaaaggcaugguuggacuauguauaaaucuaccaaacccuugugcuguauuacuaaguacaucgcaaguuucuugagaguuucaaaucacuuucccucauagugcucacugcaguguuacgggggaacuucuuuuugcuucccaagaagacagaucuagagacuuugaggucuguugccucugacaauccacucagugcacaaguccccaugucaacauuaucuagguuaugauauaguuuguguggcauuauggcgaauucauugucuccugaagcaaauaccuuaagaaaguucugucccaaaaguccuuuccaagguuggacugacaugugacuuugucagaaagcaauguugcauagugaaaugcccacgagacacagacaaaauaauuaguauccggggcuacaugagagagauuggccuuucuuuccacaugagaggggauacugauggccauuucaggaguucauagauaaaacaccaaagauggaaucuuauguucaccagcaugguugugaucuacagugucuucucccuuugugcuaauucugugaauugaaucaucauagagcuguaucguuucuaguucagugucuuccccguuacucugaaacucuucuguaaguaauucgauaaguuacuucaacaaaggugagaccacaauguaaaaugaaucagggaugucaaccucccugacauccuaagccauauauccuaagucaaaggaauuggcuucuguauccucccuguuggggagagucauucuacacaguugaucuuaguaaagggaauauguuuuccaagauauccaacguuuuguuucuggaauuuugauuuagcucuuguguguuuugcauguaauaucucauaacaaaugccaucaggauaagcuguguuuugguuucugaugcugccaaaaucuuuugaacuuuuaauccugauuuuucauagauguauccuuuucuuacuacuuuuguuuuuagcaguuauggguagcaaauguuuucuagauauauguuaucagauuugaguaagauucaucuuuaguuuaucuauaggugauuugacaaaaaucuaaugacaacaaaauaaacacagcuuggagauccauauugcuaucuuggaaaguuuuagaaauccuuuuaagcuuucuuaccagucaaaguauagacuuuaaagaaauauaacauacagaaauucauacaauuuucacuccacagugaagaccaagauauauuuuauauguaccagauucauauauguaaauguuagauguugauauucaucuguacuagagagucacagaguaaauggugcuuauguauucucagugaagaauuaugaaaauuuagguguguuuuuaaauuaagugaucuaauuugguuuaacuuuucacauuguuaccuaggcuuugaauuacuuuuaccaugauccccuccucauuccucaagggaacugcugucagagcucuaaagaauguuccuuauaauucugaacuuaaccuaugaauuggugauaagaggcuuguaaaacucauauaugaggucugcauaguguucauguuugagauuuauuuugcccuaaagauuucuaaguaguaucaacacauguccuacccugcaguguucguauggccaugauguaggccaggagauuuagaagguuuaacuaaacauuuagauuaaacuugguacacauucuacagcaugacucgucagugugacgagcaguuauuuacccugaauucccauccuuucucuaaguaguugauagaauuauccuuuucggagccaccucuaucauucaguuguuaaaacgcucucuccaaagggugagauagcuagaugacaaugaagcuccucuaguuggggauucuucuugauuucacaagauagcuugcuuguuguugaugcuguguuuuacugccaaugauuaucugucgagcuagacuuuuugcuuuugacacguaugucuuacuuuacauugaaaagauaauagauggcuaguuuguaaguucccuuauuguuaagaaauaguaucaucuauagccagacucuauaaggauagauaagacugggccauuuuugccccuguaucguuuaccuuucagucaguaagauaauugcagauaacagaugauuaugauaugaaguaauaaaugcuguaauaggacacuguacagagugccaugaagcacaguugaggugaaaauaaguuucuugguacauuauguaacuuuguucccagucaaugcuacaaacuacagaaauaaaucugaagauguguguaggaagagagaaauaugugaaaaacagucaagucucucagaaaagauuucaguaaaaauaugcacucuuuaggauugggguaauucaacaacuaaggaagacuuguaaauugguguguguuauuuuucugcauaaacuugguauggaauaucucaauuuuaaauucagagauacagauggcaauguauucauaaaugaaauguaaucaaggucaacaccuuuuaaaaauaucccaaugugacgguagccagugauuuguuguccagaacucaucugccacgugcuaaaccaugauaccaaauugaugagugaagugagagccggguauugcugcuguugaucuggucaucuaaucauaaaauccauugagaaaaagaagucacuuguuucuguugaugcauugcugagcaguauguaucuagacauguagaaauaagccauguuauauacugaaguaucuucagaguaaaaaaaaaaaaaaaaaaggguuacgugucugguuuugugaaaucuaaaagcacuucucuguaguaauugccauccuguuuucuaugccuuuaagggccaaaccugaaaagauaggcaggucuagguuccuaacuacaauccauuucaccuaugguuucaaaaguagaggaacuaaaauuuaaaacguggagcauaugccaugccagaccauugcuaaacuggggacagaacugucugugcgaggauuccuugguacagugaugcugcugcuauguggcugacauuagcgccaaguugaauaucaauauaaacaaugccacagauuaggcguaccccaaaaugucuggggugguuuuuguuuuguggagcuguaaaucuggcauuccuuuucuccacaugauucuuuuaugaaaaauuaugccaggggcaacuagagaauucuuuuuuucaaauauguuuuuaaaucccaaggccaguauaggcuggcacacagcugacugguaagagacagagcugcugucucaagccaccccccuucucuuucuugucauccugacugcaucccaaaugugccaucauuccuggugguaagucugggaaugcccaggccccuguugccauccaauugaggaaaaaaaaugaauugaaaggaaaucuuugguucuaucuaaggaaauuauagaggagagcaggaaaccgccagagaacccagcagcccccgagcugcacccuccacagugggcuuuuguacagaaugcaaccagcugggcucuguguggucgaggauagacauccacuugguugucuaaaacucuucaguuaugugugaucauuagguauuucacuauauauugcacaugccugaaacucuauuauuuucucacgugagagaaaagaauauguaguucauuacauuuucaaauguauguaacccaacaggucgauaaacccaccucacccagaaugucuuaugaauuaaagauuaaacacaacuaauguaucuagcaaacuacaguagucuaguauggcuacaaauuuaugcuuuucgucuuuuuuguuugaacaaugaaaaucauauugcauacagugcauugaaaugggccagauauuuaaaaaagagucuccuuaauuaacuagaguucagcaauuauauauagugaauauaguucauuuuguguuuuucugcauaguaguuaggucuuuucauggaagcaagagaucauauagauuacaccuguaugauguguauaaucuagaaguuaucacauguauguacauauauauguauauaagcauaauauauauaauauagcaaagucaaugcaugcuauuaauuauuaaauuuuauuaaaauuuugguuuaaaaaguuaaaaauauaauaguuguaauuuaaugcauuuugaauuuauauuuaugauauggcuggagauuuuaacauugucuuauuuuuucuuucuuucuuuuuuucuucccgucuccucucaacaguccugguaccugggcuagcuugguuccuuuucaagugucaaauaggacacccaucuuaccggcaaauguccaaaauuaugguuugaacauaauuggagagccuuuccuucaagcggagacaagcaacugaggggaaagaaccacaaccauaguauaagaaaauuaggggaaaaacacccaacaaaggaaaagaggaagacuggacaacagggagaaaggagagaaacugaagaaagaagacgguagaccagcauugcagcacuuacagucacuaauucccuuaagguugagacuauagugacaggaaagggucaaugacaucucacugaugcuagacugcagccccugcaccguagccuuuguuacaugaaguccgcugggaaauagauguucugucucuaugacaauauauuuuaacugacuuucuagaugccuuaauauuugcaugauaagcuaguuuucuugguuaguauucuuguuguuuacgcauggagucacuauuccugguuaucucaacaacgaaggcuaggaggcggcgucagaggugcuggggacagagccaugagccagccauuuuauaagcacucugauuucuaaaaguuaaaauuauauauauauauauauauauauauaaaagaaucucuguagccuuuaguuauccguacagauuuauuaaauuuuggcccuuaacccagccuuuuccaguguguaacccaguuugaaaucuuaaaaaggaaaaaaaaaaaaaaagagaaaaaagaaaaauagggaaaaaaaaaacaguuugaacucaaaggcucuauggaagaaaugccucuauguggguaaaggguuaccucugcaugcaacaguaaaaaguaauauaauguuuuccccacaaaagaaacacuuaacagaggcaagugcaauuuauaaauuuauaucuaaaggggaaucaugauuauaaguccuucagcccuuggacucuaaauugaggggauuaaaaagaauuuaaaauaauuuugagcgaauuuauuuuccccucaguuuuugagggcauuuaaaauaaggcauuaaaucaagacaaaucaugugcuugaacagaaaaaaaauaaaaaauaaaaaaaauauugaaaacacagcacuuagguuggcuuagcugcagccuccucagaggucagauuauuuauuuaaaauuacugguugcaucaagaacccauaggguguacaaacgguucuauacaaucugcaucguagagacaaagaggcagggaaauccaugucacaaggguaaagcuccccguguacaggcugggaaugccagguaggcuaggaaaacccgcucgcucuucagagaagugccaucagggugcugggaacaugcauggugcuuucggacauuagccuuguucaacacauuucucguauugacagaucuauagugugcaugggcagacacaugcugccucugugucucuuaaaauuuuaauuaaaaguacucuuuccaguaauccuaauuugcacgaagauauaauguccacauuacgugccuugccuugaaaucuaaaaaaaaaaaacaaaagacaaaaaaaaaccacaaaagugacaucacuacacuuguuuugcugcauuuauuaucguuuuaaaucuuuaccauuuuuaugacaaaauauuuuguacuccagacgaagaaaaaugugugacaucauggauuuuuuagacaguuacaccuuuaucucacauuuauaaagcauaucauggcuguguauaguugccgcuuaaaaauuguaaucgaccagcaauauuuucaguauuuuugguguuuuuucuauuaaccuuucauguuuuucaucuuccaauuaauauuugggggggagggguuucaaauuuauacgaauuaugcaauaccaaguuuugccuauguagguagugcuuuuagcuguauugguuauuauagguaaguacacagauuuaaaaaagaaauaauguaugcuuuuuuuguuuguuuguuuauuuguuuguuuguuuuaauugaccaaaguggguacugcuauuuuugcagugugaugagguccuuuuguguacugagagauggacaggggauuuuuuuuaauauacauauauaaauauauauauauucaggggugggugggaggauuuuuaacccuuuacaguguagcagugaagcacugcacccugagaugggccugggcugcaaagcaacuguucugccuacugugacaaacuucaacuuaaacagguuucccucccuccaccccuccccguacuuucccaccuggagugcaagcugaacuccuuucugguuuccaagcuaagaaaccaggaagaaaaagcaagcacagcaaaagccuccuagaggccaacuuagaggaacugcccugucuuauuuuaguuguuauugauaguuuuuuguuucuuuuuuuuuuuuuuuccugaaaguuccugaaaccacaguggaaagugagccugucucauauuuggcaaagacauuucuugaagugcccacauagcagauguuggcuguuucacacuuuugaguuuaacacaggaauaagcuuucuucuaccaaacacauucccccaucuggagggagagcuccccuagucccuccccgcccucugucauuuuguuaaugacaggauaggcugcuccugugacuuacuacuucaaaaugaaugguguugcaccuaggaucuucuucuuugacauccagaagguugacuagagagaggguugcucuucuuggauguauuuggacugauagaguaaaaucaaaguucaguuuuuaaggaacaagaauaaaucaauccucuuauuuuaccugcccuuguaaacuggaaaguggagcagagggaaauauagaauuuuaagcaaccaauuuuucuguggaugaauuaaguguguuugauaaugaugguggggguugauuugaacgggugguacuucaaguauauauuugaguuaauuuccccugaggacuacaggugaauagagaccaauuuuauuuugucuuuuccccaucccccaccugguccuauugaguguauccauugcuccaaggagaucuuuaggaauuagugacauacgcagucggcuguaaagaagcucucuugaccccacccccagccccaccccaggcccugcccuaguaaauaaacugucaaguguaugcauagcagaucauuuaauagugaguucaugagaacgaugcucagaagcccgggaauuaaaucugacuaguccauucaugaccacaugcugguuagcacagugggauucuaggaugcagguucuaagaaaggccagccuugucuguuacuugcuuugcagauaacacauccucucagccaagcucauagugucuuucugaccuauuugcugaagagugcaacccuacaggacacaguauucuuuccaggcaguccccucuccuugucacccgugaaugaacaauuguugcuaaaguacauggcacacugugggcaucccugccugccucuuggguacagaggccuagggcaacuguuccuuuuuuuuuuuuuuuuuuaaccuaguucaauguuucuucuuuucuuugagauaaacuuauuaaaaaagcacuacuauagaaaaucucgaauccacguuuagccuucuauuuuuuuuuaaaaccaggaaguauauucugacgaagggccccacuuuugcaggucuugcacgccccuuccuuacccagacugcagagcuucaggauggugaaggucacccaagggcaucuguuaggagguggugucucccaccaccagcucauggcacuguccaaccuuuguuguauugcuuugcagcccaccacucacagugccucuaaaguguguguuucccgaagugacgugagcagucgagacuugccuaaggggggaaaaaaaaccugagaggcagugaaggagacuguacauaaagacauggcaaaaccuuaaguauagcaauauaguuaucggguaauuuucgggugggcagcuccauuauaaaguaugugaaugagucugugaagcugcgaggagagagaagagcuuggccuucuuaaugaaccgccuaccuuguagacaguaauuuguacacuguauaguuuuguuaagaauuuuuuuuuaaauuaaaauucccauguuuguaaagcuaacuuuuuaacaauuauaauggaacuauauguuguuuccauuuuuaaaguaaacaagaauauuccuuguuuagagacuggacucgaguuaaaacucuccaggcucuuaaguuauguauuaaaaaaaaaaaaucuguccauguuaggagauauuucacagguucuugugcuugaaaagcauaggacgcuaauccuuaaaaaaaaguguaaauggagaaaaguuauauuuuaugaagguuauuuuguuguauuuaguauuggaagaguugguuuucagagcauuucagaauguuggaagcaccgcuguccuuuuguuaguauauaaggccuuuuagcaaagguuuucuccuuuuuuuuccuuuuuauuuugugauuauuccaugaugguauuuaaggauaaguuucacagagcauucaggauaggcagaaaaaauaauagugcgaugucucacauaacguguccucagggagcagaauccggauuugugacuuguagcuucaaaaggacucaagggcagagacugcacgggaacaccuugagcagcgaagcagggcauguucucuaccuagacgcagauucuauguaccgugugaaacgaugaaggcugcagaaaguuacccccuaucagugaacaguauuccuucuccaugaaacaacgcuacagucuugcuggcagauaggccccaagcauggcauucaauaucgcuuacauguuccugucaaggucuuuuguucacauuaaccagcugcaugcuuccuggacuuuaaaaauugggguuucuauauuuaaaaaacaaaacauaugugcaggcuauucaaguucaauaguaaaaacucaaaauugaauguucuacuccaugcugaaggagcugaaaacugccuucuucauguuuugcacuuucuaguaguugcccugucuuuucuaauuccuggaaauuguguggguggaguggaucccugcacuggggggaauaacauggaccacugauuuugcccuuugacccugcacaaugaccuuugcaucagccaaacucauugccaugacaacucuuuguacugugucgugccacagaucuguuggucacauuguuaauaguaaaggggacaaguuggagacggucaauuuuuacauuuuuuuuuguugcaauuuuucuucaaugguuguaaguaguuuuguuuuuuuuuuuuaaugauaaaaggguucaguaguuaauacucuuuagaaauaucuguguguugcaauucaaauguauguugagauugugaaagcgcuucaguggcacuagccuacgggacccuagauuaagccuuugauaacuuuuauugcaugauacaguaccaguaacaaaagguggccuaaacaugaaaagcaguguaugcuagugucacucaagccagucuuguauuacuguauuuuugacagaaugguuuugaaaacugugcuacagggacugauguggcaaauauaucucuuuaugcagaaggaagucuuuuuuuuuuuaagaaaaaaaaaagaaguauggcuuauuaugcauucuucaucgagggcauugaaguugcauggacugauaaaaguugaugcaaaaugagaaagaaacaaaaagacaaaaacaaacaaaaaaaaaacaaaaaacaaaaaaaccagcaaaauguuuaccaaaaaacucaaacaaaugagcagugccuguccaauuucacagucucuguugaguucaguuguaaauauguuucaaaugacauuuucuugggaaaaaaaaaucucuacaacguuguggaaugugaggggcaacugucucccaggcauaggcgucucaaagcugcgucagcuggcgucgucaucgggcgguucauuugugcuucugucacugagaacuuugagcacccugggacgagguacccccaccucaaugauauuucucugagaacaacuuuuguaggacuguguguuucuuuagauacauuuaguacaacuguaggugacgaguagucagucauugcuugcuagccacacaccaggguugauccauuuuaaaacuuuuggcauauuuguccuccugggccauaaauacagaaccuuguguuuuaauuagauuuuuggaaaaaaaauaaaacgaguaaaaggaggcacaugcauaaucuccauguaacaagccuuuagcagugggauguauuacaggacaguuacuuacuuaauuucuggaguucgggccucugggauaggccccagacugggccggaauguuagugaagguuuuauugugcccgguuggaggauaauguucuuuguguacuuuuugugggucgcaaaugaacucgauugccacaaguuuuaaacugguguaaaucaagcuugacuuaaugugauuguuacuguuauauccagccuauacugcuagcagcugcucauacugcagucaauuacuggaagcggauauauuuccuaugcaaaaacuguuuaaaacaauaaaaugagcuaugcuacagacucuggccucguguuuuauuuuucucaaugucuugaugcucuuucagcaugaaugcugggucaguaggauuuugaaaguugauccuggcccuuacauuuggacguugggugacaccagcuuacuuuccagcagcugggaggguuaauauuucaguucagugcugaacugcuuaucuguguaguuccuccucccacgauuuuuucagcagugauaaugaaaauacaagugcagguacagaauuucagacccagaacacccuuugagcugcgacuugaagacagcgugugccacagagaccagacuguggucuguuggacagaaagccacaaggacccacacacacacacacuguaaagggaagggaaacccuugccccucccugugacuguggguuuagugguuauaugaacacuguagaauuuuguucugcaaauaucugcgaaaggguaucgucuuagguuucaaagagagcgcagaacuuuagggcaagcagagcugauauucucuuucugagccaagggccagguuagaauccacucucacugaaugcaucguccaagaauggagucagcuggaguucaauaauagcuuauugaaaaggaaugaguuuaaaugguuccccgaucuguuugagugaugugcauaaauaaaauuaaaagguaaugcgagcuucu

SEQ ID NO: 1955 - RNA, 1265 nt, Mus musculus
cuccauggccucugcaucagcuccugcuucuacauuccugccuugaguacuagccuuggcuucccuggaugauggacuacacacuauaagcagaaauaaacuuuuucuuccccaaguuguuuuugguugcaaucuuuuucacagugauagaaaccccacaacagacauuauucauaaagauuuuuuuguguguguuuuuguucucauuccaaaugaagauacuugagaguugguguuuauaguaauaacuuuggggcgucaaaugccacauuguaccugcaugucuauguuguaaagacuguugaucugaguccaaagucacagacaucauagagcccugcuuccacuaguuacuggaaaaaaaaauggauauuaaagccauuuccccaugucaauuaagugguucccugaguaagccaagacauucacugauguacacuuaaucaccuagcuccaagcccuaucuugaaauccagcaucaucuccugaaguacacucagcguccugaaguguguguagagccacaguccgaggaggaaggaaagugaugggauacaauuucaacuuaaaacgugcuuguuuguuuguuuguuuguuucaugcccaaaaugaggccgguagucaauuucgcuuuucuuucuuuuguuaaaauuucagacuuuacagcuugaaauuaaagguucuauuuugagccuugugauuaggucugguaagaugccuuagcgagcagagguggcgugugcaggccugauaacauguguucaaucaacacacacagacacagaaggagacagagacagacagacagacagaaagagacuuguauuugaaaauaguaagacuuuuuuuccucccuucucccuuuuuuauuuuuuucagauauagaacccaggguagccuccaauccaagcucacagcacuccucaugccuuacuuuugucuaaaauuuuaugggcuuauucuugccuuugaaaacuuuugggggaaucaucuaauagcaaucuaagaaauaugaugggauaggauuugacaagcucuacuugaaagcaucccucuuggauauccaagacuacuuucaccauguuggucccucgccucuucuaugauguuaacgcuugagaggaggaacacugaugucaguuguguugaccuugaagcacguguagaaagcaacugucuuccagcauguucuggcuugcuuuucugugacuuuaauaaacacugugacaaaaaggaaaacaaauaaaaaagaaaaaaacuuggua

SEQ ID NO: 1956 - RNA, 757 nt, Mus musculus
gugagccauccugcuggcucuuguugcgauucuaaauccacucucauuagaagauauuuuggccugaaagaauuugauauucacugggcuuggugguauacaucuuuagucccagcacuugggaaguagaggcagguggaucucggaguucaaggacagccugggcuacacaguaaaauuuucuuuuggaaaaaaaaaacaaaaaaaaaaaacaaaaaaaaacaaaaaacaaaaaagaauuugauauuuauacaaagaucaaaagugaccaaguacccuaccaagcuaaguaccuguggagcauucuucagaaauggacauuaaaacuaagaguggcaaaacauuuaaauuuugacacaggaucuugucacauaaccuaggcuggccucacaugugcuauguagaccaggcuggccuugaucucaugaucccugccucaguguccugaggugguguuccacaggugcugccacauccagcccaaagcucuuacacguucaucagcuuccucugaaacucgaaagugagggcacacuucagauuucaaggcacacccagcuacguuuaacuucuaaaacuagagauuggguuccugggugcuccagugcuucagugaagaguguaggaggcaggagacuggcaaacugucuggccuuugaaaaaccgugaguuaucgacuguucucaaccccaacuaccugacaccagguaccucauauugugacagcacagucauuuuaaaugcaaacuuguuaaga

SEQ ID NO: 1957 - RNA, 1334 nt, Mus musculus
ugcuuaguauuuuaaacuuuuaauaucauuagugaguucuaguucauuauuaaaauacaaacacugcuucuuuaaaucaauaccauggcccauugguuugaaaaacauuuggauaugaaaagucuucucagaaacugaauucaauuucugcccagacauacuuccaauuccuguguuuacaggccuuccaugauuagaaucucaccuuuugaaggaauuuccuauuaucuggaagugauuauuuuaaggacuguggucuuaggcuaugcacucuuguagaacaucccacuggggucuucucugggcuacuccaaguccagaggagucaguccguccuuggcagaaggacagacgggaaccaucugcgaaccauccggcuuccuguuuaugacuguugagucuucuguugugaagacuuaucugcuaagacauguccuuaguuuuaaaauaaggugcuagaaugaaacucaagaguuuuuugggggggaagaguagugcuuaguguucaauugcucaauggguauauaaagaauugaccuuuuauaaaaauaaucagagcagguagcuggugugaauuuguccccgaggagaccucagcccugaaggcaucauguaccacgagggcuacagcucugcaaggagucucaugugaacgagcaaagucagaaaggacaguuacuugcuuuuagagucuguucucuggugucuucccaaucuacauuuuaaggggagcuaacguuaaaaugggagcgacacuaggauguaaagucaucuuuugaagaggggcagggcacagaugcuccugccaaucccgggaggcgaggcugcuggagcuucaaacaggcuggaggagaagcuuccgcucuuuucugggaaucagagggggaauugcucuacaggcuuacuucccucccuuucucccucccccucaucccucccuuucucccuccccccucccucccuuccuucuuccuucccucccuuccuucuacuccucucaauuccuuuccugguacagaugugaggggcugggaguaagaaccggaaguaagccuaacagaucucuuccuuacuuucucucgccggugcuguccuccuaguccaucagcccacucagaucucacuccuggacacuagaugagcucuuagguggaugagcucuaaggacuccaggaccugggagaacagcagguggcagugaucugugagaauccggaacagccaugggcccacagguuagaaugauugggaggagauuuuaagagccagcaaaaugaacuccaccuucaagcagucuuggucagccaaacagagcaagucaagaaaugccugug

SEQ ID NO: 1958 - RNA, 76296 nt, Mus musculus
cgguuaaaacccagcacuggaaaacaagcaacaaccaaaacaaccucucccccuccccccaggaacuauggacuuugcagcacaggaacucuggacaccugcuuacccucugagaaagaguggugcuccgauuuuccacuuggacugucuacagaguucuucagguuuguuguguggaagcuaaggagccacacuucucccuucugauuuacuccauugcuuugguugcaguugcugcagcugcagcugcugaggggcuggcuccaggaucucacguuccuguagcaagaguuuuacuccgaggguuuugguuuuguuuugucuuguccagagaaacuugggucucuaacuaagauaacuuacuuuccucaaauacuaagaacucuaagaacacacuuuuaaaauuacaguuacuuuuucauuagcguuuaaguuuaugauuaauaaccuucaacuaacuacuaagggcuaaaacuugcuucagauacucaguagcaaugucuauuucugggagacugauucaguggauuugggggacucccgggaaucugaauuuuccauacaaauauuuuaauauacaaaauaguugaaaaaugaaacguggccggaguaguuucaagcucuucacguuaguucaaaagcuuugacaguccaccacauuuuccuugucucucacuuuauauggauguguguauuuacaucugauauauauuuguauuuuguuggauaaugugaaaaguauauaucaggauacagcucuucuagauaaucacccaugcuauccugcagauccuaaccacauggaacucuagcccuauguccucuucuggccacguguacauacaugugcacacacacacauacacaagaauaaaaauaaaucuuuuuuaaaagagaagguaaauuucaaguauucugacauuucccuuuuaacacaguguaugcauauucuaagaauuauggguauuaucauaugcaaauauaauaauaucaccauuccuaagaauauuaauauuuucaaguuaucagccaguuaguugcauuaugagagacacccuaugcagucuagugcuuucuuuccagcacaauaccaugguagagcagaauaaagaagaauuagcaaggucuugucuauucuggguagacaucaggagcaggucagacaaaugucuccacuugccaaaauaugcauuccacugcacacacacaacccacgccgcgcuuggcugcucggccagcucucagaugcaccuccacucauccaccucaacaggaagaaaggggaaaggcuuuuccuugucccaagaaacaucaaagaagaucuaccugcccucauuuuuacaagugaguauacuauaggcaucugcaucauuagcuaggcauacuggcuuaagggaagaagcuugccaaaguguugcgaccggucaugugguuccuggugugaucgaagaguuaaauuguagucucuugggugcuuugggucagcuguaaggaggagagauuaugggagccauagugugcuguuuucauggugaaacugucuugacagaacagccccagcagcuaaugcacaugcuauaauuguaacacauuuuuaguagcuauagagcaccuacacaaggcuucguaaugacagccugguagcuccaguagcaauuaauaaacagcacauccaggaaagagucugagaaugcagacuuucacgaaucagacccgagaaggucccugaguucaggacuuuugaaaccugaggucauguucuacugucagccuacgugucuccgugcagccacaccccaaacucuuccuaagcagccaaagucagagaggugaaggagugaacuggauacuacuuguuaggaaaaugcuaaguagaaaugacuuuuuguaauucuguuauaguuuaaaaguuuccauuugcgugagagugcaaaaaaggaagacuguuagaaguacagugugugcugaauauugugugcaucugugaguuuuguggauggcaccauacagagaagcauaggccacuaauaagcccaagaaacaacuucaggguagccagcuagucuuucacuguuguuucuacugaauuccuagaucucucuuugcugcaggcuuuucucccucgugacuucauccugcauuucuuagagaauuuucucaagcauauuugcuauuccacucaugucaaccacucugugugugcaugugugugugagugcacgcauguguacauguguguccguuuagguaugcaugugugcuugucugcauacacacacacacacacacacacacacacacuuaugugggcuuauguguguuuagacaaguaugagcauuccuucuuggcacuguggaguguugaagggggacaugccauugaacuaaauuuuccagcuguuagaugugggugucauauauauuuggaaaaucucuuaaauuuauuucuucaguguuugcagcgguaagacacaacagaaaguacuuuuuaaaaaauuucucugguaccuuaauuuuccuuaaaggacucaauggauuuauccugucguugacagaccuccgcugagaggugugaacugucuccuuagcagccuugucccuuccagggcugaguccuuuuuuccacccccuuugagaacacagcacuuuuguucuggugcccuaacagagaagcugggagguaugagaauguaaaacucagcugucuuuuucucugcuuaaacauccccacccccaccaucccccugccucuuguuugucuuuugauuuugcaaaucgaauaacuaaacauucuccuggccaagcuaaccuucccgcugggucuguagaaucuacuggcgucucugcccuagcuuuauguaaauucccaauucuaaauccagccgucucuauuccaaaacacuaauaaaaaaacaauuccauuguuuauuagcuucuugcagcaauaaucaaugccuccauuuccaaauaaucuaccuacucuuaaaucaucuaguuauuaaaaugcauccuuaguucuccaggaaaauucuaguuaccaaauccaauggucuuuccucaguuaccacgaucaucguuuuguauguuuuccuauuuuugauuauggcuucuccuaaccccauuccuucucucauucaagaaaaaccucuugaaugucuaaaacccuccaguaucugcaguaaaucaugauuagacucagacacaucuccaagugucugaucacuguucggacuuuuauuuugaaugccccuccccuauuuuccaucaacucagcuaacccacugaacucccaggauggaucugacauggagaagaauuaauggaaagacaaacacgucuaacacagggucuaugccuucauggagcugucuugucaggaaaauuuaccagcaaaugguucacucgguguucaaaugggaacgucaaaucgcuuaaagucuagugggcacuguagcugugcaggcucaggaaagucguccuaagaauacuuuaaguacuaaaaucaucuuggauaaaacuggucucuggaccagccauaaaacuccuauacagggugacccugcaucuggacauuuaagugcuaucucuuugcuucuguaaacaacacuugcuuguugagaaguucagagcugucuuucuauguacguuauaauuguggguuuugcccuuaaaacuuaaaugaacagggucagggcugcuucccacuaaucugcuugggacaguccugacagaaguaaauaaagauuccauucaacuuauuucaggucucuugggaguucucuccggguacccuguaacaaaaggaagaugucuaauguagacagcgguucuaaaggaauucacuugcagacuucuccagcaugaguacggaguuagcagcugaggugccaggggaagcugugguuugaggucacuuuagugcuguuuagucauauauuggaagggaaggcagaaggaacagcugagacgaggugaaagaguaguaaacucagugcuccaagguaugcuaaucauaaaacagauagcgacauuccuuccuccacccacccgcuuccuggguucaaagaguguucauucaaagaaagucauccugacucacccugaccauugcuggaacccacuaugcaaaggugcuauugcuaggggcucuuagauuguuaggggcucuuagaaacugucuugauagauaaccugacacuugugacuuuguacuuccuugugacucuuaucugguauuuuugguauuuuccaacaaugcccuucccaccuccuuggguugugguuccuuccuuuaaauacucccuaauccagcuacucggggcgccacgguccucuaccccuacgugguguaugaccgugggccugagagcgcucuugaauaaaaauccucuugcaauuuggagcaagaccguuucuugugggugauuuuggggugucgccucuccugagucagaacgugggggaguccucacguugugggucuuucagaggaaccggaaugaagcugaaaaggccagauuauaaaaucauuacauacugugguagaaagucucauuucaugguaaagacuugaagcaaggaauaaugagagcagaugugcuuuuguagaagaggcuguaaaggacauuguggagaauggcuggguagggagguacgucuagaagucagaaggguaccacuguaguuuagagcaaaaacuaaugacuuugugaacuugggugcuaccgcagggauaagaagacucaaaugguuucaagauauauuacagaaauauauaaauaaagguuugggaacuggguuuggaugagucagggagaggcaguccuaguuucccagucuuggacaaacuuucuggaauuucgguacugggugacauuguccuggagaaaugacaauauccugaagagaccguuguagcucucuuugcuuaucauuugacuuuugagacaaugggcccuaaaaaaaguggaauuuucugaugggccuuaugaccaggggaaggaggcuggagucggguggcagccagaggagaaagaaacgauuugacaggguucugauaacuugccagaccaccuugcaggagagacugaaggauauaaugauggguuggucagugauggggaagaccacaccuugaugaggacucuuaguuauguacaccccgugcccucucuuuaaaguuaacccuuguaucaggacccugagauggauucugauucgcggggccucuuuguucuuuuuugcaaugugguccacauugaucaagucuccuuccucugcuuucugucacuacuuguuucuuuaauuuuggcuuuaauuuuaauuuugacccauugaggucacggggcugaaucuaacuuagcuagggggccagggcugaugcucccaccuuaaccacucugauaacaugggaagaacagguuuaaggcgguggugagauacuaauguuugacaaugcugagcuugaggaaggugagcaacacucuuuuaugacuuacaaaucuaggacuuucuucuuguuggcuuguaaggcucuugauuugaaaauuccaaugagguagaaguuuggggacaacaaaaacaaguggggcuuucuaugcucuuauucuuuaugcaaacaauguuaaaaugccacauacuuguugcuauacuguccuuagccuucuccuggaaaugaaauuauuaacaguaauuaucuuccuucuucaccagauacaucgauucauucauaagucccaagugauucaugauggcuacuaaguuguguuccuuuuacaugagaggaaacugagguacuggguaauugaguaauaucuacuuaguagugccagaguugguccaaagccagacaucuuuccuucuucauuaaacucucuuugaaauuaagaguuuccaaucaucuaugaggcaaggguccauagauacugauguacugggcccgauagacccugaauccauuauucaaauuauaauuuuauugccauccagcccugcuuauauaugaauuaucuaaggcuacuuuacagugaaaugcuaaagaugaauaauugcaacaaaaccuauuaggcuuaggauuaaaaacuauuucuauuucuuuacagaaugcuuugcugagcccauccugaggguucuaguuacuccaauugacauuuuuccucuguacguguggugguagggaaggauagacauacuuuuggccuuacagcugaacaucuguccaaagcacacuggaaacugauuuauuccuccugccucgauccucuucuucugagucauuuacugucuaaguuuccugcuacggaaaugggcaaaggugaaaacguucaccaacaccuuugucuuacuuaccagaagcaaaaugugagaaaugucuuuaccuaagcuaucaacggagagaaacauauuuaaaaggaaaagaaauuuaaaauguacagagcauucguaagucaagagguuacugaguuauuuuguuuuuguuuuguacggacauuuaauuuguuaucaaaucaaaugauuuugcaucuuggugagugcaaagcccaaaccagcaucaccaagagaugaaagcuagugaguuccuauauauuaauguggggaaacacucuugaguccaggcacuuugcugagcacgcucaguuuaaaaucauaguuuuggaagggaagucauauuucugggcauguucaguucaaagccaucaagcacauguucaaagguuaagaucgugggcaacaauacacccacaugccccugcaggucugccuuucccguggggauauccagguaccaaugugcacugggcagaccuggaaggaaugaagcuuaguugggugggcaguuagacaguaucucagcaugagauuggggggaaauggccuucuccagagacaauuuucaaugaacaguucuccuuaugggggcugggggaggugcuauauaaaccuugggaaguggguaggguguuuuugggugaguguccauuauuggcuggggcagaggugaugaggaaaguaugaagaggaauuccaggugcuuccuagacauguccuuauaaggagagaggaaguuuaaacuguaaccugaccaccaggcuacgugacuaccucaagauaacagagguggggcaucaaaaggugacaugcaggcccagaacagagaggaagcaguccuacugcuggucucagggagagauuggggggggggguuuggguacaucuugaccucacucucacuccugaacaucuccuucagucgccuggcuuuccagccccacaucuaggcaugcuuaguuggccucauaaagaugacauaaacuuaaagcaggaagacauacagggaugcuucugagcaugcuccauuuucuucuaaaaaguuuucaacaaaacagaagaaauagacacuuuaaaguuaccuguuccaagaaccauuaaauuuuagucuuuucuaucaaacacuauaaaugucuguguauggcaaauucaaaucuuuucuuuuuuuaaaucucucuagccuuuuaagauuuucuuacaagucuuuuuauucaacccaccuuguaaaaaccuuuauguagaaguuuuaaucccuccuuuccagugacacuuuuauuuagacaaaggccuugcuacauucugggaacguaagugucuaaaguggcuuacucccugucugcuuuauuucaguuccuuuaagcuagccaguugugaaagacugagauccaaccccagucaauggggaaaagacacaaucgucauuuguguuaaagccaagacuacuuccugcccuggcgagcucacucuuuuccuuuugugagaacuccauuuuugaucacaaguaaaauguagucuugcagaaauccuuccguuggaguggugaucucucucuuuggggcccauaacuugucuuucacacugcuucacucagccacuaauaggcuaacaggaggaggaaaugagguagggcagcuuggccugccuuggugagaacacugguauccucccuugauuuucauaacugcucccugagacugaaugcgugauaauaagcaaguguguauggggugggggaaggcuuugcuuuuaguuuauggaucugaagcucaacagaaagcagggcuggauagugaauuguaaauaaucaucgcacaggggauaauugaaucauuucuuccucucucuggucuuuaauauacuuuagcugcuuucccaagauuaagccuucuuccuuccgcuuuuacuccauucucuuuccuggagacccagucuacucaucaucuuggucauccuugcugauagagcucugcagaaugcgcacaacagccuucccccaaccaauccuagggcaucaccuagcugguguugugacacuucuccauuuccuuaaugugaaaccucauucaacuuccaucuuucaugguucucaccaucaaaauuauccuuuaaagauuuuaauuuuaauuuauuuacuuauuugaggcugacccccauuaccugguguaugcuagacaaaugcuucacuacucugcagugucuuguacauauucuuugcauuguuuuucuuccuucacuuuucuuuucuuuuuuaacuaaguauuuucuucauuuacauuuccaaugcuaucccaaaagucccccagacccuccccccauuucccucccccccacucccacuucuuggcccugguguucccccauacuggggcauguaaagcuugcaagaccaaggggccucucuuuccacugauggccgacuaggccaucuucugauacauaugcagcuagagacacgagcuccgggaguacugguuaguuuauauuguuguuccaccuauaggguugcagaccccuuuagcuccuuggguacuuucucuaguucuuccauugggggcccuguguuccauccaauagcugacugugagcauccacuucuguguuugccaggccccggcauagccucacaagagacagcuauaucaggguccuuucagcaaaaucuugcugguguaugcaauggugucagcguuuggaggcugauuaugggauggaucccuggguauagcagucucuagaugguccauccuuucgucucagcuccaaacuuugucucuguaacuccuuccuuggguguuuuguucccaauucuaagaaggggcaaaguguccacacuuuggucuucguucuucuugaguuucauguguuucgcaaauuguuucuuggguaugcuaaguuucugggcuaguauccacuuuaaguggguacaauuugcauuuuuuuaccacagcagauuauguuuaccaucaucuuucuaggcucauuuaucuucuuacucuuuucauauuggcucagauaugauuacuuaaacuauauuuaaguaggcuguauuaauaaagcauuuuccaggaagauaugcuagcacauaacaauaaucccaacacuuggaugguagaaagaggaggaucaagaguuuaaggccagccugggcuacauggccaaagcuuauuuacaacaaagcaagggcucugauguaacucaguggcaaugcucuuucuuagcaugugcaaagcccugaguucagucaccaguacccacccagacaaguugauuuucucuuugccuucuacuuugauccacauuucuucaaaugacgagaagcaggaugaccugcucaaaguaucgguuuucccagccuuggaagcagcucaguauguacugcugagccucauuccugggaguggcugcuacuuuauugugccuuugacacagaaaggaaacugugaacaugaagaacacugacuuugagcugugaaaaugaaaagauuucaucauucaacggucuguuaggaccuaaucagccgacgaggaauagaaaguguccccguagccugacacaaucagauuugcugucucccagggaggggagggccacaggcuuguaaauucugcucaggaauuuguaguugagucugagggaaccuggaucaguuugggauuaaucgaauuuggagguaggacuaggaggagggaauuaacuagguaucaagaggugaccgagggaaagaugguugugcaauugaguaucagaaauacugcaugaagccgggcgugguggcgcacaccauuaaucccagcacucgggaggcagaggcaggugaaucucugaguucgaggccagccuggucuacaaagugaguuccaggauagccagggcuauacagagaaacccugucuugaaaaaccaaaaaaaaaaaaaaaaccaaaaaaaaaaauacugcauuaaaaucaccaugguccaaggcuucacugguaacagucaguuaccaucagagggguucauuuaugguauuaacuucgcuuuuugugcuguuugucugucagucagucugucuguuuucccagcacugugcucuuuacuuuuuauuuuagucuaacuuaauuuuuauuuuuaaaucucaaacagauuuuaacuuguucagugucuuggauuuaaaauucguacgaacaccuaccagaauauauuucccuacugacauuuaucaaaauguuaucaaucucaaguuaaucuuuauugaacuuggucaaaacauccagagcaagcaagaaacaaaaccaguuucaaucuagaauuuuaaaaucuuuccaaacauguugccccucugcuuuuugacaaugacacucccaauaauagacuuuuccagcuuagagcagguaaucgccacugucuaaaagcugauggcucuucucuagacguaguuuugguuuuguaggucaucauaguuugauuuugguucauuccacucucuucucuacuuuucuaccucauacauacuugacccacacagacccuuuauguuuucauuucuucaugucuugacccagucacaucuccccauuucccuccucuggaaacuugaaccuggaguccugcuuucuuuugcuucucuauuaggcaacugugauccacccuccugggacuacuggcuucucggcaacagcagcuuagcuugugccuggucugcucgcauuccucucucuuugucuucuaagaaugcagugauucuuuagaguuucccgugcuauuugaaauuuaaaagcuuacuuuaucuauuuuuaacauccuagggcaaaguuuuaaccugauguucauaauuuccuugugauccucuuaaaauguggggaggcaggacaguguguagaacuuuauacauauauaugagauauauguacauacucauauguauuauauguauguauguauguacuuuucugaggaacagauuuacaaccuacaucagauguucaaagagaugugcuacccccaaaaggugaagaacaacuuuuagauuauuagucuauucuggaaugggcacucugccacucaaacagauggaggugaugccuagagcaaccaagaaauccugaaugugcaucaaaugugggugcuuagggccugggacgcagcugggcagguggagaacgccacccacccagagcugccaagggcuauuagccagugcugcuuaagcucuggacugcacugacuuuucgaaauugcaguaaaauccaguccugccuaguauuggcaccggagcaccgcgguuggcuggguuuauccacacaagugcucugccugugccuuugucagacacuguguuggcaguggcagcaucguuacuugucccugucauuuuuuuuuuuuaaauucccacguacaaucaguuugauuaggaaucaugcuucagcaucacagguccaugaaguagagcgggaagcaggagggaaauagcauacgcgacuuauauccaugcuuaaauuaaguagaaagacucuugggcuggggagguuguucauuggucaaguucuugccuaguguuuucaaggccccagguuugcucuccaacaugacagacaacaauggaggaguuagaggaaggacugaaggugcugaagggguuugcaaccccauaggaagaacaacaauaggaacuaaccaguauccccagagcucccagggacuaaaccaccaaccaaagaguacacauggagggacccauggcuccagaugcguaugaagcagaggauggccuugucuggcaugaacgaaaggggaggcccuugguccugugaaagcuggaugacccagcagaggggaagcuaggguggugagacaggaguggguggguucguggaggagaacccucauagagacgaggagggggugggauagggggguuuuggaggggaaagcgggaaggaggauaacacuugaaauguaaauaaauaaaauaaccaauaacaauuuuuaaaaaaugaagaaaagaaaaccaacagcaguaacaaccaaaaccucuuccggcaagcaucuaccacugaugccacguuucuucuguguacucacugugacacgugucugucuauacagucagugcuuaguguaagucacagacagagaugagaaauaucaugggggaggcaagacuuugucuauguccuuuaacuuccuaugcucaaacaguucaugguagggggauugccaucccgccaugcuuuuccuagaaagucuucuguggaauugguuugacugauuaaaaaaaaaagcuuauuguacaaaaacaggcauaaacauguauacuuccaauguuuguaugcacucauguugcuuaacuaauuucuuugcacuuguugugaccauuugacacaaauauuccucuucguagagauguuugaugagacauuaaaacaguauguaauccaggucacuggguuugaaggaaaauaaguguuuuucuucaaaguuacucuuuaccuguauuauuuuggcuuauucaaagaaaccaagucacgaaaaugucacuauagcaaauguauaauuauaaugaaaacuacuuaguccaacaguaaugugacaaguuuuucaaccccauagcuaugugugaacuugaaacaguauaaaacuuccauccagucagguuagucucugccauuggguugcucuagggcaccauggucuagaggaacaguuccaggauuuggguauguguucugaaucacuuggaagguuguuagaacauagguuugugagcuucuccuccaaaauuucuauuacuguggauugggguauggcuaaaaaugcaacuuuucacagguuuccaggugacacagaagcugcaugucuggggaccacaccaugaaaacaaauuaaucuaugacuuaaaggucaucaagugucagcaaucaggaaagaacauauuuuccaaaucccuagcaguucaugauaacaugggguuccaaacaagcuccauaaguucucuacaagugcagcgaggacacagaacucuguuggcagggguccccaggaucccccucaaagucuggcuaccacugagagcaucauguccaaaagguagacacagagccacacucuuguaaucucaccacuagggagccugagacaggaggauggucuugaguuugaaaugugacccaacauugucauucauaucuucaggaagguaaagcuagaucuugaaauauauucagaaaagaaccuaaggaugagucagagcaaagugaauuuauuaaguagcgauaagggacaacacaaacuucagauuuaagcccaaguacagguaagacugugggacagaggacacacacauacacacacacacaagcacaagagaggaagccagucugucuugaggaaaggacaauaguacacaucugagacgugacuuugugugugugugugugugugugugugugugugugugagagagagagagagagagagagagagagagagagagagagagagagaaagagcaagagcgagcaguuaugcugggagucuuuaugguauauauaucacauaugcaauauauacauauaugugcauauauguguauauguauauauguauacauacacauauaauucugcagcuaaguuaacuugcucaaaagauguaauuuacaaagcuuaagaacuaagaacaguuuaaaaauaaaggaaagucaugauuuacuuauuucucuuaucuuaaagaacgccccuuuuguaaagaagauugucaggugguuuuaugaggcuucuguuuagauuuagaguugagagaguacugcuaacaggguuaaagucaaggcugcaaucacccuggcccugaguagcugccacagugacugugacacuguuguuugagauguagagggaagaaugagcacuaucuuggagacagccuuggcuuuagugguuguguugauguuucuugacacacagccaggaggaaagcuaggucuccgcgugagaggccucccccuuucccacacucccuuguuuucuuugucuuccuauccugccccuaucaguggggaaguagaagauuuuuuuuuuuuaaggggaaugaaauuaaggggauuugucaggaaauggaacaagcuaguugaagguaacuuuagaguuaguacagcugucgucccaggaccugaguaacagguaccaccgggaacaguuuguucuggaaggcucucaauaccauucaacaagaaguacagacuuccuacagcagggaauuccucucccauccacacaugaucuucuucugggacauguaggcauaaccagcuaucuccauacaguauaaacuuuuccacggcacuauuuaggagugacgugcaaaaagcuauauuauuauauuauauauaauauaacauauuauauuauauuauuauauuuauauuauauuauuguaucucaggcguuugugaggauaacagcuuagauugggagauggguuauuugagcuguugcguucauuaauuuuuuuuccuaggugucacugauuggagcgcugacaauuuauagagauuaucugaaaugcauuuaaaaaugauuugaaugcggauuuagguugccaacaagaauuggaaaaaccuccaauggcugggguaucccaaaagagggucugaaggcccuaaagaugaacacugcugcuuuggggugcacugauaggugucaccuccagauccugaauuaaaauucagguacggaaugagcaggccugagacugcauucucuccagaaucccagaagaugucaauguugcagacuaaauuuugaagcaagguaacauuggaaaauccauagcugucacuggggagagaggccuguuccccgacagaaggaggaagcgagcacugcuuaaggcugaggcugguccuaggcagggaggguguggggacacgcgugugcggccgccugggcagggccgggaugcagggcggggaggcacagguagguuagacgaagguaggccgggcgcagcgcugggcugcgagcgcuuucaggucuuucggcccucggcggcucccaucgcagcuccggggcgcgaagcggagagggcgacggcggccgugccuccgcgcgggcgcgcgggcaugccgacacccacucggccggucccggcgccucggcucccggaagcggaaggggacugcggcccggccugggcggcggaggcgcggagccgaguggaaagcggcggagcgggcggcggugagugugggccggcgggcggucccgcaccugccaugcagcaucccucccggagaccgcggcccugaaugggcugggguggggagagaaauccgccgaguucuccccgggacucuggcgucccugcacccccggggcccgggcugucggcgugaccgagcguuucauucauuucgaggucgcuggugcggagcugcagaggacccucugggagaaaaccgugcaccuccauugaccuucucccuccucucccucggccggccgcaccggcuguuuugagaaaauggcuuuccgcauggcagcacuuugcacuuguuaccauucccuguaaucacucgcugaacguaaccugcgcuggucguuuaaaauuuauggucuuuucucgagauguauuugggucacauuuuaagauaccguaugagucaguggaagauguuuguaucuccagggcuaagaggaccuggccggucauuacuugaaaauacugcaauauagcaguucauaaaaguacaggaggggcuggguaaaaaucaaggucauugugggugggucauaaaucaguguaaaguuucagcccaaaauaagggcaaauaaggguaauuaaguguaaguuuaaaagacuuguccaauggguccuccacccacugcuaauaugcauaccccucacccucccccccccgaccccaaauucacucccuacuuugugguaaaagauaaugauagccguuaccauuugaugacugcuuagugugugccauuccuagaugaaaggguuuggugcaguaucucauuaaguucuuccagagcuugagauccacggauaaaguucagaggguacccuguugccaccuuaguugugcccucucaguaguaaggcuuuugaagaggagaagugguaugaaaucauuugggggaaaaaaaaaaaaccagauacaguuuggaguugaagacagaaaagccagauucgcuuuugguuucuguacuauccagcuauggggucauggguaggccagggauccaguguuauuuucucaucuauacaacuagguagccaggcuacguuuuucuaagcggugaucuuucaagcuuucucaugucugucugggaaaugucugcuuuuaacuuaacacccuuuugacauggugaggaggauccacggugaacauuuaccucaugaccaaaaaaaaaaaaaaaaaaaaaaaaaacaaaacaaaaaaaaaaaaacaaaagaaagaccuccagaauucaauuugacuguaaaacagcagaauuauauuagaugucuucaaacuauggagagcucuguuaauacuuaaggagcuguagcuagaauaaacacaguguacauguuuaagagaaauugaugucuaagcaagcuuuguuuacuuacgaaaauuuaaauaccuaaguaccuacguaucgguacguccauuaggauccagacaaaaagaaaucaguuggucauaaccuuuucacuuaugugcccacugccugacuucucuaauucauaauggguaauucagaauucuauugggaaagcacauguaguaguagagagacuaagaacucugggaaauguccacuuggaaccuauggaaacggcucagcauaggauguuguguguugcagcaauauaaauuuaucaggcauaacuggggaagcaaaggaauguagacuuuauuauauuauuuagcaaaaguauuaggguuuagauucaacuuuucaaauguagaaauuaaagaucauucuaguagaacagucaggguaugcauuuauuauauacuauuacugaaauuaaagauguuugacauaauauagaaugagcaaaaaguagaggucucccaugaucuccccgaucuaucgccauauauauguuugcauauauaugucagucagugguagaguucuugccugggaugagcaaggcccuggguuggauccacugcacuggaaggaggagggauggugaaaaauuaaagaaagaaagaagccuggguaugauuuguugguuaaggauccccaggaagcucuaucagcucguuugguagucacauuuuucaugugugaggcugcuagccaacccuaaacuaccuuacuguaaugucaguuuauuagcauguuucuugguuuauagcuggcuaugucuuuugcauuauaggccugcuuuucuacuguagucaucgcaguguagauuaagcugcuucuaggcuuuaaggggcucgauguagauacacacacacacacacacacacacacagacacagauacagagagugagugaguuagagagaucagauuugguacagauuagcagugcuugauugugaauucacacauucuuuuuuuuuaagucuuuuaucugugguuagagaguuacuuaguuguucacaaccggcagaauuucauuauuagaagcauuuaauguuaguaugcuuaauucauaccuguguugguaaacucugcuaugugugggcaggccaaucuagccuuuuuuucuuuucccaggaugucuuggcccaguggcuacuugaagggcaauagcuugcuccuuuucccauuuggaagaacaugucugguuaacacccaggaaaaaccugacuuggccucuacauuucuggcuucuacuguaccugaguguuuuuuccuaguguuauuuuuggaggaagguaauuacugaaccugucuccacccuacauuaauauugccuuuuguguuuuuguacuccuguguuccuccaugaaaauccccacagagcuuuucauacacggaaacaguauuugauagucggucuuuaguugguaucauucuacaucuuccaagucauucuugggucaggagaguacagaaguacguaacgcuggccugguguugucagcggaagugcauacuugggaauucuaugaagcugguauacaugugcaugugaagggccaacagcuuauguccaguuuuguccagacugcaguaacagagagccuuccgcagggugcauugaaaccauuggaggugccaggacaaugugccuggacacuacagcccccgugauucuuugauuugugucucagaaugccuuggcuauacuuguucacuagcuucugaaaucaagugcugauuuccauccaggcuccacucuuggcuuacaucuggcuuucuacuuggaggaggagcuuuguuucagaucaaaccuguauuuucuuuuuucugcuugaaaacagagcaggccgugugugacacgcaucuucccugcauacuuacaaagcaauaugucagugggaagccugcaguaacugaaggggucucuggcaguuuauuuugugugaguguguguguaugcaugugugugggcacauacuugccauggcacauuuuguaaaaguuagaggaccauguacaggaauuccuucucuccucccaccauaugggccccaggaauugaacucaggucugcaggcucgacggcaggugccuuuacccacagagacuucucacugauccuaaaggguuuaauuuaauaaauaauucccuggcuuugguauuaaacaaaauagaaaguagauggaugguuaaauguuaguaacacuuuuaaugaugggguucagugauaucuuuauuuaggauugcuaaagucauacuuauuuuuaauucacuucgcuuucaagucaccguuggccaauggugcuuccuugcuaggcagcuucccacugaagugugacagcaguccucuaaguuagcauuaucaucccuguuuugccauguuacaaugaaacuuggaaaggaaaaagaggcaguacaaguuugaccauagcucccuauuuuuaaugcccauauaagacaggucuacuuuguugauaauaaacugaguauugaugauauuuuuaaaauaauguuaggcagauugcuaaagucaacuagagccugguaucucagaguuaacugccaugauuaaucaguuuuuagaguagaauaaaaucaaaagccaaguaacuuuauggaugucuuuaaagauauguacuugcaacuuugguuuuuauugugguauguuuaaaaaacuaauccguuuuuuauauuguuuuaaauguagcguguuaauaaauguacagugcugauguucagugacauuuuauaguugugaggcauugagauauuguuaucuccuaacuuuuggauucaggggcuucauguuauuuguaucccacagagugauuuuuuuuagacuuuuagucagugaguggcugggauuugagucaugggugauugaccugugcugcuuccuaauaaugugacugacagaaagugcugugaggaagccaucaagagcuccaagccuuagcugcauuaccaacuuuggccauguuucaaaauguacugcauauaauucucgggcuugccuguuuguuuuccuggauaaaaaauucauuuguuuaccaauagugacguagcagcuccccaaguuugucauacauccuuggccccuaagggcaagacaaaagugaaggagaccacuuugaacuugguuaaaguuagugggugcugagagauggcucaguggcuaggagcaccugcugcucuucuagaggaccagaauuucuucagcaucugugauaauauguauuuaauaacuugguugaagaagugaguugguaugcccuauggagaguucuuuauaauaugaccuuuuaaaauuugaacuguaguaguucacuuuucugguugacucucagugguuuuguucgaggaagauaaauuuuuuguuagcauuuugaaugagaacauggacuuuacauuccucuguucgccugucgagcuuagagacuuggagcugcacauuugaucaucacuguccugauucucacaagugggcuaagaaugcauugugacucuuugcuuuguggcuaaggcaguucacugagcccaaaugcacaacacaugguuauuugguuucaugggaacuggaugauuucaaaagagagagcuuacaggaauaaagaccauggugcuccuggcagugugugugugugugugugugugugugugugugugugugagagagaaagagugagugugugugugagugugugugugugugagagagugugugugugugugugugugugugugugugugugugugagugugugugagagagugugugugugugagagagauagagugugugagugugugugugaguguguguguggcggugugugugugugugugugugugugugguggggaggggauaggaaugcacaagccaccuggacuggucaucuuaguucugaucuuaacaccuuugguuauuuacuuucccagaauaucuuccugcuuacuguuuuuaucucuguaagacauuuuuguuaaacucuucauagguacucacagagaacugguauugaagggaggcccauacgauggaauaugaaauauaaagaaauaaauaaaagaaugacucaagaagauagcacuucuaaaugcaagugccagaaaaaucacaguucaucucagugaauuugcaagugguaagugggcauucaauuuuacauaagaauguguuugcuuuccgugagauaguguguccuugaaaucuagugcuuagcaaauuccuuugcuaaugaagaauuaaaggcaauuuaggcuuuuucauauuaaaauuuaauaauguauuuucuuaagacuuuaaugucagaaacaucuuuuuaaauuauaaaucuuaauggcuuuaugcaguucuuucugcacuacauuuuaaaaacuaaucuuaagugagaaagugaagcucaaauuaaacauuuuuguuuuuaagaccauuggugucugugcuuuaggcuauuucuauuuuucaguugguugaaaagaauguagaguuucauguccucacuaauagacuuagaagaaaacauaacuuguacauauagcauaaaagcuaucccuccuuccugcucugucagccauguguuacauguggucuuagggaugaucugagauggcugucugcucagucuugaaacagccugacugagauagcaacuauagaugaugucaaggcaugggcuuggcacaucgcuucgcgcacaagucaacuggggagguugaggcagucagcuguacuucucgccagugauggucuuugcauggcuaaccgccccauucugaguuagguaguuuuaaccauguggugaauaguaguaaccucuauugaagauaguucgauuucuaacuguuuuccaggacacaguguuuuugcuguucauuuuuucccccucauuuucacugaccuaggcaacccaguccauucucauacaagagggucuuggaggacaugugacauaaacaugcuugugucugaaaugggguggagcccagugucaagagccagcuucccagugugcucaaguggcaucugagaguugauauguauccuguacacuguaucauggauggccacuguuagcaguuuagucacuguuuucuucagacugacauguucucuguguacaaaccacuuuuuguaaacaaaaaauuauuauacuauaacuuggacccccagauuuuugucuugaaaaaaaaucaaaccgaagcauggaaauaaauuugaagguguaacaccugaauacucucauguagauaguguuguagugacaauucuagaauuuugguuucucauagaacuauuauaagaauguauuuucguuuuaauuccagguguuggaauauggggcuacuucagacugugugcagcagcugacuaugaguugccucaugcuguagcagaggcaugguuuuggcagcuguagauaguuucuguaauugugugauguuuggaauucugaugguauauaaaugcuagaugcucuauaggugaggugaggugggugguuguuaguuuguuaguaguugugcucauaggagaaacaagaagaaagaauuuagauucagggauuccucccuuccccuccccucccuuccccuccccucccuuccccuccccuccccuccccuccccuccccucuccuucuuucucugcuaucuaaugauauggggugaagguggugaguggggaaugaaggguagaaaaaagaagaagccacaaaauagccagcacuagcuacaagcaaagaagaagcaaagagaaagaaauuaggcucaaguaucacuaucucuccccccacccccauuguucuuucucuccuaucuagugaucagggguggaauaaaggguaggaaagaauagaacccacaaaguagcaaagaccagccacacugcguaguuggggaucugaauuccaucgcaucccauccauccaucugucagcuuuauuauuaucauucuauuucagugugaauugcagacaucaggauuauucucuuugaguagaguucagaccuggcuuacaguuuugacuuuguagugcuucacauacagagugcagaaugccucgcucuuaccuguacucuuccugagcuugaugaauguuugauaaagguacaggaagguuuuagauaauacuguauuuuuaugauuacaaaaggugguauuucucuguaucuccuugucuguccacuuuguacacuugaaagugugcuuucauagguguuauaaauaaaacugcugggcucaaggcuuuuacauuuugauggguaugccaaauagcccucucaaggggacuuuauccguuuacaugcaggucagcaguguagcaauguaugggagugcuguuuuccccugaacccucaacaugugaaaaucuaccuagucccuccacaucucucauccucagcgguuacccauuagauguuuuuucuauuugugaguugucuucccucuauuuacuuugugugcuacuuaucagucaugcauuauaauauucuuuuugggaaugcuuugucuguaauuuuauuuuugauaugucuugaguucagaaauuuaaauuuuuuguugucacccaguguuugcaggucuuuauugugaaggccauucuuacaccaagcauuuaaagucacuugcucuuugcuuccagaguuggcuuuuauaaaccuuuacaagaaaacagaggucauugugacuaaagugcuagggaaguugguuuuaguuuuaaacccugaguuaaauucagauaguaaucagagugcuagagagucuucagacacgaguaugaauggugagucuuucccauacauaugggagaguaauaaagccaguuuuagcuaagguggggagucauaggaaacuuaaguuuacgaauauauguuugacuuugcuuuuuuauuaauuauuuugguuaguccuuauuuuucucuaaaauuuucauucugacauuacaauuuucugucauauugucuuuuuauuuauuuauuuauuuauuuauuuuguuauuuuccuuuccucagugacucaaaucuuucuucuguggugguaaaucaaggugccgaaauggcaagaaaggaaagauuguauaccuucagaauaaauugaacauuguaaauauuuccucaggguaguuuauuacaguugaauuauaauuucuuuaaaagcaguuugugcuguaguaauuuacaucaguaugaagcuagucacucugcucgaguguagucaccagauagcaaucuccagugcugaggaaccaguucuucaacuaacuagucacuucaaaguuugauucggagcucaucacuuagcagacaaauuagcauguggggaucuccagcuaaugaaaguaucugggaaaugccauccuuaaaccuagcaggcagcacuguucagucuggugguugcucaggauguguaauaguuucuguccagccaucagccacaccucgcuggagugauccugccauucuaccagugugacaggcucucggcuguaaccagcugugggcucccggaagaccacuguucuccccggccuccuauaaggacuauauggugcuaauuuuuacuaaucagguauuuguuuucaguauucaaugguguguuccuuguuuaauuucucugggcucagucuucuugggaauggugguguuuuagaguuugcugccuacauauguuuucauucagggaacagacccaucuuaaaugauuuggucacuguguggaacuuucugcugugagggauugaucuuuucauaauaagaaaaaauuguuauuucaaaacuaauggaauuaaaaacagauucaaaagaugaauacuugaugauuuuccuaccuuacagauuuauauauguuucuaauguuaauguuaggaauaagccacagaaguauuguugcaugcgaacuuaguuuuuagucuuguauggaauugaagcauugaaagccagaaggguaaaugaaguucauacuguuggguguguuguguugggaagcagagccucugucuuuucuuguaucucuggauaguuuagcaaggcuguaaaauauuaacaguaaaucucaggccagccugggcuacauagcaaaguccuuuccuaacuucccacccucccaaauuacacuuugcagugauucucuuuuuagccaugcagguaucugugcuccuuuaguuuuagaauaaugauuccuagcaagugacacaauaugcuuuacucugucugguuuucuuuacuuuaaugcucccuuuuauauuccuaagagauaaugaaguccaacuuuuuaaaagaucuggcucuauuccuauuuuagaauucuuauaaaaacacugauuuggacuuuauuucauuuaaauuggggguauauugcauuugaguucuuaucaguuuuucaaggggaaacuaguaccuuuuaaauuaaaaauacacauuuaaaauaauuuauguuuuugguccuacuggggauugauguagucucgcuggagugauccugccaaguagucuacuguugcuuagugcugugaucuucuucuuuuuucuuucuguugcuucaagaguugggaguuuguaaggaugagaggagagguauucuuuugaacuuaaguggccuauaaucuuugcuuugguagccucuggcccugcugagcaccagcaaggcccuucggugggagcccaauuauuccuagaaugaaguaggcugucagaucugcugcagaucugggagucauccucaccuuuuuuucacucucagcagggaagcaaugaguaaggcucacugacuggguuuuacuuuacuaggucccuucucuaaaguuaguucugacuuuuguuuucuuucaaucuaacuaguuugucucuaauuuuauucuccacaggagaggguuaauaauuuauuuaaaguacagauuucauuuaaaccccaccuuaguagcuuucuugugcuacuaaaugaaguucaaguacucuaaaugacauguuuuccucaugauagagcccuguccuuauuucugagucaguccaugggggguuuaugacuucugauggcagauuguggcacuuccugugacacuuagcuuagucacccugcucuggccuccuguugcuguacuguugcuguguuuugucguagauaaccuuuacucuuucaagacugagcucaguuuguuucuguuccuggaagccccgcuggaaucacuaggccccucuucugugcaauuacugacaacuugucacagaucuggaacuuaccauuguaaauuaaacccuuuuuaaaugacauuuuccaaaugcacuugguuuauuuaagcaaaggccgugccuuauuaauaguuguucuuacagugucuaggaagugacucuuauuagaguuaacugcacucacuacuguaccacugacuacguagugaaggcagugguuaguucuucugagccagcauucaucugggugaugcaccuguuucugagucuugugaggaauucaggggacguggaauggggucugggaaucugucuuuuuuuuuuuuuuaaaguucccuaguugauucuaguuuguugcaaguuugaaaaugacugaccuaauuaaguauuauaccauuauaguuugugucagagaugccccuagaccauguagaguaaguaguuguuuaagccuaguaagguauaccuacuacaguauggauauuuuuaggucacuugauggaaugacuucugaaugaaaucucagcucacuuggagacuuucucauucagggauguguugcugacugugaacucucagcugaaugauagucccacguaagcaagagucugcuugaguugacaguaagcaaauuaguugggcuucaucccacagauuuuaguuacuuguaauuuucacuuaauuuuagucuuucaaaaugauuuaaaaaguauuucauugugguuuuaaguacauauacaaucuuuauguuuaaauuuguguauacccacaaaguaccacccagaucaagguuuaaaauuuuugguccuuuagaaguuuugaucaaauuuauuuccagcuagaauauaccccaagauaaccagaauuagagccugugauguuagccuccugguuaaagugcuaagacuuuugcacauguuuuuugguggacauacucauucauuucuuuugugucuauacaugaaauuuauagauaaggauaaacaacuauuuuugcgauuuauuuugaacaauuagaauuaaauuguuugaagauuuaaguaaauuuuguauuuguuuugcuaaguacguauugagacaaaacucaaauaugcacaggaaacucagcaaauaucaugaaguuuccagagauauagcuuuucacugaguaauuuuuccguguuaguaacucuugcuuuucuccccaggauugucuugccugugggcggcaggcggguacaggacugcagaaugggucuucggauucacuuuguuguugacccgcaugguuggugcugcaugggcuugauugucuuugucugguuauacaauauuguuauaauucccaaaauuguccucuuuccucacuaugaagaaggacauauuccuggcauuuuaauaauaaguaaguucuaaguauuauuaccuucugugaaguuuuuuuuuuuucauugugaauguuuugaaguacagcgucuuccugacuuccuuuggcuaugcuauuuccguagcacuacuaaaccuuuaagguuaaaguuguacaaaacaauagcuuuuuguacuuggagagauaggauacuaacucuauauuuauuucauucugaaaaguauaugaagaccauuuugucaggagaaaagccugacaauaggauuuguauuuaauuguaaacaugggagguuauugauugauugauugauugauuacuauuuugggacaaggcuucucucuguagcccaggguggccucagacuugccaucuuucugcauuucuucugcaugccugggaccccagcaucccugugcuggcuugaagguggaggcauuauaauauaaggaaggggaugggcuauauuacugggagaugagaauuucaugauccugaagaugacccgagugugaugccacuggauuuccuggaucauuauuaucugcugcagcccagagauuauggcuugcuuauguuccugacagucggaucacaaugauacaucggugccguaauuuccuaacccaauaagcccauauuaaaaacacacagcccuguuuauauuuauuauauuuauaagcuauaugccuagauugggcagauagcuagcacuuuauuaguuuauuccccagcuaucaaaccccuugcuacuugcagcuucuccaggccaugugguucugcuccagaucggcuuccaccuccucuuccuuuauccucucuccuucugccccgacucucuaagaucuccagucccaccuuuccuuuucauuucccaaucacaggcucuagccuuuauuugaccaguucgaauggggagaagguucacaugagaucaccugaauacaugaucguaguuguggacagcuucucuugaggaugcagaauuaacaucagaauacaaacaguacuagugcaauccacauuucucccuuuugguccaauaaaaaggcuccuucuccccccacccccgauauaaauugaguacaaccauaacaaauauaaauauaaaauaugauauaccaggcuggguagugguggcguacgccuuuaaucccagcacuugggaggcagaggcaggcggauuucugaguucgaggccagccuggucuacagagugaguuucaggacagccagggcuacacagagaaacccugucucaaaaaaaaaaaaaaaauuaaaaaugucaauuuagauaaacucuacaguucuauaccugaauuauguucugauuuuaacuuacauugccaucugaaaaccauucuuucaaaucuauaucaucuuccucaaugcuaaacaaauuguuuaugagacuauaacuaguuuucaacccugucagaaauuugagaaugaauuaaauauuaccugaauauaggacccacaaaaacauagcuuccaaauuuaacuuaaccaaauuugcagagacaaaugacuaccugaacaaucccuaauuccucaaaacauuggagcaucagucuucagccuucuggcccaggaucaucugacagaccuuaaaugaaccaggaacuaugaaggacuaacuuacucuguuguggcagagccacgcuguugacuaucccacauuuuauauccuuuccuggacaguauuuuuuuuaaaucuguggauggauagggcaagucuuacccgguggcuaccuugccacaacuggagcaacuccauauggagguuuguugcucaguaucuucuuugaaccaugaagggagugcuguuaggagcagaccuggcuuguagucaaauaaucuuuaguaaugaaauaaccuuaaauguccuauuuuguggauuucugauguuuuugaagacuaucuaaguauaucugaacuauuaauccuuaacuacucuuagcuauuucuauuugaauaauauugaaauuacuuuauuauaauuaaaucagaauccaauauaaccagaguuuacuaucuggcccuuaacuuguguuacuuaaucauccuaaacaguuuguaauagcagcuauagaaggacugggucaaggccuuguguucuuaaaugaguugcaugggcacaaugccuaucuaagaguaacaauauuaauuucaaacuuuguaccaauguauaaacauuuauaucaaugaaaaccuuaaaccuauauaaauauacauaaauucuguugcaguguaagaaauuaaaacuucaauuuugcaucaauauaaggguuucuaccaauguaagauuauggcuauacaaugcuuuguuuaagaguaaauuuaauaucuuaucucuauuugucuauuucucuaguuuugcuuuucuuuccucccucugcuccuuaaccuaagaagggaggggagaggggaggaaaggaaagguagaaaucccugacucuaagcucucuaguuuccacccuguccaaugcagcucacaaccccauaucugcaguguuuacagcucucguguccuuccuuauuuugaucucauagcagcuauaagaaauauaaucccugccauacauauugugaggugugguccuguaguugcccuguaguccuagcacucagaagacugaagcaggaaaauggugacuucuaggccagccugagcuccauaguaagauguacaucagacaaacagacaguccuugcagucagguacacaucagugagcacuguuuucuuuuuauguguucaauuuguugguuuuuauucuccuauaaaaugucuauucuuuugagcaacagagaauuagaggauguguuuauuauuuuuccuauguuauuaauuuaaagcauggugacuaaaucucaauuguuaauauuauuuuuaugguuacuuuaacauucaaaagguuuuaauucuacacuuuuaaaguacaucucuuaagauuccuugaaagaggcaauugaguaucacuaauuuagaauaauuuugaagauagaguugcugaaagguuaaauguagaauuuuuaaaaugcuguuuugauccuuuuaaaugaaucuacuuguuuauucaucacuacucgaguuacuguaugaaagaaucucauuuauuauauuugucaguuauuuuagaaaaucauauuuuaaauugauacauuuaguguagacgucaucuuggcaggacuauuugaaauaguaaaauaaaucuacauuuuguuuuuacauauagucuauugguaaaguuauccugauagauguugacuaaaaugcauuuuuaaaauuuuuagcuuguugauaagaauuuuaaaugaaaaaugacuaacuucaauguuuaauuucauauuacaguauucuauggcauuuccauauuuugccugguugccuuagugagggccuccuuaacugauccuggaagacucccugaaaaucccaagaucccacaugcagguauggugccuuuuagguucauccacuuuucugauguugaaaugauauuuauugacacauuaccuccaaaauaugcuuuauguaagucacucucaagucucugcucacauguccguuuucaguugcaagcacuccccuccuccauucugugccugcucuuuucauuccuuuuagacccacgcccauucugaacauguggguuacuuuaccucugugugugugugugugggguugcaucuccagucuccagaagagucugcugccacugacaacaagucaguauuguugaaugacacagaaucaccugagagacugugcucuacucagaacaggauugucaccuugugacauuuauaacuugcuuacaacaaauaguuucaguguuauaaacacaaguuuuuacuuuucugaagguucuaacaacuuaaugaaaaauugaaaaccuguguuuuugauaucaauugaagauaauuuuuuauucuuuugacagaaaccaugaaaaguggauuguuuauuuuguuauauaccagauacaauaggagcucaccuuuuaucucucuucagcucuuugauuauuucuuuuuuuuuuuaauuagguauuuauuucauuuacauuuccagugcuaucccaaaagucccccacacgcuccccuacccacccacucccacuucuuggcccuggcauuccccuguacuggggcauauaaauuuuguguguccaaugggccucucuuuccagugauggccgacuaggccaucuuuugauauauaugcagcuagagucaagagcuccgggguacugguuaguucauaauguuguuccaccuauaggguugcagaucccuuuagcuccuuggguacuuucucuagcuccuccauugggggccgugugacccauccaauagcugacugugagcauccacuucuguguuugcuaggccccggcauagucucacaagagacagcuauaccuggguccuuucagcaaaaucuugcuaguguaugcaauggugucagcauuuggaagcugauuaugggguggaucccuggauauggcagucucuagaugguccagccuuucgucucagcuccaaacuuugucucuguaacuccuuccaugggugcuuuguucccaauucuaagaaggggcaaaguguccacacuuuggucuucauucuucuucaguuucauuuguuuaugaaauuguaucuuauaucuuggguauucuaaguuugugggcuaauaucuacuuaccagugaguacauauugugugaguucuuuugugauuggguuaccucacucaggauggugcccuccagguccauccauuuaccuaggaauuucauaaauucauucuuuuuaauagcugaguaguacuccauuguguaaauguaccacauuuucugaauccauuccucuguugaggggcauuucuguauuagcuuugagaguucuguauuuuucuauauguuuuuguaguacguuuuagagcuagaguauuuucuauaauaauuuaguggcuucuaaauuuuacuuucaauuuuucuggaagcuuuaaaaaaaucucaguguucagguuacaacuuaugccaguuaaaucguaacaccugggcacagacacaggugugaguuuccugaaagauccccugugguugcagugugaagcagaguuuuggaaccaaaguaguaacuccauuugaaaugcaauugacaagucaccagacagagcccuccagaaagacuaagucuuggcuuuugagacuugucauucagggccugacuaggcucacagacuuaaagauggaaugggagcgucacagugcuguuuguguagcuguggcgcugcguuuaccacguagcucaguucccucgcugcagccauaacccagucucuuggcacuuaauguguccguucuggagcgagagcagagagaggguacucugguuuggaagacucccucuuccucccgggcaguacagcugaaagcugugucugucccguccacgugcugcugcuccagcacucgggugcaguagcugcacagcaaagaaauggccuuuucuaauuccagaccuguuucugaggaacacugcaguggucaaacacucaaauaccuauagguuccugauacugccugucaauaaaagacggucuaaagggaguagccaugauucagcuguugugaaauugucacacaaguugcuagauguuaaaaauuuagaagagaaaaacaaacauauuacuaaguuuugucauuauaaugacaaauacccgaggaagacaaauuuuauaaagaaaagauucauuuagugcacauugaaaguaccucaugguccagaugacaggauaugggaaggcuuccuuaccuccaucagucuuuaccucccggaugucauuuucuacacagcccucuccagaauuguccauaaggcucugcuuacagaguuacaggcuucgcuacguuguucuuucaaacucuuccagaagccugguucaugcauuuguucauuccuuccuuccuuccuucuuucuuuccuuccuucccuccuccuccucuucacuauuauuauuauuauuguuauuauaauguauguauagcucugguuauccugaaacuuguucuauagaccaggcuggccuugaacucagagacccugccucuguguccuagugcuggaauuuaaggauugugcuaccaccaaaacaaagaagagaaaagaagagaguaucucguucacucuguggccaucucuccagucugcguuaggacacucuccccacuacugacagaacaagaggauucuuuuuaacacuuagaagguuuugcuuuguaauacugcgucacaguucuuagguuacagaucugggguagacuugacugcccugcaugcuggaguuugcuaaacuacucacuugggccccagcaucuuaaacuguggguccugcaacugaaugugggggucaugaaaacuuaagcuacaguaaaagauuucugaaaugcaaaauuuaauucuaaaucaaaugaaugaugaaucugcaucucuguagcaacugccucuacugagcugugggugaccucacugaguucuaaaugcagugccuccauguaugugugugugcgugugugugugugugcgcgugcgugcaugugcguguguguguguuauaaaugcuaccugaaacacccaggcucauaacucauaaucaugacauguuauuauauguaugaauuuuagguuuuuuuaaauuguacauacaaaguuuucuucuuuuuuuuuaagauuuauuuauuauuauaucuaagugcacuguagcugucuucagaugcacaagaagaggacaucagauuucuuuacagaugguugugagccaccaugugguugcugggauuugaacucaggaccuucagaagagcagccagugcucuuaaccgcugagccaucucuccagcccaaaguuuucuucuuaaagucuucuaugaggaaacaauaaagaaaacaaggacuuaauauucuucuaccauauuucucuuacuggaauguuggauuguaagcauugcuguuugaagagcugggugagaugguaccugucuguaauccuagcaugcaggaagcagaagcagaggcaccagccauaaauucaaggccagccuggucugcagagugaguuucagaccagccuggucugcauagugaguuuugggcaagccagaguuauauaucaagaugugucucaagaaaaaaaaaaaaacuuuuuuuuggcuugaacuucugacugggguuuuauuuuaaaacuuguuagauguuguuuaccucagcauuauggcagaauuuucaauaauuccugaaauggcuguaaugucuugcugcuaguuuguccuuuguauuuaugcgccucuguuuucagcccugaaaauuuaagaucaagacauuaaucaacucugcaaaacauuuaaaagcuuucucuuuugcauuaucaaauauucaucaaagauuucuuuauguaaaaacaaauaagcacaaguauuaugguaugaaguucuuuaaaugucaaaaucauguguaaaucauuguucuaaaacaauuuaugguucaucaauaauguuugauuuguagacuuacuuaccuggauagcugggaucaugugaaacuucucuggugaaagguuacaagugugacaagguaaaagcccuguucgcaccacagaguuagaggcuccuucucuguaacccgguguucuaggcauucucuuuccuuaagauacaggauguuaggcauggaauaaagcauugauuaucucugggcugcuacaugcuaauucaccaaaaugaugcuguguuggugcuauuauucaguuuccaucuugcuuguaguaguaaggcuggugagguguuuaaacuggauuccaauauuguuucucucaugauauguuuccauuauaaaaggaacuauaagagaugauguuuuaaacgacaguuaauuugauacagauuuuauuuuuacuuaccaguuuccuucaaaauaucuccagcagaacauuuuccucacauuuuccuguguaagauuggaguaugcugaucuauagccauuagacucaagugacuaaagugguaggcuuuuaaaaggggauuuuuuuuuccccagaaaacaacauuauugacaucuucuuuuuaaaagauuuagaauguuuuugaaaaaccugacuuucguauuuguacacuccuuuaguaccaccacugugugcaaggaccauacuguaauacuccuugugcagcugcuaugucuguccaccuacugugagacuaugacaguaguggaagcacaagggcugacauuuuagaaugguaaaauuucacuuuagaaacugcaaagaguauguaucucauauaaggaagcaguuacuuuaucuuggaagaugaauuaauaguuuuuaugaacaauucaugaugaaaacagguaccuauucucuucugcaaacccuuaauugcauucuguuuuccuauagcccagaggcaguugcuaacuggguaauaggcuggagcugauucuagcaagggguuggcuguggcaggacuaguggcaguucaaagccauccugggcaacauaguauccagacccugugucauaaaaccaaaacucacucagcuguuuauuuucauuaaauacuaaugauuuuucuauccuuugcuucuuuguuagauggaugcuuucuaaacccagucugaccucuagccuuugucuaaaacauacgcccaaauuaauuacuauuaaaaauaaaaugcucuaggaaaauauaagauugguuucagcuuauuuauuuacuaaaacuaagacucaguauucuuucuucuuuaguucuuuuagauaauauaacuuguauaaauuaauuaauugauuuauauaaaauucuuguaauauuuuggcuaggcauagaguuuuauaagauaccacauucucaugauguuuuuuagaacugugcuuucugucacuuacuuugaaacaaugguaucuuauuuuuguaguguuaagauagaaauuuauaaaacacguagaacaugcagcaguauuuauggcaaaggugcuugcuuauguuggagacucagcaaaaagagaaaugucacccuguggaauuuaguagcaguugguaagucugagcaucccucgcucacuugugugccuccucguaagcggaugugugugcucucucucugcagagcgggagcugugggagcucugcaacaagugcaaccugaugaggccgaagcgcucccaccacugcagccgcugcggccacugcgucaggaggauggaccaucacuguccuugguaaggagauacuugucaccacacucaagagcugcggcaggaggauuagcuaaggaaaagacagugagaaccugucagcuuuaagaaaaacuuacauuaaaaucacuccauuaaacauuuuuguaauaaaaaugauucuugcaaaucccagaguaaacuaucccucacuuaucccugcuaccaagaaaacacuugagcaaaaacuuugagcagaauuacuacauacccaaccacagaaggacuaaggugcuuauaucaaugaggcuuggaggcagaguauuuggcccaaggucagauguguggaagcacuuaccucacagcuguuuuuccugucggggagaaaagccgcaauguccacugcugagauuccucuuuucuuacucaggagaagaacaacacuuuucacauucacugauaacucucuucuacucauuauaccuuuuagaguguuuucuguuggauagcaacauuuuguacauguuggauauauauauauauguaagugcuaauuaacuuucuguagaacugccaauauuuuuggucaauagggggcucuguuguaauauuuaaagucauacuguuaaaaaguagaucuaaaaaaugcucugagaaucgauuguauuucauuucaaagcugucacaaaaaacuuugagcaagguauuauauuuaauuuugcuuauuuaacauugaaucuuguuuaaauauuuaaauugguauaauagaacuuuauaaauauauguccauauauaucuauuuauacaugcaugcauacaggaaguuaacuguauaauagccuccuuuaaccuacauccauuuaccugcaguuggccaaggaaggcaguuuuccuuuguuuaaugaugcuagucaauuucacuugccuuauguuuaacucauuuugauagcauuguuaauuaacaaacuuuuaguugaaauguuuuuuuaacuauaaacuguuuauuuacauagauuuccagagacuagaaaaacagacuagcauuuuuaaauaaaagcacuuuagguuuucuaauugucuaaauauacuguaagauacuauauacuaugccauacaguguuuaaaaaguguaccguauuuuuaaaccucagugguauuuccagucacaauaauagcauaucaaaaauacuaugugaaaucuucagguaguuaauucucacacuaaaagcucauaguacuuuuuuuuuguauuauuuuuccuaaucaacuaaaaauauaauaagcauuuauggaauagcuggguacugcugcuuccuuacaaaagagugcuauaauuaaaaaaaaaaaucauccgggcagugugucuguugguauuagugauauuuguuuaagguaaagacuaggucauuggugaggaaaugaagcugucuuuaacuuucaguguacuguugagauauuucuguuccuaggcuucagugucugguugaggguauuggugggagguuagcaaggaagguggccugcucuagauuuggggauuucugugauugaauuuucuagcagagugccgcucagauccgagugaggacagugcaugguauuaauuugaagcagaggauucuuacacuuuaacaaacugcuacauuuuaaccaucucagcuucagcucugaucugaugaucacuacgucuggucuuuguuuugucucugacuguucuuucuaaauaguuuaaauucaggcaccgcauacuaagcaagggcucuucgccuuucaggguuagaugcuguuuccgagcaaggaccugugcuguguuguucugcacuagaggaggggaggaggaugcauagcaacaaccgagcagaguuugaggcuuaggggagccacuucucuuaagagucucucuuucagguuacagggcuuagaguugaccuguuuaccuagugugugcucuguaaucucagauaaaccucuacaagcauuccagcucaguucuaguuuugauuuuuuuuaaaauaauguaaaacaauauaucuuuaacaauuuaagcuacggauugaacuugcuauguauauauauaugcauucucuccuuuggugauaguguaguccuaguuuaaaggaaaacauauaauucugagaaaaauaauuuuauauuaaaauuuaaauuagaugguaccuuaaaaauauacccauuuuguaaaauaggauacucauuuuaaauggaccuugauaauuuaugauuauauauuaucauuauuauaguuagacuuuacuguuguuuucacagauaguacauguaagugguuuugaauacauuuuuaguuucagcagacaaggauagauauuucauaaaguaaacauauaaaaauaaaauggugagccucucaguucuguccauguagcaagucugaguugcuuuucucugaaguguuuaaauugcucuccucugcuaaagugcugcaaggaagggcaggguccagccuuugucucuucugaguauccucaggccagugaccuaauccacuaugcaucuucuugugucaguuggcacagggcaccgggcuaaugugagcuggaguaauguagucucuagcuggccuccuugguaaaggagaaggcauguuaaaauguguaucuuuaaauagcuggaguugagguuuaggugagacuuaccuucaugauccugaugugagcaucuuacuaaaccuucacuguuucuuuuucauuuucccuuuaggauaaacaauugugugggugaagacaaccauuggcucuuucugcaguuguguuucuacacugagcugcuuacuugcuacgcacugauguuuucuuucugccauuauuauuauuuucuuccacuaaaaaagcguaacuugguaagacauguuuauauccacuaauguuagagcagcugugccguaugugugaacauggugguuccugugugcggccgagauagcagagagccucacaccagugagcuuuacgggacacugggcucgagagagcgcucuguugcucuuuuuagacaagucucuuuaugacuauuuguguugaguagauuucuucagaagacaaaauaugagcucuuucaguauaugagucuugguuuaaaaauaauauaaaauaaugaaaacaaaggaaaaguauaaaaaucaugggcuuucuuuuuaaaauaaaaucagacagguuuauuuauuuauuuuacuauuuaaaaaaaauuuauacaauuuauuuugcauauucuuucuucuccuuccacuucucccagauucuucccaccaaaauucaucuuccucuccucuccugucucucugucucucucucgaaaaacaaaagcaaaacacuaggccaacgaaaaccaaagucaaaaaucaccaaacgauaaccacaaaagagggcauaaagcauggagccuguggcguguugcucaugcuaggucugcccgggagugcgggaauuagugauauuuuuaagguucucagagaauaguuagcauuugagaagaagacucuuuguuucuguauuuuaagccuagaucuuggccuaagguagucgugaacucucugccuuccugcucauuucuccugagugcugagauuauaggccugugccaccauaucuggccuucugcuuccagcucucccuagcggaaagaugaguuuguagaauguucuagagcagcgguucucaacuuccuaaugacaauccuuaauacauuuucucuuguggugacccccaaguauaaauugauuuuuguugcaacuucaugacuguaauuuugcuacucuuaugaaucauaauguaaauaucuguguuuuaugauggucuuugguggcccucauggaaagaguguuugcccaccccaccccccggggcgggggucaugacucacagguugggaaccuguaauuuuuagauauagaucauuuaagcaaugcucagauuugucuaaauguuguugaugaugcuagcagcuccagagccuuugguuccugacugucaguacuguacuauggccuucucacuguagagucucuaauauucacaggagaaaguggaggauaguggaaugauugagcgagguacugcagguagaaagggagggcgguuacccaaccaccuuuaguuacagagcugauuaaacacaauuuaugcuacuuuuccaauuaauuugggccuugguuauauuuuuaaagaauaucgugugugugugugugugugugugugugugugugugugagagagagagagagagagagagagagagagagagagagagagagagagagagaacugauggagguggguaguuucuuuuauaauuacacugcuuaugccuuugcauauaaagcgcccuggugauaggugugugguuaagcugugaagugcaagugcugggaaucuuaguucuuuguguaguuguuuuggugugcaugauugucgugagaccuggcuguucugugugguuauaaaccucaguggagcugugucuugaaagugauuggauugugauuauuaaauaugguauaugucauuaaaauuguauccaauaacugaaugaaacuagagccucaugugagcuagccuugcucugaacugucucccucacccacucuuuaguuuucagacagggucucacauggccagguugaucuuaaaccuccucuuucuuacucuauugccaaaacaagccuugaauuuguagccuuccugucucagcugucagaaaagguuucaaauguauuugucauuuucauacugaaaauacagugcuuguuucuauuagagcuuuagaaagguuucaucuugcuucagguuaauuguggcauaauugguguuaauuagaacaugugaaucauccaagaaaacugugagaaaauugaaccucagaagaaguguuuuaaaauuguucugugggguugaggucauaguuuuucaaagugugagagagaagauuugagaggugucaguggagagaaaaagaucaugaaaagagacccccuuucugagcagggcggggucagcagcuucugccccaggggacuaauagaccuccauauuuagauuuuguuaaucaguuuuacugggggacaaaaaacuauucucauuuuuccaaacacacauagucugugacuacuuuugugcuccaacaaaguugagugguggugacaugguguauggcuagcaaaacucaaaaauacuaaguaccugccugucaauaggaaguuuaccaugguagucaagagaucauuuugaaagcacacacucuagauucaaauucuuacuuucuuuuauuacauguagguuguuuaagcccucgcuuuguuauuucauuuucugaaagguaugaauaaugaaacuaaauaaguuaauauauucagccaggcauggagguuuugucuggaguccuagauugcaggagcaucagcaggucagggucagccucagcuacauagcaaguuugaagcuagccuggguuccauaaguccucaucucaaaaagcuaaaacaacugagaaauaaagagauauuaaucagaaauaacuggcaaauagcuuacguuacauuugguuucaugaaaacucucagaaacagagaauauuuuucuuuagucuauuuuuaugaaaaaguauaagccauugaacaguaucacagaagguuuggugacagucaaaagaaguucccauaacaaauaagaaugacacaauaauacuuacaugaaagauuuagacauuugaaaugaugagaauauuuugcuuuaacguuagagagauggggagauggcuuagugagcaaauuccucacaggugguggcacuugcuuguaauccggugccugggagucggacaggaggagcccuggauuuaugacuagugcucuagccuaacugguaggcuucagccagugagggacccugccucaaaguagguguauggcuuucccaaugauaccugagguuguccucuguaccacccaacgugcacggggaccugcauacacauuaacaugcauacacacauaauaugaaagauaggaacucuagguaaauuaaugccaguuagaggaagaauuacauuuuaaaguagaaaaacugauuauaagugguauuagaauguauuuucauguauguacuguguuuuuuuacauauauacugaauguuuuauauaauaauccugaggaaaaauaugcaaagcuauguuuuggaaacucagacaagaguaaugcaggcuuuuaaaaauaguaauaauaccuuaguauuaauaaaugucaaucaagugaugagauaaucuugacuauauuaaagauaucuuggcauaagugauucuuuaguauagguauaucacugcuguuugugccuagcaguguggagcaggcauugcuguuuuagcccaugcuugcccuguucuuuuccuguacucaccuucaucuuagaagugaugaaauggaaacuuaaacauguauuuuccaagaucaugucauuugccagcgaggacgauugucaugagucugauguagugaaugguaguaugcacuacuucauuucaacuuuccuggaagaaauuauccgaguuauaaaccugaaaguaucuucaugucuucaauuuugaagaauuuauugauuagcgcagauuauagaugaacauuucuuucaguuaaaaaauauuuuccauugucuuuugguuucuauaguuucacuguaaagucagugguuggucuauuucaugaacuuaauguguuuuuuaaugaucacuuuuaugauuuuuaaaauucucacgcuuaguuguuuuucuauaauucuguaauaugcuccaguauuguucucuuugcauuuuucuguugaaaauuuaguguaacuucuucaaccugugugaugaaauucuucaguuauaaaauuucuguuccacuuuaaauaugcugugacucuuuuugcauauuuuagcauauaauuauguauugugagauuucugcacuuccugucuuugggguuuuuuucuuuuugcauaccccacaguuuaaucuacuuucuacugaucucucuucugauuuaaugauagcuucucucuucuacucccuugaguuuuuaauucuguuaugugguaccuuguacuuuuugaauucacgauugauacuauuucucauagauuacuuuucuagggaaauucugcauuuugccauuuuuugaacauuuuaaaauacuauuucuuaauauuuuaaagauuuauguauuuuacuuuaugugcaugaauguuuggacugaccaugcaugucugggugcccauggaggaaagaaggugaaggaucccuggaaauggaguagggaugguuguaugccaucuggagguauugggaaucaaacccagguucucugcaagagcagccaacguuccuaacgacugagccaucucucuaguaccuucuugaacauuuuaaugaaagcuauuuugaugcccauaccagauauuaaucugcacccugauaugccugauuuuuuauugaauacuggguaaauuguauggccaguuguggaagaugaaguugauauguuugauuuacucuuuuauuuguuucuauauaggauaaaaaaauccucuucuugacccagcuggguuagaugacauguuuuucucauacugaaugggcuuaguauaaugauucuuuuuagaagaucauacuuacugcacuuguguuuuacaggauguuugguugcuaaguuuuaugaaagacuaguuucaguuuguucuuacuccucaguuguauccuuccaggguuucagcugaagagcugaggugucucuuguggaugguguccucugguguccucccugucaugaugacaagcagugcggaauguacagcuagguccuccugaggcaucucugcucugggaucucagccuucaaguucucacuggguugcuagguuggcugcuguugacugccuugcaguagcuggucauggacuggcuucaucuggcuuuucacaguguccucaggaagcuuagucucagacaucucuuacagguguugguggcaauaaugcuuuuuguaacaguuucuucucaggugguucuaaucgcuguugaugcucucauuuauguaaguaaaguucuguggaguguucaguuucaaaacuuaugugucccuaagguuucagugcuguugggcucuggacagacuugauggugagguagagauuaucaaagcagaaagaagucaaaagucaguguaagucaagaaaacuacuguucuuuuuauagaaguucuuuugaagaugacauuguaaagaguuaccacuaauuucaguagggaagucccccuuaucacauugaccuuaguggugguucuaguccauauauuuauuuuuuagguccuucuuuguacucuuccauuuuuccuauaaacaauaaaaacuuguaugccacucuugaguugugugugcagcuggccagagagugucaucccugccuugucuaccauguuacuacuugagauaugcaguagggaccucagagucucuggauucauugggaguuagugguuacugugcauggcucgcuggagcagcaggccugugacugacuuugauccugcacuuuuguccugagagaagggagaggcuucgccugcuuuucccuuacacccugucagguagagagggcagcagagcgucguucuccuguccuagaugccagagcugagugcuuuucuucuagguugggaaagaaggaaguguuaucaacuccuaaguguguguuagcuucuaggaugaaaguguuuacucucugggagaauagaauugccugugaauggcacuugccagugugugugagaagcugcucgcuuauaaauaccucuuggaaacaagaauggaaagaaagcaggcuauucucaaauucugggagauaaacuauuugugaaucugguuuucuguuuuuagaagccuuccuucuuucugagauagauagcuuuagcuucuuugcaguuaccuggccccagguuuuucuuuuucuuacaguaauuucauacuuaaauuuuuuccccuguagugcugggggaagcauggcuggcaaacacuccaccacuggauuacacucccugcaucucuugucucuuaaucuuuaccuucaaaauaggaccuuuccugccuacuugucaaguuuuuggaaaauacucagaaguguccuuuguugagggaaggaaaguauagaaaguguaauggguaaggcaaucugucugucuaucuaucuaucuaucuuuuacugugaauuccaaauaggauuuauuucuuaaacuuauuuauauugcagaucuucuguuaaggaaagccugugagcuuaaaacaguuuauaugaucgauucucauugaaaauaguaauuuaaaaauuccagggacuagauauauauauggcucaguauuuaagaguacuugcugcuccuucagaggauccagguucaauucccagcaccuaccuaagggcuuccaauucucugcagccgcuguugagagggaucugacacccuccuuugaccuucauggguaccagguacauauguggcauagauacaaggaugcaggcaaaagcuucauacacgugauaaugaauaaacaaaucuuaaauuaaaaaaaucugaaggucucaacuaauguaagaaaauaauaaauaggugucuagaaauuuucagaaacuuaguagcaggcucauuuuuuaaaaauaaucaguuuuggaaaauuaguaaaauguguaagcuuuaaguuuggaaaccuuuaaaguauuaagcauaaauuuguuuguuuuuuuaugauaguaaaguguuggguuuuccuuaaaacucuugaaacugaugucuuuaauuauugagauaaaaacuauuggaagauuuaaaaacuuauugcuuaugggauaauuuacuauucuaauuuaaaaaauuaaguggauauugaaggaaaugaacuuuaaucauugaccaacuucuauguuuaacuguuuuauauacuuauuuuaagggcuucaucagcaaauuuuagucauuuauuguuuaacugaaguguaagagacaaaacugcagauuuuuaauuaaauauggaggaagauaccguauuuagaauaaacuguuuuaaguuauguaugaggcgugaauccuuaucaguccugcauuuuacaauuucuaccauaggauagaucauuuugaacuuguguauuacuaggaauguggggaagcaucacguuuggagugucccugagauugauaugauggcuaagucucagagacagucuguagcucauucauucacagagcagccauugacagagaugauucgggcugguguuuuuugguauagcaagcaucagccugcaaacauugcuucuauuuuuuccugaggaauuuuuuuuuccaaaggggaagggagggaacugugucugucucaugucaccugagcuggccucaaacuugcuauauauauauauauagcccaagcugaccuuaaguuuccaaucuuccugucuccaucuuccagugcaaggauuauaggaugugccaccaugcuugguguacccgaagaauuuuuaggcuauuuauacuaacauuuaaaaauuuuuaaguacagauuuaaaauacacuaacauguuacacaaaauuugccccucaaagaaugacaaguugauagauucaugcauugauguuuuuaucuuuuuuuauugaggcagccugcauuuaauauuuuaauugaacauaaaggcuguucauucuguuuuauaaagacaucauaguagucuaauuguuuuaauguauagccacuggcaacuagauauuacagacaguaauuacuaucuaugagagaaaaauauuuuuaaguaaauaauuuguaguguuaaaguagagguuaucauuuguuagcagcuaaucauuuguggaauacuacuucaguucuaaauuuaugcuuuuaaaauuauuuuuagaugaaguagauucaaauuaacuucugauugauucuuuuauaguuauuuuuauuugaagggcaaaauccuacaaacuauacuuaaugaucugagagcagaggugacagaaggagaagagaagagagagaguuuaaacaaagggcuugcugccaauauucauaagaagggaauaaauaacgugcaguggccagccaaacuuuucugcuagcaagauacauuaaugcuauuccggcuggcugauagcuaauuguguugcuagggauuugaugucauauagaauugugccacacaauuaugugccuagacauuuagcuaauaaagaccagaagaguugguugcagacaccuuugaauauuucuaaaccucauuauaauuaaaaauauuucuauauaaucagccuuaaagauaauuaguauaucacuguuuauugcuguuaaaauacuuuaggccuuaauggucauuauuuaaucauguacaaggucacuuauuuauaugcucacugaagaauggagaauauuuaugaaauacauguuuaacuuuuuuuauuuuuuaauuggauauuuucuuuauuuacauuucagauguuauccccuuuccugauuuccccuccaaaaaacacccucccucuauccccucccccccaggagccaugagucccuccauguguacucuuugguuggugguuuagucccugggagcucuggggguacuggcuacccccucagcuccauggauucuuucucuagcuccuucauuggggauccugugcucaguccaauggaugucugugagcauccaccucuguauuugugaagcacugucagagccucucaggagacagcuauaucaggcuucugucagcaagcacuuguuggcauccacaacagugucuggguuuggugguuguaaaugggguggguccccagagugagucagucucuagauggucauuucuucuguccacacuuugucucuguaacuccuuccauggguguuuuguucuccccuuccaagauggagagaaguauccacaguauggucuuccuuucuugaguuucaugugguuuaugaauuguaucuuggguauucugagcuucugggcuaaaauccacucaucagcgagugagcuuuuguuaaguauagccaagaagagugugggauuaagaucaauaugaaaaaaucaucuaucaaugcuaguaucaagguaauccagcuucuuuguucauguguacugacuucacugcuaggaauagucucucucuguaacauuuacagagauugguaggcaaaaaccaccuaaucuaauaauugccaguucuuucugucagugcauuccuuuucugucuugacagcuggaacauagaaacuuuguaacaagcccugagcagguacugugauaauagguuggcugaauguaucucuuuaugagacauaaaguauguauguauguauguauguauguauguauguauguauguuucugugguggucuaguucuaaauagaggaguguuuaacaugggagacaccgcagccuuugcuccugaggcagucagucucucugaguuucaaugguuaaggccugggagaguguugccacacccuuaauucuguuagacacuguugugcuucagguaguggugacuuuagcaagggaauguugccuaguuuuccuacgaauugguccagcuuuucuagagauuccauugccaaaauauaguaaggcaaacgugauaauuuuuaugaaguauucacugucugccuggaaaucagguacuggucacauuugcucuauaauaacagguuguaugcacauauauacaaaauguaagguuugauucugggcccucagugauagucacuagagagguguaauagugaguuuuccuuuagauaauaauuugcauuaagauguagugauaaaauaguuuauguuccuucagaggauguaggaagaaaauaaauuuauaaauuacccaccuauauuuugaaauuaauaaacaaaggcuuaaauauguaaauaaaucuuacagcuauaaggauuuucagacuaaaacaaaauguauuguacuauaaaaugaauuuucauaucagcauuaaucucugcauuaugaaguuauuaguuuuuuugaaaacucaaaucuuuauguuagguaugucagauggauaugauccaauuuauuucauuucuuggaaaaccagacaagccaaaucccucagugauaggcuggcucuccauggggauggggaugucaguuuuaaauaauucuguuucuauuuuaaacucuacaauauagagucuauauaagaauauguaauauauagucuaaauuuuaugauuacgauuuucuuuuuuauguugucauguacaguauaucuguagaagagugcacaaauauuaaaguauacauauacaggccagugaacuauccagggcuauaugggcagaauuugaaagacaauuuuuuuaaguaugguuaauauauacugugugacuuuugcuauaaauauucauaacaucucacuuaaaauaauguauuuuuucuuuugauggacaaauacauuauucccaguaauacucccauuaggcagccuuucuugauucccuuuccuuucggugccuauggcuuacuugguuguguugcuagaaauacugcuguccauguuugugaacuuccuaauggaauucuccaaugcaguugaaucuguuuaaacacguaccaguagaugaugcagguugaagcugcuaauaguuucucaagcugcauuaagugucuggcuuuggcucugugguccaggugagcagagauauacuugggauugcuucucuagucugcugccucauccuuacaauuagacuaucuauccucuguggagugcaaacuuccugauaguuguagaauuuaucuuguuacaugguaaagugauacuuuugguuuuuccccucuaucauugcccucagggaugauuuuggguauuuucucuucuucccucuaccaagugaguuuaaauuuugagaaauaaaguuuugucagguaggauugguuuguauggugucugaagcaguuguuacagccaugauuucuuccucuguaucccuccuuaguggcauugcucugcugaacaugggugcaguagagcagacaguccugccaugcucuuucauauaagaguauuugcuguucuauagguuugaccuuuuuuuuucugugaaaauuaacaguauguauacacacaugagaauggugcagucugccagcugagcaauucucuuccacucuggugacucuuguuuuuaggauuauauuaguuaugcagaacagugugaauguauacuuuaauguguuuugaauuuucugaucuacaaagcuuuuaaaaaacugggaaaccuugauaguccucuuauagacagugaauaacaacaucuuuccggaagcaaauguucuccaggccacccagugaguggcugucaggugugaacaggaugaucacuucagccuuccugguucauuucuauacagucucuuggauauaugaccuaugaaggaacauugaggagaaacuuacagucaaaugagccuggacaaagauggcugacuuacugacugcuaagcaugguguuagcuaguugauccaaggcaaaaucaagcuuaguuuauccuaggagaacaagguagauuucccauuagaaaguuagccugcuaaguuuaucacauuaauaggucagauaaauguauaucucaguauauggacaaagauaaaauuuagaauugccauauuaucagagaagaaguagauaacuuccuuggucagaagaaaguuuuccaaaaccugggaaaacaaguugcacaguacugccucguaugcugaugaaaugcugacuuucugcccugugauggaggggcagagcuggggccucuaagauggagagaaggagguagagacucagugauggaggguuagaccuggagguucaguuuggaggagaugaguuggaggaucaguaauugaggguuagaccuggaagcuagccuaguuugcuagggcuaguguaacaaaauaccacagacuguaacuuagaagaaauuugucccucuaaauuaugauggcugcaaguucaagguuauggugccagcagaucugacuuuaccuuguuuauuuggguuauaagcacccaccaucccaaugugcccuuagugguauuuccuccauguagaagaguccuggacuuuuuucuaugcccacacauccuuccauuuaagggcaccagugauuugaaggaguguccacuuuggugccuuaacuuuaauuuagucacagcauugaaacuuccacuuucaaauacagucaaauucugaggaauuggggguuggggauaucuucacauggauaguaaagauucugagucuaaauggguucuugauguagcugcauuucauaagauagcuuaggacuucaaaagugcuuuauuuaaaagaaaaaagacagaacuaaaguacagauuuaaauucaauuugaguaaugcaugugugaacuuggaauccaguuguuuucugaaaauauaaaaaugauaaguaauuuuauguuaauuucuguacuauuucaaguaauucaaauauauaaccaaaugcacaauguaacuuuaaacauaaauauuuuagucuugucaccauccauuuuuuaaaaauaucuuuuccuaagaaggaggcaagauagauuuuguuugguuagaaguagucauuguagcauaguaaccucugcuguaacagcaugcacaugccuuaagucaccuaccacauaaaaccaugugcuaaaaccccagaggcuuguggggaaggaaggcacagcaucccagaccuucuugucaguuacauucagaaagggggagccugacagaaacagcagcaucauuucuucuuaccagauggucgggaagugcacacaccccacugacucggagcaacguggcugcaagugugcacuaagguuggcuugugaaagugagugcagagccuugguggugggugaggcucaugugaugcccucuaggagauguuuggggagugaccugucuuguguguuccccauggcuugauucaguaagauguacuuuaaaacuuggcucaucugggcuuccuuacagaugcgauggacaaggaacaguguucuuguaaugcucaaguugcugcuucaugugugaugugcauugcaugucaguuuuauuuuuaugaguauuuagaauuagaccuuuuaaaagugaaauguugguugacagcauaguauuuguuagagaacaauucaaguggcuugaggaguuuuauguuuuccaggcuaaugaguaucaaagguauagagccagcuguuaauuucuugagucuaaaacuuugucagcaugcgccacagaaaggcaucaguccuuuguuucaaacguguccucuuuggggcuuaccuaauuuuuuuuuuucauucuaccuaccuaccugucugucugucuauguaucuaucugucugucuguucaucuauuauucagaaaauuaacuccaagcuguuuagcuuggccuuggcuuucugguccuccugccuuccccuuccaagcucugggaugcuugcuugcacucuucacuccuggcccuacuuuugggauugccacaacacucauaauccuuaaccucugucaggaagcauacagugguugcauuuggggcauucagccauugcaucuaacacuggcugguuuacuuccaaguugaacagcaauucacuccugagguaauacuaguugucugacucucucccuugguauuuucaauaaccaugaugccaaauggauuguucuuuguuuucuuguccuuaggguauaguucauguucagauuacucacuucuauccccuggaaaugaccagaaaaugaccuuugccuuaucauaguucccauuuccuaucauguuccuuuccaucucagcagcacuguaugccugcaucuccauaggacugcaugggacgugagggaguguagagagcacaucauuuuuguuugucauguguguguauagcacagggauaacugaaugggagaacacauggggugggcuggagaaggcuguuaccuccuauuacggagguuccccucgauggggcuaaauuagauaauuaguaggugauuuaguauuguaaagcaugccucuacauuccaaauuuuuagcaauguaauaacaaacuuuccuuuuguggaccaaacacccuauaauguuucuauuuuuuuuucuuccacaaauuguguguguguguguguguguguguguguguguguguguguguguguguguguguuagaaagguaacuugugccgggcagcgguggcacacaccuuuaaucccagcacuugggaggcagaagcaggcagauuucugaguucaaggccagccuagucuacagagugaguuccaggacagccaaggcuacacagagaaaccaauauauauauugguuuucugagauagggguucuuuguguagccuuguguguguguauauauauauauauauauauauauauauauauauauauauauguguguguguguguguguguguguguguguguguguguguguguauguauguauguauguauguguguguguguauauauauauaaaauggaagguaacucguaacucucagacugagagagauuaucauuucaagauacaacaguaguaaaauccuauaguuuucaacuuucuguuauaaguucuaaaguuauuuuuaaauuuuucaaauauuuauguguugaugacauggaacaaaaggaggaaacaguaaggggaauacuuaugugccauguauuggcucugauuucaguagucagcaauacugcaagucauuuaaaagccugucuucuucuuugcaggaucucuuuguuguucgccaugagcuggcuaucaugagacuagcugccuucaugggcaucacuauguuaguuggaauaacuggacucuucuauacacaacugauuggcaucaucacaguaaggagauuuuuaauguaaaaacugacaaguaugaacagaugguguaauuguggacuuaauucuaaaauguuacaggaaauuuacaaauuaauggaaaaaaauuacccacaauuauuauguguuaaauguacauaaaaauuugcaucccucauuuuaaaaugugcagaguauuuuuauauaguagaccuugugcuuaugggcuucaugauuacauauguuuuuucuguuaauuaguaucuaguguggaaucauuuuuuuucuaaucuuauuuccuuuuauaccauaacaaucacuuugauuucuuuauuacaaauaauacuuugaacaucguuuuuuucuuuaaauuauuuaagaucuauuucugaagauagacuugcuaagacaagacuacuuuuaguaguaauuaaaucauuucuugaauguccuaauggauuuaucaaugugcaaacuaacuuaguaagugauuaucacuguuuaguaugccugaaagacugucaguuccuccuucuauauuugauaugggaggaaagucuugacauaacaccaaucaauuuugacauuucucuacaucagauacagucauuuuucuuaccguuuaauuggaacaguuacaucaaacacuugagaguaucagguacuacugucuucgugcaugcauuuauugcauauguuuuuuaggucaguugaggguauaggugcaaugagagauaagacugacauacugggugcuggagagauggcucagugguuaagagcacugacugcucuuccagagauccugaguucaauucccagcagccacaugguggcucacaaccaucuguaauugcccucuuuugcugugucagaagacagugacaguguacucacauacauaaaauaaauaaauuuuuuuaaagacugacauacuagaguaucaauaauuuuuacaauuaccguaguugaauccuuuuaucacaacaaaagagauuugaaaaacugagaaaaauuguaaagauugaaaaaagagucuugguagagagaauguaggucagucaaguggccuuucuuauauauuauuggaaggaguagaacuugacuuaaccuuauuggaaggugaauuaccaaugccuaucaaaauuuaaaauguacaauccuuuugaccaaccuugucaaaauaaccuuguaggaguuauguauuugaaugcaugugaacaugcucaaaggggcugcaacauuguaguaugcuuagcaucuauguuguguaugaacauuuaaguacuuauuagcauauaaugaaucaaguaaagaaagaaaaccucaaagccuaucauuaaacaacaguauucaagcauuaugguacuggccuaaggauggacauguauguauaggaacuagaauugaaaacuauauaguccugugcuaccuauagagaauuaguuucagaaugccuuguguguacuaaaaucugcaguagcugcuaaaaccccuauugggauggaauaguauuugcauacacauuuauaguauaugucccuauauaguuuaagucauuucuacaucauuuauaaugccuaauacaauaucaauaauauguaaauagucauuauaccauguuguuuaugggaugauguauagaaaagucugagcauguucagugugagcgcaaguuucuuccuaguauucauagcccgugaucaguuaaauccucagauacagaacccaggaaaacagagggccaguagauuuucaauaaaaaugccaagacuauucauuguggaaaagagcagucuucuacaaaugguucuggggcagauagauauucaaaguaagauugucucucugcuucaugacauauccaaaaaguuaccugagaagggaguauagugcugaaguggacggccuagagcagcucucagaagaaaacauaauugacaauguugguaucuuagacagagcacccaaaguaaaaacuaccagagaaaaaugaguuggacuucaucaaaaugacuuuuaucuuuaagggguucuauuuaaggcaaugugaggagaccuuagaacucaguuggucuucacacacuguugugugugugacauagugcaguguugcagaguucuuuaauaacagugaacacagaguuccuucuagacuuaccaguuccuuuccuacauccagccccaaagaagggccuggaugcacacagcagcuaugucuuaggggccccagacuggaugcaguccagcccuugucuguccauuaugugaaugcacggauguuuaaguugccugugagaauaugaaaaggaggaagugcugauacguggugcugugcauagaaccuugaagacaagcuaacuugaagaccacacacuucagcaaggcaguuuguaugggauaugcagaguagguacuuagaagaagaaaaugguguucugguuacguagggcugcuggacggcuaaggaugacaguucagggguacagagugucuuucugugauaacaaacauguucucgaagugaaauuacugggucacaauggagccauuucucccacgguuggaccuuuuauccagugaggcacuguccuccaacaauguaugagaauuucaguagcuccccaucuuugucaucaucucuugacaacucuuguuaauugucauucuaucagaaauguacuuuuuucuauuugcauuucucuguuguugaacacuucuuuauaugcauauuggggcuucauggggcuuugugaaguguccauuuuaauauuuuuuauuuuuauuuuuuuuaaccauuggguguaaaguauuucuaauaccuccugguaguacugauaguaagugacaugguaaugagugugacuguuuccugaggucaugcucuuaacuguugcacucguucaugaauaguuaauaagaacgaacuauuaacgcccaagucuugucagaaucuacaaguuaugcacauuguuuaauuuccagcuuugaauuugucagaauuccuacuggguauuuaaaucccucaagcagaauuucucagauuccccuguuguuacuguaaaugguuaggaguggacauugggagcauucggcuaaacauucacaucacuacugagggcuggcagaggcuuguggcugagcaacaaacacuuuccuuccacagcaagcccauuagcuucugagauugugcugugaauggcaacuauuugacgcuuuuuaaaaggucucuacuguaaaguuugagcauucugaguuggacauaauaaguaaguuauuuguuauuugcuugguccuaacccagcacucucacaauacaacaugcuaauaauuauuuucagauuauauguuucuuuuuuuaauauugaauagcaguuuguuguacuaaacagggaaauugggcucugauauguuauuucuaaacugaguagaaaucacacagaauaguacauccguaugagacacucagcaaagaugcaagcauugagagggaggaauauacuuugucagucugaucuuuagccacuguucuugcccucaaauacagaugcucuuaagggaaauggcucuguauugaguugaggagauagcucauuugguaguacgaauguaaggaccugcguuuggauucucagaacccacaaaugaaagccagguguggcaggacacaucuguaaccccgugcuggaggagggaagcuuucgcucuucaguggccagcggguggcugaguccgugacccucacgucauaaaaugaaagugacuaaagaaggcaccugcuauccaucucuggccucccccaugaacgugcacacaugugcacacacccacacaggcaccacacagauaaagcaauuagaguaaauuuuaauaacauuucauuggauugcuguagugacugucaagcacugaccuuuuuggauuuagugaauaaugguuucagaauuuacuccuguccuugcugaugcagaauucauuuugaggcuuaauaguugucuuaagucuaaggaacuauuagcaucucuacaaaauaacaucuaaaauauugacaauauagacuaugcauaccuucuucauaaauacauguucuguuccaucuuuuaucaaacuaagcuugccuauaggcuucaucauauaugaaugcaugggucucuaucccgugagcuagaaggugaguuuuuaagauagcaucagagccauggaggggucauaguggaccaauccacuccauggaaaugcucuuccucucccuacccuuguccccucaucuccuugggaagaaaggauaucaucuccuuauggagaacuagaguuuccuagcuugaauguagguccacuaacaagugagcagacuaaaugccaguucaugugcuuagcccuaggaucagagaagcagggcucucauuuuuaguaauuauuuccccauuguuuccuuuaaccuggaaugaauaaacucuauuaaagggccacaaacaauaugcaucagguauuucuaauaaauugacuaaagcaaaauuuuaaggguuuacuuucuuuucagauuugguuuaaauuaggauuuaaauguaugggucguguugcucuaacugaaugaauacuggaagccauguuugcaaagcaguuggcuuugaugcagucuuuauucaggaaacaaguuaucuuagcagcccuugcugaggagcccuuuuucgcucuuggaugugaaugaaguagacagugauguuguuauuaauguaauugacaucagaauuagggagcaguagucccaggcagcaagaggaaaguuccugcugguguuaacagugcaggggagccagacugguccgguuuccagugacaggagauguaaucaagaagccuaacagcugcuccgcucccuggggagguccugacagggagcuguuaucugcuaugacacucuucugacaguuugucuacauuuuguauacaagcauuucuguuugcugggcgcagcaguuugugugcuggugugagcuucugaugucuucuuuggagcuuagugcauugcucauugugaaguuagggaauaaguguguugccuuuggucucacagaugccauuggauucuacuugaauaugaaugauaauucuugagagaucucggggguccagauuauuugagacugcugguccuccuacagggucgcccuccuccucagcuucuuucaacuuucucuaauucaacaacaggggucagcugcuucuguccauugguugggugcaaauaacugcaucugacucuuucagcugcuuguuggguuuuucugaggguggucacgauaggucccuuuuuaugagcacuccauagccucaguaauagugucaggccuuggguccuccccuuuaccuggaucucacuuugggccugucucuggaccguauuuuucucaggcuccucuccauuuccaucccuauaauucuuucagacaaacaauuaugggucagaggugugacugugggauagcaacccaucccucauuugauguccuguuuuccugcuggaugugggcucuauaaguucccucucccuacugucaggcauuucaucaaaggucccucccuaggaguccugggagucucucaccucucaggucucuggugaguugggggggggucuccucaaccuccuauuuccugagguugccuguuuccauucuuucugaugauccuuagggcuucaguccucuucccucagcuaauacuagaucagguuccucuccaacccccacugccccccccccacuccauccacauucucucccaagucugucccucccucccucccucccucccucccucccucccucccucccuccccaguugugauugcuuucuucucucucccaagagggacugaggcauccucacuugggcacuucagcuuguugagccuuuugaauucuguauggguucguccauccuuccuuccuuccuuccuuccucucucucucucucucucucucucucucucucuuucuuucuuucggauaauauccacuuauuagugagugcauacaaugcauauccuuuugggucugaguuaccucacucaggaugauauuuucuaguuccauccauuugccugcaaaagucaggauguccucguucuuaauagcugaguaauuguguaaaugaaccacauuuucuguauccauucuucugucgugggacaucuagguuguuuccagcuucuggcuaucacaaauaaggcugcuaugaacauaguggaacaggugccccugugacaugaugggguauauuuuggguauauccaaacagguagcauacaccagcugauaugaggccccuaacacacauauacaguagaggaguuccaggucuguguucauucagagaugaugcaccaaacccucaagagacuggaggccccauggaguuuagaggucagguggggugggguggggaggaggugugggauguggagcagucagaggguggauggggaaggguggugaauggaauauggaauguaaaaaaugaauuacaaauaaaauuaaauuaaaaaagaaagauaauuuuuaaaaccauugcauagaaaauauuucuccuuauaccuacuggcccauauuugauuuauggucaagacuuguguacguauagaaagaaucauucgugcaugagugacuguggugguuuaacuaagauuggccccucucggcacaaauacuugaauacuuacucuccaggaaguggaacucugugacaggauuagaaggguuaggaagugugccuuggaggaggugugccacuaggggugcgcuuugagcuucuggaucaggauguagggucucaguuccuucuccagugccacgagugcuugugugcuuuuaggcucccugccaugcuccucugcaguggaagcaagccccaacucaaugcuguuuuucacgauccuugcucacaggaucucuccacagcaauagaauaguuacuaagauagugauauaauuuuaacugggguuaaucuuaugcagugaaaaauaucuuauauucaaaaucagauuaaaggagauuagcuauuaaauaagauuuuauuaaucaauuaauggauuuuuugcuuuauaaauauauauacagaaguguaggccuaaauuugucaaucuuuauaauugagcuuagcaagauaucagugaaucagugaggugaguuaguacagucucuauuuagcucguguuuacacacuuggcuugcagucagcauuacacacaugcaggucauuguagcucacugccuuuaaaaggagaucucuggcaguuuggcuuuccuuccuaaguuauauauauuuaaauaaaauaaauguauuucuaguacaguauuuccaauuguaaaauuauaugacauaucuccucacugccuucuuuaaaaugcuaaaauaaauaaauaaauaaacccagguaccuaaauuuauuauguuucuuagaugcuuuucaugcucaugaauauauuuguuugucuguagauauaauaaagaaucuuauagagacuauauuuuuccuuuuuguaguaacaaaaauuauguguggaauugaaugacuuauauacauauauuucugagcagaaguguuucucuacuuuguuucucuuugcucaguauaauagaacacccaaaauacucaaaugaauaagaaagcuguaaauaauguaaauguguuuugacaaugcugguaagauaguuaaggcauagacgucucaaagggucaccagugaacauagagacuccuuauguugcuguguggcuaagcauguuggguguuacuguuacuuggcguuuccccagaaauugcucuuccuaucucgugaucugaacacauguggauguuuaaccugacuuuaaagcaccguaagguuagaagaagcauggaucauauauuuauucacuugaggucuuugcuaagugucugucucucacguucuauuuguucaugaucucccaaaaccuaguccaaaggcacauugaguucccuaacuccaugucuucuguugauaaccagaaaccucaucaaaagucuaauuugauguuaaaaugcaaaauaguuggguuuggguccugacucuaagcauagauuuuuuuuuaauuuucagcuguuuuggugagguuacuuaauaaaauauuuuuugcauagucacucuccguggccugcauguguaccuguguaauuucuuugcugaccaucaucuuucuuuuuauaaagaccuugccauguagcuuguaguuacucuacauaaauagauuagugaaugaacacuaguuuauauaauuuggaguuuuacuuuaugacuagauuuuaagguucuugugauuguaggauugcauauaucuucuuugucauuuugguuuuuauuauaaacuuuuguuuaaacauaauuuuaguaacugauauaguugagauauuuuuuucuucuaagcaucaggaagugcuuaauaaaaacaauaaaaauaagaaauuuuagucauuaaagauuuaauacacacugauuaguuuaaucucacaaagacuuagaagguaagcauuucuacuuggaaauugaggugugaaguuuuaauuucuuaccuauuuugaauagccagauggugguuugaugaagagaagcagagaaguuauuuuggaaggagauuuucagugacuacaaauguaaaauucucugcaucucuagcacugccccgugcuugaugaaguguuuaugugaacuucaaauuucaaaucaaagauccagcugguccucuguuugugauggccacuaaggaacugccaguuuccaacgaggaaacugaagggagaggcaauagaggguaacaggacucccugccuucccauugaaaaaacuuaaaaauaaagaauuacgggggggcuggagagauggcucagcuguuaagagcacugacugcucuuccagagauccugaguucaauucccagcaaccacaugguggcucacaaccaucuguaaugagaucugaugcuaucuucugguaugucugaagacagcuacaguguauuuauauaauaaauacauaaauaaaucuuuuuuuuuuuuuucucgagacaggguuucucuguauagcccuggcuguccuggaacucacucuguagaccaugcuggccucgaacucagaaacccgccugccucugccucccgagugcugggauuaaaggcgugugccaccacgcccagcuuauaaauaaaucuuuuaaaaauuaaaaaaaaaaaagaaagaauuacacuauuucagguugugccugguuaguccuguccugcagauauguaccaaagguacccaguuuguacaaccuuguucugcuagguguuuuagaguuuaaaguuaacugggcauuagaaagaugacucagaagaugugcuugcugcucuugcagagacuccaaguaccucugcugggugcuaacucuagcucuggggaucugacaccucuucuggccuccaugagcaccuucauucauucaccaccacacacacauacauacauaucauuuuuuuaaaaaaauuaaauguacuacauuuauauacuaguaagcagucaaaugaagcucuuacaacuaggaaaacucaaagacagaaccagguaucugaccaugaaguacaaaacccuuuccugaacaguguuucccaggguacaugcaguaagugagcauagaucaucuagauaaccaccuaugugcaaccuagcaguauccuggccuaugagacccuccuuccaggacagauuucagcugacuaugaaggcucugugcaggugugucgaagggcuucucucucauggccaccuuuacuuugaucaggucuuuaguaugcuaacaaacuccuuuggaaacuguuuccagaguuaaacgggcccaaaggcaaguccucuuccacacucugaagacuguuguuggaagcagauggacucuauccuguauguguugcucgggaugucugaggccucucuucagcacacccuuuacccauagggcaacagauguggccaagggcugcugcuugggcagagugaaaggaaagcaagagcagcuaucagccuggcuugggcuguguuuucaguccuguuaaccugcuaaucaagaaaccuauggugugauaaauucuuaccuuucauacuacaccccauuccaauuucccaauaaauccaucucuuccuucugcuaaaaaucguuuuuucuccauuccagacauaauccagcauuaaguuaggcuauaguuuuuucuuauagucaaacauacuuuuauuccgaaucugaagcaucucuuuuuauaccaggauuagccguuaggagaagacaacauauuaaaagacagaacagaucuguucugaaagucuuuuuugcuuuuuuaaaaaaauguaaaucuccaucuuuuaaaauaaugaagcauucucuuauauuguuuagguauacaggcagauugaaguguuagauauuuugaucauuagaucauuccagccauaaacauuucucagaacucauuaucgcagcauucaguauaugugggacuuucacauuucuaaaauaaugguuuauuugcuagcuagcuaaggcuguguguuguaucuauauuccauuuguagcauuugccuuguugguccuucccuggugccacuagaagauuugaguauuuucaguaugcuuaaaaaaaaaaaaaaucccauguuuguccacauuaccaaacacaguaaauuaagccuuacuuaguacuugugcagacuguggguucuacuuuccuucagugacagacucuguccgguguacugcagccugcuuauacacgguuguguuuaggucuccugugcucgcugccucccagacugaccacuuacugugugcuagugcucagcuauagaccuuaugcugguuuuguaguaauaguauuccauacggcagagguagaaagagguaagcauuugccauucuagagaaaauaguagauuaauuuaggcagcuucccaacuacuauuuacagagaguaaagaucucaucagccaggcagugguggaucccagcacuugggagacagaggcaggcagauuucugaguucggugccagccuggucuacagagugaguuccaggagggccagggcuacacagagaaacccugucucgaaaaacaaaaacaaaaacaaaaaccaaaaaaaaaaaaaaaaaaaaaaaaaaaucucauccucucauccuuugaaagaguagcuaucuacucaugaggauuuaaauguguuugauuuugauguccaaaaacuucaaaggguuucuauauaugaaagcuaaaccuggagagguuuuaaagaaaguugauucuuuuucagaaccacaacuaaauucuacaguguagauucuguguaguaaaccugucccaggauaaaggugacaguagaccaacccuccuacccugucuugccaguccucgcauagcuuuuacgugcaaagauguugucaaugcuguuuccgguugaaacuccuuuggaguugaaagacucuuucacuggagucacauaucagauauucugcuuaucagauauuuacauuaugguucauaacaguagcaaaauuauaguuaugaaguuguaauaaaagugauucugugguugaaaaucaccacaccaugaggaacuguauuaaagggcugcagcauuaggaagacugagaaucucugcucuguggugacuuugccugcucucucccccugcacuuugguguuggguccuuugcaguggucuuugccaucucucgagcacccuaagauacuguccaaauggccuuuuccacuuccuuuauagauguuaacccgaagccagcuuuccucuaaauuacugacccucagccucccugacgcugggcccuuuaauacaguuccucuuguuguggugacucccagccagaaaauuauuuucauugcuacuucauaacuuacuuucuacuguuucaauuguaguguuaauaugugugucuucuguuggucuugggagaccccacagguugagaaccaccucacuaaaugccuaagauauuuucucguguauuuauagacugugcuuucauuuagaaugaauaaaauacuguuugagaggaaguuauacaacacacaaaaauaaucuuauuuucaacauauugucaaauuucaaagcauaauacaaaaaaguaauguauguggaauacuuaguaaagcugccaucuuuuugcaaaucuugaggaagcgcugugagugaagcuguuguuugcucccagucuccuacaaacagcugacuucucccuucuagacgcugcugcugccucagcgcgccugacaguuugucaucgcgagugcucaccuagcgucacuaaauguaaaagcuuggcgccacaaaggaacguucuggagccaaguaauguuugcagagacaaggauuuccaugaauaguucugauugcuauugcuuuacgccaugucugucauaagugaacaaguuaguaagaucaaaucacaggagauggugaagauuagcuaauguuuuugcauauuucaaaaauguuuccuuuguauugcuuuaaaacgugcuuacacuuuaaaguuucaccuauauauagguugaacaauguauacauuggguauuuagauaucguaacaguuugucacuaugauggagagauucuuuguuacuagaguuugugucaggacuuucagaaacugucuucugcugagagcuuugcuucccugccugcauuucagccugguaaaagcacacagaagaaacuguaguuuuguaaagguuugguuuguucauugggggaauuaagaaauauuuuguuuucuuuguguuaaggaauauuaauuaucuaacuuuaauuuucuuauuuaaauauauuguaacauuaucaguuuauagauuugccuuauugacuuuguuuuuuauagaagucuauaaaacccagaaccaguaguauucuuugucucuugguaguucuguagucauugauggcuuuuaugcauuauuuugauauuuauuuuuaauguauauuugcagaaaguugaguuaaacagaaauaacuaggcuuuuaaaauaauuaccaaggaaucggguauccucaaagguuguaaucaaaugaaauaguucuuggagagauguuugauauuuuaguaguucacugauuuuuuuauaugauagaauguuaauuuuauuuuucuaagaggauuucagaauguguauugauauauaaacuuguuaaaaguauuuauaaauuuguuacaucugaauauaauuuuuuguuuuuaauaggauacaacaucuauugaaaaaaugucaaauuguugugaagaaauguaaguauuaaguuauagugaucuuauuuaaaaauagaaaccauacuguuugacuaccuuugagaaucaugugccuauguuaauaguaggaaacuaauauguugauuuuuuuuucuugguguccugucugaggcccaagcuagacaggcguaucccagucuuacuguaggggucuuucagccaugggagcuuuuaaacaaaauaaguaccgaucacucuuguucccugucucacagaaguaagcuaaauuauuuguccugaaaguacaucaaaagagauuugcuacuguguuguugacacacauucuguuaugcugagcuucuccucugcuuccagaguuacccuagguugauugacgaugcagauacaauaucugcucuccagagcugacgcucagcugcaugccacauugaaaggaaagcugcauuugugaugcugagacacagugcaucagaguccaguaauggauccccagccaaccuguauuguuuuagcugacugaagggcaccaugggagugcugucuuucacuaauaaugcugucuucuguagaucgcggccccgaaagccauggcagcagaccuucucagaaguuuuuggcacucguuggaagauccugugguucauuccuuucaggcagcggcaaccacugcgaguucccuaccacuuugccaaucacgucuaaacagauggauggugggcacagauggguccuccaugcuggaaaugcguuacagguuuuaugagaauagaacuaugacagucuucaagucaauuaaaauccaccuaccaaucuuaggcaucauaaugugccccaggcuucauuuuaauagugaucuugauccuguugugggacuaauacaagaucuauauuuaaguuuuaaaagcauguuuacuuuuaaauuagccuuccaccaggguuucuuuaaaugcguuuguuacuaaacucagaaggcagugauugggaugaaacaauuguacauacauuuucuucaguacucaaaguuuuuuaaauuuuaauuuauaggaaauuugacauguuuuauguuuaccuuuaagcaguccuaaccaaaucugaauuuaauucuucaaguuuacaaaacuggauacacuuuguuauguauaaguuaaaauguuacuacuugcuuuuauaugugcuguaggcuuuuacagugcagugagcaacaaggggcagugccuggcuaggagcagcucucugaugcccuucuuucuccuucucaaaaccacagacgacuccccgaguguagugcaccaacuacuaccuuacugugagggaaaaacuauguuucccuucugcugcaaucacugauugcuuuuagaauauuugcucccaggagaaaugugugaccagucagguuuauauuccuguuuuacccuaagauucuaaugacugaagaggguaggaaguuugcaauaauuccaguuacuucuucaagugcaguuauauuagaaagcagauguuuuaaagugcuaagcugaaugguguguaacaguguaaggaggagaacugugcuuuuaaaguauggauacuuuuauuuaucugccauuagaucucacuguacacauugaagauuuauauauuauagaaucgauacuggucaacucauaucaaaguguaaaagugggucacuaaauuuauauaccaguaaucacccaaguugaaauugaauuuccacuuguaauucgcaucacucuagagaccuuuuauuaaugucaggaaauuacuguaaaauagaaugaucuaugguagugauggucucuuaacaaacaugagccuuuuguauacaaagacauuuuguaugauuuaauuuuuuucauuuagaauacugcaauuccauauguuugugugcuuaguaaucuuuucccugaaaagaguauugaacaaaucuaccauuugugaaccaucuacauacuuuucuuauaaguaguuguaaaguaaggaaucauagcugggaaauacuguggcuaguucuuucagauacuguaaaugucuuauaaaauauucugaauagaauaaucucuuugcagaaauauuaauaccauauuuucauguucuaauuauguuuauuuaaaaacuuagaaguggcagaugaaaauauuuauuggugcuaagacauauaguaaguuuaauauaagaaacauuuauaaagguuaggaaacauaaaauuaguauguuuuaguaagggcgaagggguuggguuuuguguaagcugauugacuaacuuggccaaugacaguuacugaaggaagugguguacauagacuguugggagguagaaguugaaugccuucagcuguauauauucaguucacucaagaccuggagcauccaaagcagagccaaacgaaagcccagcguggagcuuuguaaacugcuuuauacuucuggagcaguaguagcucugacacaagguaacgggcgugaucccuuccccaugcuggaguucguggguuuggucugcuuacauguaccacuucugggcacauuaucuacccuuucucuuuacucucccugguccugaccccucucugcaguuuccuaacuagucauuguacuugaugcacuaguuugaucuacagaaaugcuguuauugauguauuuacauaagaaucuauauugcaguauaucuauauauacuuacauaguauuguuaaauguauaugucuaacccccggagggguuuguaaucacucuaaagauuccuagagaaaaaccuguuggccauuuccuagggauuaagcuccuauguucuuucugcgcccucuuuuggcuaauugauguaauuauccuggcucuugagguuuuuacuauccuguuaguggguuguauagccaaucugugaacaugccagagguauacaugccaguguauacuuauaggaacauauguauaaaaguguaaaguuuuauaaaaauugaaaaugaauguguuauuguuggugauguuccuucuugguaaacugccuggcuucauguauguauauucuuguacacuuuuuacugucagucacaaauuucgauuaguuuaagcuguuucauguauuuuacuuuaaaccuuauuuuggcaacuuaucuuguuagcauuauaaaaacuuacuuaaaauacuauuuuacuacaaaacaaaacauuuauuacaguugcugugguaacuguuauucgguauguuuuacuauuuuaaaaaguacauuuaauuuuuucaauucaauuuugggauuguccccuuccacacacacacaaagguucaauuaccuuaaaauaauuaguaauugguuaauaauauuauuuuucuuugcuuuuuaaaacgcuugucaaugagaguuaacccuguagauuauucaauagccucuuuauuugucccucucaguaaccaugggaauaacuacccauguggggucucaggaagcgauggagcaagggcaaccccuucauaucuacagugcauugaaguauuuauaagcuuccuguuuaauuuuagcaaaauguguguuaagugacauuuuuacauuagcaaagucaccucaugggauccugcaguuaaaguguuaagacgaggcugcagauacuugguaaacaauuagaauugggcacgcaagguggcuccauacagaaaggcauuugcuguacacggacccacuuaggugaagaaggggaaaaaagcuccuggcuucauagaguuguccgcugaccuccacaaacaugccuugucagucacgccccuccccaucaucauuguucauucaucgccucacacacagcacacacaaacguuucugauauccaauuggauaagcuugauguagguaacaaagggcuggguucagaaucuccuaagcauuaaacagucuacuaaggagucuuuguuaccaggcuuccauuucagauuacuaagcuagcugauguuacaugaaaauaaaaaccuauuuuguuuuauaauuuauauuuaaaauguuuuaguuaacauaaaagccauuuaaauuuguagcuaacauaagauccuguuuuucagaagacaauuuacuuuuaauaguaauaaaguaggggcugauguguaccucaaaaauuauagugcacaagaugcccaggauuuaaugccaagaaccaggaaaagacaagaagaggauguagacaguagcuacacacuagaugcagaagagcugaguugaacaucucagaacguuucauuaaugugcagaagugguuccaugaaggacgguggcucauuccagcuauucuuaaugagacuuuggguuauuuuccuacaagcaacuguuuugcucgagagauguauuaguucuaaacaguaaucacaaagacuaaaauuaagaacacacuuccuaacgggagauacaaaugaauuuagaugaaagccacauaguuuuuguguuaguucauguguaguuugaauguucuuacauguauugcuaaaaaagaaaaaaaaaucacaauuugucuugcaguggcuuaauauggcacuaauauucauuagcucuauacuaauuucugucuagacugucuguucucuggguaguucuauuguaugacuuguaucaguaaguagauagccuagcuacaguucacuaaacuauaguacuucauuauguacauuuuugacauaaccucuacuauacauacauauauugggaauuuauuacaaacauuauaucauuuaguaauaguuaaaacauuagacuuucauccaccucuacuagugcuuugaaaaucacaaauauuggcaaauguaguuaguaaguccuguaaacuuaguguguucuauuguuagcauuaucgaccauguaauuaaugagugagaauacgauucaguacucacauugcuacugucuucuguuguagguaccaugcucggagcuugcuuacaaauaaaaauuuuaguauaauuuauauuuagcuguucuuagagucuacaauauuuuacaguagaacaugggaaaguauuagaagcuguuuacaugaaguccuuuauaccaguauugucaccgacuaaaugaaccaauaguuagcauuucugcuaccuuucugauggugaugacuuaacuucaagaaguggcuuuucucacuucuuccauuaucuuuaugcauuuuuuaaacaaaauuuauuuuuaaaagccauuuuguuaaaaccaacaauauuuugugaguucuuuagauguggcaauauuaucugcuagugauaauuuguagcaaguuaucauuauuauuauuauuuggagacaggguuuuacuggcuuugcacucagaguccuccuacguuugccucccacauucugggguuauaggcauaugcugcugugccuggcucagugcuuaaaacucuuaagucauugguaauacugauuuuucauuaucauaucuuuuacuauauuacagcuuuccccuguaucuacccuagaguucagguaccaaugaguaaugaguaucuaaaaacuagauuaagaacauuggggacguuaguaagauggagugaaggcuaaguggacagaaauagccagcaucugaaaagagcugacuagagacagcugugauagccagcacugucgcugacgccacgucacuguagagguaccugcacagccauugugggaagcauuugguuugagcuguuugaucuccacuuaauguucuuucuccuuagcuggccagaugcucuugagagauuauuuuugauuucagauaauuguguaggauaaguuaaauucaagcauuuuuagcaugcacauguuaaaaauaacauagaaguguagcuguaauacaaaggagaagugauugcuugcccaaaguuugaaaagaucuggaaccugucugaggagucuuuuggcaaagaaauacugagucaccagagaaaaucaacgacucaguuaugaaggaagggaucuguugggcuucgugagacccuagaggucuucauuucugaagcccuucauuuccucauguguaaaaguaguguuucccauaguugcucaacuguguaauuaacuaauugcacguauaaaaccuaguuuucaucucacuagcuuuauagggaaagauguagcccgagcuuccggggccacaggcaugccuccucugggcuuugcuugccuguuucacucagcacagggucugguuguuuguaggcugucgguuagagggaagaugcaucugcauacugauagcucuguguccacaccaguguggaugggugauauuuuaaccuacucgugccugaaauuaguguuuuacaaccugaacaauuaaaacauccuggugcuauucacuuuaucauugaguuacauuuuuaauucuugaaccaaagaauuaguuuucuuuuugguugacugagagcuucucacaucugugucugaagaagugaacagucuauugacagcuuaauuucagcagagucaauugugaaugaaucuuaguuagacuuauuuuuuucuguuaugcauauuagugugggcuuuaauuuuguacuuuaauguaacauggcuacuauauaagguauuuuaauaggcugaagcuacuaaagauuauugaaucacuuuucaaaagucucaccaaccccccuuggucuuacuucagcagugaagaaaaauuaucucuauaagcaaaguauucuauuggauacuuuuaaugacugcucaaccaaaugcuaaaauaaagggcaaauaauagguccauuuuacauuacaagucaagaauuuaguaccucugugugggggcaggguauaaaccuuaauggcuuuaaauaaugauacagguauuuaccuaaugagaaugaaauuaaaggacacuuuuaaaaacauaaaagucacaaacacaugcacacacacacacacacacacgcacacgcacacgcacacgcacacacuuucccaguaggaaguccaaagguacguugacuugagcaaacacccuggcaguugaacuucacaucagaagcaguuugggugcugcugcucagcauccgugaaaauuagucagauuauguaacuggcagacugcaguccucuggauggacuuguccaggugucugcugcugcuuacgauuggcuucucuguucuuccuuugaagcucugcaaacaccaucaggguuuccuuaaaacagacgcugcccggcugaucacucagccacucacggaaccgugcggggggcuaggaagguagacagucacacugaaaaugcuuguguccuuuccauucgcuucaguccgugucuccuugaggguugaugcaauauaugguuuugcagugaauucugaauggaaaaaagaaucgauucuugaaaggugacacgcucgugugcauagaugagcaaauaugauagaaagcagagggagggcugccccggcucuuguaccuguguugccacgggauuguuucuuaauaauuccacugcuuguccaagucuuaaaaggcaaagugagucauuuuucucaaguaggaaaagagaggagagaauaggagagaguuugccacugcuugcugucuccuggugugauuauuaaaaagcaaagaaaaaaaucaacauagaauaaaagcaacuaaugacacagaaggaagaaauucaucccagucagagguauaggaugaauggguuguaagcccaaggacagacaggaaaacagagggagcauggaguuagccuggcaaguuuaaucacuugacacacaccugugccauucugaugcuccaaguauuugcugucugcuccaauucucccauaucccuaauugaaaagcacugcuugaguuucaauaaugguguguacugugggugccuaggaagacccugucuuaaaacuugcugggugugcuuucauucagcuggacuguguguaagucugagggccuuggccugcaucgucugcuguuguguuuugucucuuacccuaggaaacccuucacuaacauuuccagugcuagugguaauaaggaagagaguaggucagagaacugugaguccuuugaggagagggagggacauacaggcgggugggaacugugagguauacuuaauuguuuagaugagacaacgucuacacugguucuucuaaugaaaauggacuauguaucuaccuuaagaacaacauugcuuuuaauuuauuuuagugauuuuuguuuuauucauguaauauucaauuuucuuugcaaauugcuuuuaauuuaaacuguggaauuuuuacuucucuugaaauguacuauguacuguauuuuuagaaaucuuauuuuuaaauaaauauuuuugaaaaacauag

SEQ ID NO: 1959 - RNA, 3530 nt, Mus musculus
gucagugucauaagcccaugaaucuauuccagaaaugcuucugaaagaccaauacaagacauuuauguggcgcagcaaguccaagaauuucucacacucuacaauguaauauaucacaacacucagaucagggucagaauuugccauugagguauuugucagguugaauuugucacacauacucuuagacaauaggaagaagcccaaacauagaaaccuaacuugcuagaagauucaaaagcauacgaguagaagauuucgucuauauacacgauuguccuucaaaaugacucacaauguacuuggagacuuauggcguuuccuaguaacuuccucaagugacucuaauacuguucauguauuuuccucauauuccgggaaaagguuugguuccuagugccugagccccuuccacguguaaacuguuaagaguaccuucacuauuccuucuucaacgccagauaaccaacaguaaaaacuucauguggagaauacagaaagaaaaaaaaaaaaauacaugggccaccaagcaagcugcgucccacaucuguggcaaggcccauucaauagaaucaaaauauuuucugagucucaaaggcaacuuugaaacaugcaaaaucucuuuuaaaaauccuucugggagcuauguauuauggagcaugucuguaaucccagcacucaggaauuggaucaggaguuuaaaaucauccccagccacauugugaguuugaggccagcugagaauacauaagacccugucuaaacacaaacaugugugugugugugugugugugugugugugugugagagagagagagagagagagagagagagagagagagagagaaaauagagagaagagagagggggagagagggagagagaaagauauuuuccacugaucuuuauauaacucacauaacauuuccagauugaauaacccucacuuauucuguugagguuuugcuuucuguugagguaauucauggguuuguuuuugaagcuggaaguccagggaugaaggaacccugggaaccagccaguaggaggcgcuccucuccacguuccgucuucaccaugcacugacacucuucuacuugcaucaccaucuugaccacggggguugggcuggugcaguucagcaucaagugcacgguggugaauuuggugggcgagcagugggagcagaagcugugggcaucugccccuucuccgggaaaacgaauggaacugcauuugccaaagcaaagguuguucuggacaacgacuuuuugacagucuucaugggcaauggucugaaaggcaaauggauuagggucaucucgagacauuucagaccacucaaggcacagacggaugauuuagaauaaagugcucuaaacucuccacuuugggacgaauuuugugauaucuaagagaugauguuuguuagggacaaggccaccacaaaaaaacuuccuuuuuacugaguuacuuaucaguuaaccucuuaaaagccuuaaguuaacaugaaaaaccucccacuaaaaacagcauacuuaaaaaaaaucuaauucuaaucuaaaguaucucaucuaauugaauauaaccaaauggagucaagaagccauaauggcagcuuucuuauuuaaccaccacaucuuaucuuucuguuacccauagugcauugcacacagcagcuucucaauaaauacugguccguuaaucagcaaagaccagagagcaggaguugaauucuguccuauuucgcuugagcugugcagcguucagcacucuaaguggcagaaucgcgaugcauacaccaccuuuaccaccuucucagaaccccauacacccagucuuaugugacucaaacucaaaauaugacucaaacuccuuaauuuuaaucuaauuagcaauagaauuuaaaaguaagaauuucaaaggaaacuugauugccugagucuuaggagcaauuuucuaauuccacaugguccagcaaaguggauauuacuugaugacugacccgucauugcuacacaggcaauugccuuagaauacugccggcuuaauugggcaguguuacuagacuguaaaauuuuagucucucccgcacuguuucugguucuguuucuucuugacgcaguuucuuuauuuuauuuuagcauuuggaaaguagguguugucaggaaggaaagagaaguagaauguuccucugucuaaucaugcagagccgaucgcuauaaauuagccagcacguguuaggacacgucaaggaaauuccugauuucauauuaagauacuuuuuaaaaaccaaugagaaacauaacuuccacucuaaaguaugguuugccaucacaaugccaagaaaugauagugagaaucucaacauagagucccugcaggaacauucuaagcaucaaauaguuuuagcaacaauuaaagaaagcucuccugaaccuguaaaguaauaagcugaguagcagagaugcaugcugggguaucccgggagauguccaaccuagccccccucaccuccaguuggauuugcuugcuuuacuaccuauccucaugaguauggagagaagcuacaggguaguucaggcaauugcucuaaauucccaguuuccaaacuggggacuuagccuugcuuuucuauauggaugauacccaccaaauauauacaaauucaacaaucuucugugccuucaauacggggacuaccgauacugagcaugcuaccaugcuagcaugaagcauuuccaucaugccaagaaacacuggagacaugaaaaauaaaugagggaaaugugcuuacauuuggccacgucccacaaugaauacccaaaggacugaaucuggaacuagacaaggcccgagcucucgccagacucuuucuauuuugccguuuguccuagcuguccagcuguccucccugucuggcaaacuggugguuuacccucuagaaugcauaccugguugaagggcacaguccugcaggucucccaguguacuucguggcuuuugaugggcaggaugacucccuggaacgccgggcccuuucugaacaugaaccgaugccagaaccucuuggcuuccuccuguagaggugaucucuccacuuuccucccaucugcuggcugagucacggccugcauccccgaugagacaugaucgcuuuccacaucccuugggggguaaaauucggucucagguuucuuccagaaucuuccaagccuggacagcaucuucccucucugccucuggccuuccccagccaggcuggugcccaugagguguggcacggccacaaacagauccggcuugucuucugccuccucgugguuggccacguggagaucucugcgaccccuuucuaggagaggaaaggauaaagagcccugacucuggcagccauccacacauaggucugccuuccccagaggcaagagaacaagcagcugaacuaagaggagaugcaugcuuccugauucccagagacugagguuagauucacagauggacgggccuaaaagagaggcucccucugc

SEQ ID NO: 1960 - RNA, 103968 nt, Mus musculus
cgcaguggauaccgcggcgccgggggcggggacagcucgguccggucgcucggggccgccugguuccuccuccacccgugcugggcugaacccagagccagaaaagagucgguucugaguucccugugggugugcggccgccgcggaggggaacauggcgcucgugggcagccgaguggaauuggacgcggacgaggugcgaggacaggcagagcgggcugguccgggcaccggcgggcaccggcgggcgugggagggaugcggagccuccgcuggcacggagggugggcagggcuguccuucacgccgaggagcgucccacggggccaggcagagcagcccgggccagccugagccuccuuggacccuaugggcuuuugcggaaccguucuggacucgacuucugugucgcuuucuguggaaguuccgcgagguguccgccgggcgggugggguacggcugucuagucaccccgggaccgagggccggagccugagccccgcggccgggaaaggucccuuguccagaaucgccggcggccucgccucucuaggcuaccgaagugaccuaccggguccucgcgcggcgccggggucugaacgcucccgggcgggggcgcccgaccuguugauuucagcgcuuccuucagcugcugcugggagcgcgcgcucugcucucaaguugagggucaggcuccugccgccgccucugcugccauuuuaccugacuugaauuuuacaagucgcggccugagaaagccuugauuuccaaugaugcaauagaugggugauguggaggaggcgagugaguuaggauucggucuuuacugccagaagauccugguaacgaguaaauacugugcuuuaaauguugacauuaagaaccgaucaaaaccccaaggaucaaucuuuaugcuacagacaguuaaggcggcgaaccagagcuuucugaggaccagccuugcggugugggcccaagaccacacaccagggaauuagcgcuugcccagggggcauggauguguugcuggaccuucuaaggacacacaaggcaaacaaugagauagaauauuuguuacuauuuucuucugugacaacuuuuauuuauagcuuuaggcagucuuuuggcauggccuguugccugcgcuuuuaaauuuuacauucguaauccagguaacacacuacuacgguacuuugaccaucuacuacuuccucaagaguuucuaacguucccucuuguguauacauuaaauagccacagucuuggcaugauggaggcuguuguacagucucaauagcuuaucccaggcuugucuccagcugcuucccuguccauaaccauuuaaucuauuuguauugaaaaugaaagaacaauccugagccuggucuguaaucucagcacucagauggcugagucaggagaaucacaaauucaaggcuaaccaggucuagacacauagaaaaaucgacuagcauggauauuuuuuuuucuuccguaauaaagaaaaaaaaaaaaaaacaaucaagacccagaguagcuccuaacuauagagugguauuucugacucuggcucacuguugaagaaaugcaagccauaacaguagauguuaaaugggauugucuuggcauauugagaugaagguuacucugucaacugccaauaaaacaaacucaagagcucaugucgaaguuagguaucagagcagcagacagccuggcacaaagacuugaauacauguuuguugagugacugcaugacugcagaaaagauaugccuccaucagaccucaguuuuugccuuauuacugauaagcucccaaugauggacaaggcacaaagggacuuuuuguuccugccaaaucuauguuuuacccucaugguggacaaguaugugggcauacguuuauccacucucuacugagugcuuaaguacucuuugcuuaaguuugcuaccuuagagagagaagguacagcuuuggaugucuaggucucccagagugccagggagagaagucauguguggacccauuuagggugaacgagcagguguacaguaggguguuguagguaugcuugaaguacuuguaaaauauuccuaauuguaaguggauuaaagaacucuaccucacuaggcagugguggcacaugccucuucaaucccagcacccagaaggcagagacaggcgaaucucuugaguucaaggucagccugguauauauagauccuguuccaggacagcuagggcucuguuacccagagaaacccugucuggggggggggggggagguguuaggggaggaagaaagaaaaaacaaaaccaaaccaaaccaagaacaaacaaaccaaaacugagcuccaccgugaguguggaagacugucagguucaccaggugugugaguagaccggagggagcuuaucccaggcuuucacacccuccagggcacuuugcuuucuuccuggccauuguuugaugcuuuugagaggugaaaagggaccgaagcauuguagcugagaagguucuaaucucguugccucacuuuuggguaugugugugggguuaauuuacggcuggccauucagacguuaaaauggcaaaccucugaucuuaggugccaagcuagugcugacugggagauccugacagaaggagccucauccacaacugacugcuaagucccucagccccugagggcuuagucagguuccugguccugaggaguuagggcuaggaacaucuuaaauguucuaguguuagggguuuuuuggggguggggugggaggguagguggggagggagaucuuuuuugaggucaugacuaauacuaugagaauacuuuucuuccuaaguacccacagaaaugauagugguggggaaacuuauaguaucucuuggguggauuuugguuuuuaaacagauuuuuaaaugauugacucuuccuuccucccucuuucuuucuuucuuucuuucuuucuuucuuucuuucuuucuuucuugguuuuuugagacaggguuucucuguguagcccuggcuggccuggaacucacucuguagaccaggcuggccucggacucagagaucuuccugccucugccucccaagugcugggauuaaaggcgugcgccaccauugcucagcuuuuuaaaugacuuaagagggggcuggagagaugacucugugauuaagagcacuggcugcucuuccggaggacccacguucaauuuuucagcacccauauggcagcucacaagugucuguaacuuucaguuccaggggauccaacagccucauacagauauacaugcagagaaaacaccagucaaugcucauuaaauaaaaauaaauuuauuuaaaauaacuguuuagauucuguaaagagaaguaugguugcauuuugucuuagucaggguuucuauuccugcacaaacaucaugaccaagaagcaagguggggaggaaaggguuuauucagcuuacacuuccacacugcuguucaucaccaaggaagucaggacuggaacucaagcaggucagaaagcaggaguugaggcagaggccauggagggauguuacuuacaggcuugcuuccccuggcuugcucagccugcucucuuauagaaccaagacuaccagcccagagauggucccacccacaaggggccuuucccccuugaucacuaauugagaaaaugccuuacaguuggaucucauggaggcauuuccucaacugaagcuccuuucucugugauaaccccagccugugucaaguugacacauaaaaccagccaguacacauuucauuuuuuuuuuagaauuauuuuauuuuuauguacauuggugauuuaauagaaaugaacaauuuguguacacaauuacacacacauauauaugaauugcauuucaaauugaaagucauucaguaaauacaguuauuaaguuacuaauagcuguaaaauuuggauuuaacauuuacaguuuuaguuauuuugaacucauuauugaguaggaaaauuaagccauuuauauucucuuacacaauacauacauguuauuaaaauuuuaugggcaggugcaaauaggaaagcaucuaaaagagcgacuuaaggaagugauaaugaaaacaaaaaccuuacaaaacacugaaucaugugaagaaauggcuuaggaugauuuuuauggccuguucgggauguuuuuuuuacagauggagucuugcuauguauugugacuggguaggaacuugacuuuauagacuaggcuggccucaaacucccacauacugccucugccuucucaguauugggaugacuggcgugugacucugaucagcccgaugacauuuuaguacaacugauugccacaauuguuuuagaaugagacugggacucauugaaggagcuaguuaguguccuagaagagcucacggcuuaguaaaugaugaguaguuacccaaguaaccagucugccugggggucagguaggauucuauaauguaggcucuagagcaaggguaguaagacuggggugcauucaguacagggaguagggagugcuggccacccuagcuuagggacuaguuuagaguuaaagaagagguauauuggggugaucuaggauccagcuugggugaaaguugguguggacuggauuagagugaacaucuugggaguugauacagcaaaaggcagguucagaucccaggaggccugcagugccaugauacuaaggagucuggauucugucuuauaaauaauagguuuucauggcuggagagauggcucaaugguuaagagcacugacugcucuucaaauugaauuucugaguucaauucccagcaaccacaugguggcucacaaccaucugugauggggucugaugcccucuucuggugugucuaaagagagcaaugauaaauacauaaaaauaaguaaaucuuuuuuuuuuaaaguagguuuuuaauuaggcaaguguuuguuaguagcaccacacuccccugcagcagcuccagggucccuuaaucuuucagggaccuuaacucagggaaacucaggauucuuggcuuugacauagaaaagaguuuugaggugagccagugugaaacagagauggguuuuaucuaaaguagaaggaccgugggaacugcugcucagagaggagucacagcuuaguaaaagauuuuuuaaccuagacuuuuaaguguggggauuaagagaaaaacgaguuacuuucaagagguugcaaagaagccccuccucuccuggcuuuauagaugacaccgggcugucucuggagauaccuuggauggaacuguaaucugagaagguaaacccaggaguuacugggagcacacagggacugacacuuucuucuucccuucccuucccuucccuucccuucccuucccuucccuucccuucccuucccuucccuucccuucccuucuauccucccccuccccucuuucauuccccccccuuuuuuuuuuccugagacaaggucucacucacuauauagcuuugacuaccuuggaacuuguuauguagaccagguugauccccaacucauagaaauccaccugucaggcuggagagauggcucagugguugagagcaccgacuguucuuccauaggaccugaguuaauuaauuaauuaauuaauugauuaauuuuuguuuuguugagacaugguuucucuguguguagaccuggcuggaacaccuggaacaccugccucugucuccugagugcugggacuaaaggcgugcgccaccaccaccugacccacaccucuuuuuauuauaaauaguuuuugguuagauuucuagaaaauggcaagugaacagucauuggaaggagaaaggccugaagcaaaugcuaguccugcggaguucuugguuuucaagcaaugccaggcuuugauucaaccacacuccaaagcgaagccucccuuuccuucccaggucucccuacuuuucuguccuuuucagauugugggguuggaggcaggaggggcagagucuguuuccacagcuccuguggcuugggcugaguccugaaguagaacaggggugugguguuggagggggugaggcugacucucagggccuauccaggagagcaagggggagggccuggcuuggggcagaggugugggagaaggauggcuaugcagugguaauucugguucccuuuccacucagguggguggagauggggcaugcaugcgagcagaagaaaggcccauccccauuccuauugggugggugcuuauguggggaaggaagggggggggaggggguugucuguaaacugguaaugcagcugaguggaaggagacagccccagcugcuaucagcccagcucagguuaacaagucaccucccaucacugagaugcuggguguagaaugucuuuuggaauccuagcuagucguggauuguagcuuucucagcagaacuuuccuuggugucccccaccccuccacagacuugggcaccucccuccccucuuuucacugcuuacaugggcagguggcaucucuccagguggugucugccuucuugguucucugccuugggucuauugcuaauugucuauagcaagaaucugauacugugacucccaagagacucuuguguuuccaucuuucggucuauggacaguuaguuccccugaccugccccucuggggcccaguagugcaucuugacuggagucacauucacuaccacaccucacuaccacaccucaauugagguucaggcccagaggaagacaggaggagaaaacccuuuguuagcagcucuguuaaaacuccuucuccaucccugggcucaaugagucuggguucccucacacuucaccagauuucugugccacuguggccagacagccauguuggugaagucaucauagcucucggaagggacucgaggugugggauccuugggagcuccuaaugcuaucguaagccuuaaacucuuuacuuaaauaccuaaagauccuguaguauguguguguguguguguguguguguguguguguguguguauauagccaaugcuuucucgauguguucaccuuggccuugaucauauacuggcacuuguauagggccuacguauuuaaauuaucucuguaaaugaugcccuuuguauguuaauugggucguaugguaacuaauaaguggugcagucuugucuugggugggaagagcuagggaugggaaacuccuccucucuaggcggggcucuggagggugggacuggguguggcaggaugccagguggcacuggggacagagaaagaggguaucucacugggagaagggugaaguuuuucauuuacaggaugaauaaagguuaacaggguuuggugugaagggaguucaguauggacggucagcagggugugguuuugaagguguguccugucccagaggaaagggaggucaggacuuggauuccagacugagaccuugggaagggcagugacuuagaguucuugcuccuuaauccuuugggccuugguuauuuuggggguggggguggggguuggaucuuaauggguagcaagcaguuugaaaugcaugccgugucuauaaauucuuuccaguuuuugacaucugucaucuagaaggugacauuugaacaagacuucuucagagguucagagguggaauuuuaguagacagugugggagcucagaucccacaggcguggugaaaaugaagccauaguuggugugugucugucugugacagagagcacuggagaacuggcagagauuggcuagauuuugguaggccuuagccagcuuagcugagguuuuuguuguuguugcuguuuuuuuuuuuucccccuuccccaaguggaaagauaugugagccuuucugcaucugaggauuuuugccuuuuuaggggcagaguauauggggcuuuuuaguuuaguuuaguuuuuuuuuuuuuuuuuuuuuuuuuuuuuuugagacagggugucccuguauagcccuggcugccccagaacucuggaacucacuccauagaccaggcuggccuugaacugggauauccaccagccugugccagugcugggguuaaaggcauucaccaccacaccuauguggggccuuuuauguuuguuuugagucagcacuccgguagauacuguuagccuucuacagcguuauuacagaauguguuuucuugcaccaagacauuaacugaagauucuuuauaaaauccagagacagucagcagugguggcggcaccucagagcagaaguguaaggaauuaaagagcaggcuagcacuguaagagcacucugagcagucgagugguuuauccuuagugaaugcaggguucugggauauacucagaacucaguacuucagcaauguacccaaggucucacaccagggaggacagucccagagcccagcugcugcuccaugcugucggaagccagcgcugcucacacggaugccagcagggcucagucacugagcagcuggcagacuugucugcgcugaguggucuguggguuucuaggcagggcuuugagaucagaccucacugucuucuuccaggacuccuuccuuccuuccuagucagccucaucuugcuuaccgugugagaaucugaggguaguuuccugggugcucagugaccgagucaguggggggaaaggagaaauguuucuuggcuggcccgccugccaaugcagcagggacucuucuggcucugucccagagacuaaggaucaggugacgaaacagccagagcacuuccucagaugugguaguccuugcucacuaacuacccccagguaguaguccugggcuguggauuguaccuaggaaaugggauggaggacugggaaaaugaaaguaaaggagacagcgguugcuuccuguuuucaaaacaaaacccgaagggcagugcaggagggggaaggagguccccagugucaaaggagccuuugcucaugcaggagcacacaucucuagugccagcuacucugagggccuugaggugggagcauccuuugugcccaggaaccccaggcuagguuagccugggcagcagagugagucccuguacaucuuagaaagcuaaaggaagugguugguuggugaaaggucacagcguuguuggaggcuaagaggguucauucuaaauucagugccuuuugaaauaggucagggaccugugaacucucuggaaggccuaaugcaggccacguuagccaccccugucuugucuauuuuguaaguaaaguuuuauggaaauacaaccauggccauuugucuagauacugucuguagcuacuuuugcacuauacgugaguagcagggacaugggucaugugguagucaguacuuaaggacucguagguccucugguggcccuugcacugggugaucucuagggcuauaguuuauucauauaugaauauuguggggccuaugaaagauuugcuuccuuccuucccuauuagauauuaugaaccuuguuaaagcuagucuguuugccacuuccugugaaguggcgugugcaaagcuggaggcgggugaaagcaggguuugaauuccugcuucuuguacagcauuggguaaguuacuuaaucucucugugucuucaucuuaaggacaaacaguucauccugccuaguaagauugcugugacgguguacagucuaagcagagccccaguguuggggcauuggugcuggcuccuggugcugucauccagagcagcucuuagucauuguucucccagacccugcauggcaguccuccacuggagggagucccuuaggacaaggcaguuuccuauuagguuaauucccaggacuccagcuggauaaauggugcagauuuauaguccguaagcuuuucuaagggagaaaaaugaacucaaagggccauccaucuguucuagcuuguccgccacggacuaguguuagcauuuguccacgggggagguggcauucauucuuccacugacgcugacggauugauggugguguaaccucugguugcucuggaccuuguguuuguguagccccacuuuccauugguggaagucuguguucuuacgggguuuucaugcagcaaacguguaagggacuaggaugugggaaaggcguguuuauguaugcuuacugucucccacuguuagugagacaguaaccucuggagcgaagagauucccuucuuacaguucuagagucugagacugaagaucgagaugucacaucuggugaggaccuuccugcuguggcuuaacauggccuauggcaucauguagggaaagaacauagagggggagagaaagcgugaacucacuugaaccaauuuucucauguuuuuuuuuuuuuuuuuuagauuuauuuauuauuauauguaaguacacuguagcugucuucauuauauguaaguacacuguagcuguccucagacacaccagaagagggcaucagaucucauuacggguggcugugagccaccaugugguugcugggauuugaacuucggaccuucggaagagcagucgggugcucuuacccacugagccaucacaccagccccaauuuucucauguuuuaaaccacgcaggguuuugaacucagggccucauguaugcaaggcaagcacaccacauaccaacuaagccacauccucagacuaauaacccugucuuacaaugccaggaaguaacccucuccaacauuaacccaucauuaguugacauuaauccauucaugaggguuuuguucuugucuuaguguuccauugcugugaagagacaccaugaccaaagcaaccuaugaaaggaagcauuuaacugggagcuugcuuacugcuuuagaggguuaaucugcaggcucgagguggagggagaggugggggaccuggcaugggccuugaaaccugaucagagcccaccuccagugacacacucccuccaacaaggcugccuccuaauccuucccaaauagcuccacuaacuggggaccaagcacucaaauaugagccuguggaggccauuuucauucaaaccagcaguccugaauuuguaaucacuuccuaaagcucugucucucaaggcaauuugaguagagacuaagcuuccagcggcuggcucuggagagccaucuccaucgguggcgguuacuguauaagaggguaaaggagcuaggugacaguguguaaggacuccugggcacuggagggcaguuuggguccuugcucugcucuaaagccacacaucaagcuagacuguacuuucuaaaauggaaguccguucucaccuacuuccuaaaaucuugucugggcuucuuauugccuuugagguaaaagcauguggucauuuugucaugguggcucagugguucucacacuugaaucugcuuaaagucuccuugcugggggagcagguggcuuguuaagaugggcauccuuggguuuuccuaccagugagucuaaugcagugugucuggugcaaguccuaggugcuuggguugcugcgugguggacuucuugcuucagccuuuccagagugcuuauugcuccaugucucaugccccaaggggccuuccucaaguccaccuguuuccuuugcaguucccacacagguuaaggagucuuucaucccuggucaaucccugcagaugcuagcccucucacagcuuccccugcuggcccauagccauguagcagucuuggcugcuccaaaagagaaagauucucccuuugacccacuuguugggaggcccagccugcacgagauggagguguccugggguucggccggaacugaggucuuucuucccaauuccuaacagcaugguguauccucucagccaggaaagagaaauuuccuuccuagagucagacuuuucuguugcugugauaaaaauacccgacagacagacagacaccuuaagggaggaaggauuugcuugguuagcuguuugagaaggucauucucuugucauuuggcuuugggucucagggccuccucuagugagggaggcacauguuauggccgagggaaaguguugcagucuccuggggucuagaaugguggaucgcucccagcagcauccccggucacgucuccuucuucuaauuuucacugccuccccauaacaucuucuuugucugacuccguaaaggaucgacccauugauuaggucagauccauaggauccaaaugcuucccaaaugcucagcagccagaagccaagcccugaaaagcgaggcuguggagacauuucgcauuuaaacccuaauaccugagugaccaucagcgucagcucagugcacgcguucuuaacccacauucaccagacaggccugcagucucagcacucgggaggggagacaggaggauaaaguguucaagucauccucagcuaccacacaguuuaaggacagccuggguuacaugagaacaagcaaacccgccguccguccauccaccuagcuuucuugagcugugauuuacacaccauaaacuuggcuccuucccucccuccucaugguguagaaaucugaccugacuuccccagcgguagcucacuccuuuuuaugucccucugcuugcugugugccaugcuggugcuucagucagugucaggcguuggcaccgacuugacugcacuccuggguaggacgcaggcguuagucuugcugucuguauaagggcucuccugugguggugaaaauuguguagaguggaauaggcaguaguuagcaguacuggaaacaguacugcagcuagccacguugaccauguuggccucccauauucauuugcugguaguaauuuuaagaugugcuuugaggaggaaagguuuuugauuuuaaacuuaaagguaguaauggucccuuuggaaagcuggcucaugcugguuaauuuauaccgguuaggucggcugggaagagggaagaaagugucaguuaagaaaacugccuccgcuagauuguucuguacgaaagucuggggugcauuuuccugauuaaugauugaaaugggagugcccagcccacugggggccgugccacuccugagcaggugguucuggguuguauaugaaagcaggcugagcaagccucgaauggucuuggcuucaguuccugcuucgacgucgcucagugaugggccauuaccucaaagcuaacauaaagccguuccuucucucuggguuagucaguguuuuaucaaugccuuugagguaaagcauggucaucaagccagggaagccagggaaaggccugcuaaguccuuuccuaacucacagagcuugacuccuggguagguacggagcagucacaggacgcgcccgacugcuuuggcacagugaagcuguuagaggcgcugugaauccccagccacuccagccgaucucauaucagucacacacauggauugcuugccaugaauuuucaagguagacugaaggaaaagagacuuucccauuucuccugucauucuucagucugaguaugaagucagucugcacugggguuguauuguacuaggauggacauuuaagaauugcuauuucaguugauggcuuuaguuucuuuuuuuuuuuuuuuuuuuuaaaaaacuuacuuauuuaugcucuaucagcauguacaccugcaugccagaggaaggcaucagaucuuaggauagauggauggaugugagcccuaggugcuugcugggaauugaacucagggccucuggaagagcagacagcacucuuaaccucugagccaaugacuguuguaaaaucaaaauauuuaacucugaaaaaugcugaagcuguuuaguacccugcaguaucaaaucuucaggcaacauuuaauucuuuauagaaagauaaacagauccuccuuacucgugugaaaauucguuuuuuaagugugugaguguucugucugaauguaugccugaugcccuuagaguccagaagagcuuccgaucccuuggaacuggaguuuuaguugguugugagccaccgugugggugcuggguauugaaccuggguccuuugcaagaggaacaacucuucuuaaugcugagccacucuccaggccccucgucuguaacacauaggaaaaggagagguaugcuaaagaguugucuuuaaacacauuuuaaaaaauuauuuauuaucaauuuuuuuuuuguuuuuguuuuuuucaagacaggguuucucuguauagcccaggcuguccuggaacuuacuuuguagaccuagcuggccucgaacucagaaaucugccugccucugggauuaaaggugugcgccaccacaccuggcuauuuauugucaauuaauguuuaauuuauauuccuauuuugcauaccuguccauuugacguugcauaaucauuucuugggcaaaaagaggucagagaaaauuuaagaagucucccauuugaaagcccacaagcccaguugucuguauaucacaugacaguagguuagaugugacuauuuuaagguuguuuaaagaacucuuguccauguaugugcugaagacuacaaagcccuggcuuucaggggaggucacuggagacugucauccauuuguaaucuucugaagcaaacaaaaggcuuugcagauggauuuaaaauagcacugcauccccaaaggccuggcgucggacuucauccucccuucccaccucagucacccuuucucugccgucagccacggcuguggagucuagcuccaucuuggucuccuuugcucucacuguggccuccauguaagacccuauacaacggucuuccacggcgccacccccgggagagcacccuguagguguccuugccucuucuuugaccucugugaucugcucgggguucuguguccccaccgaucuuucucagacacugauuacauguuucuucuccucaguguacagacuugcaguggcuguccauaguaauuagaagaaaaccacucuccuugugaccaaauaguugagcuuuuugccucccuccagcugugucuugccuucucugccgauuuugccucucagugccaaguuauucucuaccauagagcucuuguguauguguuuccugucuggcugacucacuggucaccaguuccugaacuucccaaacucaccacagaggucaaauuuccaaagagacugugcuggcuaguuuuacgucaacaugggcacaaagcuagagucaucagagaggagggagccucaguugaggaaaugucuucaugagauccagcuauaggcaaggcuguagggcauuuucguaauuagugauugaaggcccacuucuuugugggugguaacaccccugggcugguggcccuggguucucuaagaaagcaagcugaguaagccauggggagcaaaccagcaagcagcauccuccaugaccucugcaucagcuccugccucuagguuccuggccuguuuguguuccuguccugauuuucuucaaugauugacuauaauguagaaguguaaaccaaauagaccauuuccucuccaacuuuccuuuugguuaugguguuugaucacagcagugaucacccuaacuaagacagcuuagcuuagcuuggcuccuauccgggccuuuacugcagagccuuuuugcuuucuccuagcuguggguauuaucugcacaaucuuguuuguuuauauccuuuuuuguuaucugucuucuaucuaauuuucauugcaggaaacagcaguugcuguaggcaguuuaaagaggaaaucagguccuuggaaggacuauagaguguuugaucuaggcuccuguucauguaugacccccgaguccuaucuagaaaugacccacuuagggaagacccuggugcucugggcucuugucaguucgcucuccaucgcuguuacuuaagggaggaaauguuuguuuugguuuccuucuguggucagcuggccccaugccagacagaacauuccagugggaagguguacuggagcaacgcugcugcucuaguggagaccaggaagagagaaagagagaagacagacagguuccaauauccccuccaagggcacguucccuucaaagcucuuacaggccccgccacagcucaguaguuaguacguaagcacuagcacacugccagcgaggaccaaaacuucaacccaggagccucccucugggucuauuuaagguaaaccaugacuagggcuaagccuucauggcgcucuguguucugaaggagccuguguuuguuuuguuuuauuuuguuuucacuguuuacucuggcuagccuagacacuuaggguccuccuucuccuaguccccacuguaugcaugcacuggugaaucugagcaggcggaaccuaaucuacacccaggcauuuggaggaguugagagauuagguaauggcuaaguggugaagucagcuucagacagcagcaaaccaaacacacugcuaaagucccuuugagaguguacauuggugugucagcuaugagagccgggacugggcgaauaaaguaaagauacaccucagagucacaggguagcaauucugacccaggaauuauuuucauuuuuucccuuuuuuuauuagauauuuucuucauuuacauuuuaaaugcuaucccaaaaguccucuauuaccccuccccccccccccauucccuuguacuggggcauaucaagggccuauccucccauugauggccaacuaggccauccucugcuacauaugcagcuagagacacaagcucuggaggggggggggguacugguuaguucauauuguuguuccuccuauaggguugucgaccccuuuagcuccuuggguacuuucucuagcuucuuccugacccaggaauucuuguagcaaacuagcaccaagcguuagaauuuucucaagagggaagguugugagaauuuacaaguuaucuggaccguauuugggacaguuuggguaucacaaugguuauaauacccuagguguauuguagaacauugaaaacagucggggucuuugagucuaugcugauggcagauaaacaaacagcuugcugagguagaauacgcgaggcaggcugacggaggccuugcugcugccuguguuaggaggcuguugcuagauugcuucaggagccugcuaugguggcugaugguugccugggaucucagagcuuuagaggccaagucaggauggcacuguccuaggugcugagucuaggggcucacuugccugaugagugugguagucuugugagcucaugugcuugucugcaaacacacuuuuuacauuaauaaguuaacuaauaaguuaguuagaucaucgugcgcguauuugaggaagucagaggacagugggagucaguucuguucuuucaccaucuggauuccacugguuacacucagaucugcagguguggugcggagcacccuuagcuguugagccaucuugcuggcccucaccuuaaacaucuuaguaacugccaaacagaaauagucacagugcaguggagaaacgggcugcuguguuaggugauuacaaucaacaccacuggagggacagaugcccugagaaggauauuggaccccugcuguagugggguaguaucuacucauauaaaccucagagucacagggccagaguuucgacccaggaauuuguauggugagcaagcaccaagcguuagaauuuucucaagagggaagguuguaagaauuuacaaguuaucugggccauauuugggacaguuugaguaccacaaugguuaaggacacuaaguugauuauagaacauugaaaucaguuggggucuuuggguucaugcugaugaaagacucacugucuugugagucuuuagugcugcaugcuguaaagaggagagaagaauaggaaguugacaggaagauaaugguauaaacauuccagguuaaugaaggcaggggaggugugacagcugagugcaguagcaggcgcuagcccagagucuguacugcagaauuaaaaagugcugcggagacggggcagcugacacauggcaugaaguguagucuaacuuagagaaccaggcugccuaagagguaaacacaggcugcgguauguagaccacacugacccagaagcgcgucacaccuuacaguccgaugccuuagaaaaauaaacuguguggauagcuagacagcaagcaagggaaggagguguugggagagaaggaagagcaggucaugaaaccggaguggcaaaguggcaaagacaggagaauuugucuaaguggcacacaggcaugcugugcuaguaaccuggcgacuaguaugucaguuugcaguucuuuccaaauaauguuuuuuuuuuuuuuuuuuuuauguuuguugguuuguuuuuguuuuaaguugccagaaugaaaaggaacagagugagugucaguguucuuuggcuuuacugugcccgugugugcuggagcugcuucuuaaagaaacagcguuccuuuuuauaguauccagauuguucaugcucugugucagagauauaggcaugcuuguuguaagcuuuaaaccauucagaaguuaacaugaucuuucucuuuaccauucauuccugccuaugucagaaggaacccacugugccuccuauuaucauucauuaccauacucacggguccgccuuagggauauagaaugccgugcugucucguccagaacugggacuuacacuuaauaugucuuagaaauaguucuacucuuauuuuuuauguaacaacugaagagaacugagugacaucauagugccauaguuuaucuguggaagaucacuugaucuguuuucuuuuauauuuuaauuucuauugacuauuugggauucucacaguucucccaguccuccccugucugcacucucccauuaagcuccaccccagucaaaaaaaaaaaaaaagggaaaaaaguuccuuuuguguuguucauauacuuacucccuggagcaugaucagauccccagagaggaugagucuuucucugccugcaucaguaccagaagccauggacugaggagagccaugggcagccagagagggacagggcuagcucucccaccccacacucccgagcuaacucgcuugaucugcuuuccccccuaagacuauguaugcuaacagagggauccuuauguaugaauauuuuuauuuuacacacgcacacccuugugugugugcacauaugcaugcucaugugggcaccuucaugcuauggcaugauuguggaggucagaggacaacuuacuggaaucucuuuaccauauggggccugggaauugaacucagaauuggcagcaaauaaccuuuacccacugagccauauuuuaauaguauggaauugaaauauuauuauuauuuuuuuaaagauuuauuuauuuauuuuaugcauaugaauauaccaccauugcucuauucagauauaccagaagagggaaucagaccccaucacagaugguugugagccaccaugugguugcugggaauugaacucaagaccucuggaagagcagucagugcucuuaacugcugagccauuucuccugccugaguugacacaauauugcggugugaacucuguuccuuuuaauuuaaaaauacuccuaucagugauaguuucaaaaucagauaguuuaaaacacuaagucuuuugguucugcuuguucucuguguaaaauuauucccgagacccccacucccaaacaaagaguaggcccucgccuucugugaacuucuggguagguauggcacuggaagacagggguguggauauaauaaguaauuugcaagguuuacuuuacagucauaaagacauuagccaagccggguggugguggcacaugccuuuuaucaggucacugaguuugaggccuguuuggucuacaugagggaguuccaggacagccaaagcuauacacaaagaaaccuugucucgaaaaacaaaacaagggcuggugagauggcucaguggguaagagcacccgacugcucuuccguagguccagaguucaaaucccagcaaccacaugguggcucacaaccaucuguaacgagaucugauucccucuucuggagugucugaagacagcuacaauguacuuacauauaauaaauaaauaaaucuuaaaaaaaaaaaaaaaagaaaaacaaaacaaaacaaagauuuagccaaguaauaucaaugaaaaugaaauaauuugcucaucuaugcuaaauaaauccaguauauacagcuguaaaagaguugccuuuucaaaugcacuuuauuaucuucuaugcacugcagugcacaucuuuuagaauaucuuuucuacacccucugacaauuuauaugcagccauaguggcucuugaucaccuccccucccaaauguagagcacauuucauguccauacauacucacugcucuguggagucacgcuaugugcuguuuggcaaccuagaguauuuguuuuguaguaauuuugauugugggugauuaguuuauuuuuuauuuuaaaggucuuagaacuucucccuuaugcuacagcuucuccucauacgguuagcuuucacuuuuaaaaacacugaucuguggguaaugggagcuaacggcuugagguuaagcuuuucuugagagcgacaccuggugguugguuuauaaucucuucccuuccccgugcuugcaggaaauuccgaagaaucuuucugugaacagcucccuuucuugguagacacaacagccgcuaugcaggcucagguuggugccacugaagcccacacacucccagaagccuggagauuugauugcauguucaaggaggcucuuuuuauuuuuuuaauuuuuaauuuuuuaaauuugauguaauucaaagaguuuaugacuuugaccgugugccagccucucugcuuuacucuugaggaggcuggauccuaaaaagauugcaugugucagucaaggucacacugcucacuggcggccugagguccugugacucugugcucaggaguuaggcuuuccaugcugaagucaacuguggauuuuuuuuuuucuucucuguuccaggagaggcucagagucuuggguaggaugagggguucuagcucugucuucaggagucagcugacucaucucauuucugaggaugaauaucccaugucccuguauugguggagccuguucugagucaggccuguucucuaugcacugcgucgccaaaauccucacaggacuucugggaaugggaugagauucccggcauagcaacaggaaauggaggauuaaagggcuagacuugcuucaggucaggguucacaccgagacaggccuaucucccaagcuaacuuguauuuucuccaugcucuacugacaaaagaaguaagucauuaaugcauaauuacuuauagugcucagagacaaaccugcccccauggguguuagagcaugugacccauaaauuuuccacagagcccuguaggaggcugggagguuggguggguggggcucaugccaucacguugugauuaccccaguaggcacccagugcccucggcucucuguagguauuguaacuguccaccaauguucccagguuacaaaugcuaacacugggauggguggaaaggguuugcuacagcgaaggaaaagggaaaaggaggggcuaagacuguguggaccuuucuauccugaagugauggaccucggugugguggcaccgcacuugacacacaccuuccuccagggucauuaggaccuccaagccaccguccaaagggccgcucuguacgcucaucaagugccagcuccgugccguggacaggcagcacgguuucucacgugugagagggaaaggcauuuuuuguccuuugacuucguuuuaaaaaaugaagaucuucacgauauugugagugagucaugucuaggcugcuucagugacugaaucaucugaauagaaugcagcucaucagaaugaagcuuaggaaaaaugaacucauuugauugagacagggucucucugcagagcccuggcugucuguucucgcuauguagaccagguuggcuugggacuuagagauccaacugccucugccuccugagugcugggauuaaaugcauacgccaccacgucuguccaugguuccuccaauucacggaagugcucaauugaaucauucccacagggaugacuuaaccuacaaucccaggcuuucauaucuguggguuuaaaaaacuguauguuauuuguaaaaaugaagcuuuaagccucaaaaggcuuucgcccaaugcuuguagucacagcacuuaggagagugaagggaugggccuggugggcagguccuuugagcuccaggguuccagaucugccuagacaaugcagugaaagguugucugaaggaaacaaacaaagaagccagacauaguggcuuuuaauuucugaguuugaagcuagccuggucugcacaguaaaauuuuaggucagccagggugaaaccuugucuaaaauucaaaccaagccaauuccacagaacuuccauagguaacaagagagcacuuuccggaggguaacuagagaacaaagcaguaaggucaccuuugaagaaugugugaaauuauauucaguuaaaaauagccaaggcagccucugucuucaguuagugauguuacuguuacacgauuagaacucuguuuuaaagagcguuuugguguuuugagguaggucuuugcagcccauuuaggccuugaaucuucagucuuccuaccucagucucuugagugcuaggauuagaaaugucugccaacacaugugaauuuaaaauugucugaagcccauuuuauuaaccgaaagaucacccccccacacacacacacaaaugaaaguuggauuuaaagaccuugguuagagaucaacugugcugcgccuuuuucuucguuuucuuccuguuagucugcucuaauugagacguuuguagcccuugagaccuggagaagguuguguuuuguuuuguuuuuuuuuuuuuuuuuuuuuuuuguauuuuuuuuuccauuuuuuauuagguauuuagcucauuuacauuuccaaugcuauaccaaaagucccccuuacccacccacccccacuccccuacccacccacucccccccgguuguguuuuguuaacugccagaccuagcaguaguuaccgguggggaucuggagguggucucugcagaauuagcuuuuauagcuucugacgaagagccccgugguucaguuuagguucacauaggacuugcuuugauuuucuuuuucuuuuauuuauuuucugagacagaauuuugcgauguaggucugacugaccuaaaacucgauuauauaauaauguucuuacauuagauaauagaauuuaagaugacucagaagaaaagcagagaacaguuuuguugaaguuugagagggaaaacaaacaaacaaaaacaaacagcaaaaaacagggcaggcaggcugccagucgggaguagguggguaagaagaaagucaagccguuugaauuaaggccagagaagcugggaagcuggcaggcauuaauggaagaauagaguugcuguguguguucagagagugggaugccuagagcaucagucaagcugauuuaggaucuuuggcugguaucuggaaaggagacggaaggaagaagcuaugguugugagauagaacuuggagccucaggcaggcuuagugagcaguggacggcuguuguagccaccuagagacaugcuacuugcucugaaaguacacaccucacugagaggacagcuguuacucccauuaaaaaaagcuuuuuuuuaaaaggcuuauuuuuauuuauguaucucucuggguccauggugcccacagaggcucuaagaggguguuggaacaguuggagccggaguuacaggugguugugagcucccugaugcugaugcugagaacagaacucagguccucggcaggaguggcaccgaaggaugcuccugacagcugagcaucucuccgacuccacagucaucuuuuaauaucuuuuaggaguauuggacagauugccaagugauggauagacccacauggguuaggccuucaagggaaggagaaauaguauuucuuugugaccuuauacuaccugggugguaugcugccacccaggcuagagguacaacucaggucccauucuuuucagcaaaagucacagaacagagcugauuaaagcgaaugaaagcagaacaaaaggaaauauaggcauggguuaccaggaggaguggucuucucuucguaggcguccacuugccucauaccuccauugccguugucacuguguugcuguguaugaguccagccagugccggggugugugucagggcagggugccagagaacaacuucagaguuuuuuuucucuccugucuuuuguggguucuggggauugaacccaaguugugaggcuugugugguaagcucagucgggguccuaccccaccaguuaccagcugccagucccugguguuucugaccuuaaugcaaggcagugcguuuccugcuuucacaugguauuuuauuuuuauuuuuuauuuuuuuaaaagauuuauuuauuuauuauauguaaguacacuguagcugucuucagacacuccagaagagggucucaggucucauuacagaugguugugagccaccaugugguugcugggauuugaacucuggaccuucguaagaacagucgggugcucuuacccacugagccaucucaccagccccucacaugguauuuuaaaucccaaggacugcaacugugauauuuucuccuucuuauaauuaguuauuugcuagguaaacaaggaagaugauuauagauuauaaguauuguggacgaaauaagucaguugaugagaaauuauaaguugcuauucuuggugacuuuaauuagugugaucaaaguccuaaccuugaggaaaugacauucggugguaaaaccaagugguggggaucagccugggccggagagggccacacugcugggagacacacaugagcauggcguguuagaggagcagaaaagaaagcucuguggcugaagaggaaugggugaggggcaggcuggaggugugcuucgaggcagguggacaggacuuucaugacugcggcaaggagcugggccagggcaaaggagcuagaguagggcaggggugugugcgucuacugaaagggaaaagaggguggauggcucgauggaagaaagagagcacauguguguggucuguaugugucugaguguggaguguguugugcaugugagauagggagggggagaggaaggagggagggaaggagagagagaauaugaauauucuggcuaguuuucuuuucuuuuucuuuuuuuuuuaaagauuuauuuauuauuuuauguaugugaguacaccaucacugucuucagacacaccagaagaaucccauugcagauaguugugagccgucaugugguugcugggaauugaacucaugaccucuggaagagcagucaguggucuucacugcugagccaucucuuuagcccugagcauuuucuuaauuagugauugauggaggagggcccagcccauuguaagugguauuaucccugggguggugguccuggguucaauaagaaagcaggcugagcaagccauggggagcaagccaguaggcagcaccccuccacggccacugugucagcuccugcuuccuaguuccuggcuugugugaguuccuguccugauuuccuucagugaugaacagcagaaaagaaggcucuguggcugaagaggaaugggucacuauacggaagugucagcugaauaauccauuuccucuccaaguugcuuuggucaugguguuuuaucacagcgauagugacccuaacuaggacagaagaugcugaugccuuugagcaggcuacuggcaugcagcacagcaugguggugggcuaagccuagcucgggaccauaggauugguugguagguuugagauaaaggcgggagaaagugaagacugaugugggcauguccugcuacucuugggguguucucugucggggugaaugaaacggagcagugaaagcugcucaggcugaauucucugccgcaguagaagcagaaggaaaucgugcuucgauucacagagcucuucuguggguguauuccacuaggauuguuacugcccgccccauccuuucccaccccacucccuaauucguagacucauccuuuuucuccauucuugagaaacucacuguauguuuucuucuuuuccaggauaucuuugaagaugccuuggagaccaucucuagguaagucauaacauaauaaaaaaagugaagccgggcagugguuguccaugcccuuaaucccugcacucgcagaggcagguggaucucugaguucaaggucagccuggucuacauagggaguuccuggacagaaagggcuacauagagaaagcuucucuagauaaacaaaaacaaaaaacaaacaaaacugugggucauagugagaagcuggugauucuuguguauaaaaugucaguauuucauucucaguguuuugagcguaguggccacugucuggaaaacaucacaagucuauaacgaaaacguuaggauguaauuacacuuaggaucuaccaaacauucucaaccauguuuaauucuugcauuguuaaauaaaagaaugcucuccagcaaauuacuuuguuuauagccaauguucuaagcauuuguccauauuauuuacgcgauuagcuuuauuauagaguguugcuuuuccuuaguauuuaauuuuaagccugagugguuuuguaauaauuuaagaugacugaauaguauuagaucaaguagguuacuguagcuagcuaccacuccauuguuagauucaagcuguuaccagucuuaauuuuuaaaaaaaguuuuguagcuaggaggucguggcacaggauauuaguccuagcgcuugggaggcagaggcagacgaaucucugaguuugagguuagccuggucuacauacggauugaguuccaggauggccaggguugcacggagaaacugucuuaaaaagccaaacaaacacgaaaaccccuccaguguuaaagaggacacugaauccucuggaacuggaguuagggauaguuuugaguggcaguguggguguugggaguugaaucugggucuucugcaagagcaacaagcgcucuuaaccacagagccaucuuuccagcacuagaaaagguuuaagagauguauguuuucauauauauaacuuuguaacauguuugaguuguuuauguuugauuguuuggaaauaauuaagaacuuggcuauaggauuguugguuuaaaaggggugaauggauauguuuauugcucuuuacauauccugaaaugccagucugugguaauuagcuugagcuucguaacagaauguaauauagcccacugcauggcuuaagcaacagaaacuuacagucucgguguuuugaaccuugggagucugagauaaaggugccagcgugacuggguucuagugaggccacgcugucucccacuuguacagguuugucuugcucugucuucacaugauggagcacuguucuugggagucaccagucucauugugagugccucacuccuuugaacuugaaccaucucccaucuuaacucuuaccacacggagggugaggccuucccugggagaggacacauacuucagucccuagcacuuucaaaaaaguuucuucuguuuaugugguaccaguccuacgugagugaugcaggcuucaggaucaccaccccagagugugacccaaagauuagucacacuguccugguuagagaguugcuauuacugucaugaaacaccaugagcaacgcaacuuguaggggaaaggguuuauuucagcuaagguccauuacugagggaggucaggacaggaacucaaaugcagcaggaaccuugaggcaggaacugacccaggacauggagggaugcuugcuuacugccuugcuccccauagcuugcucugccugcuuucuuauagaacccaggacgaccugcccagggauggcaccacccacagugggcugggcccucccccaucaaucacuaauuaagaaaaugccuuauaggcuugucuacagccuaguacuauggaggcguuuucucaguugagguuucccccuuuuagaugacucuagcuucugccagguggaccuaaaguuugccaucauccauccuuuaaugauaccuguuuagugcuugaguauaagacauuuacgugccuuguuugaaucuguuuacuuuuguugucauuacuguuuagagacagagccuugucugggccuggcuggccucuaaaucuuggucuuucugucucauccucuugagugcugggauuacaggcauuuccaccaacuuggacaucuauuauguucuuauggaucuucaguuauaugcauccuaaucuuccauuugcuauagugugcuuaauacuuuuguguuggaacuguaaauguuuauuuuguccacagguuuuaauguuuucuuuuuuuuuuuuuuguuguuguuguugauugcccaugagucuaaaacacaaacaaaaacaaaagaacagaaaaagccacguuuucauuaggaauggcuucagauuugaggauuuccugugaaaggagcaaagagagcucccgugcacccugcacuggcuucccuuaucagucauuuauuaaccgcugcauuauauuucucacacugaguaacauggaccaugcuagaauuccaaucgggaguguucccuacacggcuuaugaugugggcauuguccucagccugguucucuugccaagaacugggaaauuuuaagagcuggggcacaguaaguaggcuucaggucauuggcaguauacugaugaaggaaauuaggggacuccaaccucccccuuucguuuuugccucccaucuccuuugcccugcacuucugcccagauguacugcuuugccacagaccucaaggugaugagguugaccagcugugaaguaagccugaaaagugugagcccaaauacccuuuccuuaucugaagccgccugagugucagcauuuguuacagcagcaggaagccaauacugaucacuuaugcuaacugcggucuguccauuguucuuauuuauucagauuucacuuagggucccuucuuucucuuaucaucccaacuaucauaccaugcuguauuuagacagcguuucuccuuaggcuauucuaguacugucugucuaaucuaaucuaaucuaaucuaaucuaaucuaaucuaaucuauuuuugagaaaagaucucaccauguagucuuggcuggucugaugaaaaguaguggcacguggacuauauuguuugaguaaauuuaaauuauucaugaguuuugugauuggcauggcaugaggaggcaagcuuuuagggcgauauggucagucagaccaucucauaacuuguagagaucugcuauguguguuacacacagcuccccacgagcucucuugugagauucuauuucuugguugaaccauuugacauguguuccaugguucacucacgacaagccauucuuucccagucugugcacauacucuuauggugguacaugaaauaguuuguucauaaaugaccuugacacagcauaggaagaguaccaaaaaugcuuugaacugggaauguggcccaguugagaagaguaugcuuaggacauguaaagccuugaguuuuauccucacagucaguaaacugagaguggugaugcaaauuuguaauuccaguacucaagaagauuaaguucaagaucauccguggccacguagcaagcuugaggcuagccugggcuacaugaaaagcuaucuuggaaaaaaaaaagucuuugguucuagagagaugguugugaauagggacauuugccaccuaacaguggguguagaaaagacaugggacuguugccacagugcuguugaauggcugcagacuccuggggcugaguaguaggggaugggcuaggcauuugggagucucucccuuugacaguuuggauugacucuucuucauaaccacaguggacaaugggacagucaucuuuccucuuuucaccguaguuagaaagagucuagggggacacagcacauuugucuucagacuguuagagcgguugugggauuaauguguuuucagcaauggcuuccucucugguaagaguugaauuaacccugauguaggaguuuauagguguuuaaugggaucccgaggaugcaggaauggugauggaugugucgauacacagagcuucugagaguuagccaugcuuggagaaggugaaauagguagguguguuuagccaggugauuaggaacuuacaauggaaauaaauauuuuguggacaucuuuccuuucucacaccugaucuuuucaacuauaauuuguagaugaguaugcaauaauguaaagccauucuccccucauuugguggcaauguguuauuuuaucuaucuuaagguuuuuuuuuuuguuuuuguuuuuuuucuuuuucuuuucuuuuuuuuuaauuagguauuuuccucauuuacauuuccaaugcuaucccaaaagucccccauacccucccucccaccccccuacccacccacucccacuuuuuggcccuggcguuccccuguauuggggcauauaaaguuugcaaguccaaugggccucucuuuccagugauggccgacuaggccaucuuuugauacauaugcaccuagagacaagaacucugggguacugguuaguucauaauguuguuccaccuauaggguugcaguucccuuuagcuccuuggguaguuucucuagcuccuccauuggggacccugugguccauccaauagcugacugugagcaucuacuucuguguuugcuaggccccggcguagucucacuagagacagcuauaucaggguccaaucagcacaaucuugcuagugugugcaauggugucagcguuuggaggcugauuaugggauggaucccuggauauggcagccucuagaugguccauccuuuugugucuaucuuaagguuuuaaggguaaaauguuggcaaauaacuguuagaaaguauuuaauauuuuuuccuguugguuugguucgucagacacuccuucagugauagugaccuuucagugguaucugcaaaaguaagcagugacuggaccgcacacagaguucagacaaagggaccaggcucccacggugccuuuaguuacccuguggguccaacagacaagcaaaagcccgugucucuugaucucuacauggggaagaggcaaacccaucaaaugcacauuaucuuguaaggggcaguguggugguuugaauaugcuuggcccaugggaaguaucacuauuaggagguguggccuuguuggaggaaguguguuaccauguaggugggcuuugaguauuguccuaugcuuuuaagcucugcccagugcagaagagagucucuuuauggcugccuauggaucaagauauagaacucuuagcuucuucuccagcaccacgacagccuggugcugccaugcuuuuugccaugaugauaauggacugaaccucugaacuguaauccagccccaguuaaauguuguccuuuauaaaugcugcauuggucuuggagugucuucucagcaaugaaacccuaacuaagucaggaaguaaggccauccaugagaguggaguccuuacgaccuaauugccuccccugaagcccagcuugcuacccuggcaucugaggauuaagcuucaacagaggaauuuuggagguucacagauacucaugcccuguugagaaaauauaccaaaagagaauauaaggauuugcacauauuuaaaaaacuccagccaagagauaguuaaguuguuaaaaaaguaaacugcucuuccagaggaccugguuugcuucccagccuccacauagcagcucaggaucuucuuuaacuuccgugccaagugcucuaaagcccucuuggcuucucaccagacauacaugaagcaaaacacuugugcauguaaaaguaaaaaaauuccugccagcacugugcacuuacacaggauaccugcugugauuguucaaagacugaugaaagaggucuuuaaaauauaugcuucuucacaaaaugacucgugacuggcuauguuugucagcucacauagauaauccaacagugcucaacuuaaugaugcaaacacuacccagugcuaaaggaauuacuucugccauuucucauucauugguggacucaguuuuuauuugagcuuuauguaaauugccagcucuuugcuggcagguccagacaagagaagucuuggucccaccagggcucuccagggcugagugauauggcaagugucuacagcccaaaagaaacacaccaagccgggagucuuguugaagcaggaacucgacucuauggcaucagccucucgcuuauauaaguuuggauuuuuggugggguaacaugacguaggagguggggaagggugauggaggguauggaaugacugacagggccacuggcaaagcuuuaccucagcaauggcagggcagaggaaggggcaaacaggucuuacugagucacccugauaagggaagugauugagacuggucuuaaaacucgagccagacucggguugguccucaagacccaaaccagggccaaaauggggcccaacauaaauggccugccaauuaaguguuagaugaguccauugccuuuuaacuuccacugucuucuggcugccuuuuccccugucaugccaucuguuuucuuuucuaccuuugauaaaacugucaccuaaaaugacuaauaaaacauuuaaaagcagauacuugagaauuucauccuuugaaaugugugucucucucucuauuuugagaguuaaucagugccucucuaacucuuccucuuccgccuucuucucucauugagcucaucgaauggcaucuauagaacuccucaaaggcuuagacauccuggaccgagcgacauuuuacugagugcaauuuaguauuguguaucaugcacauuuaauaagucacuaacaaauuaggaagcgguggcaggggacuuacauggcuuucauuauugugcagucauuuccgagcuguguguuuuauuuuguuguucagaacggauguguaggacagcaguucuuagcugucaucagaacguucugaccuugccugcauugcugauggaugcccuuccaguguugugucccacgaaugccagguagaagcuuuggauaucuaucuacucaggcggccucaccugugccuuugaguacuuaacaaaaaguucugcgggucagcccuccccuccguuaagggucagcccucccauccguuaagggauuauuuggcauuuaaaaacugugggccaaucuaaaaggaaauauguccagaagaaugugugauuuggugugauuuuugugagaaaguuaaauccuugcuuagcuguuugaagugacaccugugcuuucauuguggccuuuuguggcaucaguacagugcuaucauuuacagacagguugauccuauauuuucaacagaacuuauucacuaaaaaguacauggaugcuuuccacuuaauuccguguaaguaagaauacauacgccuuuacccuaugaaguaacugaauuguaaguauuuuguuaacuuagauauaaaacaagcuucacagauaaaugccagucaacguucaauagauaucuagaaaauacugcugguuuuuuuuuuuuuuugggggggggguggugguggugguugagacagcguuucucuguguagcccuggcuauccuggaacucacucuguagaccaggcuggccucgaacucagaaauccgccugccucugccucugccuccggagugcugggauuaaaggugugugccacuacgcccggcuugcuguuuuuauagaacccuuauaccacccaagaugugagauauucugauuauuuucaugcagcugcauaauggcuuuaacauuaaaaaacuguuuuuauaaaagaaaaaaaaaucuucuacauuuaacagacaagagaaaagaacucuaauuugcauauuuccccauuucugagauguaccccaucagaccauggguaagcgaauaccugcuuugcauggugggggugcuggugccaccuuccugauccuccuccuccugcuccugcuccuccuccuccugcugcuccuccuccuccuccuccugcugcuccugcuccuccuccuccuccugcuccuccuccugcuccuccuccugcuccuccuccuccugcgaauaccugcuuugcauggugggggugcuggugccaccuuccugcuccuccuccuccugcuccugcuccuccuccuccugcugcuccuccuccuccuccuccugcugcuccugcuccuccuccuccuccugcuccugcuccuccuccuccugcugcuccugcuccuccugcuccuccuccugcuccuccuccuccuccugcuccuccuccuccuccugcuccugcuccuccugcugcuccuccuccugcuccuccuucuccugcuccuccuccuccuccugcuccugcugcuccuccugcugcuccuccuccugcuccuccucuuuucccauacuaauuuuaugaauuugcaagacgcucuaaacuuaacagacaucuuuugagcacauucucuacauccuagagccuuaagcuaguuuggggaccaaagcugguuguaaauggauaaaaauucuaggaagucucuaagcuucccuguugggggaaggaccggcacuagugccacugggcuccugucaggccaucucacucagcggucccucugccugccauuucucuguggggaggggggggcaaauuccucucaauaccgugcaaugcaccacucaccucauggucagccaucacaucacccaauuacccgguagaauuaaaacucuuaagcuuauaguuaaccaguuagauuuauguaucaauaauaucacaacuuacaaguugccuauacaauaauuucagagccaauugauaaugauaaaugcuuuaucccaauuaaucuaaccuuacaaaaccacaacuacuuguggcugguaaaugccacacagguucaugugcgcaggcaucuuccuucucucuccccucucuccccugagacgcucucugucucuucaacucuuagcucugccucccuuuucccuguccaacacaggccuccucuacgcuaauguaauuggacagggaaaauucugcaacacuucccaacacuuuauuuuuguugugugcuaaaauucauaccaagugaacuuacagaagaguuuuuuguuuuuuguuuuuuuguuuuuguuuuuuuugguacucuuccaaaggggaaguccacaauaguguaaaaggcauggcaacuguaguuguuagcuggcuggucauagcuucaaacacaagcagaaagaaaagagagugaacuggaaguggggagaggccguaggcucugaaagcacaccagaacccuaauuucuucaaacagcaccgcgagcuggugacuuucucccucaaaccaccacguccucccugacauccuccuccaaccuggccccugugucagcacuacuggggcgaaggugcaaacacacaugcggguggguggcuuuuauaccagagaagaaguacuggaagucuacuguauaaacauuaugaguaaacaggcaaacgauucuguacucauuggguaaagaaguaugcuuuaugucugccgcuugccaccauccugaggaaacacuuauauaagggaaaggaaaacugaaggcugggacugcaucucagugauggagagcuuaccuagcugucuuagucaggcuuuuuauuccugcacaaacaucaggaccaagaagcaaguuggguaggaaaggguuuauuuggcuuacacuuccaugcugcuguucaucaccaaggaacucaggacuggaacucaagcaggucagggagcaggagcugaugcagaggccauggagggauguuccuuacuggcuugcuuccccuggcuugcucagcuugcucucuuauaaaaccaagacuaccagcccagggauggcaccacccacaaggggccuuucccccuugaucucuaauugagaaaaugccuuacaguuguaucucauggaggcauuuccucaacugaagcuccuuucucugugauaacuccagcugugucaaguugacacaaaacuagccaguacaccuagcgcuugugcagggcucuggguuugauuucuaguguuuucucucucccugccccacccccauuccacccccccuccacacccacccccgccacagagccauguaaaaaacuccauuuuaaguuaucacaccuuccaguguucuuaaucuuuaaccuucuucagcuucugggcaugucaguugaagaugcuuagaaaccuguggucucuggcugcuuaaaagauuucuggaguuauguacauagccuaccucuuguaauuuuauaauuguuauauucuaauugauuaaauguauagcaguuuauacacauaccaguucucacauacauuauauuuaaaauauauacaaaauauaguuaaaaucuacauuuaaguuuugguggagauaaagaaauauuaguugaaagacauuaauaaugaugacaagccaaggcgugaauuacacuguacugagagcuuugcgguuggauugcuaugugccaccccuccccacauguucaucuucacaagagcaggucucugauguguuccuugcugucuguaguucauuuugauagcacaguauugauuacaucuggugacuauauauagcuucuccuauguauagaauuccagaagaguaguaguuguauuugcuccacucaucacacuauuuagcccauaguagguauacaaauauagcaacugucauuauguguacuaacucuagugagcauuuuuagaaaucugggugguugggccagcaagguggcccagcagauaaaggugcuugaugcaaagccuggcuaccuugaucucagucuuggaccccccauggcaggaaagagcgaacucuuaaaggcuguccccaggucuucauaugugcugugguacuuguguguuccucuuccccaacaaauaauaaacagcuguaaaagaguaaaaagaaguacagcugguuagacguaggucacacauaugggcaaguaguuuuauuuuuuaugaagagaugcuguguaucuagggagaaaggaagcuugaccagauauagaaagcugauucugagaacaggucaugacagcugggagacucacaaagccccucccuaaaguuguauaagcagaaaacaguugguggaagaagagacagaggugccuauagguuggccaggacacuguagacacagucccuccugaguucucacccacacuggguagaacuguuaggggugacuuaccuuggagucuucugugagugaccccagugaacucauucagucaucaagcaagacuuggcucgagugguuucuuuguuuuguccucaguuucuuaccugggaugacauuuguucacgugaucccaggaaaagccaugagcaugaagauaauacauugcauggagagcaaauauaaaagaugaaaaaacagaauuguuaagucccguccauaugacaggaaacagcgaauauucuaaguuacaaaguguuggcgguaacuaucucuggguuaugggguuguauaugguuuuaaucuuuuucuaguuauuauuuauaauguggaaacaccagcuuauuuuacuugauaguaacuuuuuucuuuacugagucagugucuuauauagccuagauuguccuggaauucaucauguagcugagacuggaaaauccugauucuucugcccccaccuccccaguuagggauuacaggcaugugauaccacauccagauacuacuuuuauuaucagaaacaauaauggguccuauaagaagacacuuucagcucuguugugagcugagcccuugcuagauggcacuaaguuuuagcuucagaaucuugcuuaguuaggcucucuggaguagaguucuuuaaagaugauguuuuugguuuuggauuagccaaauccacuucaagaacugggcuugauaagguguaucuauauuagccuagaauuugggaagaggaggcagaaggauccugaguucaggauagccugggcuacagagcuagaguccaugucaacaaucaaaacucaaagauagugcucgcuucggcagcacauauacuaaaauuggaacgauacagaaaagauuagcauggccccugcacaaggaugacacacaaauuugugaaguguuccauauuuuuaagaagcgggaguggguggguaggggagcagggcggggggaggguauaggggauuuuugggauagcauuugaaguguaaaugaagaaaauagcuaauaagaaauugaaaaaaaaaaaaacccucaaagauaaagcaacagcaaccaaaaaaccacaacucuaaacccaagcacacuugaaauaauauuuauuagaugccaaucugaaauugaccuuuccagcaaccuugaucuaacugccaugugauugguguuggccacugaaauaucagacaagacugaaaacuauagagaagcugauuuuuccuuauucugugccccucaauugucuuuuaagaaaguccauggguagaaaauguaaaucaugucugggaauaacaaccuguucucacauuuuucuuaaaguaauucaugcuacuucuugauagauggagaaaugccuagguuaggugagaaaucccugaagauccuacgguuuuuuuuuaauaagcccaguccaucuguaccugccuugccagcucuucuaggauaauuaaacagugauggauuaggacuaggcuguggcagggauugggaaaaaaaaaaucucccagcaucccuuccugcggaagcagccgccacaguagugaguguagcugccacugucacugacaggucuuaaauucaccccugcagugcgccgggagccuggcugaugccgguaacuucucugccaggucuggccauugaaagucucucgagacuggggaacgaaacagacguugaagguuucuguugguuuuacauuaaggaaggacuccucuuuuuaguugguuuuaaaaagagcugguaggagagagagccauccucacaguggaacccgguucuuuccucugaaguuacagcugccguaaacccgugaguaugcuguauuuauuuaguaguuccagggggacaugauugcaagguccucucuaagucugugaggauuuauuuaaggaaagcuuuggggaaauaaauuaaagaguucuguuucauuagagaccuucagguuuuguuagaugacauuguccucuuagcagcuuccugccaggcuugccgggucuucccacgcccccucccuuuuugacucuucccgagggcgagagcuguaauugcagaaagccgcaugcacgccugugucugugcgccugccugagccgcagaggcuguggucucucccggugcccuggcgggcugaccauggcuggcugacggcugcugcaaggugugcccuggggcucccgagacucccacugcagaacaauggcagcaggaggaggcucacuuguguuugucuuagguccucugcugccuucuucuuagcauuuuaucuugcuauguuaauuaaggcuuuaaagaugaauaaagugauguucauucagaaauagcuugugcccuuuauccuagaccuucagcuccuccugggugauauuggcuucagcuagucuucucagcagaucagagcgacugugagcccccagaaagugagcucugccucacggcauuuuuaaguugugcacuggaaucacugcugacucguguguccgugugacgcagauccugaacucagaacaucuguccugagucaucgugccccacuuucccccucuggaauucaccagagugcagcuguuugcuggauuggugaacgcacccugagaagccuguuaggacagagguugacuugggauuccucuugugaccucacauguucuugauugggcuuugugaacugauuaauaucaguuggccauugauauccuuucuguauccuaaaaccacacuaaagugguuuuuagaagagagguuggcagucaaaauacuuuuaaacaccaacugguagcagucaucuuuguacauguaguaugccugacuuaggcugacauaauauaggagcuuucagaaugccaguauuugguugauuuccugcagacuaaaaauaaauacaggauuauuaaaaaaaaaaagaaaaagaaaaaaaucccugccaccuagagaucaaacaucugcuguuuuuauuuuuaaacaguuugucauaccuaaaugcagcaacuugaauuuaauuaggaaggguugcuaaauuuaggacacucugucuuuaaacuagcaaagagcauucauucauucauucauucauucauucacaaauguuaacauuuguugcaaagcuuuuuuucaagcucuggggagaugaggcugaagaaaacauuguauuuggauuccuggaauagacguuuuaaguagauaaaggaggugguuaaaaacuauuuaccaaguuauuucauuagagcuguggugagcuuuucagcuauguaaaacuacaggcuaccuuuaugagcagcuuuauauggaacacauaaaugcuugaaacuugugcugccucagaucuuuugucauggagucuuugaguucuuagcuggagagguauguuagaaauauuuccauuaguucaaugagcaugcacuaggcaugguaagagcagaguuuagaugagaaagaacugguuucugcuuugccugguccacuggggaagggagggagacugguuaucauguacauucugugccaccguuuuccugucuuaggggagucauagaacuagacucuucuucaaaagacuucugggccaggccacuacuucuccucucuuuuccucuaccacucucuuuccuucucuucuucuucuuuuuauuuuuuuguuuuuugagacaggguuucucuguauaguccuggcuguccuggaacucacucuguagaccaggcuggccucaaacuuagaaaucugccugccucugccucccaagcucuggguuuaaagggaugcgccaccacgcccggcucuuuccuucucuuuuuacuuuacuguccuguccugucacaaaagagaaaauugacucagguuaaagcacagggccauuucagauugcugauuguaaugaccaagucaugcccauugccuggggucaucagagugcugauuguaauggcacaaacuccuugagugauugcauugugucuuccagcuggagguugauuggggcgagucucccccaguuaacccuccucugguauaaguuucagugugcugcuggguaucauaaaucauaaaaaggaagaagugauuauuuccuuuggcgccaagcccagaucuucuaucauuugcacucgcuuuccucuugcucgcuuccaucuucaccuccuuuuagagaggcaaaggcuguguauagacagacugagcuucaguggugggccagggaaagaccugcaagagguucauccgagaaaagaaacggccuugggaagaagcuaacauuucuugcacuuccuguucagauugcugucaaguccagauagcugucaaccuuagcagagcucccagggucccacagcagugugucagcuccugcaugcaguaaugaggcagagugacuucaguagacacauucuagcagguuucccuugaccugccacaguuucuagauggcgccacugcuucuuggugggaacugugacaaagaacugggaacccaugggaucuguuaacaccacacucccugaguaaguccccuuugugcuuccagcuuugucaccuuaaacccagcagcuuuggcugaccuggggcuguucacccagcugcuggacaguucuuaguuuaugcguuaacaguuugcgagcagaguuagcucucuuaaagcuguuugagccuugauugcugugcccauccuaggaauugcccacccucuggcuguacccauguguuugcugccucugcacugaaggcaugagcacguuggccaggccacuguggguguuggagaccccucucuaggcuaacacucugacaucaaccuaacugccauguggccuuugugagagguggcaagugcugcucuaaggcagacuucgugccuagcauguggauuugugcacauuucacacauggauuccucuucuuuugauauuucaucaguccacagguguggacaguccuuagagaccauucaaguggcacugauggguuucuuuagugauuauguagauuaguguacuauagaauguuauuugaaaucauacagguggccgcacuucagaagaagaagaacauggggcuaagacuugaauuucaccugugguuggggcuguggucauuaucuuuuuagacagagaguacggcagaacuugagccucucaauuauccacaaaccaggaccuaacacaaaacauuuaccugcuguucaccuccaaaauagcuuaggguuucucuuuucucuucuuuucuuuucuuuucuuuucuuuucuuuucuuuucuuuucuuucccuuucccuuucccuuucccuuucccuuucccuuucccuuucccuuucccuuucccuuucccuuucccuuucccuuucccuuucccuucccuucccuuccuucaucccucccuccuccccccucuuuuugccccucuuucuuugcaguagcaccaguuguggaagccauugcaucugguggcuuuguaucacaagcugaaauaaauauagccuaucaucagcuaggagagcauaaaugcuggugcuugauuucuuaagcauuuaugaagcccuccuuccacgcagacacagccacagcaucccugcacuaauacagucccgugcucacuucauaaacugcucaccacaacucaaauaaccagucagagagcagagacgcagacagucugagaaaauggcuuuuuuguggccguuguuuucgcucccucucuuggacuaggagguggaugaaagaaaaccuugucuucgcaauuguuuaaagauaucuagcuauucuucguuucaguugggggcuucuuuucuuuuuuuuuuucuaaagugcucaguuucuuuccaguuaucgucacaccgaaaaccugcauuugcucugcacccugcaaauauuugcuuccgugcugggaggcguauuguaauuggccaaacacugcuuuuagcugucccaggacuacuggaaacauuagacagaacugcugaguagcaggaaugcccuggucuguguaaugggaagcucuugguucuccucaucuuaaguggcccaguagcaucaccaccgauuacagccccuugcgcuuauuuauguggugucucaguuuaaaaggugguuuuacaaauggagcggcuccauuagacugagcugggaauuguucuuuccugcucuugcugaggccuaccaucaaaacugaugacacaccuaggggagcaauccaguuuugcccuguuucucucuacgccaccuccucugucccugggguacucuggugagaaagagaugaaguaaauuuauugcugggagggaggaggauuuucuuccuguuugccuuucaguuaagagaugagcaguggggccugggaagacggaguaggagcugcgcacaucuccggcagaccugccgcccucuuguaguuuauuuggaauaacacaggaaauuugauuugcucugccuaaggacagaaguugcaaacgucuagauuucugcucuugggagcuugcagcgucuucaggcaaggaaaacagcacuccuuggggaauaguguccuuucaggucugagcugguuuauaagcuaggugaagaugaacucuuauucuccccaaaugguuuggcuuugcuguaaagcccccauucccaccaggaacagagaacaaaccgacguggagcuggcguugcuaaguugacuuuccuauugccaguacccucuuuuggaagggugcuggcuuugggaguggugagggagagucauuggcaagugaccugaaacucugcagcggcggcugugucuagcuccuucucuccuuccagggagaagcugcaagugauugggaggagcccugccuggcugggaguugccauccugccuucccaccagcuucuagccugccuggggggggggggggaugauuguggaggguaguuguugguaccuguggggcgugugaguggacccggccuugauccuggggaguuauaguucucucuugauauugguuggcccacaagaaccccggaugcuaaagcuauuuccacuuugucacuaagcuagccugaaaauagccucauuuuuguaguaauuccagacagagagggaacgugcaguagccaaaugaagagccaaugaauaugcuuaaucuaguuucaguauguacuuuuuauuuucucuauaagcuggguaugguggcacacaucugucgucaucucagccuuugggagguugaggcaggaggauugcaagcuuaaagcugguuugggcuauaugaaacucugucucaaaaaaaggugguggugguggugguguuauauacuccuugugagucauucgagagugggugcugcagacgggcggugggagucuucccagugaacaaggcuguuucugugcuuccguguccucagcuuucugccugugcuuccaucucgcucugaaguuaacuuuauguccuugagaaccagccuugagugccugcccuggcuggcugauggcugucgauugacuuucccacaguuggcuuuaacagugagugugucgagguugggggguagaccaggguggcuggucugcugaggggagggugggcaacccuucaguuguccccugguuccuuuacccagucggcguaaugcuaaaugaagguucccccuugcaaagcccagggauaacugcugagacacuggcuuucuucaagauguuugcugucccuggaagagcuuguuauuuaggaguuggcucacuuuguuccuccuggaugcuccauccgacucgaugaauacaacuuaaguggugucaguuagcauucugccacguucaucagcacuucacuaccauguugcuaagccacaucucuccuaaaauuuaguuuauuacugucaugcaugugugugagaugugugugagugcaggugcaaacgugccacaguguguguguguguguguguguguguguguguguguggucaugggcagagaacaacuuuugggaguggguacucacucuccuuccaccuuuauuuaggcuccagagauggcuaguacaccacuguuuauugucccuccagggcucguuccuucuguaaagaguaggucucccguugagcugggucccugggaagaucugugauccccacugccugggaggcugaggcuggaagaagacggagaacucaaggccugccugggcaauuuagugaaaccugucuuggaauagaagugaaaaggagguggaaacauagcucagugggagagugcucagcgcagcccaguccccagcacaagcaaacaggguuagagcauagaucgguuucagcaaaggcagacaacaggaaaaaaccagguugaagguacauuuauaaaucugaaaacaguugagauguuuaaaaaugaacuauuuuaguuuaauucuuaaaauaguaauggagcauguuauaauggaggagauaaaaaaaggccgaauuagaaaaagaccacagagguuuaagaacuuugccacauuaguggaaaauugaaauuuuucugaaugaccuaaaaugaugugggaaaaacauuagguagagaaacucuggcuuccuaggaagggcuacaggaaggcuacaggcaaggcuacaggcaaggcuacaggaaggcuacaggccauacauagauggccuggccugauuuuagcuaggaagggcuacaggcaaggcuacaggccauacauagauggccuggccugauuuuagcuccauuugagcugugugcggugugcaugggguguugagaguuucucuccuuaaacuaauacuugaaugucucucuagugcuuggagucuaaguauuccuucacuugauuaugaaaacaauacaugacuaugucugaaaauuugcaacacuggggacaggaacaaagaauaggaacccugccugccacauccuagagaugacagugaugaguuugguuuugguuugugaacuuugguaguaagucuagagaagggugucuuggaccacucuacugcugucauaucuaauauuuccuuauuucaggauaaaacaaggaucuuuuuuuuuuuaucaccccauggcucugucaguuuuauuuccuauaaggaguuggggugagaaggaggggaaguugggaugguauucuucugacccugguggcuguggugauaggcaggugagugguggugggugcugaagggaaagcgcuguugauugacauucugaguucuggcuguuugucuucccuuuacucccacccuccuccaccgagcaucuuuguuucagacuuaaaggaaaagauuuauuuuuauuuguauauauucucugugucugugguguaagcguagcuguagacuguacuuuaugcauaaaaacuugaucuauugcaauuguaucucccaaagaauugacccaaagaccuauuacauuuauuaacaagcugcaagucuaggcugggcagauucugagcuauucuaauccucuaaggcuguuaauaucagacaaaugcccuguuacuugccaaucugguuuugcccugccucgcucugguccaugugugcccucgugucugcucucucauugcaaucucauggcgaauccuccagggucucuccacggggucucuucaccucuccuccugguccuuuuacuuuuuucuccgugggaccccuggcugggauuggaaguccagcuuuccuauuuccucugcccagcuaauuggccaaucaacucuugacugcccagucagaaggugauagagaaggauguuuacaaaacacugagacaggugaugccucacaaaaauaacuaucaaagacuggucuguacucaauucucugucuguauauaaaucagcauuugaauaaugcaaggguaaucuuuacacaguacacaaaagcaucauuccaacuugcacaggggcuagcaaggaccaguagaggaugucauauucccuggagcuggaguuacggcaguugugaaccgccucuggauucugagaauguaacuugaguuccuggaaaagcagcaagugccuuuaacagcugaguugucucucuagccccucuuuuugauuaaaaaacauuuuauuuaguugugugcuguacguauguccaucacgcuugcuauagcaugugucggggucugaggauaacuguuggaagucaguuuucuacuuucacuggguagauucuggggauccaauucugguuaucaggccuguggcaagugucuuuaccuacugaguccucugauauuuuuugagagucucaugaggcccaggcuaccauuaauucaccauguagcagugacugugcuaacucccgaugucccugugucugucccccaagcaccaggguuacagcugugugccaccacaccuggcuugccucuuucuuucucauccuccuugugagaaucuuucucucucauugaucacuggccgugagcuuggcuccuggaagaacucgucuauugggcugcuacacuuuauugguuagcguuuaaaauuauauacccacuuuggaaaaaaauugguggcaauucuucagugucaaauguggaauuaucauaugaccuagucuaucauagucacguaaaacuuacaugugagcauuaauaacagcaaucuccaugauguacaaaaagcaaaaugucccauguguuaugaacaaaugaaaugauaaccaaauugggcauaucucuccaguggcauauuccauaguauuacauaugguagaguguugcucccuguuccauacagcaugaaugaaucuuggaaacaugggaaguggaaaaagccaaccauugaaaacaucuacagaugcaaaagacucugguuugcuuagaacuagaggucacgaggguuauggagcaugguggcaagugggggguaccuuugugugaugggauguuguuauauuggggugauaguuggauggaugccuuugggaauuauauaucaaaaucuauuuaaagcauuuuuuaaaaacuaaaguguucaaaacaaugcaauauaaagacauauuuuccuuauauacgaauaccuguaguugucacugucaaucaaaugagugguuuuuuuuuucucuccaauauuugaaaacauucuuuacuacuugaguauagugguguuucagauuuaaaaaaagaagcacucagguaaauauuaaaacuugugcuacuugugguggcacaaauuuuaaaguuauggagcaacauaaaguuuaguguuguucuuuuaaauacauggauaucagcacaguguuuauauacugcuaaccuauauugaaggaaauaagcaaagccuugaauaagucaugagcuuagguagccaauucauauagagaaagcggggcagcagacagacauguaucguggugguagcucguguuaggaggaagggcacaccagacuuguuccuuuuguaacauuguucauggaagcucaaagguuguaguugaacuaccugacuaccuggcuaccugaucagauucucccacaggaucuaccucccaaggguccacugucuccuacuuggagcaggucuuuuaaucacaguggacuugggagagggcagagcagacgggaacauagauguaaaaaugcaauaguacaaagaacauuuuucagauuucgguaauaauauaaugaaaucugaauaaaaaaaguccagcaagaccuuuuguguaacuuuauaauuauggcuguuacaaucacauaaaugggaaugacaguauaauacaaagauccccaaaugccaguugaggaagcagaggacucacuucugcuugucuccgcuuagcagaaagcugaggugaugucaaguguguaaccugcagagagaauggaugugugcaacggaaguguguccaggaccagguggaaugcaugggaacuugcucucaguuagggguugcagcauggugcagcauuguccacaaauaacugcagcauccauguguggaugaucauccaggugauaaagggccucccaaagcacuugggaaacugaagacaaaaugucgagauaagauuuauuaaacacaaaccguuuuauuuguuuuaucaccagcccagggauuaaaccauagcacguucggacauucguauaucuauuggaguaaaauagcugcaaacuagugucaagguuuuaaaaagauguacuuauuuaugcauaugaaugcuuugccugcguguacauguaggcacugugugugugcccuuugugagccugguguucacaggggucaaaagagggcauuggguccucugggaacuggagcuguggguggcugugagcucgaaccuggaucuucucuaagagcaacaggcuaacugcugagucaucucuuccagcaccaaugucacauuuucuagaauauaaucuuaauagaaagugaccagucaagcaaaggcaagcagaucucuggaggaugaguuccugugugccugccaguguuuaaggaucuugagaggacuucagucuuccuuuuaucugguuucugagcuaacaaauggcugaaggaugagcuauugauugccuaucuuuggaggaacggaggaauugggggcgagaauugaauguagcucacacuguacccaaaaccacauucuagauauaauguaugugagcugugcuauauuuucuccacuguacauuugaaacauuucuagcauugggggaagaaaagggaggaaauagguucuugaugcuuuuugaugaagaaugccaugccaugccuagaacgaugagugggaggcaggauucugcacugucagcacccacagcccaguuucuuuccugauucuccgaggcccuccuguuacgucauugacauccuucugagaaggcaguauaugcugacuacucugcccaguaaccuuucuacagagcauuagaagaaaccacagaggggaaguuggaagagagccgauaaggggcuguguugggcaccggauguggggaaacaaaggggacgggggaaauucacgucccgcccgagcucggggagaauggacaggcagacgagggagacucaugggacccuacggaauugcugcaggaugggcgucgggccguagaccccguucuggguggguagagugggguugggggaaggcgcagucuuggcuacggcucucgggcaccauagaccaagagccagcuucagggucccugggccaaauggaggccacagacaacagguuuucagucuuggacaucccaggugcggcuggaugucgcugaagggcugagaacgaagugggggccccuggggcagcuaggucagccccagggcugaagggagaaggggcaggggaaaggugcugggugguuucugggugggcgagagucuggcuagcucaggcugcucgcucugugggcauggcuagagcacaggaaggccugcuccauugcuccagcccgguggauccugaugagaagaggcaguccaugguuucaagguguuuauugcagagagagggagaaguguagagaaauagaagcuggccauggccacaaggagagaggggagaagaggggggaagaaggagggugaaaggugagaguaagagcaagugcuuaagagagacaagagagagaggaggggccaagcagccccuuuuauagugggcugggcuaccuugcuguugcaggguaacuguggggaggagcauacuuggcuauauagacuacaugacugauagccacagaauuaaggagcuggguccucgugucaggagccuaugucugggagcauggcaaacaggccuucugucccuuccagauuaaucugcuggguuugaaccuagcucgaccagaaagcaggcugccuuucacggucccacagagcuguagguagaacuaugccugcuggccuuaagaaugaauuuuggcucuugucaaaaaggugauguggcccuugguggcaugcuaugaccagaucccugaaguagccaugcagaaggggagauggucagacacgcauaccuuucuauugauguuuguauuugaaauguguuacagaacucacauccuaaacuagagaaacaacugauccugagcaaauacugcugaaaaagugcagguuguaguaucauaggccuguugugauguuaauguaaaauuuaaaacauagacuuucugggacuuuuaguguguauaaaagcauaaagggugagaaggauguaauuuaaguauuuguaaccagacccaggucuggcugcucaccuacacuuaggaaauaagaggccggugggaaggaauuuguuuuauugaagaacugguauucagggccuggcaugggagcauacaccugcaaugcuggcacucagaaggcugagggcaagcaagguuuguuuucagugucagucuggcuauagacaaaacuuuucucuuacaaaaaaccaaacaaaccagcaaacaaacagugggacuggagagguaguuuacugguuaagagcacugguuacccuuucagagggaccugaguuggauucucaacacccacacagcagcucauaaccaucugaaacuccagacucagaaaacucagauauucacucuggcuuucuggaucaccaggcucucacacgugauacccaugcagccagaacagccaugcacguuaaaacugcaacaaacccagcagccuaagaggguggguagcuguugccucagggcuccaucuuauaaauguaauaauuauuucaauaacguucuaauaaaauauguauagcuuuacuuggggaaaaaaguucugagccaugcuugguggcucauaucuguaaucucagcccuugggaagucgaagccagaagauuguugugaguagagacagacccuaacaaaaaacaaaacaaaacaaaacaaaacgcuggaagacuauacauauaguaaucugggcuaagcagugacgcacucacggucccagcauuugguacauagagucaggaggacguggcaauuugagaccacccugauucacauaggaguuccaggccagccaggacuauguugccagacucugccuguuccugcccucuuccucaagggggguggggggaggaaaaaauuaaagaaaagggauacaaaagaugaaggcuguggguuaguaguuuuaaccuauaggucauguuuccuuugaguggauugcauaucagauauccugcauuucagauauuuacauuaugauucauaucaguagcaaaauuacagauacgaaguagcaacuaaauaauuuuaugguuuggggggccgucaccacaauaugaggaacuguauuacagagucacagcauuuggaggguugagaaauauugcugugggugauuuuaauauuuauguauguuaaaacauaaggaaaguugguaagucucccagugguuuuauuucagaaauguuuaacacaaaauagaauugcguuacuugcuuuccaaacugaaguagaggugagccauacgaaaugauugacgcauguguguuguacucucauguuugugcagcccuuucucacagaucaaagaacuaaaaccccucacugguuucaauccacagaucuccaucggacauggccaccagcggcuuucacuuuguaccaugcgagaccaaacggaccuccagacagcuuggagcaucugcuaugggaagaccugaaggguauguggggacuguuggguacucucaagagacuagaacaccagugaggugggggugggccuaggcaguuauggaguccuuuggcaaguuagagaagaagaugcacgccagggggcuuggugguauaguaacagcaauacuaaauucaauucuggggcacagguucuugauucuggacaaaccugaguguuauuuugugugugugcaugugugugaggacgagcaccacggcacaugugugugugugugugugugugugugugugugugugugugcgcgugcgugcgugcguguagggcacaggacaacaugcggagucaguucucucauuccucucuguggguuucaggaauugaacucugaucauccucguucgggcuuggcagcaggaaccucuuacuggccuaucuuuaaagguuaaaacuuuggucuuauuuguuuuguuuguuauuguagcugggcaggccuggagugagcuacacagaugaagauggccuugaauucccaacccuucuacacaaaguucuggaauuacaacuaccacaugugaccuauaauagauuuuaaaaacuaacauuguguuccuauuuuucuuccuuauauuuucucaugucuuuggcuugaaaauacuuuuuuuuuuuuuuuuugguuuuucaagacaggguuucucuguauagcccuggcuguccuggaacucacucuguagaccaggcuggccucgaacucagaaaucugccugccucugccucccgagugcugggauuuugaaaauacauuuuaagaaacauauccacuguggaaacucaguagcuucagaaaagcuuauguccuucuuagacuuacugaguuguuuuaauuaggaucauguuacauuguucuguagucugcuuuuaaaaguuacagaucauuauauuuuccaucccuaauaggcauggauuaaaauuauaauacuauuuaauugccaguuauugucuuuucaguuuauuccagaauuaacagauuucugauugucuaaguugauuuuuuuaauguuuuuucaaaaaguauguguaauauguaaugcaugugcucacauacguguguauguaucugcauguuuguguaugcugugugcaugaaugugggugcucgugugcauguguguggcggucagaggacacacggacacacacaggucaguucuuaccacucacucugugugaagaagcaggaugucuuuugcuagcuguuuacuccaggcuagccggcuacuggcuucugucuccacuuccucuaucucuauagcaaugcugggauuaugagucacagcaucugguuuuacguggguucugggcacaugaacuucugcccagugcuuuauccauccagccuuuccugagccuucgguugaucuuguaugaguuacaggccuuuuuguuaaaguucucuuaaaacccaugggaaacacugugcauucuuacucaugggcuuguagagcuuugaaguuuauauaucaggucuucaugugagaguucacaauuggaauuagcuauuuacaaguggguccaauuuacucaugaguuuggcaaauugucauaauauggaagggguugagggauggagaugaagguggaaauaacuuguaagagucuuaaaauuuuauuuuccacauugcuuuuuaaaauuccaaauguccuugcucauggaauuuuuguuuuuuugucuagaaaaaauauucacuucuuagaguuauccuuuaauuuuuauguuuccuaggucacuaaugcaucaauauuuauaaagcuguuuaaaagccguaguaaaauaaacacaacugaaaguacuaaugaguaaggucacagcucgacuaaagcuaaggccugggacucuuagcuggaaggccuggaucacggaugcuguuucugggagacagcaggcuauaagaagggagaggcugcagggggaggggaugggcagagggaccuugggaaggggggaaggcuagcugagagagugaggguucuagcgagagccacagacauaggggcugagagugaaacagcagaggacacaagcuagacaaggauuucagggugggcgagcucugaaugugguccacaaggcagauguuguaaagcgacgugcauggugcccucugcaagguauucuuuguauuucguggucagcucuugaugagaauggaggacauuggggcaggacuugggcuuuggugacagaugccacuguuuaguucuuugguaggugugcuaagcauaaucagcuuuuguuaccauagaaacuaccugaagcaaucaacuuagaaagguuucuguugucucacaaaccauaaauucaguguuucuggccugugaugggccagccccacugcuuuuggcucugucauagggggcauguuguggagggaauuuggagugcauggcggggcaauacugcacuacaucauggucagggaaggagacaggaggaggaagccagagcaccacaguucccuuuaagggugucuguccaucgccuaaagaucugccacuugggccccaccucuuaguuuaccguucccagauaauacaccuuuggagacgaacgcuuuuaauacaucggucuuugggggcauuucagaugcaaacuagcaaagaugccaugguaggauacacagagaggcugaggguaaguuauuuccuucuuuaguuugcuuagguuaaaauaagugagauuugugcaucugagucaggaagaggaaagguuagagauguacauccaggaagauguggaggcagagugugggcaaugcuguagagaugcuuuuauuacgguaguaacgcuuguaguuuuugcagccauagcaaugugcccagccuguuucaucagaagauauucauucugcugauguccgugaagcaacagccuuuuuggagucugugagugugguuggcauuaguuaggugguccaggaaaugaccaguguacaccugguugcucuuccuuggucugccccuccccucaaacaccugccugcggcuccaaacggggcaggcaguugggaguuugggucaccauuuaagaaacuggaagcaguagaugcuaugugaauugauaggugcugcaaccaggcaaacgacguucugccgucaucuccgggcagcauaccuuuugugauuccgucugcccuugucggaccucuuguuuguuuagucucaaauccuugugaugguuucuuuugauuaucauucaaccuggaaauaagaggagagaaaucuucccauagaagaaauuugauacguagagaagaacaugacuauuagcuaugauacuuuguggcucuggaauuguuugauuuuguauuuauuaucauauacuguaucuuuaaaaaccaguguuuuuaaagggcacgagugacaaagucacagauuucagcaaguggugugcuaucacauccaguuucuugauagacuaguugcugaaguaguuguguuaagcacuuuggaaaaaugagggaagacuguguuggccggcacucucaccgucggaucagccucuuaccaugucccguaauuagagaggagacaugcuguuaggucuucacgcaggcauuuuuuauggaagugggcuguugcaaagguugcucauuuucaaaucccagggauaaaguauaucauuguccucaaggacaaaguguaucauuaucccuuugauguguauuguauuuaaggaaauguauccuccuucaugaaagcaggagucugagcucucagguuaaagaaauagagagaaacuuucuaaaaacuucuuuauucuuguuguauggauucuacuucauccccauguggguacaaagcaggcuagugucaguuauuaaugaaggcugcuuugggggaaucccagcaccaugaaggagauuauagccacuaaggagguaaaauuccagagacaguuuaguaggaugagacucccaaauggcuaaaucauugauuguggcaaauuuugaguggaggcuagugacaagaacauagguucaggccaggcagugguggcgagugcccuuaaucccagcacuugggaggcagaggcagguggauuucugaguucgaggccagccuggucuacagagugaguuguucaaggacagccagggcuacacagagaaacccugucucgaaaagcaaaaacaaaaacaaacaagcaaaauuaagaacauagguucaguuuuguaggguauaaaaguucuggagauugcacaguaauguggcuauacuggguauccuggacugugcuuuuuaaguggauauaauauuuuauuauaauuuuauuuuauuaugcaugaucuuguuauuuuuaaaaaagaaugaaggauagacugaucaaaccauugacccuaaccuagcuucccuuuuccucuuuaauuaauuaauggauagcaugcuuguggggggagggguugcaaugcuauguucacaggacagccacagcugucuguccccuggaaccuucuaccguuguuugaggaaggaucucuuacugggcuggagcuucccacauaggccaggcuaguuggccugugaguguucagggacccaccucuuuccaucuuccgcaucguugcuaggguuaccggugugcuucaccgcauccugcuuuuacgugguuucuggggcuccagacucagguccugggguuuacaaggcacaugcuuuacugacugaccuaucucugcagccuuugucauuuggauaagaggucucaccauguugucuaugcuggccuugaauucccuaucuagcucggcuggucuugaacuuugagcagugcuccuccucagcuuucuaguuucugugauuacaagugugugccgccacaccuggcuucuuugucuuagagggugauguaggcaguguuuacccuuuguaucagagaguaagcauccaccaguacacuuccccauauccucgggaaagacccuuccuaguguaagagggaacgcagccugagcuccggaagugaaggcgggccucuggugugcaccuccucuuccugcuuauuucccuccucccugccuuuccugcuucuuccgaacucauuuggcauuugcccacggcacugaauucccugcuuauccagaucucucaucuucaccacuaggcuaaaucaagguaguucccaguauuugccaagaagcuguuuaaaaaucaguuaauucuuuuagaggcaaauuaggcauugcaaaaauagcaucacacuaaugagcuauuaaagagcagcucacugcacucauacuuaaauaaacuaggaugggcagaaauggccaaagcagagcuaauguacaggaacuuagacuagacuaaguugcuuguugcugcugcuucugcuucuccuucuccuccuccuccucuuauuccuccuccucuucuuccucucccuccuccuccucuuccuccuccugcucuuucuauguagccccagcuguccuggaucucaauaugagaccagguuggcuggaaacucacaugcauucuugccuuuguuucccaagugcucggacuacaugccguguaccaaccacgccuuuuaguucgggaagauguuaauuuuuaccucuuuccuuucaguguauaauucaaucacauuuuuauccuuuuuugcauucgaauuuuugucuucucuggcuuuugcagcagcagcugauaccuacuaagcaaauauuacuagauuuugacuaauuuaugugugagagauuauuaaaacagggccuuucucugcagaucacauugagggguggugcaaaaccucagagagaagccuggggcacaccgacauuuuguuuuguuuuguuuuguuuuguuuuguuuuguuuuguuuuguuuuguuuuguuuuguuuaagacaguguagcccuggcuggccuggagcuugcuuuguagaccaggcugguuucaaacucagagagaucugcuugccucugccuuucgagagcugggacuaaaggugugcuccccacaucugcugggggacaggauuucugagacagugcacuuggcuuuguucuuaggauagaauccacccccucugacacuauagucucugacuuuggccuaguuucugucauuucucucauuuucugucuugcuugcagcauaugcagccuagaaguccuccucccugcaaccuagauauucccaugagucaccccacuguauaauaguuagggagcaucuuucagucacagucauccucagaauuaggccuccgugccugugaccuuugcccucccaaccccucauguaguuggugccuacuaugggcacuuguuuguuggucaaacuuucucaaaacugccccaggaaauagauugcugugcucccauuuuacagauaaggaaguugaggcccagcuauguuauagacagaguugguguuguuagaaaaugaugcccuagaauguaagagugguaguauguacuuaggaagccaaggcagguagauuacaucaguucucggcuggucuggguuacuuagugagcuuuaggccaggacuccaguuaaaaagaaugaaaagaaggaagguaaaaggaaaugggagaaggccuaagagacauggguucuaagcuccguuaguggucagcguggcaaggcaccauauuuugggaugucauuuucuuuuccuguuuccuuuuggaagaacaaggaggaaccuucuuugaagggccccugucugauaagagagauuauuccagagagaaugcagugcugugugcccccuccccuccuucccacuuaggaagaagagccagaggaaaaaagacucgaguggacaccaacugccuuggccggccagaaggauuuuucagggaaaugaaguucagaguuuuauggcuaugaugaaagcacucagaggcuagggcaggagaauugggccuugagguccagaccagccugggcuguggugugagacccuguuucaaagagcaaacuccagaaaaacaaaaucauugguugucucuggcucuacuucccucucuccugcauagacuuaucugcaucucaguguuaaugaggguaauugggcacccagaguucagccuugccaugucugugugugcagugcacacuugugccucuuuucuauccaccuguuucuuauaggcucagagcauuggccuuacagaggaugggggaagcuucuuugccccagcauugagaagcaccaaaggagggggaggggggaugucagcuggucuccagcccuacuuuuacuauuagcucccggggcaaggagcuaauaguaaaaguuaccaaacucccaugucuuuuccuuuuucucuucaguucaucagccaagguggaucucaagagcggccuggaggagugugcagaggcacugaacuuauuucuaaguaacaaauuuaaagaugcccuagaguugcuacguccaugguaauuaacucuauuucucaguugauauuuuauguguuuuucugaugucguguuuguauguucccgugucugugccugccucaguguguauaagcuaguuugaaugggacccauccggucaaucagcuuuaaagaaguguuguuucauauugggucaggagaaauuuuccgaugcuuacacccuagccucuacgcgugcuggggcgucgucuccaugguuuuggagaaucucugaccagcguugccuuugaagccagcaggggaauaacuagagaugcguaaucccagugcuaagaucaaaucucagagaauaggaauaugaugaaggcucgcuacuguugucauggaaguuacuaacgcugcgcuuucaggcuuggcagcacccccccccccacacacacacacacccuaccugcucacuggccccagcuguguaugugauguggacuuugcagaagugaucuuguaguggucuccagacucagcgucuagggggacgggggaagcuucuuugaugcugaacuggggggaccugaucccucaugucaaguggccagcagugucccuaagacuugccugucgucuacuggaccccugcuuccuucaucaucuucggucugccuggcuuugcugcucuuuagcucucgauucugacucagugucucuguguccuuuauuuauuuauuuuuuuuaaacaaacccucuuucacuuauacaaugugcuuauaaaauagcauaaaaauaaauuauugauuucauggucucugaucuuuaugcacaguucauuguuaaaauuccuuuuccaccccacuugagugugagguuugaacugccacugauaacuggggugauaacuggggugggcgggcagugccuucauucaggacaaaggcucuuuauuuagacucugugugaggaagaacaaaaggaauaagguugccucaggauguugaaacauagauggucagguaagaggcuuugagaggagcuagcacgcucaggcagugaccagagccugguuaccccacuguuaggagcuuuccucaggacccucagauauuagauccuaagggcuacucucucaggucucucugugcgugaccuaauuuagugcaaaaaucuugcuuccucuuggcuuugacuggaaaggagagaacaguuuuaaaggcacuuuuucuucauaucacauuaaaguuucgccucgccucgacucgccuugccuugccucaucccccucccuuagauuuuuucucccuccauccuccuuuuuuagauaagguucaaguagcccaggcuggccucagacucacagaagaggaccuugaguuccugagcuccucuuucugcuucucuggaugcuaagaucagcugugugucaccaagccucacccuuuucagauuuuaagguggugcacugcccccauucaacuggggaaaaaaaaauagcuuugcuuauaaacuuuuuccgaggaaaaaaaguccagaggcugcccccuuguguugaaucagggaaaggcauguuguccccagcacuucauucuacuguguggguuucaauugauacuugagguuuuaaagcaggcuuuuuggagcuuguaucauuucaguaacuauggaggagaaguugagauauacacggugaggauuagguauuguugguaucagaaaaaaccugggcuuuugugucuuuccuuuccauuguacugagauguacucaccggcuguguuuuuuccagggccaaggagagcauguaccacgccuugggcuacagcaccauugugguguugcaggcugucaugaccuucgagcagcaggacauccagaauggcaucucugccaugaaggacgcuuuacaaaccugccaaaaguaugacugaguaauuuauauccgagcuaagacaaccccugccuucccgccagagugccaagugaaugcaggucgcugaaguaagggguugguuugagguuagccagagcuauggagcaggacuugagauuuaaagugucuuggacaguuccguucuaugcaguggaauuauaauacagcucccacuuagcaccugugcccucugcuggguacauggggccugagcuaugguacaagucugagggaggcuucagaagggcuagcagagagcaucuuucuaguucuuuugcgguagguugguuaagaacugggugccaugucaagucaaacagggagugcaccuguucuaugugggagaaauugcacacucagaagggaacuuuuauuugcccgaggaugccuuuggacacuugauuuguuggaaugagagugucaguucucagcuguacucugcauguagaaggccaucgugaaggcucuuacuuauauuggugaauuuuaauguggcuaagaugaaucgucaugugacuuuguuauaaucucaaauggagaacauuuuccugacugcacuuucaguccacucuuuucugagguaaguggaggcacuuaccucaggcauucugcuuucauccacaaaggaggggagguucguaugcagugggccugugggcuccucuacaccacccuuaguaggcugagugcucaugguuggugguucaggacuaggcacuguaugcagaggagggaggccuggccuugcagagggacuaggaauugccauguggcgacaucuugcugugauugaaaggaucaccagugacagugagcuucgccugaugcugaucuuugcccuugucuucaaugcagauacaggaagaaaugcacaguugucgagucuuucucaagucuccuuucucgagggucccuggaacaacugagugaagguaagcauccacugaggcuuggucucucugucuucuagaggcuaagagccccugaaccaucacugaaguguagagaaugaaggaaguggccuuuccuuuucccagcucacccuggucccugguugacuuugaagcuguguacacauuugugcaaacagaaaugcauauaagggacgcgcgcaguuuguuuuucacuugcucuuuuuuuuuuuucaaacauugaaccacacacuugugcuacaaugugaucuugccccacaccaguguccguaaaugcguuuucucuguuuggagcugugcaguugugaaaugggaugguacucgguacagcaacgugauuguucuuucaucacugaaggacagcucuaugguuuuaauuuuuggacagcucuaugguuuuaauuuuuuuccuguuaacaaauauuguuguccuaaaauccuuguguguguguguguguguguauauauauauauauauauauauauauauauauauauuuguguauucuuucaaguacuucaugagacaguuuucuaaaaguagaauaacuggaaccaaggguuuauaauuuuacaauauugauagguauuggcauuuuccccccucaaacuauauucaacuaucguuggaggguuucauuuucuacagacuauuaauguuuuuccaaggugaaaguacuguuuuguuuuucagacagggucuuccuauggguuccacccuggucugaauucacucuguagaccaggcugaccuugaacucacagagauccaccugucucugucucccaagugcugagauuaaagguguaucuggauaaaguuuauaccuugaagugacagugcucgucuacauagcugaugaagauguuuggcuugugggcuuuaagaauaaucaggaguccaggaaagcacucagccagauagcugggaggaacaucaucacccauuguucccuauucccucuaagaugaggggagaaguagcccuaaucagcccucaacagaagggugcgucaucaccagggggcauccagggacucuagugucacuuucaagccuguguuuuggaagagaugauuagugcaaacccuggagcagcugcgguuuggggaagcgagcacagcucuggggauggcugucaaggcaggacagaccuaaugucaaguggacacugcacacaccuggagagagauuuaccauggggcuccguuuguccuguaggaguguugucagcuuguuugggccauuggagaaguuagugaugugagcucucaguguugaucacaggacaggacugugacacgucccuuguguuuaggacuuacuagaaaagaguauugacucaaccauggcagaaacugaugguauuuuguugguuacugucagcaguugaaaccuaucuucuuuuucaucagaaacugaucuccgagcaucccuaagaacaagagcugguacugggaggccuaaaguguuuccgagacaauccaugagacugaacuggccccaguaugacuugcauugccuuuuccuuccugggaaccccaugugacuccuucccugguccauuggugacugcuucccuuuuucuuuguggugugaaggugacacuggagaguuuuaaaccuuaguuuuaagaggaaugacaugguauuuuuggugugagaauaaauaauucuaaaacauguuaaugcucuauuuuuuuuugaaguguucucugugugccaggcacccucuuggugcauuccuuagcauuaucccccucucccccuuuuguguuuaacugauguccacagagagaaaggccaaggugauccagcugucagagcagcaugggaacuggucugcuuuuccuaaaccacugcucuuccgcuguccccauguucucccguggagggcugggaaacaccuuacauggcugauggaucacguguggaaagucagcgaugcugugcucugguuuccccuuguugccuuuaaacagagcaaguuaggaaaucuggacuuuccacuaaauauugaaaaauuaacuggcccaugucuguagcuuauucugaacuauaaauaucuuuagauuaguacaaaaaggauguuuagcuagcuuuuugagugcaccaugaauuuuuucauggacuaaggaauuuacaauuaagguguauguuggugaagaaauuacucaguguaaaucagucacagugaaggaauaaagcgaaauacaugaaguuccaucuuauuuccaguguuuuugcuucugagggcauccuaaacagacuuuuaaguuugaaggguguuuuaguuugcuuucaauuggugugacaaacacccugaccaaaaucaagauggggaggaugcauuacagucccuuaucaggggaagcugaggcaggaacuaaaaccacccaggaccaccugcugggccaaucauccaucaagaaaaugcuccgcagacuggccuauaggcagccugauggagguuaguuucucccauugaguuucuucucucuagauaacuaauuuaugauagguuggcaaaaaccaaaccagaacaacagggcacggcagcacacugucgcuuuaguauaggauuuguuuuccuguugguaauuuuuguuugcaugguccaguuucucucuguguucaggaaugaguaucuccauggcgguuuucauggaccugguguggaacacucuugcuccucuccucccaugacugguggcuggugcugaacagcucauuucagagagugcgaugcuuaagugaggugcagagcuuggaaugugggaagagagucgguagggagaauacuuacacgggaauuacagaguccagacucucccugcuuugucucauauccuuuguauuauuggauaccaaagucugucugucuuugguuuagucgcccuucugcucaggccuugaugaggaccugcuguuuagcccaccgccaacuguagccuucggcacugccccugugccagccugcugccuucuccuccccuccccucaggaaccucaugcuauagccagaggcuccccauugccccuuugggagggcgccugcacuuucuugccuucuaucuucugguccucaaccagugcugaccuuucccuuccccucuccugccccaggccagucaucuguucucaagguggcauuggcauugauaaccccaggcgguugucacuuuguagcaguuacccaguguagcuguccagcggccaugggugaacuggguuuaccugaaagcggggcuggaaaugaaaggacggguaugagagaagggcgaagccaagucaaagguucagagcuuggcucaaaguuuaauucugcagcaccaaacccaucuuuuguuucagcuggauuauguugcaaaguaagcucagcgggcagucuauuccucugaauuccuguaggaaguugcaggugcagcaaggaggacgacuccaccuaggucagaaagcccacuguggcacacacucaagaucuguuuagccugcucaaaaggcugggcgagggaagggcauaaccuaggacucggcuagucagguggugaaaaucaucugcuaguuggcauuccugugaagguccugaaaacccagaggcauacucugagggaaggcguccuggagacuggaucgugacugguggcagugccaggaugcacacagacaacaccguguccugguggugucuucuaccccaucucccugccuguuucugaggaacuuagcugcauaguacuuuucacaaauugaacauuuaaguugagucaguaugagagagcccgugggccauguguguguaaaugaaggaaaaccucuauuuuaucuaguuuggccagcaguguucccagugacgcagauugccuccuguugcgucagcacuugaauuaaaaaggcccugugccgccuucugaaccuuaaccaagaagcacagacucgggccaaaaacaauaauggucagaguugccagcauucaucaaggcugauugugugcgcgcgcgcgugucugauaagcgcuacaggcaauacucauuuaauccaugguugcaaaguagaagcauuauuacuggaccauauaaaugaggagaccagcagagaggaaaggcaggccugagcaguacccuguacuagcaugaagcagaaucuucccuccaagcucaaauaacacaccaauuuccacagacagcagaggccccgugguguccucuacuccauggagauaggaaucugaugguuuuguucauguagaaacauaaaauucucucucucucugaucucugcaaauacagcagacuguccaggacaccaggacauguuggguggugcauaugucgcugggcuggccuggcucugguaauuccuuuuugugagcacacauggguucaggggugauucaugccuauaguaccaagaggcugaggcaggaggauugccgugaguugaaggacagucuggacuacaacuaguacugcuugggcuccaagugagacccuguucagacaaacagucgguuuccuccucuucucgagccucucucugcugguaauguuagcuggaggugaagaugaccuuaaccauucacacgauccaggcuuauccaggaacaggccauccuguuucucuggaagcauggaugccaucucggcuuuugcgucuuucuugggcuuaucuaucuuccacgauuuucagaauguuuuaaaacaauacuguuucuuaauaucaauguauuuguuuuuaauagaguaauaucaauguauuuguuuuuaauagaggagaugcaugcugagaucuguuacgccgagugucuccuacagaaagcagcacucacauuugugcagguaauaaccgucuggcugaauacugggguugggcaggaagccugccagcgcuguacagagcacgguaaauguugcucagccuguguuagcacugaagcuuagagugguaauaaaagauauuuguuuccguccccuccccccccugcccccuccuuccccuuucuuacguugguuuccagacagggucucacuguguagcccuggcugggcuagaacuugugaagaucacuugucccugccucccaagugcuggccacuaccuggaaagaacaguuuuuagaaguuaaggagucauuaugaggcccuacauuucacgcuuuacguacacgugugugccccaaugcuguuagaagcauggguuuuacauuaugacccgaugaugacuaugucccgaugagggcgggaguagagaugauaagccagcagaaaacagucucagagucuugauuuugaaaguuacuucuccagguuuguuuguuuguuuguuuguuuaggugguaauaguggugguauuuuucccauguuagcuuagauucgguuccguaaaacugagucaggguaguguccuguuccccgaagcccuguacauuaauuacccaggcggguugacggcauucucgccaugucaguaacgucacauugaaucacggaggcaccuacucuucucccuauguguuuuccaagugggguuuugaccgguuuuuuagguuuaaacuuuguuuuguaacugaggaguugaacuccaaccucuuagaaguguccacuccuccuccucccucaugucugcuugugguuacuuccguguaucugugcuuuggcuggguuaggaucugcagcuccaccccuuucucggugcucccaccaccuuugcuccugcagagguacucauaagcuccgccccuuccccgugcucccaccacgaaucccggcuccuguaguggugcucaucagcugcugaaggguugguuguacagcggcugagugacugucccugguuucuuguuacuuuucguuuaucucgcauucugugauugauucucacucagaaaggagccucugucuuguuauguugguguucugcuucugcauuccguggcuuucuuggacucugucaggguucuguaucagaguaucacagauugggaaaguguuuccaggguuguccucaggugcuacugauccuugcucacgcaggggucaaaguggcuccccucccgcucggccccuuucucuucugcgguagugcuguguuagcucucaucucuguacucgcagauggccccgcguggucuuuaaugcuuccuggugcguccaguugagguuuccuuugcauauaaacuucaggaucgcuuugccuuccuuccccgagucuguccuuguguuuucuugguuuucugguugauuccaugcuccacuuuguguuuucuugacaccccacgggugugugcauguccccaucguggcgcgggucuccaucguggccugggccuaaucacucagcacaucauguugcuuuugcaaucaggugcccaucacaaaauaagcauuuggucaguguuuaccgaaucauggaaugaaauaaucauuaguuugauuuuuaauccagcccaagaaauuucuuuuuggcuuguauaugaacuuguauaaauauaaauaagauuuuuauuuauauuaauauuuuaaauauuuaaaauuucuuaauaucuuaaaauuuuaauuucuuaauauuuuaaauauguaagauaaaaauuucuuaguaucuuaaaauaauuccuaaauaagaauauaaacacuuaaguuguauagugaauuuuguauuuacagacuuguauaaaaaauaggaauguuaaauauuuaaguaguuaaugagacuaguaaacuaaaaauaguuuuuuuguuuuugcuuuuuggcuucaaaagugucugagaucuuuaggaguguaagagugugggccugucucuagucagcaccauuaacagaaugucuuucaguugguuauuugguauauuuauuaggagacucuuagagugcugauccuagaaaugucguucauuuggccaacugccucgauuucaugagggauagcccucaagcccagagagauaaaauagucuuccucccccaaauugcauaucagugacaaccgcuucagaauuuagaucaguguuuuuuuuuuuuuuuuuuuuuuucgggguggggguggggcgguguccgacaauuuauacaagugaaauuuauaguguuggaguuggagagguggcucagguguuaagaacauuaacugcucuuccagaggucccaaguuuaguucccagcaaccacacaguggcucacaaccaucugugaugggaucuguugcccucuucugguguuugaagagauagcucauacaaauaaaagaaauaaaucucuuaaaaaaaaagaaauuuacaauguuaaguagacuucuugcccacuugacaggagaacuauuauucacuggguaugguggaugugaagguuuguccuuagaacacauuuguguaaccaguguucuggggcccacugagcccagaagaguauuucucaguggaugauggugucuacugaaguagcauuuggccccaaauauuugaggauuaauuauguccuuagaaauacaagguaagagaagcuuuuuaaaaauguguuuucacugacuucaagcuuauaagaaaauuauaaaaugacauugcaaaugcaaagcaagaaucauguaucaaaugcagucaaaauccaguaucuggagcuagggagcgagcuuagugguagcguguuccuuuacccagcaugcucuaggcucuauucacagcaggaagugcucucucucucucucucucucucucucucucucucucucucacacacacacacacacacacacacacacacacacacuuacuucuuaguucacaaauacauacuguuuaacuuucccccuaacugcucuaauuauuuaauuguauuauuuucaggaugaaaauaugaucaacuucaucaaagguggacucaaaauuagaacaaguuaccaaauauauaaguaaguuauaaaguaaaaugugacugaaaucgauacuaaauuaaauauuuuugaagaugggcucuuauucuauagccaggcuacccuggaacuuuugauuuuucugccucagauuccuaaguguugggguuauuauuacuaccccacuaagauuggcuuuuaaaaagauucucuccuaagaauauuuguauauuuuuuaaaauuuauauugcuauuuauguauuguguuuuuuagcacaggcuggcuuuacaucucucauucuccugccucagacuuuggagugcuaggauuacaaacacaugccacuacauuuggcuugcuuuaauaaaaucuuucgccgggcagugguggcgcacgccuuuaaucccaacacuugggaggcagaggcagguggauuucugaguucgaggccagccuggucuacacagugaguuccaggacagccagggcuacacagagaaacccugucucaaaaaacaaacaaacaaacaaaacuuucaaaaacaucuacuauaauuuuaugucucuaguuuuugugguuaguguagugauuauaauguccuucuuggcuuauuaccaucaacuuagaguuaauacaguacuguugugugcaaaauguaagagcuuuguaaaaacguaguuucauuugccaccaguuggccuuugcucuagcuccuuucuguugcugugauaaaacacucuaaucaaaagcaccuuaggggaggaaagggcuuccuugacucacauuccaggccacaguccuacacugggggaagugagagcaggagcucaagcaagaacuugaagcagaaacagugaagaaauaaugcuugcuggcuuaugugugggcucauacuuagcuugcuuacacagcccaggaccuuccuauggaaugaugcucccacagugggcugcgucuuccugcagcaauuaguaaucaagacaaucucccacagaauugcucucaggccaaucuguucuugauaaucccuuagucgagacucccuucucuggugacucuaggcugugucaagaugaccauuuauaggacagcuuuuuuuuuuuuuaaacuauucuuaggguguguucuguauguguuaucauuaaaugcauaauaagcaccauuguuuugguuuagguaccuuugucuuacuuacucuguucugcuuaccaaauacuugccauuguuucuguucauguuuaggcugaugagcccccguuagcauuucucauagcaucaacuuucagcauuuuucuucuguucucguuguuuugaaaaccaguuuauuuuggccuuuaccuucaaggguauucgugcuacauagaguauucugaauuguuaggguauuucuuuuuucagcccuuuaaaaccagcucuucaucucaucaguucuuguauuguuuaggacucagcuguuuguguaauuguuucauauguuuaauguaucauuuuucucaucuccuuaaagagcauguuguaucuuugaguuugagcaguuuaauguggauguagacuuuuguugccauaauuuccauaaguuuguuucuccuucauuguuucucacucauuucuugcgaacuuccaauuacucacuggucagccucauuguguucaguaaguuacauacagauccacacccacuuauuuauuuuuuauuggauccagcaugugggucaucuuggagucaauuucuauuuauugcuuuuucuguugacugugugucaugcucucauguggaauaauuuuaaagucauauccuagagauugauguauuuguagagacgcuggguucugucaucuuugaagugugccaggcuuuucucugggaagcauuuuguuugcucaggcucaggcucaggcuccagagucuuccaguugcugggacauugcuccugcugccucuuggacccucccccagucacauagcucuuggauuagccaggacugccguguucuucugauauagacuuugguuuacccacuaguguaguucucucauuuguggaaauguccuuauagcuacccaaccuuucucucugucucggauucuaucuuuuaauccagggagacuaaauggcuuccugauuguggucugugguccccauagggaguggagcaugcuuucaggcccauagaugcguagauagauugauauaaaguuaauucaugagcugcuuccugcuuucggaaggggccuacucccccagaaccuuccauuuccaagccugcaaaaauguuuuaaaucuauuuuuuuuguguguauuuuuucaggguuuacaauuguuaugugugggaaagcaaaccuaaccuaagcauccuagcaucacugggaaugcaucccaccacuagaugcagagccccauugguauuuuaagaggcgcuuuuaccaguacucauguaaaccuggaauccauaagaaaauaauccugcaagagggaguagaguugggaaacucauuaugauguuuuuagauuuccuuucaaaguacuuuuuagaagauuaaagaguugauugcuuuucuaaucaucagaacuuuaaaaagcuaguuuagguaguccuaugguagguagaagagacaccugcaucagagcaguggcggggcuuugagagaggccucggugugugugcgcgugugugugcgugugugugugcaugugcauguacuucuacauauaaauguuucguuagaaguucacacuacacugaaauccuacuuauacguaaauccuuucaaaauaguggagaaagaaauauauuuuaaguaaauuuuuuuggaaaacuguuauaagguaaaaccaccauuaauacagaaauaaauuucaauuaagauuuaguauuuuaaaauuuuauuuucucaggagacagaggcaggcagaucuuugaguucaagguuagccuggucuauagagugaguucuagaacagucaggacuacacagggaaaccuugucucaaaaacaacaaaacaaaacaaaacaaaaauuuaaguuauuagcaaaggacauagggaaauauucuguguucuuagaauuaaaagcuuggggcuggagacauaucccagaggcuaagaguauucacugauuugucuaaggaucacaguuuguaucucagcacuuacacuagguggcuugcgaguccaugcaguuucaucugcaggcaaucagaggcuccuugugugugacacauaacacaaacacaacacacagcacacagcacacagacaacacacaugcuaaaaucuuaaaaguuaagcuuuuuuuaaaacaauuuuuuauuaaauauuuucuucauuuacauuucaaaugcuauccugaacgucccuauaccccgcccuguuccccaacccacucccgcuuccuggcccuggcauuccccuguacugaggcauauaauaaaaguuaagcuuuuaaacauauguaacguucuacuuugaaacaauuuguuauuauuauaaauaauuuucauauaucuuuuauucggacuuacaaauauaagcauccuacaaaauaaaaagcucaauuauaguuuaaaaucagcuuuuaaacuuucauuaaaaaauuucauucagcggggcuugguggcucacgccuuuaaucccagcacuugggaggcagaggcaggcggauuucugaguucgaggccagccuggucuacagagugaguucuaggacagccagggcuacacagagaaacccugucucgaaaaacaacaaaacaaaacaaaacaaaacaaaacaaaacaacaacaacaaaaaacccaccaaaaaaaauucauucagaggccuggaaugacucagugguuaaaagugcaacugcucuuucaauugacccaaguucaguuccguauuaggugguucacauucauaacuucugaucccauaucuccggcuuccccaggaaucucugcacacaguaauacacccaugugcagacagacacuacacgcaauuaauuuuuaaaacaauuucuucuuuugggauauuugucauuauaaagaauuuucauagaucuuucguuuaaauucaaaaauacauaguacauaacuacagcucaguuauuaaaauggcaucugcugccuugacagcauccaucugucccuguucccauagugcuccuuuuucuagggucuaacccgggauucacuuuuaguugucauauccccuuaauaucugucuguuuugagaccggucucacucuguagcccacucuagccuugaacuuacuccauagcccaggcugacuuuaaauaucuggaaaucaccaucuucagccuccugagugcuaggguuacaagcaugugccacugugcuuagggcagaugacagcauggcauggucauaaguuggaaggagucugaagcaaauuaguuccucuggucaguuaacacuuccuccuauaaaccaggucagcucugagcuggcuagauuuggcuggaaugcaucauaagggaacauagcugcauuauauugggauagaagauaccuggugauaccuuguuauuuuguuggguugcucuuggggcacuggggauggaacccagggcccuguggaugcugccccguguccugccacugaaauacaucuucuuuguuacuugguaacuggcuauuucccaguuccguaagcaguuaucacuuauugcuaauuuaugugccuuugauuauuugucuuuugaagaugaucugaggucuggggauguagcuuaguaguagaguauuuuccuuauguaugugagccauugguucagucccuaccaccaccacccccacucccccaccuccuucccuaccccuuugcuucgguaagguuaaaugacaccauugugaugggaguggccucagcaagcucugauguaucugugagcccauggcagcugcauggaauugaaauguuauugccagagcauccauguuugaggguuaaaggcagggcugugaaguuugcauggccgcagagaccugcacacucccgaagucuccuggcaaaugcuccgggggagcugcgagaucgaagcccucagguuccauggcuccuaaauugugcuugcugauggcugaucccucugucacuguaaaaauggguguuuccuuucuucuuagugggaauuacucaguagccuuaggagcggacuagcuuaaauuguuaguuugcauuuguauaguauuuuagguaaugacauuuacaguauacaaggguaacauugguuugacguuucuuugucaagagucaugggaaacuaauucucuacgcuuuuuccucacuccagagagugccuuuccauccugcacgucauucagaagaacaaacaagagcagcacuucuucuaugaguuugagggaggagucaagcuuggaacgggggccuuuaauuugguaaggaaagaauucuauagaaaccagaaccuuuuguaggugaaaccaaggguccggcaucucuccucuggguuugaacuucaucccagaccuccaccuguguuggcugaugagucgcugggguggacugguuuuccugugcggugaaggcuacagcguucuguauaugcucagaguagcuuugcgcuuuccaucacacagggcaagggaagcgcgcagcacucugauuggacuaguaaggccuuuaguaacgaggagccuagaauccaguucuguuugugcaucggaaauauuuauggucguguuaaugauggcucuggaggugaaaacgggagggagugauauaauuugagaagcaauuguugaagaucucuagggagaugcagagucaguaagacugucagaguacaauguuauuuagaaaucuggaauuuuaacaaagguuuaacucauuggaaaaugaaguagugaaagagucauauuuugagcauguaguccccagggcuauguucacgagcccgugugcaguagucagugcugggguugaggguggacugauucuccccauggacugugccugucugucugcuuggcuguuaaaccucaccauucaccugggacgcaguaucucccauucagagagauauuuccaaacccucuucuaccugagccucuggccgucuagcccuaccccacuggcuaucuccaugaguugguauuuagucacuucugagagacuguuuuccacuguccuucaggggugucccagaaggcaccgggcugcuguggcugcccaguucuguuugugcuggaguaucacccacaucuccuuagguuuguaccuuccagaaaggaagcugaaggaaacuuugccuaaaccaggcauggacacucaugucuguaauccagcacuugaucuguaggagggcacuggaaguucaaggccagcuuaagcuacagaugagacccgaucucaacaaaacaaaguaaaauggaaaggaagaaagaagccuugcccgagaugccuuucaugucacuucauuucacagaagacccaagucacuguuuagaggaccacggagaugccagacuuuauugucuccuuacugaguccuagucagguuagacuugauuuggcuuccagggcuuuugaacagguuaggguuagccacuggcagccuauagucagccucacacauaagcucacucacgugggcugucuguagucagagucuaacaugccagugcacuuacaucucuauuuuuccuuacagaugcucucucuuuuaccagcaagaaucauccgguuacuagaauuuauuggauuuucuggaaacaggguaaaaguugcauuuuguuuuaauuuugaagaaauuucuguuguucucuguuauagugaucuucuccacccagcuucuuuucaaaugguguucucugaagagugccucuuuucuugguuugagauaaauacuaucucuuccacggaguauucucccauacuuccccaaaugaggcgcaaguguuccuaacguucagauucaugcauucaccuagccgauggugcucacucuggucccauaaaauugugaguuccuguuccaccuucccuguugggcggcggggucucuguaggcauagaauccuguguucuugaccaucacaguacauugagcuugaaacucaguauggucuucuguggugauagggaugaaacccaggccugguuuuacccgugcuuggguaagugcucuaccauugagacaagccccuagcagcucagaauguaaaucggaaauuuuaucagagaaaaauacagcauuacuugggaaugagccguuuauuccucuccguagaaucacauaaucaacauggaucaguuugauaacaguugcuaugaugaaacacugugaacgaaaaccauggaggggaggaaaggguugauuucgucuuguacuuccagguuucaguccauugugaggucagggacuaaaggcaggggccuggaggaaggagcugugagggaagucugucugcugacuugccauccugcuugcuuauguauaggcucauguuuagcuaucuuucuuguacagccccgcaccaccugccuagggauuggugcuacucacagugggcggucuucuugcaucaagcaugauccuccaaaggcauggacaggccagucugagcuaggcaauuccucagugugagcuuuccucucagaugacucugggcuguauuaaguggacaacuggagcugauugggacaguuaugaaaggaucuaucagauagucuuaugccaguuuaaacugugacgauuguuucuauuuaaauacugccauuauucuaagcuggugaaaaaugaaaccccaaguuuauggagugcaggacggaugaaugaugugagaauuuccaaauguaguuuuuugucagucagauuuuucucucucuguaaugcaauuacuaucugcaggaccuaggccuucugcagcuccgggaaggcgcaucaggaagcagcaugcgguccccgcucuguugccuuaccauccuggccuuccauaccuacaucucccucauucucgguaagaguugggucgucgcugucugcuuacuuugaauuuuugaguuggaugaaagauggugagauuuaucauagagaucuuuggcagagacaguugacggauuguuuucacugagcaguuuagaagucauuuauaugcauguauguuauuuauuuugugccuaugagcauuuugucugcauguguaucaguguaccacgugcaugccuuguguccacagaggccagaagaggcauuagaucuccugguacuggaguuacggaugguugugaggugccaugugggugcuaagaauuaaacuucucuuuaagagcagccaacgcucucauuauugagccgugugaugucucaugacauuuuaaaaucuguucuuagauaagauuuauguauuagguggcuguauuuuuuuuuuaccacauuaguguuaguauuuccauuuuuuuuuuaauuuuguagaaaauuaaauuuagagguaguguugucuugaaaaguucaaaugucaaugagacggcagccuccauucuuuuuuuuuuuuuuuuuuuuuuugguuuuccgagacaggguuuuucuguguagcccuggcuguccuggaacucacucuguagaccaggcuggccucgaacucagaaauccgccugccucugccucccgagugcugugauuaaaggcgugcgccaccacgcccggcguccgccuccguucuugagacuugucugagacagccaacuccauucuuaaauugucugcccuggagcucuuugauccacacccuucucagaugaaaacacaaaacaaucauuucuauucuguccacgggugugugcuguguguguaucagugagagcugggaauugguuguaaaugugcacuauugguuguuucgugagcacugagcacugucuguucaauuucuagguacaggagaagugaauguuguggaagcagagagucuccucgcuccguuccuucaacaguucccaaauguacgcuuacuguuccauugucugccucagccgugacucacagccgccaugucuguugaagaguguucuuuccucucuccacagggcucccucauacucuucuaucaugcccgaaucgagcugcucaaagggaacacugaaaagguagcugugucagcaaggguuauuuaagggcagugucugaguggggguugcgucacacggacacacaguauaaguaaauuugguugugugcacuagcagagauaaaaggaaugugauucugagaagcuaagcuuuuacuuugugcacguauguuuucacacuuaguaacuugccucaaaauauguuuacacauaugugaaguaguucuugguggaguauauaaaauauuuuuuaaaagaauguguaaaacaauacauuuuauuaugggcaucuaagaggcuucagagaacguugaucauuaucuauucuugcauugauuuuggaaccuaucuuuuacauaugaugcaacuauacugguuccucaucaaaggaacuaggcgauuaauucucuuaaagccaaacagaaguguguguguguguaugucuaugauguccuuccauaaaaauaagaucaaccuuuuuuuucuauuuauauuaaaccgcagaccuaccuuccagaucauacauuuaagucucccuuuguucauuuugagggcugggcuuccuuuuuccgagauggcuauuuuauacuuauuaaaguaaucugcuguuggugacuggccacuaaacauuucugugcacaaaaauacggauauagaauccugggucagaugaugcuugcaucuuuggcauccaggcaaauugccuuucucgagaaucuuucgauguaaaugucuguacagaaauagugaacaggcuggagagaugccacagugcuuacgagcccuugcuguucuugcagaggacccagguggguucccagcagcugugucaugcagcucacaccagccucugcucggcuuccaagggaucuaacacccucuccuggccucuguaggcaccaggcaugcaugugguacacauauacaaugcaggcacucacuugcauauacacauaaaaaaagaagcuuuaaacaugugauucuauauuuauauaucuauauuuauaucuaguguucuuugucaacuugggacauaucuguccuuuaauuuuuugcccaugggauaaguguaaaaaaagaauuuaaauuuuuacuuaauucuauuauuacuaucauuauuuguugugcuggucaaaucuagggcugggcaagugcuuugccacuaagcuacauuccuaugcaaacuuucaaauuugugaauuuguuacauguuuauuaauuauucuuuccccccccugacuugccugguuacaucuuuaccaauuuuucuuagcuaaccuuuugcugauuauguaggcaauagccuucucuuugccuuuccaaagauccuuaugcuauuauacucuauguuuuaugaaagaacuuuggcauuucuaucuuacuuggcaaguggcuuucuuauuccugaguuauaaaguacaagguccccucacuaagugaaauaaagcaacagaauccaaccguauugucacacguuaaggaagagaacguaaugguauauugaguggcuuaaugaguggugauuuuguucuuuuuguacaaaguguuuuauguauuucccauuggguuauuaucuccuugucugauaucuggguaaucagcuuuacgcaauugacuuauaggcucaagaaacauuucgaaagugcauuucaguucaagaagaguggaaacaguuucaccaucucuguuacugggaauuaauguggauucauauauaccaacaaaauuggaugcaggcguauuacuauucagaccuacuuugcaaagagaguaaaugguccaagguaagcucccugcuuuucucacguccucgguuugcuacauggccacggugguuugucauuuaagauugauuuuuuuuaagaguacagcauggauauuuuccucaguuuaaagcuggaggaggaggaaggggggaggaggaggaagaggaggaggaggaggaggaggaggaggaagaggaggaggaggaggaggaggaggaggaggaggaggaggagauagaccacacuccaggcaggauguugcuaggauguaauugcaggugcuguccucuaagcguccucccuggugacucagccuuggagacgccugcaugguuucuaggugauuucugguuugcaagguuagaaugccacguucauaugagugcucucuuacgagccccaucuuuuucccccuaaaggcaacauauguguucuugaaagcugcuauuuugagcaugcuuccagaggaagaaguggcagcgacuaaggagaauguggugucucuguuuaggugagcaugauacuguuucugucacagagacccuggggguguuaauacacaucugaauuuucccuucauguucuuuuuuuuuuuuccuuuuuaaagauuuauuuauuuauuauauguaaguacauuuagcugucuucagacacuccagaagagggcaucagaucucauuacagaugguugugagccaccaugugguugcugggauuugaacucaggaccucuggaagagaagucagugcucuuaaccgcugagccaucucugcagcccccucccuucauguucuacuucauuaguuuguaacuucucuacucaccgguauggucacacuucgaauaaugaauuuggcugagagccagcauggauucuuuagcaugguuucagauacauuuucaugucugggaaucaugagaauagcauuacacuuguuuucuagaauuaggguuuaguuucaggggcucugcaccugcucucucgcggccauuggggucuuucagggaugcaauuggauauuuccuugaauccuuucccuugcuuaugcauucauagaauugugcauaagaagcgaccccacaaacauguagucucucuucacccauguguuuagauuguguguguuguauguacacaucauguguaggcauguaugugugcaaaccuguacaugugcagaggacagaggauggcaucaggugccccccacucuacacucucugcccuauucccucuagacaggguguuacugaaccucgagccagacgguuggccagcaaaucucaggggccuucccaccucacuggguuacaggcauugugcacgaaccagccuggguuccgagcauuugaacucaguucucgcuugcaggccagcacgcuugcuugccgagccaucuuccggccccagauuccuuagaccuuagaaaacacugaauccuaaagggauuauuuacaaagucaccuauguuugcuuagcuuucucagguuaugcauauggauggcuaucuuuugagacauauuauguuauagguccauggauggcuuauguuauagaucugcgcagcagcugcagacaguaacaggacauuuaccccuuuacauucuucugucuugcuggauaaagacuuugagcucuuuucugcuuauuuauggaaauugacaauuuuauaccuagauuagccuggacuguguuugaccaauguaagauauuagcuaagcugaaggaaauaugucaguuaguggcucucauggaaucaaucggguacccacauuacuugaaugugugucaccauccagagcucugucccuuccugaggacuucccacucaggucgggguauugcccaaaaacgugcauuuggaacaguuucucggcugcuacuagccugugauguugucugaaagccucaguugugacuaauaaguaugcucacugccuuuccauggggaccuucacagacagguggauggucugaagcagagaaucgcggggaaaucucucccaacagagaaguucgcugugaggaaggcgcggagguacucacccccgucaggcguccccggaaagcuggugaugccagcccugguacugcuuuuacucacuguuuaccuaccagagauaaggucacuguugggagcaucgagggaugcacuuaccuuugcuugugaaguuuauagcucaguugagaacuauuauguauuuuuauauuuauacguaaacuaguuuuaaaauaaauugaaaauuuuaucugauguguuuugacuaguuaguauguucuagcuauugugauaaaggcaacuucaaaaaaucauuuugaauaaaguggaauugaauuacaaaauaucacaaauucaauuuuccauuuuuuaauagcuauguaaaaagguaaaagggaaccuugaaagcauaacuuuucacggauauagcucguuugaccugggcauggcggcuuauaccuguacuccuagaacuuggguagcugaggccagagaauugccacacauuugaggccagccugggccucagagugauuuccagaccagucgggacuauaaagugagacugucuuacaaaaccagcugccuucuccaccccuaaaauauuaugucuaacccauguaaacaaaacguugccauuuugauguagaauuguaaauaagagaaaacauccuggagccgugcccuccuguggacaugggucucccaccgcaagcagcguccuuuggaccagcccugcugugcugcagugggagcccugcugugcuacagugggagcccugcugugcugcagugggagcccugcugugcugcagugggagcccugcugugcugcagugggagcccugcugugcugcagugggagcccugcugugcugcagugggagcccugcugugcugcagugggagccaugcugugcugcagggcuggaggggcucugguccuacuugagcucacccuccuaaucaccucacuguuuuggcaaagccccugugaaaaacacaauuugacuuggauuuucaaaacaaagcuuucuuuuucaaggauagcuguucagugcacaaaggcaccccaguucuccugugugguuuuaggaaccuuuuuuuuuuauuuaggggauuauuuaaccauucuccuuugaguguuauguaguguuuuccaguuuuuacugucauaagcaugcuacaaugaacaucauuuacacguacauguaauuaauucucuaggaauguuuucaaagaaauggaauucuuagugaaagauguuguguuaauguuggguauauaaugcuaaauuucuaacccccuagccccccaaaagccccuguaucgauucagaugacggauaaucuuuuccuaacuugcauucugcgcugccacgcugaguucuuuaugugcaugcucacucagcuuuccuuucucuauguauuuuuaagaggacuaagaauuuagccccugaccggggucagauaggagccagccuacagcuagccuagaccgagguguuucccacagaaccccaagauuacacugauggggugagguagaaaugggccugugaucauguccugagcauagacaauaacaagaacgcugugcuacacggaggcuccuaggccccucuccuaguugaugcccauguugcuuaauuagcuuuaguucucucccacauucuuuuuauauuaagugcucugcacugggaaggguucucuaugucaaagaaccuuccagaaacuuuaccgagccauuguauuucuuugucuacguuagaacuuagacccugguauguauacgacccacuugugcuuugaaccacugacuguugguggguguguagugacaaagaauugacuagaauugcucauaccuaggguucuugucacagccugguuuucauaaaaaucucaaaccaagcuugccucgcccuuugauaaauauuaagucaauaagaaacuuuaaaucaucaucaguuuaaaaauaacauuauugaauugugcuccuagcuuccaggaccauaaaacaaaucugacaccaucauuuccugccucaugucuguggcugcucugcuaaggggacucucaaauaauaucugucguaacuuaaaauucaugcucaucauagauccuucaaaauaugaacggcacuaucuggacauuagaaaaauauuuucaagcaaaaacacauuugcuuuugauccaaaaaaaauucuccugugcuagcccauuaaauguaaucugcuaggaagagucauuaguuuacauuucagggacugucacucagccauauggccuuuaaacaagcgccauuucugcauauuggagcgcauuacugggccgacacauguuuuuaaugauauaaaagaaccugagcccaguaaaauaaauauuccaaugaucauuucuaacgauaugcuuggaaacacuuuauguaaacaaguggcagacauuuuaaaauauuucccuuuacuuaaaaguaacaacagaaauuuacauuaaacaaaauuguucauagugucaguuuaaaauacuguuuuccuuccgugucuauauuguauccaaggauuguaugcuagagauaauuaguauuuguuuguugaaugaaucaaugaaugauuuuuuaguaagaguauaagauaauugcuuacuuaccuuagagcauaaaagacaaaaggauauaguaaaccaggggaaauuaugccacuaaauuccaaacaaggaaagguuaggaccaaauccugacgguccuguugagguuuucagcaacaccucacguagcugccgaugguuuuucauccuuacuccuuaggaaaugauguacgucuggaauggcuuuucaauagugggaaaaaggaaggaccuuucugaaaaucucuuggugacuguggagaaggcugaggaggcauugcagaaucaagguaagugugcgggcccaggcccugugucugcucuccuuccucgccugugucuccccggugcacaugugccugccuugaucugugugcaucucacgagcccaccuugaucuguguacaucucacgagcccaccuugaucugugcgcaucucacgagcaaggcuucagcuugugcuugucaucaagauaaagagacagcaccucguuacaucagugagucuugagaaccuaccucuaaacaaagggcaugugccacaaaagaccaugguauaggaugagacuccauuuuuauagucuagccaugaccaguguuuaaaggaagggucagucagcaucuuuguuuuuaaggagcagcucuucuuagucuuuuucggcuacuguaacaggauaccauagguuggguaauuuauaaagaaaaaaaaaaaggauuuuuuuuuuucucagauguggagacuagugggugcugaaucaaggugcuaggacggaccaggacuuucuuacugcccuguaacguggcagagggcauggcguggggagagacugaggcacacagcacacaucaccauucucuucaaguuccuaccucucaucauugucucaguaacaguuaaaucucaaugguuuugaaggggacacucaagcaguuagcacuacuguccugggcugugaguggcuccauugucuuauacuuagguccacaauacaucccacccgcucucuggacuccauggacaccaggcaugcaugugagacacacacacacacacacacacacacacacacacacacacacacacacacacacacagaggcaaaacacucgaauaaaacaaaacaaaaugguagcccaucuaaugguaaucuuugcuauuuuauugagaaguuauuuuaaaaagaaaaauguuuuauuuuauuuugaaaucgacagaacugaaucauuuugaaauugaaauaaaauggaaguauguuagaguuuaccuuuaaaauaagacguaggggcuggagagauggcuucuuuuuaaguaguuacgaauucuugcuacucuugcggaggaccuggguuuaauucccaucacccauaugguagcuuauaacugccugcugaucugauccccucagugugugcauuagacaugcagguggugguacacauuacaugcaggcagagcacucucacacacacaaaauaaauaccacuauuuuuuuaaaugggguuccaugagauaggcuucucaaaaaaauuuaaaauuuugaacaaauuugguaguucucauuguugaucagugaauuugacaaauuuaauaauuugcucauucaaacuuccauagcugacauagacagaauaggggaagaaagauagcucuugcuguugugggaguuaucuagauuaaagcccacauacccacaaauuaaaaggaugaaugaauguuuauguggaaacaggaaagcaaaggagacacuuuugcaggauuaugugggaacagguguagggcauccccccccccccagcacugccucucuguccccugcuuccccaggcucuguaggugaacccucaaccucugugaugugcuguuguauccuccugacccucaagaguggguccuuugucagucacauuugcaaacaagcaguggcuuuuucuuggaacagacucguuacccucagguuguuuugcucuccauuguuuggagaagaacuaaagaaguaaugcuugcaucauaugcucauaccgggaagugguuagaaacccaaagcacugccuuucuguuucuguuucuaauggcaucuucagaugagagauccgagcaacuucugggcagaugagcugagacuccagcagacacaccaggcuugccacaauucuguccuguguuucuccugggugaaagaacuuguuuauugucaaggucaccaguuccugcagauuaaguuucuaaugaguuuuaggaccauuguucuauguaggaacauuaucuucuccgacccuaaacuccugacuuaguaauuaagcuccuguucuccagauugagggguggggaaucugugauuggaaaauugaguuaaguuauaagccugagguugugugggcuuccacccagcccauauucauagauaucagaaugugguuugguuuuguggcucaaaaacaggguaggaggguaccagugacccuacuguaguaacugggcacagugagucaagguuggccaaccacacaaagggcucagccuagcgcacucggaggcacgcucagccuuggucggcaugugguauuaauuucuguaccguuuccuuuggaagucuaaacaaauccaucauguacccagaaguuggcagcagauccacuuugucuauccuugcaguuaauuuguguggcgacauuauauagcaaacagaaucaguuacaugaagggauugcagucugguggccuuucacguuucagucagcuuccacguuuccugcuuggugcgauccagcaaguuucuaaaauacgcagcguagauauuuuuguaguucuuaagcuuccuucuuucuuggccugcccacaguuaggacacucagccccucacugugcugcacauacacuugggcaucguuaccaugauugaaaaaaaaaaaaaacaaaaaaaccccacuuuucaaacaguaucauuucucuaugugugugugguugucagaggacauuugugacacugguacuuuucuucuaccauguggguccuugggaucaaacccaggucaucacccuuaguggcagucgccuucaccggcaaagccguaucgccugucuuguugcagugauauauauauauuuuuaaauuccaauugaagauggaaacuauugaaaucuuccucuuucaugagacuuugaaucaugacagggagugaucaugugacgacaguguacuauggucagaggagucugugguuuugcuucugagguuugugucggaugugggauauaaaccccucugucaaauugcuaacuuaagauccccacagagugacuuuacugguuuuucaaugguaguugucuguggcaccucaaaaaccauaauucacugagcaagcagauguugucacgacacaaacugucagaaaacuacuucucaaaguucaauaggauacacagcagugacacuaaaauccaguguccugugugggucuuaaggcuuugggcuaagggccgacugaccuuuucguagacaucucugagagaagcauggguuggguguagggaaagguagcucuaaguagugggaaagguuagagguguuggcauccgugggcuuucuagugacgugucagcacuugauaguuagaagugaaucucaaauguuuaaacacuuagaagugaagugagccccuucuagcugggugaguggcacuguuaaccucuaauaggugagggcuuuauaagcugaaacaccagcacaugucacuggugaggucugagccuugacccugaagcaugagccuuucaaucuggggacguucagagucugcucaguucccuucaccaccccuccacacugucacagccugagacguguaaauuagcagucugucuuggaauagcuucuucacaugucacccgcaaaagaaaaaaagcaggaaagcccucacgcauggagcgcauggcauggcuaccuuugucacacagccaccgccccauucgaugcgacucacucugccucauacgcccaaacugagcuggagacagggguccggguggggaaggaaggcccugacauucuaggagcauggggguucgugggggcuuggggugccucgcccacguuucggaaccauuucacggcauaacuuccccccaaaagaacauaaccugggagaacugcuagguuguaaacauaaugaucuggaagagagguuucugcuuccugcauuuugaacgggugggaggccaucugcuucuccauauggaagcgcuauccucuccugcacgggugccagcagaguuagaagccaaaaccacaggaggagacagccuggcuccucccuucaccucugagagaauuaauggagcucauucuuuauguagaguucagauuuccugucguagcuaaggccacaggauucaggaugaccaccugaaaacucugccugugaacacagcguaagaaaugcuggugauugagagaguucaaugcucuucucagcaaggguuugcagugugucgugaguuaacaaacguguuugugaaugguccccuuaaagcccaacaucaguuaguuuuccucucaguucggaguuuuuugaaagcauuuuuggacuggaggugcagggcagcccagagugucugccucguaaagauggggcucuagcauccaucgcagacaccaugcaaacaaugagcuuucccccuuccgucuaugcuucuuguuuuaagacuuuacugacuacucuguggaugaugaaugcuuggugaaauuacugaaaggaugcugccucaagaacuuggagcggcccuugcaagcugagcuguguuucaaccacguuguggaaagguaagaggcagcccgaggacaggugguggcuucaggggaaucugugggacaaaggggugccccgagccuuuaaccucaugaacagaucugcgguuuguuuggaauauggcuuuacguuauuuccacucacugcuuaaagaugacugcuaaauguaaacuuagagccaggcugacagucgcuaagcguuggcuguaaacuacugaggcucucaaacucacuuggucucuaucacuuccuguggggugugugugugugugugugugugugugugugugagagagagauggugauuuggcagggaagagaggugaaaauacugcuccuuguuuuuucccacaggacauuucuucuguguauggugaucuuuguuuuacagcaaugacaguacuguccugauacuuuucagagaguuggagcaagggugacugccugucaguaaacuggugaccacuguguucuaauggcugugacuacucacucugcacagugugggcccaggagcagggcucccuacuucuuuucauaaagaaccugaaaacugcaucuaaugucaggucuccuggguuuuaaauauuuuguucaauauuuuugaaaagacugcaagccaaaaagauagaggccauucagugugccaccugaugccuucuuucccaggucacgugccuucccauuaacagccacuuggacuccucccucaugacaguauuuaugagaauguaggacacggaaucuuguuccccaauaagguaauuugguguauucgcagcucuaguuuauuggcauuuuccuaauguucaagggccggccacuugcugaauuucacagggaaucauugacuggugugguuuacaauguuugaauugugcagucaccuuaggugggguuaaguugaagaggagaccuccuacaccacccaccucggcuucugcgcaagccacuuuuguguuaauaucauuguucagcacaguucuuggaacucuagagcaagggacauuugaaaugcaaguuuccgugaggacuggccucuugaugguuaauuuccaaagagauaugcuuuuuguuuuuucuucaugccagaaguauaggcaaaaggucaucugucuugucccuugccagcaagagaguuucuucugguccauacucucuccaaaagaugcauccucuuuuccaagcugaagguccagccaccugcugucuguggguuuagggcuucaucuucuucauggccaccaagacacaagucuuaggucucugcauaaccaugucuccuuccacacaacugucuccucuuacuucuuugagacuaguuuugguuauagccugauaaacugaaauuaaucugacacagaauuagacaagucagcaaacagaguagccauucagaauggaaacuguagaguaucacauugcauuuuguacuuuuaaaaaaagacuuauuuauuuuauguauucaaguacacuguagcucucuucagacacaccagaagaggggcgucagaucccauuacagaugguugugagccaccaugugguuucuggaaauugaacucaggagcucuggaagagcaggcagugcuccuaacugcugagccaucucuucagcccacauuuuguauuuuugauaaugaguauauuuguaugcauguaucugccaccaaaagugaaaaaauccauuauaguuugaacuacagaaacaguucgcucuagauuuaaaacacuguuguuaacucaaccuuuuuccugggcuucuaguuuucauaaugaugcugaaacaagacuacuagccacccagucacugacauuuugaagaauucuaagaccaaguaugaagggaauugaugcuuaauuaaacacauaaaccagugcaaguuccuuacuccuacauuuagaaucacaugcuccugaagaugaucuugucaacucuggguucaucuuauugaaggucuguguguaucgguugcccugagagguuguguguguggugccagugcuggccuuaccuaaggaacagaagauuaguguugugcacuuccuuccauauguugugaggccucguaucugugaggcagcauccuuccuccgauggcagucucgauguugucugggaaaugaagagugaugugcgucugaggugaugccuuuuguguucuuuuaagacuuaauugauuuucauuugcucuuuuagugaaaaacuauugaaguacgaccacuaucuggugccauuuacgcuguuugaguuggcauuuuuguauaaaagccaaggggaaauugacaaggccaucaagguccuagaaacugcaaggugaguccugaagguaacuugcccuguggccuugaagugggagacaucagugcuauugcaacagcagcagugacugauuccuuaaggccagugagccaaugcagguucagcacgguugcuuuugcuaauuuaggcugugggcuuuugcuggaguugugcuauuuccugccuuaguccacugcucuguggcuaccugcagaugugauugugugcaccuagcuaacugaccagcuucagcauauugucuucuguaucaggagucagcacacuucucugcaaacgaccaagcaguagguaucugggccucagagugggcacuggcuuuagagccauaaacuguccaucuauuguaugcacuuaauccacuguauguaccuguaauguggaagggaaggggagaaugggcguguucagagcugcucuuugggucauaguuuucugaccaacaaauacugucauauaagucauaucugacauuuccugaagagcuuccaaucaugugaucuuucccugcauucauuuuucgcuucuauggcaggucuaagugucuuuugucauuucugcuagauagugacucagacuugugaucauggcacuuuuucagcaagacaaaaccuguagucuguuugaagaaugccauacaggucaguugaguguaguagcucacacacaaguguaaucccuacucuaaucccaggcaguaggaacauugccacaaacgugaagcuagccugggcuacaaagugagaccuugagucaaaaacaaauacaaacagacagugagaucuuguguugaaaacaaaacaaaacaaaaaaaccaaagcaaaaaguucugggucauaaauagcuuaguagucacuguuacuucuuccuguucacugagugccuguuauauauaugccaggucagugaaggccauggagggcugcugugagcucagcggggaaugcccugcagggcuagcugaagagagaucagagacucgagauguacgguguugaucuggggugccuggauguuaacugaguugagagucuuuggaggaggagacaguguaguugacaccuguguaaguaggcuaguuuuggaaaggugggucaccaggucauccugcacaggauguggcuguggagccccuggguuaggcagugugguuaguggguggacaguggugguuuauacuagcuacgggaacccucagagcagcaggguuuugggaggaaagagacacagcgcucagggcugcaguacuuugugguggcugcucaggauccacauggagagggugagcuggcuggccacaagauaugcagccguuuucagggccacauggacaggagccaaaguccccagcacugagugucauagucaaagccauuguuccugaggucauuagggaaagcgucagagcuggagcuggaggccccauauagccccuggagcauuccagucuagacauuaaguuguaagaguuggacacuuaagaucuuagaguuaagaggaugguccguugcuguuuaacuucuacagaugucaauguuuaauuaaaguuguuucagaacagugaggugcagcacguggcucagagagucaagaacgagcccguaaaccugaagaccagaguucuuuucuagaaggaaaagaaugagcuucaucgaguuguucucugaccuccucacaggcucuguggcauugccuacacccauacaacaggacauacacccagugauaacaaugacaaaaucaacacggacccucuaaauucauacaaguggucgucagcuaagaaaguucagauaugagaaggcaaacauuccuuagaaugggugccagcugccaaacagcauaagaccagaacuauagaggucaugggugaccaugacagggaggugggcucagcuaccauaagaugcuagggacguuagcugugaacagacuggcaauauggaggaagacgccuuagagagguggugccaccaaguacuucuuucuuacaagagaaauggacaaugcaggaagaagccacuuuggaaggugagguguuaggcaugagaacacugcaguguugcagcuguggcgucugucuguguauccucggaugacaguguggggcacucggaugacugacagugcgggggcggggcacugcugcuucagaccuucccuguuggaacacagcgcuacucagcgcagcugcggcaucaggugaugcugcucccuucagcgugggcuuuucaaaaugcccagggucuggccagacccugagagaauauucacugauucuuugauaaaucuuaguaacaggucuauuuuaaucugugaauuucaggaucuaucacacucaucaauguuaucaagaaaguguaaaaaaaaaaaaaggcaggggaauagaaagcaacaguacuucagaggcagcaucagcugucugucugccgaagcauauaugaauccaggagaccuaagucgaagcugucuugucugcuuugccaguuccuagcaauuuuagugaggagaagucaacaugaacgauuuaaguccauguucuuucucaugguucuggggauugaccccagaggcucugugugccaggcguguucucucccacuguguuccauuccucgccucucacaguguaccacccaccuugccuucuugaccccuucugacacuggucuaauugagucauuagugacaaaaucacugaaaacuuacaugagaacuggaguaagugguuuuggggucacggggaaauccuggugucuuuguugugggguaaccguguggguuucaagguauuuuuauucuguugaauaguggauuguucaugaucauuguguuauaugacccugccuuaauguuuuccucuuuaaauauggaaguugagccauguagcaguauuuagccaaugugccaugccuucuugaccaugcuauaguuguggucuggcaauuagaaugauuuacucaacgguauaaccucuuaaaucaucacuggggaagccucaggaaagcaagaaugcagacucacuguucacuuugccccacagaaagacgcugcucuuuacucugcuccaguagaacauguuagagucagauguaaggggucagagggaggcagaggaagggggcggcaccccccuagagaggguaaguucugacuguacaauuuuauccuugucuucagaaauaacuauaaggauuacucccuggaguccaggcuacacuucagaauucaagcagcucuucaucucuggaagaaaccuuccacggacugauccggaacacacaggauggaucuucccccccgguuaacauugacucuugcuauggagaucacucucugugucaagguggacccaugauccaucaaauaagaaacagaaagccugcugucagccacuuccugucaucggaguggcguacuguuuggucuacauacuuuccccucuggaaugacauuuaauacuauacagaaauucuuauacucugccuucacuguagauuucaauugagggggugaagucuuuuaaaagacuggcagguacaauaaagccuaguuagauuauuuauuuuuuuaauguaaaaauuaauauuguucaaauagcaaauggcuuuaucagcugagccauuuuuagauuggcuuguccuuuaaacuucagagauauuuuacugcuguuuaaaucucugagaguaaauaaauaucacaucuauaauaguaugacaguggguuucugaagauucuggaagagagaaaugaggggccugaggugggugaaguauuccuaggcagaagggacuuguaucucagcaagaugucacaguuguaaguuucaggauuuccaguccucucauugguugaaggugguggcauuuuucagaaacuauccuguauuugaauguacucauaucagauccaauaauagcauucaaucacauagacacauuucucauguaucuaagggaauaaaaagcuguauuuuagaucucccuaagcuuagugcugaagccugaacuacagacuuccauuguguuucuuacaggaaggagaagcuccuguugcugugagugauaugugacaugucagugauuguuuacagucaugaugcugcugacccagggccauggcugcaucuugguucucugaguaggaacccggaucagagccugagcagaugcccuucugggguccccacaccugucaaucacccuuugugaauuagaaagaacacgcucauuucgagaaacagaaaaggcacagauggcuuuaauuucucuuugaauuguguaacugugagucucuguguuagacacuuucaacaaugcuuagcauuaauccaaacucuucccauuagaauauaguuucuucaaccccucgcucuccucccaaucaacggccuaucaauaguggguguuacagcugagggccagacuccacccagugacaaaaaccaguuagaguccauggaccugggcuuuugucuuguuucuauuauuuccaagaccaguaacuucucuagaggguagauggcuccaccuucccucgucagcgccccagguuuguaguucugagucuuucucuguugguuaauaguuaacaacauaaagcaaauaacuuaccuuuuccaggacuuggguuuuccagugggagaggcaagguagcacucacugccugcagccuccagagcuggugcauuugguagcuuucuguauacuggggaagcuguacacggaggagugaguuugauaacuauggccuugcacauggauuacaauaccucuaguauccgcugagucuguggucucuugucuacagugagaugaacgugagcauucaugaccuuucaguuuauuuauuuaugcauuuagcacugacaguggcccagauuauggaguugcuccugcuguccccgacugcaguuccccaugcucagcaggcacugguggccuguuacguaaggugccauuucuuauucaacauugauaacacggaggcagaaaucauuauaucucacuaauaugaaucacacaauuagcuacagauaguagggaaauaaauugucaugagcuauagaaauauguuuaauaauuauauauauauauaugaagaaaaguuuauaaauucuuuagaagagcuuugauaacgauauuuuaaaaacaaucuauucauacuauuaaugugauggggugugguggcacacauuguuaauucuagcauuugggaggcaggggcaggcaaaucucugaguucgaggccagccuggucuguuuauucaaaacucaaaccaaccaaacaaaaagaauacccauauuuugugagaaacuaucaaagcucauggucuguaaauucccauucugauauuaaaugaaaaaaauuaagcuaaaaaugacuguuuuagagacuggagggugucccggcaguuaagggcacuuucugcuuuuccauaggaccagaguuuguuucccagcacccauggcaggcaguccuuaacugucuguaacuccagaagagcugacacucgcucuggccucuguaggcacccaaacacacauggcaugcauucacauagaaacauacauacauacacauuaaguagacaauaaaucauuuuuuaaaugacuacuuuuauacuaucaaacaaaucuacuugugcuauuuuauuuugugguuuucuuuuguuuauauugcucaaauucucucugucagcacuguggaccaucuaucaguggcuuuauaaguacugcaauagaauuaauaccacagaacuuuaucuauuuucugucauguucaagauacuguaccggcaccaauuucuuaggauguuuguaagaaucaucuuuuaaaaucuguugugauuuaagauguuuugugaagagcaagugccuaagagacaacguuaucuaaucaucuuuuugaggccacggguaauaggcuggguuuccaguaugucugauugcaguuucuguagcuaccugcagaggcaguguucugaucgguguuuuguaaauguaaggauuguauuucagagccuugggagggaaagccuaauuuccuugggagaauugauggaaggguaacuacagcaacucccgaguauauuugaccacuugcucugucugcacauaggagauguucccuauuuacacugcagacaguugaguggccuucuaguuguccugaggacaggaagagacaagugggcaggagcuaagggagaucaauucagauuccuggacacugcagcuguucgagcaauccaacagcccaaccagcuccuugggaauggagugaauucagcaguucuggugacugucaucccgcccuggucugagugucugucuggguuaauugaauuggaggucagcucauucuacaaugcuuugaucggggucuaaaaucugagguagggaaagguaaaaagcagguacccucucuucaaauagaagcgcauguuccuugucaaucauucuacugugaugggcacuagugucaucugcuauuguguuuguuaugggucuggcuggcucaucuguccugugccaucuauucuggguagauccuuguuaguagagacccgcacccuggacaguaaaaauaauggaaaaagucuuuaugaucaaguggaaaacuaauccuggaauuauucugcuuaauucucuggacauuuuguuuuuccucuuccuuucuuuuccuuuccuuuccuuuccuuuccuuuccuuuccuuuccuuuccuuuccuuuccuuuccuuuccuuuccuuuucuuuucuuuucccacugguuugccaacuuuguauuccugaaucaccaguucuggugcauucaguuggaauuaguucaugaaguaacugaaauucuaagcauuugugauuuaucaggucuagaauggaucuuagaaaacuacauugucccuuucagccugugagcauguugggccugcuguucucugucuacugcaauagcaacuugucagcugucgcugcucuacucuugccguggccaggggaccucccucuuacaccauguugugucauacaucucucagugguuuacuuuuuccaucccguguacugggcagaugauagagcuccguggcuuguuugaacauuggccuuuacccaccucucaccccugugaacuucuugugugccaucucaaagucuuuauuuuuaagauuacuagguuauuuuagaaacuaucuucgaugucacagcuguugggguuguagaaauauuuguagauuucaugaguaagacaauuuaugaaaaaucuagugaccccuuugcaagacuuuggcauuauggaaaugcuaacauugguucucguagcuagcccauuauacuauuuaaagguuguuaggcacaauuuauuucccuuagggaguaacauaaaaggugacuuaacuaaauuuaaauauuucaugccuuccaguugccuauugugaauaucuugagugugugugccuaagcgauauacauaauacaaguuuuaaucucuuuaagcaucucuugauuagaugcagggguagcucuaauguaucaauagaccgguaucaguaaguaauauaaaauaacccauauuggauaauccuucaugcccuuuuaggaugaaagcauuucuccgaguuacuuucuuccucagagcccaguugucuacguacuuuccuuuauguauuagcuggccagaacccugcaucuuuaguuaguauuuuuuuuuggcauauuguacauuugcuguuagcucuuguuauuuuagaaugcugaacuugaaauauaauguaaagggcacaucagacuuuaucaucauggaagauagacuucacauugaaugguccucucugaccuggacagccuuucacauggggaacaauuuaaauccaucccaauccauuucuaaaaccucauugcugcaggaagaagcagcaagaagagcucuucuguguauugagguggcugagcagguucuuagccuuaaccaugcagaagaaggauucguggaugcagccccauucccuucuaauugcacuguguacagugacagagucagcacaguauugcugcgacaggacuuugugugcaaagaucaaagcagcugccuuacuguguuuaaauaauaaagaaugucugcacaugccuacagguugaauugaauuuuauuuuguggugcuagaaauggaccacggagggcugguguaggcuuuggaagugcgcuauaccugagccacauccucagccccagguugaauauugaauggaaaaagucaaggucugcuaauaucaaacuuacugacaguaagugcacaccgcaccuuguaugucacagcccagugguucuuagguucuguguaauuuaaaggauaaauuuaggggacacugggugcauuuaauuuuauugcacauuaacuuuuuuuauuuaaauauuuuuaaggacuuugaauuaaaagucuucguaguuuguguaccaaaagaaaagaaaaagaaauuguuuucaguggaacguaacugauaaugagaguaucugaauaacugaacauauuaaggaauauuacuuacauuuaucuaggaaggaauugcauuauucugaguuugaaguauacucagauugaaggugugacucauucugcuugaggaaucacacacacacacacacacacaaacaccuuacuuuagucuuaucuuaauggagcaggagacccaggcaggucacaguuuuggagauaguagaugaguauaaauaauuuucacaaauucccauuuuuccugaaguaauuuuuuccccacaguagacaguuaaguguuuucgguacagcucuccccuugcccacucuuguauuaaaccaagguuaccagcacgggugcuaaguaagcucgggaccacagagcacuuggcccaagggauuuauuuuuaacuugcacaaaagagagagauuaugguaaacauuuuaaaucucaggcucuugguucuguuggguccagauuacccaagaccuagagagacugcgugucacuggcucgugcuguacaggaaaccacuuaugguugacaguggguugugcaccgucacugugucauggggauuccagaagccacgucuucaccgcuuucaucaguuuuuccuuuuguugacuguuggcaucugaccaccugggugaauaucagcugucucuuuauagauuacuauuuuaaaauauuuauuucagauguucauagaauguucaauuuuuugaugcaaguuauuuacagaggcauauauauuuaauaauugagauauauuauuuuauugcacaaccuauuuuccaaagcaaauuuacuuuguagguguuugucuuuuugugaagaaaaaaauguuuuuuucuuuugccucaaaauacaaguuguaaaccugucuucuggcguaagugacucuugugauaauauuugcuuuccgcuuauuugugaaccaguuuggaguugccaguugaacccucagagcuccccucugaccuggauucagugcagugcuggucaaacuuggcauuguuucccugccucgguuuccucuccucauugcacuugaguuuggccuccguuaguucguuuuucagcaaucaguuuuacagaggaaaaccgccuuaggaauugaagagguuagaacucuuuguaaaucgaauguguuauuaacaucugucugcuaauaaguggauuaaggucugguccuagagaaagagaccagcuagaaagaacaagaaaagugcaaauauuuuugauguaaauguuguguucccgugacuuuucauaugcugauuuuauguuaaugugaucaccugugauauuuaagugaccgcagauaaagauuuaauuuucaaccugaagacggcagguccuguuucuauuuuuaauauugagacaguuuugaaaacagaugucguauuauaaauuguauuuuuaaguggaaauaaaucaauuugaaagucaguguuuuccuuuucuuugucccuuacagaaggcucuguguuauuagauauauauuuaaguugccagauuauuuucagaauucucuauuuucauaucgcuguaaccaguuugccuacaaugugcaauugaauuguuauuuaauaaaugacacgugaugggau

SEQ ID NO: 1961 - RNA, 2072 nt, Mus musculus
uaucagcucuugccccuggguuccugcucugcuggagucuuguccugacuuccuuugcugauggccugugauauggaagccaaguugcuuuggucaugguguuuugcccauauugucugugcacuauugcaugccugguacccaaagaggucagaagaggcccuggaacuggaguuauagaccacugagaacugccacacgggugcugggaaccgaacccagguccucuggaagagaagcugaagcucuuuagccacugagagacaucucuccaguccugcuuguuguuuaggagacaggaauuccuguaucccaggcuugcuucaaacucccucugaaggugauuaugaccuugaacuucugguccuccugccucucccuugcaagugcugggauuauugaucccaggacuucaugcaugugagccaaguauuuuaucaguugagcugcagcccaguccauccaaugaguuucaauaaauaaaauauauaauauccaugcaauacaauuaaauucaaccaaaaaggggggggggaugaaguacugaaauuugcugcaaaguaaaaauauuguacaauauuauagaaaccuauuguaaaggucauauaugauuacauuuauauuacauguagaaaauaaacuggguguggugggacauaccuuuaaucccaggacucaggaggcagaagcggcugugaauucaaggcuagacuguucuacguagugauauccuauuucaaaaagcccagauagcaaaccuuuacagacguaaagccugaaaaguguuggcuaaaguuggaaggauugggagucauaacuaaaagcaaccuuuucacgaguggugaaaauguucuuaaacuaaugguugccccauugugaauauacuaaaagccacuaaaggaauaguuccaauggcugaauuauacaacaugugucacaggacaaucauacaagccagggauuguucagcacacccugcuaugauauuuggaacagcugagcgauggccaagcuucagaaacaucuaggcucacuggguuucaagcuacuuccauuuccuaguuuaccgguuuacuccuuuaacaaucacauucggcucucuccccggaaaaguggugacuuuucaaaauauauacauauggcuaagaaugaauuuguguguugcauagccgacguucgauaagcucuaucgugcagguagguauacaaaggcacgcauacaaacacacaccgugccuuucagaagauucuggacgaaccagucucagugccccuuguccuucaggauucucucuaggauaggaggaaccgcagagcagcucgcaaaaccaguggacaaaagucccgccccuacgaaccagauuugagaaaacuaugagauggggacccaaugauugagucuuuagguaauugugggucccaauaccagaucagcucggaacacagcgagccgcacagcccucggacaaguccagagaacaaugcauccagcccggcccacagcgaccgagccgcgcccaggcgguagccagccugcugggaaauguaguuucugaagcacagcucgcgcaaccgcccgccaccccggagcucugcaaaacuacaaaucccgucacgccccgcgacgcccucucgccagcuuuugccggaagggaucguggcugacauggcggaggaccugcagggcggcggugcggguggcccacagcacccaguccccagugcgagccacagcagcuuuccggaauacgagcuucccgaguugcacacgcgcguguuccaugugggcuccuuuggggagcuauggcguggccggcuaggggcccaggauuugucgcugagcgaaccgcaggcagccgagcagccgaccgacggaggggcauccaacgacggcuuugaggaugcugcaguagccagcgaucugggcugcagucuggaggcagcagcagagcugagggucgugugcgggugagugugcggcuucgggguuuugcguggaucccgcagggcucagccucgucccugcgcuucucggagacccuuaaccuucgucccccuaaacccuuuccgga

SEQ ID NO: 1962 - RNA, 50382 nt, Mus musculus
cagcuuuugccggaagggaucguggcugacauggcggaggaccugcagggcggcggugcggguggcccacagcacccaguccccagugcgagccacagcagcuuuccggaauacgagcuucccgaguugcacacgcgcguguuccaugugggcuccuuuggggagcuauggcguggccggcuaggggcccaggauuugucgcugagcgaaccgcaggcagccgagcagccgaccgacggaggggcauccaacgacggcuuugaggaugcugcaguagccagcgaucugggcugcagucuggaggcagcagcagagcugagggucgugugcgggugagugugcggcuucgggguuuugcguggaucccgcagggcucagccucgucccugcgcuucucggagacccuuaaccuucgucccccuaaacccuuuccggaaggccggaagagauccuuggguccaaaagcacuuuccugagggguggauccaguaacgggacacuacaaaugcacgaaagacuucuauucuugaucuuuaaagugcuuguugaaguaacagcgguauauaucugucauugauauuuggacaauggaaguaccugaggauggaggagacuuaaacagagccggguugaaaccuuuauuaaccgugguuucuagcgguccucaugaaaauguuauuacuaaaauuucccuaaaaguuucuuaccuggaaauagaaauacaaaaacuaacuuguagcgguccuucuccuuuugacaguacuggcuguccucaaaugaacauacacccuuuucgguauaacacuggcacaaaaaccauugucuugaauucuggccucuuuugagcugccugcuggauuucauaagacuuaauuauucaaugauguauuuaggacaagcucugacccgcuguugaaaaaugcauggcugaucauaaaucguugcuuuuccuuucucccuuucccaaccucccuuucucuaagccuugauaaacugagaugccucggggaagaugaagacccggaagucaucccagagaacacugaccuagugacuuuaugguaugaguuuuguuuuguuauaugcuauuuguuuuggugcuggagaugaaacacgaccuaccacuaaacuacaguuagucuuucugcuguuuaucugaacacucugaauguuuuacuccaccacuuaaaauucaaccauuaguuugguguccuggcuuuuggcuguaaucccagcccucgggaggcugagucaaaacugauguaaguuagagguuagccuuagcuaccuagugaguucaaugauaauugaugacugguuguuguugugguggugguuguuguuguuuuaaacauuuggacauccuuucuuuggcucuguggcucuguggcucuguggcucuguggcucuguggcuaugggauacaguuguguguguuuccccaggcucuuccauucaguaaaucacagauacugugcuaauuuacccaucaguuacguagcuccaaaagaaguaccauucuguaauuugggauuagggugauauuuuuuuuuuuuuaagauuuauuuaauguauaugcguacacugucacugucuucagacacaccagaagagggcaucagaucccauuacagauggcugugagccgcuaugugguugcuggaaauugaacucaggaccucuggaagagcagucagugcucuuaaccacugagccaucucuacagccccagggugauauucuuacaucuaaagaaaaacauuaagaacacaaaaucccuaauauccacuacauauuugaauuugcauugauuuuuuaauguagacuuuaucuacuuagauuuguaaugcaagcuuaaauacucagauagugugucccaaaauaccggugauaaggaaggaauuggugaccuacaccuuuaaucccagggaggcaggaacaggccgaucucugaauuugaggccagccuggucuacauagaucucugaguuccaggccaggcagggcuauaugaugucugaaaaaaagaaacaagcaccguuauuuugcuucuuaauuuuuaaucuucaauggagccauuuuauuuguaaaauacuauaaaaaucaauuccuaauccuggggcgguggcuaagcacucaggaaggcugagcuaaacccaucgccaugaagucaaggccagacuaaguucccggccagcuugaauuaaaugugagauccugucucaaauauaauaaaauaauaauaaucccuucuuaaauguaauaauaacaauaaauuacuaaagaggaaaaauuaaaccagaaugcuaacauaauaaguccaauuuuuauugcaaaauuuagacauaaaaaugcugucaacuuguaaaaguuucuaaaugccuacuuucauuuugcagauugcuuaucacuuauuacagauccauuuuagccugcuuacuuaacacauuuugagcacuguuacucaaugauguauaauauuagaaauuuauuacuucugguuuguagcccacuaauuuaaacagccucaacuguguucugucauuccugaguccuuuuguuauucccaucaaauauuuguagggaggagguguguuuguauauguuuguguuuguauauauuucuguguauuuauguauucauguuuugacuguguguuuauguauguauuuguguauucauguuuuguuuguguguguauguguucagguuuuuguauauuuguguguguguugacaaaagaguauucuuuagcuaggguuggaaagcuauuguauuuaaaacuuaagaaaugaauccuaauaaccuuguaaaauguuggacguuuugcaaaagucuaaaucuagcccuacguuugucuucccuaaaacucuuucauucaguaacuuaaaauaaaaauaaaaaucuagccagggcauuugaugguucauguguguaaucccaguauuugagagacuuaggaaugaggacugccagaaaguccgggcaggcuaaccugauuuacacgaauggguuccaggcucucuauauaaaaagaaacaaaaggucccuuaaguauaaguuuugccacuguuuuucuuuucuaauaaagaaacuucuugucaggcauugaagagagaaggaagacagacguuagaaauugguucuugcugugugccauccuuuuaucauaacaagcuaaaugacuuuaguauuuaaggguuuuuuuguuguuaaagauugcuucucccuuccuuccuuccuuccuuccuucuuuccuuccuuccuuccuuccuuuuuuuuggaacucacucuguagaugaggcugacuugaacuccaagcuuuauguuucucuacauccaucucuccaacuccccguauuuacuauuuaaaccagguuuuaauuucugcaaucagaaauuaauaccguccacgguaaugguaaaaucuguucccgcaaaccuuguauccauccuccucgcuggucuggcuuacaacgcucuguuuacugcucuaauguaccauuuaaaggauaaaacaaacugucagauuuuuggaagaaagaaagaaccacaaaauuguaagauucacaacugucaaccaaacuaggaauguuuuaaaagucgauuuugagccaccaagaugcauuagccaucagaucuaacagccuugguuaagaguccauuugugaagguuuccuaacaucugucuuccuucacucuucaaugccugacaagaaguuucuuuauuagaaaagaaacaggggggcaaaacuuauacuuuuuuuuuuuaagaaauuuuaauuacuuuauugaaaacugcucugaaugcuaaaauguccaccuuuacaauaaacaaauacaguaacgauaacucacauuaaaacaaaacauuucugauagccauuauuuuucuguuugggacaguuuaaaguuuuuuuuuucuuuugugucaucacaaaaacaggaauguaccuauacaaaggcucaaaauaggccaucuuuaaaaacaaaaaggcaaugauucacaaaagacuaugaauagaacauguaacuagcugauacaaaucuaauaggauuuguuaaaaucagucacaucuaauagcacaucugaaguguucuuguauaaaauaucacgugaagaaaagaauuuaucaaugucuaaaaaaguggguuuguucauagacaaucugacaaguuaccauaaaaaguguuuccugagacauaaggaaaugcaacauuauucuucuugaacccuucucguccaagacuuuccacucaauaaaauagcugaggaucugaaacugagaaaauagauuugaguacaaacagcuugugaaacuuaauacuuuuuucuuuuguucuuuuccuuuuuuuuguuuuuuuuguuuuuguuuuuguuuuguuuuuguaucagaggguuuuacugaaccgacucugcuacucagaugugaaaccuucuguauaggagcuuuuacuucuucaauccugugcguggagaugucuacacaggcaaacaauguccuccccaucuuggcuuaauuuuaaucuuccuaucagcagaggcaccagccccuggagaccaaagggacuagucuugauggggauuuccucucaacuuuuuauugauauucggagcucuugaugcaacauucuagagcaaauucuagagcucuagaauguugcaucaaaacuuauacuuaagggaccuuuugucuugagaagcagcgccucacgaacccucugaccucccuacguccaccauagcaugaggccacaugcucacguccuagaguaaacaaagaacuguaaaaacuaaaguaaaccaaaccugggauuuuguggaaaaguaaaaccuuagccugugucagaaagacagaaaaaaaaaaaaaaagcacuguuaaaauaggaaucuuauaaaacaauccaaguaccacaaggacacaggaggaaaugagacuccaaagagaacuuccugcaggaagagacugacugagguuagcuugugagaugagugcaguaaaacuggagcucaaacucauagaaagccuucaaucccagcagaggcagagacaggcggauuucugaguucgaggccagccuggucuacagagugaguuccaggacagccagggcuacacagagaaacccugucuuggaaaaccaaaaaaagaagaagaagaaagugaaaagaaauggacagaauguuuauguggcagaaguaggcaaaaacacacaaugggaaaaggaggggaagcgaucugaaccaguaauuuacacuuaaaaaguuuuaagaaaauacaguaugugcaccacaguuacaaccccuuccaguucugagaggcugagguggaaagguucaugucuggacuguagaauuaaauccugucucaaaaaagaccucuaaauaaagauguaguugguggcaaaacacuggcugagcaugcacaaggcacugacugacccccuguuccagagucgggagcaaagcugaaagcacugauuugcucugacuaccuuagggcauaagaacaaggaggagucgagcaugccacacuuguuccgucuccacuaauguguccccauucccucacuucuacccagcaccccugcaggagauggcuuagguucacuguuuguccaggucagugggugcuuaugcaguuuaucuccuauaucaggcagaguccaaguaaggaaaaacagcagucaccuugauggaggaggguuaaucuaacggacuguuaacuguggcugggcauugugguucgugccuguaaucucagggcuuaggucugagagguaggaagaucccuguaaguuugagaccagcuggacuacacagugaguuccuguacagcccggguuuugggcagaaacauaacaaaacaaaaagcucugaggaagggucagaacagugaggcgcugacacaauaacgaagggaauggggcuaggugguagaccagauagcuguaaggggcgagagugcuaagggagcuccuuucuuccccuagacuaagacccacagccuuuaagagagggccugcccuuguucacuaaguggcagugacauugcuuuguagaaauccgugugccaggaagagcuguugagggcagcuggugggaagggaagccacugggcgcuuggugcugcagccaagagcuggguauugacaccaugaagccgugugcacuuuaggacugugcugagcuaacuagcaugucgccaggaagcaaaaccuucccuagaguacuacaugcaauacaaguucucuccuauauuuauacacuuaaugaguaccaguuggcaaagaaaaauaguuaaacugcgaagguccauuucuacagaauagauaaaagcguguguuuguagacaagagcugguaagcugcuguauccagcuuaccuuccuuccaagguucccauaguguggcuuggcuuucuucauccacaaggaugccuugagaagcacugacucagccuucaucggagcuucauuauucuacugugugggucucccauauacaccuauauggauguguuuaagauauuagaaauguuuugcaagcuaaaugugguggcuacauuuguaauccugcacuugggaggcuaagacagagagaucaugaguguuaggccacccuggacuggugagaccucaucaaaaauuaaacuaagcaggguggagguggcacacgccuuuaaucccagcacuucagaggcagggagaucuuugugagguuuuuuuuugggggggaggggugugguaguuuucgagacaggguuucucuguguaucucugacuguccuggaacucauuuuguagaccaggcuggccucgaacucagaaauccgccugccucugccucccgagugcugggauuaaaggcaugcacuaccacgcccggcuugaucuuugugaguuugaguccagcuuggucuacauaaugaacuccaggacgaccagggcuacacagagaaaccacaucucagaaaaccaagaaaguaaaauaaaacuuaaaaaauagauagcuccaaaggaacaacaaaauugcccuuuggcuuacacacacacacacacacacacacucacucacucuccucccuccccacuugguuuucaacaaagaaaauguaugccugcauuugaguacacaaacauaggauacagaaacccagcaagugagcccauguguuuuacaaauguccacagcccugaggaggaugcagggagcuccucugaguccacguggugauggugaugcaaggcugaggagaaggcccugcucauguguuacuguuuaucagcacccaggaagcugagugacaccauuacuagacuugaacagauaauaggugcggcucucagagccacccuucucacuuucggagagucugugagucuugugaucugguuugggauuugaagaauccaaauagaaggcuucagagauggcucagucaggaaagugcuugcaugaagucugaauuggaucccuagugcccacauuaaaagagacaguggugcacaucccagugugcaugaagcagagacaugggggucuugagagcaauacaguagaaggauggcuuggguuaagaacacuggcugcucuuccagaggaccuggguucaguucccagcagccacauggcgcuucacaaucaucugucauuccguuucucagagagcuaaugcguacuuugccuuccaugagcaucgggcacucaugugauauacagacaugugcauaggcaaaacacccauuuacacaaaauaaaauaauaauuuaaaaauaaugacaaggugaagccaggugugguguucaaggccagcauggucuacaagcucugggcuagcaagagcuguauacuaagacccugccaugagaauuaauuaaaagaaugaagcaugauaaagauacccacugucaacuuuuggccuacacacacacauguauccacacgcaucuguaucauauguacauaaaaguauccauaucuuuuuuuuuuuugguuuuccgccugucaaguauccauaucuuaaauacauaacaagcaaccaaaaauaacagguguuuguacauucaugguuuaacagacauccagccuacuucaguugaaaggcuuagaagcaguaacugcuaaucauagcacauaguuucuagaacugguuucuagaucugucuccaugaugguguauucuguacuccaacgcuuggggcacaggcaagaggaucaagaguucauagugaguucaagcccagauugggcuacaugagaccuugguuuaaaauaaacaaacaccccacuccaguaaaggaacucaaguuccugaaggguuaaugccaagguuuggguaggaaaaguagagaauguguuuugaauaccugugguuccacaaaccaaguaaugcgugaccucuuccccuaucaaaaauaaaagaucagccgggcagugguggcgcacaccuuuaaucccagcacuugggaggcagaggcaggcggauuucugaguucgaggccagccuggucuacaaagugaguuccaggacagccagggcuauacagagaaacucugucucgaaaaagcaaaaaaauaaaaauaaaaaaucagagccugucgcguguuuggagcaacuugugacuauuugagcaacaaaauaauaguagauuuuaacccauggaauaaaaugagugaguggaauuuguacaaauagaaaugaacaaaugagcagggacagguuauuucgcaauagaauuccagugcaggggaagagcaccauuaggcauauaccauaguaaauggugguggggaugucagaugggugcuaaaauuccugccugaagaagcaguguuugcauugucucaaaguaccguccuccaaaucuuuauccauuucagagaaaauaaaguauuguucuaguugaggcacuuggcagacagaacggaacugaacugaaccgaacugauggaagcuuccuuaguaacaugacuuaguaacaccugacccgugagaugggcugcacccccagaugcauuagucuuguaaauggucugagcaagaugcuauguacucaagccagucacauuuaaacugagucagcuaacuuaaagggcauucaguaaacugaaucaguugcacucuucuacagugucaggaucaugaaggaaucuaacagguuuaaagagaucaauggaaaacuagugcccuguagauagaacucuggaacaggaaaacaaagaaagcucuaaaguaagaguuguugugaucuggaaaacaucuguagcugauaaucauugugcugauguuaauuucaauucaugaugugaucauagaagacauuggaggaggaaccuugguggagagggagaaguaguaguauacucuugguguuauucuuguaauuuacgucuaaaagaaguuuaaaaugagaaguuaaaagauugggucuggucaguguagcucaguaguagagugcuugccuagcauaugugaaauuuuggguuugauuccuagcccugcuugaagcaacagguguuaaaucuucuaaaggcuuagggauggcucagugguuagacgcacuugcugcucuacacucuguuccugguaccuacauagacgcucacaacucuggaggucagguuccgucucguaggcaccaaguacaugugcacaggcguacaugcaggcauucacacauaguguauauauauauauuccccugagacaggguucucugugcccuggcuggaggucagguuccgucucguaggcaccaaguacauguggugcacaggcauacaggcaggcaugugugaaugcaggcauucacacauaaaaaguauauauauauauuccccugagacaggguucucugugcagcccuggcuguccuggaacucacucuauagaccaggcuggccuccaacucagaaauccgccugccucugccucccgagugcugggauuaaaggugugcgccaccacugcccggcaaaaaaucauuuucaaaggauauuuuaaguaaauauuguagagagcaugcugaccauuuuauuugugugucucuugucagugugaggaaggggcuuuuggacuaucgggaagaaaacaucacaauagaucgcgccuguagacaagaaauauuugcuuaugaaaugguaagucucagcucucccacucccggcucccagggcaugucauaggcuguuaguaaccgagcauuacccacagaacggaagggaccacccaucugaccccuuuagcacucugcugacuuucccuuuaguucagucucacugucaguuuuaggccaaauucaccugucuaccacccuguuccuggaacuuuuuguuguuccugauuuuauuuuaacauaaauuuuucccgagagggcgucagauuuuggaacuugcuauguaccaggcuaaccuugacuucucagagucaccugucuaucuccugagugcugggauuaagggcauuaucaccaugcccagcuuuuuaaacgguacucuuaauucggugcuucaugaaugaaacucaaaguggaaauggcaaguguuaaugaaugaggcccuagaagacaugaugguucagaagcagucacaugccacacuugugggcacuugguaauguguaagggcagcuguuggcuuccaccuuucagccuaugguacaauuacagaacaaaauccacuuuaacuggucauggagugcaugccuguaaucugagcacucugaagauggacaggaaguaucccugcaagcuccacucuagcuuggucuacauagcaagccccugggagggcagcauauggggauggaacacacucaaaguacacuauacauuaacuuuguugaaaauacccuaaugaaacauaggaucauaauaggaaaauuuuaaaaauuguuaaaaauuaauaaaaugaaaacauuuuugccuauuucaaggguucaguaaagugacacucgggcuggcaagauagcacuguaggcagaauaccugacaccgggccccauaauuugucagcuucccagaacccacaugguagagaaaaagaacuaaucuucaaaagucucccuguggcuucuccacucucaccguggcauguuuuugcacacaugcacagacacacacacacacacacacacacacacacacacacacacacacgauguaauaaguauuugaggcuauagugauggcucaaauggacugcucuaccagagaaccuagcuuugauucugagcacccacaugguggcuaacagugguuucucacuccaguuccagggggauaggugcccucuucgggccucugcagguauuacauguacauuauacaaagacacacuugcuagcaaaguacccauauacauaaaaaaagaaaaaggaaggggcuggagagauggcucauugguuacgagcacugacugcucuaccgaagguccuaaguucaaaucccagcaaccacaugguggcucacaaccaucuguaaugagaucugacacccucuucugguucaucugaagacagcuauaguguacuuagauauaauaauaaauaaaucuuuaaaagaaaaaaaagagagaaugauaauaagaaugauaauguuuuuaaaaaaaaaaagaaaagagaaaacaaugcaauacaaaauuaaaaaaacaaaacaaaacuuuaaagcaaggcaugguauugcucaccuuuaaaucccagcauucaagaggcaaaaaugggcagaucucugagucugaggccaagccuguagcaaauucuagguagggccacacagugaggcacugucucagaaguaaaaaggacugacuggccaaccauuagguacauucaugauaaugggguuuuuuggcuuuuuguuguuguuguuuuuuuguuugauuuuuuuuguuguuguuguuuuuaaagguuuauuuauuuauuuuuuguaugugagugcacuguagcugucuucagacacaccagaagagggcaucagauccccauuauagaugguugugagccaccacuagguugcugggaauugaacucaggaccucuggaagagcagucaugauaauguuuacuguucauuauuuccagaacuguuuuuuuauuaugccaacauaaauucuauacccaguaaggaaugacuuagucucuucuuccccugguaaccucuggucuguguucugucuguaugaaauugcuguucuauauaccucaugugaguaagugaacuuacauauuuuucuuuuuugcauuuuuggagacaggguuucucuguguagccccaacuguccuggaacucacucuguagaccaggcuggccuugaauucagaaauccucuuuccucugccucccaagugcugggauuaaagguggucccaccaccacucggcuauuuuuuucuuuuuguauggcuuguuuaacauaaaguguaaagguucauccauguuuuagcauguauuagaacuucauucuaugggcaaaugaaaucuuuuguuacaugaauacaccauauuuuauuuguuaauacgcuguuaauuuuuagcuguuuuuaccuuugauuauuacaaauuauuguuacugagaguacuggaguauaaauaugugucuggguguuacuuuagugacacaccuggguggaacuugucggcacgaugacgacuuugcuuaucauuuuaugggcauguggugauuccguaugaacaacgcugucuuccagaaagagcugcacuuucuagucccaguacuaauuugugaugcuccaguuuuuccagcucuuuuucaauccauauaauguuuguuuguuuguuuguuuguuuguuuugaauaacccuaguagauauguuccuuauuuugugauuuugauguguauuucccuaguggcuaaugaugcuaagcaucuuuuuauuuaaucacugcuuauuugucuuuucuuugaaaaacaucuauucugauucauuacaguuaaaauaccucgucucauuauuggguuucacuuugccauauuuaugacuugaacauguuuucucuccuucugaagauucuuuuucagucuuuugauguugccaaauguuaaaauuugaugaggucaagaauaugaauuuuuuuguuuacugacuuuuggaauauuuaagaacuauuaccuagcccaguacuauaaagauugcccuuugauuucucugucgaguguuagaguuuuagucuguagguuaggucuuugauucauuuugauuuauuuuuauuuuauuauuuaaauuuauuuuauguuugggucuuugccugaaugcaggucuuuacaguaccugcaugccugguugcccagagaggccagaaaaggaucuuggaugcccuggaacuggaguuuuagagaugguugugaacccuauguaguuaugggaaaucaaaccgugguccuacaaaagcagcaauugcucuuaacuguugaaccaucuuuuuagccccagucugagucagcauuaacaugugauguaaaccaaagguuagccuucauucuuuuguucauagcaaccaggcggaaugcaaggcaucccugccccccaaagcaugguuucaaaauuaugauugauugauugauugauugauugauugguuuuuuuuucgagacaggguuucucuguguagcccuggcuguccuggaacucauucuguagaccaggcuggccucgaacucagaaacugccugccucccaagugcugggauuaaaggcgugugccaccacugcccggcugguuucauaauuagauagacgugugugugugugugugugugugugugugugugugugugugugcuuuuguguauguguguuuuauucagaccucagaccucaggggucucacuguguagcucuggcuagccuggagcuugcuauguagagcaggcugaucuugaauugagaaaucagcccaccuccaucuccucagugcugggauuaaaggccuguaccacccacugacauucaaaaugauauggaauaauaguaauacauggaagguauucaauauuucucuagcacaggcugauauaaagauaagacacuuuagaaacagcaauuucaggaaagggugacaagagaguuuaugcaacuaaacagugguauauagauuccauccaucccucucuucccaccucccucauuccugccuguuucuucugaggaagcaggaaacacacuaaguggucucucagcauugagggccacaugcacccuuuugugagcagucuggaaaggaacagaaagacaaauuuggucugggcugagagcuugcauaccgugcccaaggcuguggguuagacuuccaucuccauggaaauagggugucucacuagaauuaccaucucgauuucaucacauauggugaaauaauuauaguugcccaguuaccuaaagccaaagacuuaagcacagaauuggccuucuuuuuagcaccguccagaauugcccuuuucugcuuagcugguguuugcaacaaugagguugucagccaucagucagugccuucccccacugggccauauggacagccccugcguuuacuucugauuuuaguaguucaguguuuuauagagcucacguguguguagccgugguuuagugguuagcgucuccuugacucuucccaaggaucugaguuggcucccagcauccauuuuguugugauaucuaguaucaguggugauggggauacuguguaugauuuuagucccuugaaguugguggucuguccuauagacuggcuccuguuggguggaggguuuugcuuacuuaugugcuagucucuagccuucacugcuuccacugccugaucaggccuguuaguauuguaaaauacaaaaguucacaauuguuuugguuuuuuaaacucccagcuuuuguugcauauaauuuaggaucuuuuuguucacuguaugucugucauugcauaucucacugcuguauggcaauguuuaucaacauauaaauacccuucuaugacucaucuuaauggaaagccuguuuuggcugaaaguaaaauagccuauagcaauuuucuuuugcuaugauacugucuccccuuucacuuucacccuguguguuuguguccuucucgcccccccaccccccuccggguucucuguguagcccuggcugaccuguaacucacucuguauaccaggcugucagaaaucugccugccucugccucccgagugcugagauucugaaauugaaggcaugcgcuaccacugcccaucugugucuuuauaucuaaaaugagucuccuguagauaacagcugaauaaaguuuuuguaauccagucugucagucaguaggggaguguccccauuacaacgacacugguuccgggaggaagggcuuccuguagcacucagcucuuagcuguccuugugcccugcucucccauuacuuccuuguuuagauucugauuugugcuggguauguugagucccaccuccuuccuuuucagcauauacugacaguaucuucucggcauaucuacugcgcagcuucacuucagucagaagggcugcugcugcagaugccuccucaccucugugugccugcgugccucuucaucuccugcauucugaguggagacauaccuuuuuuuuuuuuuuuuuuuuuucccccgagacaggguuucucuguauagcccuggcuguccuggaacucacucuguagaccaggcuggccucgaacucagaaaucugccugccucugccucccgaaugcugggauuaaaggcgugcaccaccaccacccagcgagacauacuuuuuuaaaaaagauuuauuuaauauuacauguaaguacacuguagcugucuucagacaucccaaaagagggcaccagaugguugugagccaccgugugguugcuaggauuugaacucaggaccuucagaagagcagucagugcucuuaacugcugagcaaucucuccagaccuggauacacaccuuugccagauacagaauucuggauaacuguuuucuuucgugguuugaaguguaucaucugacuuguuucuugucuuuuucucugaugagaaaucagcuguucaaucaguuggggaagcugauuuccugcaguuaaaguaacugguuucuauuaguucacuggccauguuuauaauagcuggcuuagcaucuuauuuuauuugcuuuuugucuuaguuaggguuuuauugcuguaaagagacaccaugaccaaggcaacucuuauaauggaaaacauuuaguuggggcuggcguacaguuucaucauggugggaaugaacagacugugcuagaggagccaagaguucuccauauugaccugcaggcaaccaggaaugagucuggaucucacuggucagacuuaaguauauuuauuuaugagaccucacagcccugccuccacagugacacaguuccucuaacaagauuaccccuccuccaauaaggccgcaccuccuaacagcgcuaccuccccagcauuuacaaaccaccacacuuugauucaguagacuucuauuuacauaugacuguagaauuugcuuguaggaauuaugaguuaccauguuacaucuuuuuuaacauucagagagagugggugagaccauugggcaagcguacaugugcauauacaccugccacaacuuacaguccucuccuucccgguaggaauuucugggaucaaggacucagguugugggcuggagagauggcucagugguuaagagcacugacugcccuuccagagguccugaggucaauuccaucuguaaugaggauccgauugcccucuucuggugugucugaagacagcgacaguguacucauauacauaaaauaaauaaauaacucuuaaaaagaaagaaagaaagaaagaaagaccccuccgguugccaggcuugacagcagguucuuuaccugcuaauccaucugccagcuccaauuaacucuuuuuuuccuucaagacacuauuuaguucuggcugucuuggaagucacuauguaagcugaucacagagaucagccugaccauaccucccuagugcugggauuacguuuuauguacacauucccagaaacaacucuguaaaguauuuucuguuauuacaauaggugaaacagcauaaagagaauaaugguucgcugggcaguaguggcgcaucucagcagucaggaagcaaaggcaggaggagcucugagucugaggccagccuggucuacagaacuaguuccaggauggucaagaauacacagaguaacuuugucucaaaaaacuaaaaaagaaaggagaggaaggguggggcaugggggggagagagagagagagagagagaaagagagagaguccagcugggcauuccucacuuugaauuagacauuagacccaagguugacuggaguccucacugccucuuacugaguuacaguggcugauuucaaggucuuguuuucuuucuccaggaaucucaugcacuagggaagaaaccugaaaacccagcagacaugauugaagaaggagaguguauccuaucugugaacaucuuauauccuguuauauuuaauaaggucaguggugaaaccuucuuguuugauggcuaagucucucugaguaugaggguuagagccuagggccccgaugccuucuagagaggcacuuuaucaccgugaagccacaagucccuaaaaggaccuuuggcaaagcuuuuaagacaagauguauuugugaguucauuguuuuaauaaauguuccaacaauuucaaaaguuaaauuuacaucuuuuaaccaaugauuaauuagagcuuguagcugacuuugcaguaaaaacugaaagucugcauacaccuccauagagauucuaauucuaugaauuauugagggguuuuguuuguuuauuugguuguuuuugcuaaauagguugcugguuguggaaugggauaaacuuuguugagaugcuuaggaaguugcuuuuugauacaaaugcauaacaaggaugccaguguuucuuuuguauugccugagacaaccaccuggaaggaggcaguucacagaagggcuagguuagcaucugagcugaggguuucucuaaggaagucccggcauggaagggugagcacuuucagauugguuggucugagcucugaacagcacucccauuccuaccauuccacaugcaugguagauaccacacacuucuaccaaaaagcucacucuuuguaagagcuuaauaaugauacagaaucuaagagaacacagaaugucaacuuauggaugugauuuguuuuuaguauuauaaaucaaacucagaaccuuguacauacuaggcagugcuguacuacggaacccugacuccaacccuaaaggauaggucaaauuaagaaaauuaugcuaggcaaccaugccuuuaaucucaucacuugggaggcagaggcaggcagaucucuugaguuugaggccaguugggucuacagagugaguuccaggaugaaaagaauagaaaaagaaaauuaguaacuucuuuuaacaugucuugguaggauuuaugguuaacugguuuucuaaaaugggcacuguuaacuuuacuguuuaacuuuagcacaaagaacacaaaccauaccagaccauguugguacugggcagucagaagcucacagaacugagagauucaauuugcugugucagugaccuccagaucgguggagaauucagcaacgcgccagaccaagccccugagcacaucagcaaaguaagaugaccuucccuuucccccuuaaaaagaaggaauagcagcaaaggaacccguagugauugcuccagcaggguccuaaguguugaaugcguguucucauuguccuuguugugcacugaggucucgucucuccgucugcuguccauagagccuuucagaggcagcauuguguacauauucucacuucucaccauuacaacuguucuaugacacuguccucugaccgcucuuuccccuugucuaacagucacagugaaguagcacugcagcuuccuuauucauucauuuguugguccuagggauuaaaccacguaagcauuagaacugaguuauaggcucagccuuauuguugcuuuggcguuguucuucauucuuuccuguuuaaaaugcugagauuuucacuccaccuuuacuaccuccaggaaaaguuugaaguuggccaagagucauuugcaccuguuagucacugcuugaagggcugaaaaguacacgggcuggugucggaugauggcagaguugaccuuucccauaacauaaccacaaacauguaguguaaucucuucaugagcuuguuucccagcaggggcacgacuugugagacaaaaaugccucagcaccucuugaagaggagcaggcugcccagccccucagaagugaggguuuaccaaccuaagcaaacgcaacagccugauauugcugaaucacaagacacagaauugaucugguucuuucucguggugcagcccuggcagaggacccuggguuuccuugcccacuaaggagagggcaucucugcaggcccaugaaaggacagcugaaacaaguaggaugcagauagaacuuggaaaaggaucaaaagucaggcuccugucuccaucagcuaugcacaguuuuaguucuuugauuuugagucccguuaacugacacucauuaggcuuuacacagugaaugugugucuucucccugcuccuguuuugagcauuucaguguguuaagaagcauaucaccaugcauggggguggcagccgaaucauggucacauuuacagacuugguugcaggcuuuucauguguauaauguccuggugcuguuugugucucugucuuacagacccaccauguucagugacugacauggagaugagcaucauggcucaugaagagauuacacuagauguuugugguuauguugaaaaugguuuuaagauccuuaaacucuacugaacuucugagucagugcuuguggagguaacugcaaugauaaagagaaacaaauggaauuuuaaggaaauagguuucucucucuuuuuuuuuuuuccaagggagaaagcaucaaucuuuugaaagcuuucucucuuuuuuuuuuucuuucuuuguuuuuuuuuuuuuuuuuuucgagacaggguuucucuguguagcccuggcuguccuggagcucacuuuguagaccaggcuggccucgaacucagaaauccaccugccucugccucccgagugcugggauuaaaaggcgugcgccaccaugcccggcuugaaagcuuucuuaacccuaccaaaaaagaagguguaacuauaaauagauuaaugugagcuggguauggugguguaugucuuuaaucccagcacucaggagguggaggcaagcagaucucugauuucaagaccagacugaucuguaaaaguauuuuuccccccugauguaauugucaucucagaggcuuacugcauccaucugcuaaccuaggccugguccuggaagcuucuagccucuguacaaucauaaucuaggccuagaauguuuccagccucagagacuuucugcugaaucagcucacccuuucuaguucucucugaacuccugcuggcugauucaacucagcuguccuggcucagacucuucuccaggcucacugauucagucuggcuucucucucugcaucugcugaauggcucugccuggccucauagcaaaucuucugucuccuugucauucuauggcucuuucugccuucaccucugucuagcuuguucucuucaaccugucucucucuguaagacucuuccaguaaaacugccuuuuucauuuucugcauugucccuuaaguagcuuucuuuuccucucuccugguggggggcugucauauccuaguccgucaaaucuuucucugauucaucacgucugucacucacuuuuaaacauggguggcuuaccuucauugauugggauuaaagaugugugcuaagagcugagguaccacaaccagcaauucccaggaaauaacagucucggguucacaguguaaucaaauauucucuaacacuugucuacauagcaaauuccaggauagcuagagauacagagcucuuuucuuucaaaaagaaaagauuaccaugaagaaucccuuuuuauaguaaccuaucagcauugguaagagcagauauguaguucauuccagcaacaagugcuuguaaccacuaacccaucucucuagccccuacugucuuaauauuuacacaucuguggcuacauucuuuguuugucuacuaaaauaauacucugaucauugagcacaugucaugugccuaguguaugcuggccuuaaaagaauugucaccauuuuuauaagaaaagagcauagucauccugagcugcucaagcucagccaucaguggugggggcuagagucggguucucguuucuccuucugagcccacagcuucucugcccugcccugcccugcccugcccugcccugcccugcccugcccugccgcccgcugugaaugacugcugaagcacggugugauucacucacucaccagcagcuucuagcacagggccuggugggagaugaauguaucaguucagaaaucuguuuuccuuuuuguucuucagcaauggcuuagaaauguguguuuaugauguuaaaagcauuuagaaggacagauuccuaugaaugaaguauugacugaauuuaacaucuuucugcuguuguuacugggguuuuugguuuuuguuuuuuucaagacagguuuucucuguguaauaguccuggaugcccuggacuugguuuguagaccagcuggccuucaacucagagauccaccugccuuugucuccuaaauguugggauuaaauguguauacccggcugaggcuaacaucuuuaugagccuuagaaagacuauuucauugacauuuuuauuuuacaguauuguuggcuguggggguuauuuuuucucauuuguaagguuucuguuggaaaauuuucaaauauguaaucaauauagagaauaguauaaugagccucuguucaauacuucguagcuuuuuccagaaguguuuuuuguguuaagcaccauuguaccucaaagaaaagugaaaauaagaccccguguucuauguuuuuguugguuuccuggcauguauuccacuagcuguuguagacugguuugacagugaguugcagcucuuagagugagcuagauggcuguuguugaugugccaggacuuggauaacucuaaugcauuuaauuaagucucucuagcuuugaaguagaggaggauuugccaguguuuguuuuuuuaauaauugccuugagaauggaacuguauuuuuaaaacaaacauguaaacaguacaaguacuuucugaauaaguaucaaauacacugucuuccaguguagcccaugcugcuuggaauuugugauucuccugccucagcuucagaagugcuggcauugcauguggguuacuaaaccugcccaucuguuacuucuuuguacagugaggagagguuauuauuggugaaaacuacuuuuguucuagaguuuucuuuguaaauaagcaauuaugugagaagacauuaagguguucaagucacuucuaguggagguuuauacaaguguuguaugaucaacaaaauuguauguauaucaaacuuuguuuccaaaaugaggcauuaguuaugguuagggcaugcaugcauguaucuaucuauccauccauccauccaucuuaaaacagagagucuacaagccuguguaacccaggcuugcccagaacuauguagcagaaacugacaccaaacucacagcagucuucuugccuuagccuucuuaacauugggauuauucuuaugcauugcuaugccuagcucuagaucauuuaccuuuucaauguuuucuuuuucuuuuuuuguuuuuguuuguuugguuuuguuuuguuuuucgagacaggguuucucuguauagcccuggcuguccuggaacucacuuuguagaccaggcuggccucgaacucagaaauccacccgccucugccucccgagugcugggauuaaaggcgugagccaccacgcccggcuuuuucuauguuuucuuauacuuuauuuguauauguuugcauacaagugugugccaugcccauguguggagggccagggaccacuugugagcgcggguccaucaucccuucuaccuugagcacccagugaucaaacuuaggucccccaggcuuaucaccagucacuuuaccccugggccaucucacuagcccuuggacccuuauuuuaaauagcuuacuguucugaaugcugcagaagcacauuaaaaagacugguuuguguucuagcagccaaacaggacauuuaguacuuaauuauuauuucuuaacuauacagccagcccugaggauucagugacuuguaccgugaggauccuggccauccccuuuaaguuuggugugauucaggauugagaccacguguaccuacuauuacauaacuauuacauguguacuauuacauaacaugacuuaaggacagaaacccuggugguguaugucuuuaguccugucacucaggagguagaucagguagaucucggaguugguugccagucuaauuuacagaguuuuaggacagcaaaggcuacacaaagaaauccugcccccccccgccccccaauccauguuaagaguuacuggaaauugaaaagguuuuguaagaaagcugaaaauaaaagaaauggcaggaaauauguaacuagagaaccaugucgucgcuaggaacgcaucaaggcggcugcugugguuuccaguucugauagaaaaguaccugcucgugcaggcugcugagagggaagcaacagugaugcgaacgcucugggcuccucucaagccuuagaacacacauuuaaaucaggccuaaugauuagaauagcaauaggauaaagcugaaaaagagcugugucucucucucucccuguguguguguccaagcagcaagguuuuacugagugguagcagagaggucccaucaugcguugucugguauucuugugguuuuauaguguauugugaauauuugaacugugaaugggcuuucguugagcacugucuguuuucuuguaggaccucuacaagucggcuuuuuucuauuuugaaggaacauuuuacaaugacagaagauacccagaaugcagagacuugagcagguacuaauucuucccaaagcccuuggaggaagggauucacucugugccccuggauggccuagaccuugguucauccuccugccucugccucccacauuaaaaaccacuuacuauacagcuguuucuaguccccuuucuuuucccuugagacaggguuucuacccaccugccucccaagugcugggauuaaaggcugugcugcaacacccagccuauuucuaacucuuagugacaucuccauaaaucuuacuacuguauccgcucucccucaaggaauuguuaaguuuggauggcucauaccucuaaaaagguuauuaaucucaaaugauaaccguucaauuuuuuucuucaguuuuaaagauuuuuuauuaugggggaaagggggaccacacacugugugcuugugaguacaggugauagcacauccaggaucccuggaguuagagugugucagggccuguggaagaacagugcaccccacuagccaccuucccacccacuuuuuacuauuuuuucuguaugucucauacguauggauguguguguguuuagguaaacgaauaugaaaguucaucucuaauagcguuuauuagcacuguuucauggcuauauccucccaugaccagguuccagccaguuuuauuguaguuuuuacaccuguucuagaguuuuagccucugugggacauaacuaucaguacuugccauaauuagucaugucccucuguccuguguccccacccccacccccacccccaguuuuuuaagacaaguuucucuauagcccuggauguccuggaacuuaucaaaccagccuggccucuaacagaucuccaucuguaguggcuauuccugguugucaacuugacaauauuuggaaugaacuacaauccggaauuggaaggcucaccagugacccuuaucuggaggcuuggagauccuuaucuggaucuugguuugaagaucuugagccauaguggcuauggauuccagaagauugaaucuccgaguuaaggaacacaccuuuaaucugggcuaugccuuucaucugggauuaaaggugugguggaacacaccuuuaaucugggcuacaccuuuugcuggagacaauauaaggacauuggaagaagggagucuagcucgagcucuugcuccuucgccugcuugcugcgugagacugaguaacugcuagauccuuggacuuccauucacagcugcgacugaacaauuguugggaauugggcugccgacuguaagucaucaauaaauuccuuuacuauuuagagacuauucauaaguucugugacucuagagaacccugacuaauacagaaguugguaccaggagugguucuagaguaacagaaguacaaggaugaaucuuuuaaaauacuggaauuggcuuguugauccaccagcacuuucaaauauugaaaccucuccagauucucucccuccugggagcucagagaauuuugaagacccaugguugaaacuauauuccgaacuuaaagaagcuaaugaccuugauuuucuuaaugaauuaggugauucagugcacaaagcuuucuacaagauggggaaaaaaucggaaaaugauuuuacuggcuggcugcucuuaguaucuguggaaagaaugaugaaugaaaggaaggaguugugugauaaaaucgaaagucuccagacacaaguaaacgaucuaaaaguugcuaaguguguccuugaggagaaucuucucucuuguagcaauagagcucaaguugcagaaaaucaaacagaaacucucauuuuaagguuggcugaacuacagcgaaaauucaagucucagccucagagugugucgacaguuaaaguaagggcucuaauuggcaaagaaugggauccuacaacaugggauggggaugugugggaagaccauguugaagcugagaauuuugaauccucagauucucaaggguuugccccaccugaggaaguaguacccucagccccaccucuugaaauaaugccuuccccacaugaggaaauuaauuuugcagagucugcucacggcccaccaauaguuucuucuagaccuguaaccagacucaaagcaaaacaggccccuagaggggagguagaaaguguaguccaugaggaaauucgcuacacuacuaaggagcuuaaugaguuugcuaauucauucaagcagaaaccuggugaauaugugugggaauggauuuuaagggugugggauaaggguggaaggaacauaaaacuagagcaggcugaguuuauugacauggguccucugaguagagauucuagguuuaauacggaagcucgcauaguuaaaaaaggugucaaaaguuuguuugaaugguuggcugagguguuuaucaaaagauggccuacuggaaaugacuuggagaugccugauauuccauggcuuaguguugaugaagggauuuuaagacuuagggaaauugcaaugcuagaguggauauauuguguaaagcauaauuguccacaaugggaagguccagaagauaugccuuucaccagcucuauaagacgcaaauuggugaaaggggcaccagcacauuugaaggguuuuguucuuucccuuuuccuugugccagaucuuagcauuggagaugcuucugcucaauuagaugaauuaaauucacuggguuuaguuggauuccgagguaacaagggccagguggcagcauugaaucgcccgagacaaggugauucuaguuauuauaauggacagcguagacaaaagaauguuuauaauaacauacccaguaauggucagcacaggagaggugaaauuuauaauggcaugacucgguuggaccuuugguacuggcuaaccaaucaugguguuuccaggaaugaaauacauaggaagccuacugcauauuuguuugaucuguauaagcagaaaaauucucaaacaaaugaaagaaaggcuacauuagaucgugguaaacagucaaaugaaagaaaggcuacauuagaucgugguaaacagcaaucucggccagugaaucaauuuccagacuugagacaguuuacagauccagaaccccuugaaugaagggguggccagguuccgcugaggaaggaucuugauaagacacucaaagguuuugcuguuacccuuucuccaguucuuccccagagggaccuacggccuuuuacaaggguaacuguacacuggggaaaaggaaauaaucagacuuuuggggucuucuggauacugguucugaguugacacugaucccaggggaucccaagaaacauuguggcccuccaguuaaaguaggggcuuauggagggcaggugauuaauggaguuuugacugauguccgacucacaguagguccaguagguccccggacacauccuguggugauuuccccaguuccagaauguauaauugggauagauauacucagaaauuggcagaauucucauauugguucccugaacuguagagugagggcuauuaugguuggaaaggccaaauggaagccuuuagaguugccucugccaaagaaaauagugaaucaaaaacaguaucguauuccuggaggaauugcagaaauuacugccacuaucaaggacuugaaagaugcagggguggugguucccaccacaucuccauuuaacucuccuaucuggccagugcagaaaacagauggaucauggagaaugacaguugauuaccgaaaacuaaaucagguaguaacuccaauugcagcugcuguaccagauguaguuuccuuacuugagcaaauuaacacaucuccuggcaccugguaugcggcuauugaucuggcaaaugccuucuucucaguaccuguccauaaggaccaccagaagcaauuugcuuucaguuggcaaggccaacaguauaccuucacaguuuugccucaaggauauauuaacucuccugcccugugucauaauuuaguuagaagggaucuugaucguuuggaucuuccacaaaauaucacauuggugcacuauauugaugacauuaugcugauuggaccaagugagcaggaaguagcaaccacuuuggacucauugguaacacauaugcguaucagaggaugggaaauaaauccaaccaaaauucaaggaccaucuaccucagugaaauucuuaggaguccagugguguggggcaugcagagauauuccuucuaaggugaaagauaaguuauugcaccuggccccuccuacaaccaagaaagaagcacaacguuuagugggucuauuuggauucuggagacaacacaucccucacuuggguguguuacuuaggccuauuuaccaagugacucggaaagcugcuagcuuuguguggggccuggaacaggagaaggcccuucaacagguccaggcugcugugcaggcugcucuaccacuuggaccauaugacccagcagauccgaugguacuugaggugucuguggcugauagagaugcuguuuggagccucuggcaggccccuguaggugaaucacagaaaagaccuuugggauuuuggagcaaagcucugccaucaucugcagacaacuauucucccuuugaaaaacagcucuuggccugcuauugggccuuaguggaaacugaacgucugacaauaggacaccaagucacuaugcgaccugaacuacccaucaugagcuggguacuaucagacccugcaagucauaaagugggacgcgcacagcagcagucuauuaucaaauggaagugguauauacgugaucgggccagagcagguccugaaggcacaagcaaguuacaugaagaaguugcucaaaugccuaugguuucuacuccuguuacaaugccaucugcugccaagcaugcaccuauagccucaugggguguucccuaugaucaacugaccgaagaggagaagacuagagccugguuuacugauggcucugcacguuaugcaggcaccacccagaaguggacagcugcagcauuacaaccccuuucugggacaaccuugaaagacacaggugaagggaaaucuucacagugggcagaacuucgggcaguacacaugguauuacaguuuguuuguaagaagaaguggccagauguacgauuauucacugacucaugggcuguagccaauggauuggcuggauggucagggacuuggaaagaucacaauuggaaaauuggugagaaagacaucuggggaagaaguauguggauagaucucucaaaaugggcaaaggaugugaagauauuugugucccauguaaaugcucaccaaaaggugacuucagccgaggaggaguucaauaaucaaguagauaagaugacccguucuguggacagucagccucucuccccagccaucccugucauugcucaaugggcacaugaacaaaguggccaugguggucgagauggagguuaugcuugggcucagcaacaugggcuuccacucaccaaggcugaccuggcuacagcugcugcugauugccagaucugccaacagcagaaaccaacacugagccccagauauggcaccauuccucgaggugaccagccagcaaccugguggcagguugacuacauuggaccacuuccuucguggaaaggacagcguuuuguucuuacuggaguagauacuuauucugguuauggauuugccuuuccugcacguaaugccucugcuaaaaccaccauucacggacugacagaaugccucaucuaucgucaugguauuccacacaguauugcuucugaccaaggaacucauuucacagccagagaaguacgacagugggcucacgaucauggaauucacuggucuuaccacauuccccaucauccugaagcagcugggcugauagaaagauggaauggccuuuugaagacgcaguuacagcgccaauuaggugguaacagcuuggaaggcuggggcagaguucuucagaaggcaguauaugcuuugaaucagcgcucgauauaugguacaguuucacccauagccaggauucauggguccaggaaucaagggguggaaaacggaauaguuccacuuacuaucacuccuagugacccucuaggaaaauuuuugcuuccuguccccauaacucuagguucugcuggcuuagaaguuuuggcuccagagaggggagugcuccuaccaggagcuacaacaaacauuucauugaacuggaagcucagacuucccccuggucauuuugggcuucuaaugcccuuaaaccaacaggcuaaaaaaggaauaacaguguuaggaggggugauagauccagauuaccauggggaaauuggauuaccucuucacaauggugguaagcaagauuaugucuggaguguaggagaucccuuagggcgucucuuaguacuaccauguccugugauuaaagucaaugggaaacuacaacagccuaauccaagcaggaugacaaaggacgcagacccaucaggaaugaagguaugggucaauccuccaggaaaagagccaagaccugcugaggugcuggcugaaggugaaggaaauacagaauggguaguagaggaagguaguuauaaauaccaauuaaggccacguaaccaguugcagaaacgaggauuauaaaguaauaugaaugcccauuguaaauuuacuaaugcguuugcgauuguacgagggauaguuauaucauguuaggcguauuuacaaccuuguuauuguuucaugugaacaugagauauuauuugugucaaguugacaagggguggauuguaguggcuauuccugguugucaacuugacaauauuuggaaugaacuacaauccggaauuggaaggcucaccagugacccuuaucuggaggcuuggagauccuuaucuggaucuugguuugaagaucuugagccauaguggcuauggauuccagaagauugaaucuccgaguuaaggaacacaccuuuaaucugggcuaugccuuucaucugggauuaaaggugugguggaacacaccuuuaaucugggcuacaccuuuugcuggagacaauauaaggacauuggaagaagggagucuagcucgagcucuugcuccuucgccugcuugcugcgugagacugaguaacugcuagauccuuggacuuccauucacagcugcgacugaacaauuguugggaauugggcugccgacuguaagucaucaauaaauuccuuuacuauuuagagacuauucauaaguucugugacucuagagaacccugacuaauacaccaucuucugcuucccaagugcuggaauuaaaggugugcaccacugccauccaguaccagaauuagaaucugaagcuaagaaauaacacucuaaucucgguacauguuaaaguuuuugcuuaaaaacaaaacaaaccuguugaccuguugucaaaaaaaauguggcacuguucuacacuuuguguucacacuaaaguggcacacauccuacagccuuccaaaaccuggugcuuacugagagauaauagaucaauggggcagacagaucuuugcuuacauagugacaagacuuuaaaggaaccaggcauggugguuuaaugccuuuaauccagcaguugggaaggaggcagaggcaggaggaucucgaaucgaaguccagccuggccuacagagugagucccauggcagccagcgcuguguguaaugagacccuguuuuaaacacagacacacaguaucccaagaauaaaaaagagcugcuacacaggugaaaaguguggugucuaaucccccuacacacccccucccugggggaggaacaucuuuuucucugggaauuugaguaucugugugugcuguggcaugugagcagagaaagcuggugugugugugugggggggggggggcgucuuccagugucaucagguuugaugacuacugguuucaauuucacugcuucugcuccaaauguuuauuaaccacuaugauaacccuucuagauggcaaccaugcauuuaauuaguaggccagauuguaugugacugcacacaaccuuuucuuucuguucaaguucuaauaacaaugcucuauacuugcccuucccccaaacagaacuauuauagaguggucagagucccaugaucgaggauauggaaaauuucagacugcuagaauggaagauuucacauuuaaugacuugcauauuaaacuuggcuuuccuuacuuauacugucaccagggagacugugagcauguuguugucaucacagacauaagguacgugacaucauucagaauauuuuaccuugaagaugucuuuuuaauaaaagugaguuggggggaggaggaggauagcugcaugcgcuggcuggaguggagaggccaggggacuaugcggaagccucgccuggccuggccccaugugguccugacagugagcucaaguaaucacacuugucagcaucuacuuuucugucucucuaacagugcaaaaguguaauuuaccagcgugguucacaaauguauacuuucuaugcagcuggaaaugggagacaaauuuuuaaggaaaacuuacacuagacaugcuagugugggccuauaaucccaacacuugggaagcagaggcaggcugauuucugugaauuguaggccagccuggucuauguaucauguuccaagucaggcagaacuacauaagagagaggauugaaauccuauaauuuuuaaguuucucaauuuaaucgaaagcuuaguccuucuauagugggaaguugaauaaccaauuuucaaacaauugaguaguuuagaauugaagggcugaggaaauggcgcacacacacaggcauguagagaaucuugugcaccuaccccagaccagacacagagagcccagagagcauuccacaaacagcacugcuguguuaaacucugaugguggaauacauucaaaaacaaaacacuauaugcaggaauucuuagaaugucacagcaugguaacaaagggaauugagaaaucagcucuguauucauucugaaaagcucucugggcaaaguguucagugaugcaggugauugccuguuagucagcaagcuagacaaggccucugcgacuaagcuacagccccagcaguggguauucuguaagauacugccugcguaaaugacaggucagccauguugcaguaauguugcuggagagcaggucgaggugcauuucagcaucuucauguguuuuccucaucaaaggcuugugcaccaugacgacugcuuggauagaacacuguauccccuucuuaccaagaagcacuggcuguggaccagaaaauguuuugucuguaagauguauacagcuaggugagugacgcuuuuuuccuucuaaacacccugguuuucacaguaauuuaguacucuggaggucuguagauuuagccgucaugguuuuaucuccuagagucaguguugcagucagugcaguuugcuuaaaguuagcauauuguuuuguacagacuugaacccagagccagcugccugcuggugagcacaugcacacuagguuauacagggaaacacacaggaagugcagaacagacuuggcggcuguaaggagccgugcuucuugccugucauuacaaaaucacuuuuaucucaguuuucaauacagaaauaaccagcauauauauaaagccaauuagaaauuagguuuucuguuuugaucagucacugugacacagaucugggaggcaggaggaguuugaauguaauggacaacaggauacaaagugaaaagcuggagcauaggacaugguagaaggcucacaugugcagggggcaugugcagaaggcaugugcaggcucuuuagucagucuugacuaaagacucagccccuuuaaaaaggucaggucucauguagccugagcugacuguccuccucaaaccuugaauuucugccuuccccugcugauucuuauuauuaaucagagcccagaaguuuggaaacuacucagaaauaguugaguaucuucaguuggcuuugaguuccauaucauaguauuuaucuaaaggauuaggaaaauagaaaugauaccaaaaugaaaauccagaaauugguucagauuuucagaaaagacuaaaauaagagaaacuuacuaaagauugugauuucaugugaccagugacauccgaauguaugaaacaaucucaggugaauaggauagcccaaacugccaugauuuuauccucaaacucaauuaaaaugccugcauuuccaaacugaccagucuuggcuaaauuaagaaugauacacaguaucauggccccugugcagggaugucuguuucauuggcacaauaaggugagauguagccuugaaucauccgcuacguuguaaaauaacuggaagagcauggacauggucacuauauaaagaauucuauacacuauauucucucuacauauauauacucuauacuaacaaauauguguaaguuugccucauuuuaaaguaucuggguacaugggcacgugcuuauaaccccaacaaguggggcaagaggaccgugaucuuaaggcaacucuggaucacaucacuaaguuaaggaaggccguuggggucuggagcaaggaagcgagggagaacuuaaaggacaguuuuucgggcacuuuaguguguguggagcuuucuaacaggucauuuccuuaucuuaaggaggaaucucaggucagugugcagcauuucuuguuggugucccuacugugucugcugaggagguagugagaauguucuuuauguacugguguaggacagugguucucaagcucccuagugcugugaaacuuugauagaguucuucaggugguggugacucccagcuauaaauuuuuguuguuguugcuaacucacaacugcaauuuggcuacugauugugagucauaauguaaauaucugaucugcaagagaacuuguuauaacugcuaugugaccccuaugaaagacaaccacuauuagaaaacacuaaucauagaauguugaagcauuaaaaaaaaugcuauaauauacuuuuucguuuuuuuuuacacuacagaugggugacgaacaaugacaccuuugcaccagaggacccauguuucuuuugugauguuugcuucagaaugcuccacuaugauuccgaaggcaacaaacuaggggaauuccuugcuuauccuuauguugacccaggaaccuuuaauuaguaccagauauuuccuacuacagcuuaguuaauuacuauuacauuauuuauuacaagggguuguuaauggcguuuuacuuaaguuguuuauguuacugagauguagaaaugcuuuucuguauuuugaauauauaaaccuugucggaaacacaacuucugauucuuuucuccaaguccuaugcauucuguacccugaguggauuuugauaaugauagaaugcaguuaauaaugcaucucuuaugguagucuuuuuaaagaaaucuuuggaggaugugagagcuagcuacaccuuccaagguaaaaacccuucaaauaucuguaguaaggagaaauuuaaaacaacuuauuuguagucacaauuuaacauuggacagacauuaagcacaugagaugacaaugaaucuaagacacacucaguauuagugaggccuuguuucuuaacagaaucagaaagauagauguacuaaguuuagaauaucauuuaaagccauggccggagaaaacacuggcagacuuuacauuaccacaggcauaccaugaagcuuggcucacuuucauaauucuaagacaaaaagcuuuuuccuggcucagcucuuccauccuucugaccccuuauuacagcaaaggcuucucuuucugagcuauagaaaagaacacuucuaaacaaaucuaucaagauaguuuguggaaacuuuugggguacaaaauuaagauguagaauaguaauauaaaguagacuuugaacuauuacuuucucuguccuagguuuaaauuaaauucagccgaauccuacauuucucuggaugguuaagaacaguuaucauauaaauaaaccaaugaagcuuaaacaucuguuuaaaagauuuugaaguuuaaaagaaggugaagcacgugucauggacauaauguuacacauccaguuauggcgacugacguggagcugacaagugccugcuugugguaugucuacaaggauucucacuuaaugcuguaggcaacacaggguacuaucuccuugccaaggcuaacucacauugugcccaaauuucuuacuuuguuuugaauagugcuaaguacccugaggauucugcugcauaaucacacauucaugaugaaugguuuuacaacccccagauuauuauugcaguucaugugggucuuguacuaaugauuguacucucagaaaguacauuccagcaaguuuccccuaauaacacacauaaugccaauuaccccguuuuacuagacaaagaugacagauaaacauuacucuauggaauccuuauuuauuuauugagaaugcuauucuacuucuuuuucaccaaaaguucacauaccuuccauuucuuugauggugaaaaugaagaaaggcuagccaaguuacugcaauuaucacuuauauuuacucacuaguucacaucaaaaguauuucaacuuuauaaaguuuacaagcuauaaaguccccgauuuuaugccaauaucaaucucuuaaauauaacaucaugugucacuuuaaggacauagguaaauaugaauggaacaacuuugucagugaacaucccuguggauacaccugcauggaaaauagcuauuuccucaagugucuugcuuaugcuucacaauucuuuaagaaugauuauacuuggcaguuuuacagcacggggcagucaccucuaguaucuguuggagaauuacguggcacaaauuuaagcacauuuuuuaguaacucucauuucuuaagggucucaagcuacaauuuagcuauuugcauauucucugagcaauggaauaaaacucauucauugacgccgucguucugcauacaggauggcggacuugccuuuaccuggcaucucuacucagguaaguugauaugaguaggaacauuuuuaguguaucacaucacagccuugguaacuuccuaacuagaauagcaaauguggucagaugagcucuggccgaauuguuuauacauacaagcuuacaaccagauuuucucauuagggggauaucugaaguugauccaagcagcugagaaaucaaaguagguauccauacaugcacauuauacaugcauacucuauucacagugggagagguggcuaucauucacuagaucucuuaggucagccauuguuguuaucagaguuuugagagugauagcuugucugugaauuagccuuauagacagaguauuccaaauuaaaaaaagcagcugugcuucaaaaugaacauacauggucagagcaaggcagcaucccauaacuuaggagugccauuaauguucugaaguuggauguucuauaacuuaacaccuguggcuaggaagaaagggaagucaacacaaggcaaguggcaguucucuccugagcuuccuacugcauagcuccugcaucuccuagcagggucucagugacagcuaaggagaacacuacuacuuccuuagcaggaaauccagaauuccuuuaguaauaauaacuuacuaauagaguuugguagaaaaaacuuuaauuaaaacaauuuacacauugacacuuauggcuuaacuagaauaauuuuuguccaaguuaaaaauguacuaaggacaaagcaaaagacugguguguauauaauguacagcguuugcucaaaacagucaaguuguaaaaguccaauuauugaaguaauuuuuacauagaugaaaauaauuaucugagaaaucaagaacauauuuaaucacaucgcacaaaaacccugguaugaagucacuuuccaauggaauuccaaagccuaaggaugaacuauccugccugauaaaaaccaacagcuggccugaucgcucagaacaccugugacauguccucccuagacgggacagagugauaguucauguuuguguguguggacuaucugguuacuaccuuagagcaacugauguauccucuaauaugucugauagaaaaacuaaaaaucccauuccaauauggccauguuuucaauuaagcuaguuuccuuauuuaucauuuaucacuuacaagcaucauggauugauucuaauuaaaaaaagaaaacacacaccuuaaugagugacuuucuuagugaguguaagauucaaaacaaacuaguuuuagcuuuuugugacuaguagcuauaaaggauuguagguggacuuucuauauguagauauaccagucuguucucuuuaguucuaaugccacugaaaucccaguccuaaaacuaaauuacuuuggaaaguaaacaaauuuguaccuucuauaacaaccugguggcuaucuagcugucauacagacuacgcauuauuacaaagaggcaagcuaacguagcacaauggacugagggucacuucugauaaaagaagugagcacuuagaaguaacauucacuuuaucagccauaaaaaugcucaacuucuaaaaaacccauaacagugaaaagacagucugcuaaauccauaucuguaaaaacuaugcacaaaacccacgguauuugggaaagauuuauacaaguagcaguuuuaaaauauaacugccccacuaccaauuacacauuaacauacacacuaacugaaaauacacugcagucauaaagcaggcugaccuuucuaaguagguuucccuugcucuuaaacuaaacgacggagcuguuaauacugcacacggaaaauuaggaauaauugacuuuuacacaaauauaaaggguuuuucuuuucccccaacuacuuaaacaucaaaaccuaugcuuauaaaacuuuaaaccuuucagcagccuaaguauuucaaaugaagucacucacaagacuucucacacucuuuacaucugaagucugccgaccuaguuaucuaguguagacucuuucagagauauuucagccucucucucuucuccagguggccuaaaauaaagggagaaaaaaagaaugucauuacaacuaggcuugggaguuuucucuugagcaaacagggcauuaaaucuauguccuguuuaaagaaagacaagacccacaaaacacacuaccaaaguaaugcagauauggugagauaaucccuaggaagcagucuaggucuggcgcuaacuucugugauaacauaaaaacuguuuuccuucauugaguucccaccgagaacucaauagggcaauuuaauuguuuaaucuguaaucacaagacagcugugccuggaagacugcuauaaguucaaggccaaccugugcaauacaaggagaccuugucucaauaaaccuuuuuaggguguuggagaugagauggguucucgcucauuagaaagcuccaauuuucugauggauagauuaaacauagagcuguaaucacuaacacacauccaguucuucuuccugccuuuuuuauucaaaacuuuuuuuaaaaaacuaguaaugcugggacuggagagauggcucagccuuuaagaacacugacuguucguucuuccagagguccugaguucacaucccugcaaccacaugguggcucacaaccaucuguaaugagaucaagugagaucuugucuaaaaggagucugggggguggggaggggcugaaacaaagccaaaacuaucaaaguagaacuaucaccugguguagagguuagugauagugagucccuacaacgguugggucucaaggggaaauacaaaauacacacuuaauacuauuaacuucugggcuuuacugugcuaaaaucaugaauaagaaaaaaacauuaaugauuguucuuccuaagucuauguuacagacugcugugagcugcuauauaguugcuggaaaucagccccaaauccucugaagagcuaguacucuuaacaugugagccagcucuccgaugagagagcugagucuggcuuuaacucugggccugcucuaacgugccuuacuuugucuuacugcuggccucgcggcugucuuugccgucuucguuacuaucaccauuaugcuguggaugauuacucucuugagcaucagauccaccauuuaggcucuucguaccuuuagaauggaaaaaacuguuagcacaauacaaaauaacacacuaaaccaucuuaaaaagucaaagcauggcccucaaggugcuccugcuucagccccucaaucaaugauuagguucaagucauuucggacaacaaugaaaaguuggacuaccgauuuguaccguuaaagucuagaacauuuuuuuaauggacagaggacuugacuuacuaaucucauuacauuuagaaaaaauguucaaugguauaacucuguagugcaucuuguguguaguuuugggguuuuuucccuuuuuguuuaauuuuagaagaaccaaauguugcauuaauaguauuuuagggccuaaugugcucuaauguccagaugacaagcuugggcauuucccuauaaaacccucuaaucucuuaaaaaaaaacaaacaaaaaaacccuauuaaguaagugagagauuuuuguuguuguuuugucuugaaagauaacauaugccuguuaaaaguguucuuaacguugaauuggggaggcugguaaugguauucuauccuuagguaaauccugaaccggaaugucucaaaguuuuuguuuuguggacuuuuuuuuuuuuuuuuuuuuuuuuuugguuuuuugaaacaggauuucucuguauagcccuggcuguccuggaacucacuuuguagaccaggcuggccucgaacucagaaauuugccugccucugccucccgagugcugggauuaaaggcgugugccaccacacccagcucgaguuuauuuuuaaauauacuugaguucacacaaaggcuguacaagaccacagcauguacauaugaagcagcaguuuauccaacacauuuggaaccugcaguguuguaucuugacuauagggcucaauuuaauaugcaucuuaaaugcacugccgucauggcaguuuuauucauugacacguacaaagcauagcauaggugugucagccaucuauuuggauagucugcuauugacugucaucacuguuccugacuccauuuagauguuaccucucacuagccaaccguguucuuacagcacaguagaauacagcuuguaucaacaaacacaauaccacucccaaccguguucuuacagcacaguagaauacagcuuguaucaacaaacacaauaccacucgauuaacaguguauauaacaugcuggggguuuaagugacauugaaaacauuggccacaauaccuauuggcucugaucagaaagaaagcaagcaacagcauuuucagcucugccuaggaugcagcaauucuggucauaugcuaacuauacguuguauuuuuuagcuaaagcaaaugagggagggagggagggagggagggaauuggcugguucucuaacauucugauuucccucaagaguuaacaaauguuuuuguuagaaguuuccuucauaaagcucaucauaacauucuuacaggucauauacaaguacucuguguuaauggcauccccauugcuacuacuauaauauuucaaggucaauggagguacaguguagccuuacugagagagguuccuucauuucuaacauugacaaaaaccauuuagaaaagcaacccuggcaaacaccugaggcgcaagcaugacaagcaucagcugagcggacggaucaccacauaccuguugguuccuucucuagcuuuuuguuuggcccuuucuuccccugaucuuugguuuuauuugcuuccucaugcugucucuguucagcaagagauuuguucagcacuugggugaugacugaaucuccuucaccaaccaaaaacauauucuuaaacuuguuauauaacauuguagacuuuuccaugauaacuugacugacuuugaaccgccguaucugagaaaacaguagucauaguuauugucccuaauugauugaaacuuuggugaacugagaaacgauguuagcguugcaggcgcugagggcacuuacuuucuucaggguugugaucaucucuguguguuucugagcuugcugcauuguuaccugaagugaagcgaguucauccagggccucuaugcaucuguucacguccuucaugacaaaacagcaauuucauaacuguuaaucaccaaggcagccauggaauccacuucugaccaucucaaaagcucuuaaggugguacaaaaauggccagguauuguuccuuuuaucuuaaaacuuauauacuuaagucaugugagaaaauauauaaagcuauuaaagcagugcauuuuaaaugagauuaaacacuuacuagauuaucaauuuugagugaauuuuuaauuucagcauguauccuuugaagucgagaauccauugauguuucuauaaauugaaauaugugaaaaacaguaaauaguuuuucuccacaccaugucucuguacagucuaacauauaaaaguaauggugguuauaaaaauuuucuucauaaucuucgagaaacccauauagaugaacaguguaaaaaguuaugcuaauuuucuuuucauauaugguuccaagaagaaacaugcagcaugaaagcacaaaauuacagcaugcugcauuuauucugucucgggugacgcgauccuacuuguacuugucaccucuuaaaccccugcuucaccuugugccuuuaacugcaagguguuuaucggagccuccagcucuuagcugggcugcacaacugacaccaaauaagcuuuaagauauuagcaggguuacuuuaauugcuuaaaaugcaauugaauauggaaucuguuagacuugaaaacauguuuuguaagaucuaagaacaugaaaugggauuucaaaagucauuuuuaaauuguucaauuuuaaagucaggaucccauuuuguaccccugguuggcuuggaacuugaggcucucccggcugugccuccauaagugccgggauuccagguaugugccaucucagccagcucccauuaaccuucucuguaauuuuccaugucuuagaaaguaaaacaacuaaccucgcuucuucuccacuuucuuaacuucuggcuucuuuccuucaucuuuauucugccuaucaaaugucaacacaaauauuucaaaacacuguaacuuugugacugagguuagcagaugcccauauuccccuguguaaagguuuuaaaaaauguuccuuaaaaacaauccaucagccuacaaaauaggacgcugacuaguuuuuagaacuguguagcucuacagcauuaacauaaagacaaaaaaauugccaaauucaucuuucagugacauacacaaugguaaaagaagaucuacaaauuaguaaugaauuuuaaagcaacuuuacuacguuuuuuuaaagcauacuaaaguagaccagcuguaccccacaucuccaaaggacagguaauucaagggauuuagaaauuggcuucaauaguaaauagaccugcuuuaagcuacuguuguuuguuuuuguuuuuguuuuuuuaaguuguagaggaggccauuguuuucaagguaaaugacauccacuaauguuuacauaccauuucauaagugaaaaaguaccauuuuacuaagauuaacaaaaaauaaccguuugaauuagaaauuuuacuuucuaguaccuuggcuuggcauucaggcccuauuaugaaccaauuaaaauagacaagaaccaaaaaaaaauaccuaaaaaucagguuuuuuuuuuaaaaaaacuuuauuuuaaaauuuucguuacaauuucaguuuuuuuacuuaacaagucuacuguuuaaucucucaggauuaaaaagaaaaaaaaaaccaagacucuagaauuuaacaacaaaagacugucaagggcacaccugccccaguuuucaagaacguaauagcuacuccaguuuaauaccuagcuucaaaacaaaaugauuuucauauucucuaagugagauaauguacagucgccgucuucaucuaugucuguuauaacuucaaacacaaagcuucauuguaagcuuggcuucaaaagaaaaaaaaaacaggaauaauggccaaccuuaauauguaguguguaccuuacaggauauuuuguuaacaaucauaacacaguuaauaaugccauuaauagugaaguccucaauuuagaaucuggaacauuucuuccaucaagggggggagggggaaauucaguccaaugagucugucucaagaucuucaucgcuuguaugcuccacuuguauucucuuuucaguuacuggauuaaugcuuugagcccaaaaugagauauauuuuuauuacuguagauuacauguuguuuggcugggaauacaauacaauaaacuuuauuuugcauaaugcauuucacacaaguugcaucugaaaugcuuuacagagcaaaacuguccaaguacaaaguuuuguaauaacaggagaaggaaagaaaacacaaauauuagaauuugagaaaguuacauuggaggacauucaaaagaaacugaaauacaaaaaagauaucuugagauucugaagauuugggcuagauucacuaagcaacaacuaauuuaugccugacuuacgggagcacagaguuaaaagcaacaacagucacaguauucaguggagagaaaggacaggaauaauggcauuuacagauguggccauaauccagcauuuuaauuacuuuuaaaaacucccuaaagcagcuaaacugcucuguauccuccaaacagcuacagaagcagagacaauguaccuauaaaagugguuacuuuguagauacaucauaaaaacaagugaagaaauguuuccuuuuacuauuggccacuguauaagugaccuacaacauguuuucaaauuaucuccucacuaucaguagaaagcccacagaaguuuacuaagaggaugacuuuauaaaugggaaaaagggacagugauaaacuaggaaaacaaaugugcacaagagccgugaugucuaaugacuguaaugacuauuccuuauacugauagaauacugauacaguaaggggggaagaaaguucucaugguaaguaucuauccaagugucaaacuccaauuaaagcuugagucauacaggaucuagccaaugcuagcaagccuuugagcuagcuuuuaucagcgucuagguuuccaacugggauugcauucuuucgucaccuauauaguuucauaauucuauguuuaacauguuacacaaagccuaacucuacuuucacuuauauuacaaaacaguucacaagaggauuaccucagugaaucucauccucugaaaaaagaauagagccugaaauagcacauauggaagauuuucuaguaugggaagucacuuuaaaaggcuucaucaacucuggaaaugagaggcuacuuaaagguuuaacucuuuaaaaaagaaugcaagauugaaaacuaaaaagaauacuuacugcucaguuuccauuuguuccuccugcuugcguuuccgaucuccagcuucuuucucauguuggccuuuuagcauguuccuccugugagcagccuggaaguuccuuccacccuuucucuucuguuugagaacaggaaggauguauuaauaguaacucucaaguuagugguuggagacuaauaauuacaaucaugguagguagaaaacaaagcgacuaagcuuaagccuaacaaacaggaacacaggucuacugacuggauauucuucuucuuuagaagugagcuaagaagcuagccaaaguugcuggcuuugagcaggccaugguggcacacacccuuaaccucagcacuuaggagacagagccuagguagaucccugugaauucaaggccagccaggucugcagagcaagucagccagguugaaauuacaauggauaaagauuaaaguuuaauguauaaaugcaccuuuugugucuuugaucacagacaucuggguuaucuacaacgugucuauauagcuggaguacuggaaguuuaccuauguucuagaaauuaauuauacuauaaaauauaaaguauuuuucauauaaacuguauacauuucaguuauguaauauauuaaaacauaaauaauaaagaaacccauaaaucuuuuaauauuuguuaaagguuauuuauacauauuauaauauguauaucuaggaaauaaauuuacaauguaauuggggaaauaaccccauggauuaaaugcuucuuguccaagaaugaggaccugccuucagaucccuagcauccccauagaaguugaguauggcugcauauaucuguacuugagguggcaggguagauaagcuaacuaacuucagaugggguaauaagcagucuagcuucagauucauugagacccugucucaaaauguaaaagugguggggcccaauagauggcacuacuuaaggcucaauucccaacauccacguggagggaguuuugugccuaucuccaguuuucuaagagaucugucuacacauacugcaggcaaagcagucacaugaagaagaaaacaauuagcaugaggaaaauggagcuggggacauuguucagcacuuuaagaggaccaaaacucacaauucccauggaacugugguggcccaccuauaauugcagccaaaguugccaccaagauuagccucaugaguucgugagaguuugcuugagagacacuacccgcaucaaccuuaggccuccacaucccauaugcugcacgaacaccucacacagaaacacacggggagacaaacuggcaaggaguuucgaauguggauucgcuaccuuuucacccucuugaucgucuucgucuucugaaucagagguugauguaaccccugguuuagcuaaauuuuuccguuuagauucaacuucuuucuucccuucuuucuuaucugguucuuuucuuggcuucucuucuuccuuuuggccuucuuccucuuuuuuaagcugcuuuuuagguuguuucuccucuggucccuuuuuuuuacuuuuaucuucaucaauaacccuacauuaagaguucaagagcagaagauuucauuuauacuuuuucuuucuugaaagaacuauuuguauuuacucaagugucugugugaggagcuaaguuucuggaugugggugcugggaaccaaacucugcucuacuagaagaauaaucaguaagugcucagccaucucuucacccuuuauuuauacucuccuuuaccaaacaaggauuucacgagggaaaauuauggcaaaauuuauguuuaaaaaaaaauacaguuugucauucuauuguaaaacggaauuuucauuauauacaauuuuuuggauguuucuugcuccuauuuagcauauaaacccaaggcccuauuaaauugaauuacauuucacauguuuauaaaaaucacagucauuuguagggauugaacauaacguuaaccuaaugaccaguuacuuuuaacugucauccaagcuaugaagaucccacagggaauagcgacauaaaugguucaaucaguuuaacucaagaaucuauuuucucugcaguuuuuaaguauauuaacuguuacugugucuacauuuugauguuuuuuaaagagacaaaaguuuuacuauguuacccuugcuggcugcaaaugccaagggacaugaauaacacagucuugcaaaacaaaaaagucuuauuuuugugguggugguucccccuuugagagugauguaacaacuagcuuagaaagaaagcucuugaaaaguuuuauuuugguugaaaaguaccaacucugaaaauauucaauucaggugcagaaaaguggugaaaagugcuuuuuguucuuucagaaaaccagaguuugcuucccaaggcuaagcugguggcucaccacugugaguuucagaucugauucuagagcacuugagacgcacacaccacagugaauccucagucauccugcacagucaucaagcagucuccccucuuccugacuauaucaacuuucucaaggaaauucaaggugagcacauuuucuaagugggaaaagaaccagauaaagaaccgccagcccaggaggcagcucgguggguacagauggcugccauuaaggccuaauuaugugacuucaauccccuagaaucauauaguaaaugaccacacaucuugugguacacauacacaaaauaaauaaaauauaguaaaaaauuauuuauuuaaaaaauaugucuuucuaucauucuaaaauacuuaaaacuaauuuuuacacuauuuuaaauuauaaagauauuuaucaccauuacuguucuauuacacagaacaguaggucuauggacacuacucaaauauaaucugcacagaaauuuuuuucagcaauuuacccugcccaaguucccuguuagccuacaugaccuaauuuuaucauauacacacacacaaaagucacagagcagaagcagacuucaaucccuuuaacacaaauccuccuccaaucucucaucaguuuuagagauagaaaaaaaacuuacacaacguaguaaaaguauuuucuacuguuuacaaagaucucaauaauuuuguauuccaaacucacaugucaccgucugaaggacaaggcugcuuuaccacuuuaggucugccucuugguuugggaaucuugacuucaguagcuaauuuucacauaggaaaaaaaaaauuucauucuuaaaugcaaggcauauauaggcagaauacaaauguuauauaauauaugcacucuagugacaacucuauauacaacuagugaccccagggauagauaaagugacacuuuaaugauuaacaauacauuuccauuuguccuuauguuugacagaaacugaaaacugggacgcuguagucgggauggaacguaugagaaaaaaaaauguauguaugguaucacucauucagaauucauauacccacaacaauguuauguacuauacaauuuuaucagaauucacaaagagauuuaucaucauacuacaaaacauguacauacauuuuaauuuuucuuuccaaucugacuauucauuccccuuaaugguauccguaaggauacuacugugauauagggaaaaaagcaaaaaaaaaaaaaaaaaaccuaguugauuuucaguguuguauuccauauuaggaagaacaacucaagauuauuuccaaauuaucaaaucaauacuaauccuuaucagaaugugauaaucugaaagugaaaaaaguaaaagcucacuagauucucuuuucaggauuuggagagaugaauuuggagacaaaagaagccacaauuauuucaaacuuaauaguugucacaagcagaaaccauuucuccuuugaaauuguucuuguauuuagcccgaugucuacaugacauuuccccagacauggagcacagugguaauucuuuaaaacuccaugugcuacugacaccacggacacagucauacaaugaaacugcccaaugacuaauuucuccagccuccucuauguccauguuaaaagugauaaugugacucucuuuaaucaacuucugcggcaauguuuuaauggacuagaguauucaucacaagccaagcuguggggcauugcuaccaucuguugggaaagaauuccuccugugcucugggcaagcagaggugggagggcugccagccacuuuccacuuggccccgggugggcaucuaagccacuaaccccacucggcaggggguggacaaugggcagccucagauaccaggggccuuggggcgacacccuuggcccccgggguuacaggagagagggcugagggagagguucccacucaggagagaguccuuaguccggcccuugacuggagcacaggaaggccuuccaucgggagacuagaaauggcucauuagaagaaagccuaucccaucauccaagcguagugggccuugaugaacagagacagucuaugauuuuagagcuuuauuguagaaaggcgaggga

SEQ ID NO: 1963 - RNA, 3366 nt, Mus musculus
cauaaccacuccaaaagcugccaggcgaggaagaaagagaaagguaauuucuuaaacacacgguaggaauuucaaagaaauuuuauuuaaauugaggaaaaauagauaaggaaaccuuauuuggacuugaccucuacccuuuaguucuuaaaggguaaguugguuacuuuauaaaguuucuuggugcuaaagcuuuggcacccucaaguuaagcugaaugauaaaaggaaauaaagugaaccaauuuuuacuccuuucaagcugccucaucuccucuauaaaaugauaguauguaaucaaauuguugaugauuuaauucucgugaaaucuuuagaguaaauccugauuucucacugcuagcacaggcugucgcccaaugugcuaguucaguguugugugagacaagaggggcagugacgguuuaggccagguauuuuguaggcuuuuaauuaauugcuguuuguccccugguguacuggagggaaaugaccuuauaacuucacaguguuaaaacaaugagcguggaaaggagcaggccaucugaggguacgucaggcacucacagucgaguaugauggugcauacuucagcuuugagaggcuugaaggucggaggguaaaggaaaucuaccguauuuuuuugaagaacugcugugaugggaagucacugugacucacuuauagguaguaagaugacaggagauuguauuaggacagugagaacagacagugauagaauuucagaauugaaauucuaagauuggcauugguagaguugcacggggaauaaagcaaacgggucucuugguuuuuuuguuuuuguuuuuaauuacaacaggaacauacaugaaugcuucauuuucuugagcuuuguuguuguauuggacuuugcaauacaaacugggguuuguuuuuuuucuuugcuuaguuuguuuugagacaggguuucuuuauguauaccaggcuguccuggaacuuaccauguagaccagguuggccuuaaacccacagccaucaccugcuucugcuccccaagagguaggguuaaagguguauguucagcccauuggggcugcccugcugagcuagucucuauucuaucgcaguuuguuaaucuuauuauuuauagauuguguucuaucuauuaagguagucuaaugaucuuugaucauucuugagucaccacaaacugcuuacauaagacagcaucuuaauugaaaaauguucugaccgcuccccccuuaugguucauucuuagaaaaauacugggauuagucaguuuacaaaagggccucuaggucuucagguggaggaggguauguuaaaaagcugcuguaagccaagucccaauccagggcaaggcccugccuucaauucucuugaaagcugagggagguuuuuaaauaauauacaaaaaaagguccagccagggcucuccugggucagcugguggguguagcaggaagcugccugcacucauggagcugcaagcccuaccagugcugauggggaagcuccaggaaguuauccagauaaggaaacugaagaauggaucacacucaguuaacuuuucauugcagacauuuuuacucuggaaggaguugcagcuaggaauucaauuucuguauucaaagccuaggguguggaacugcuaaugucuugacuaugaacccacuuuggaaauccuaggacauuuaagcacuuaaacuaacugcuuaggaaaagacuccuuucuacagauauucacugacuauccaccugguugcccaggggcucuggugugacggaaauguucacguacaguaagaauagucaugccugggaauaauccaucaacacuuggggauuagcagugaggggguuucuugacagucuccuccuggugaggguacuauaaauguugaagugacauuaaacgauuucagacauuauguaaauggcugauaaagcagcaucagauuuugagacauuugaccccaauuugaaagaagucuguagguaaaauauauuaaaaaaaagaaaucuuugcauucuauggcgaaacuuucuaugcauggaauaaaucaguugaugggauagauuucauuuuguuuccuuuuaagaaauugccacagguaccccuacguuuaguaacuaccaugcugauaaguuguagccaucaacacuaagguaaggcagccacuuuggcuuacugaaggcauagaugauuuguuagcauuuugauguaugugguuuuuuuguguggaucaaacguggaguuuugaacaugcuauuauaagcacaaguuguaccacugagugaacacaagcucuguuugauggcauuuaaaccaauggguguuuuuguucuguggugcugcggcuuguaccaaugcuugcaugcaugugcuaggcaagguacaucacugaauuacacacacccauccuaauuaaaugacccuaaauugagguaugugcauuguuuuuuuaagacaauacuuucacaucuaauagacaauagcauaauauacauguaacuuuaauauauauagggaagccaaaaggcuuauuugcuaaauugccuguagcaguuaagaugaggggcuauaagagugaccuaguaacugaguaggucaugaaaggccuuaggaauuagcauuaaauuccuuacaucaaguuacuuauuguuagugugagauguaauuuuauaacacuucaagaagucaaguugauaacugauaacugagugaugauaagaauggagcagaaugugggaugacuccaaggugcuugcuuuagugacuguauccgugacugggcaugacucgggacuugaaaaucaaggggauucuuuuuggcuauauuucccuuucccauucaaucaauagguggauccaagcuuguuagcuacucaggacuugcaguagaaggucaaaggacuaaccauagauuugaaauaccaacuucaaagacagaaaaugauuucauauuugucuuccuagugcuuauuagcuuaaucuuuguuggggauucgugaaacagguauagcaagacaaggaugagggcuuggaaaaggauaugaacaguggucuucugauggauauggaauggcuuuaggaaagaggaaagacaggcuaacaaugagaaauaaauccaguguuaagaggucccguuagcaaucuagcuagaaugugaacauuaaagauauucaugcaugcauuucaaauaacuagucuuuccuuggauaaaauauuuuccugaguaguggcuuuacuuuuacucacgugauuuugcaguaguggucauaaacauaacccaugcuagggcaaaccuuucaugucagaguugguggguuucuguuguguuccuuuuguuuuuguuuuacuuau

SEQ ID NO: 1964 - RNA, 6229 nt, Mus musculus
cgcugagccaucucaccaaccccggcauugcauauucuuguuaguaaaauaaggauugcccaaugcugcuuaggccuggucucaggagccacacagguggugggaagcucagaagagagaagccagacagagugcccuuugugugucuggucacucccagagccaagcugaccugcugccccagguggauauauagcuagagaacugaugggaugaaggaaauuaauauugugcgagauuacagcugcauguugaacuguuuugcuccuuguaacuacaugaaauugcuuuggaggcugucucgacuaacugccaaggcuuauagucguagaugccuagagcugaauaguuuuccuugcacuguauaaucuacgugaguuggacuauauuuucuguagaauagcauguuuaacugagacgaaaugcaguuguggagaucucaauuaucacuauuuuuuggacuuuucuuuuuucguauauauguucauuuuguguuuugccuguacauuuugucugugugagggugucagaucuggaacagagcucuccggcagcugcugggcauugagcccucugacagagcugucuauuuaguuauuuuucacucuguccuuaagagugauauaaaaguggcaacauuugguuuaauuucuguuuccugcuucucuacuuucuaaacuuacacauaauuugguaaacuuacugagaugugauuuauauugcacaauguuuaaaguacgcagucaauuuuacuuugauauauuucauuggauuuuaguauaguugugcccuuuuccacuaaggucauuucucuuucccuagcccuacacaguacuaauuaccaucuguaauuaccacuuaaggacauuuuguguuaaugguauuguuugaccuuacauuuuuuuguuuguuuguuuguuuugcuuuuuugaauuuuugagacuggguuucucuguguagcccuggguguccuggaaauugcucuguaggccaccugccucugcuucuugagugcugggauuccauaccuggccacauaaauuuuuuuguuuguuuguuuuauuuaacauuguguagcccuggccauccuagaacuuccucuguacaccaggaugggcuugaacucagagagcuccuccugccucuggagugcugggauuaaaggcaugugccaauacugccuggccuguaguuuuuaaaaacacaguuuuguaucuucgauuggauuggccuucacaauguucaguuugaguuggguucacauauauuuuguauaugaaaauaggacaagcucccugggggcuggagagaugauggguggcucagggguuaagaacacagauugcucuuccagagguucugaguucaauucucagcaacccuuugguagcucacaaccaucuguaaugagaucugaugcucucuuccagcacauagauauacaugcagauagaauacucagauauacauaaaguaaaucuuaaagagaaaaaaaaaaaaagcucccuggggaaggcagacaccaacagaucugaguuugagcccagccugguuuacagagugaguuccaggacagcuaaggcuacacagagaaacccugucuccaaaagaccuaaugaaaagaaaugcugaauuucuguuuuuaggguaaugguuuacaauuuggagacauucaguagggaaaggggucuguaagagaaacuguacuuuguaucagaguagggauuuggauuugcaugguguggaacuguaguugaaaaacugucccuagggccuccccuggacagagagagucauagguguggggcucagggauuuuuuaacaggccucuccagucggugauugugaugcacgcaagguuuugagucaucuuaauugauaaguuauuucuucgugggugaaaugagccaauuuaagccagauuagaguauauaaacacaggcuccuugggaaguugcucucuuccagcacauagauauacaugcagauagaacauuccacuggccccaaggacaaggcuggggaaguugccaugggggggaaaagagagaagggagcgagggagcagagagagaagugagauucugcauugcauagggaagagccuccgugggaggggcugcaaugggcacgguucgggguggcuuuuccugguaaggacucagggaugcuaggagaaacugggggccagguuauguaaaauaugcauaucagacccuuguccugagucugagacccacgauaauugugaggaggcauuuuuuuuuuuaggacuuuuuggcuuaaaauugacucugauuuuaaaagacuuuauauucuguaguuuucuaugacucacagcugguuaaaucuuuccuuugaguuguugggaaucuauccuuuggcugugucuguacuaaccaugugcucgcgcuccgagccaccaccccaacccuuaaauacugaagaggagacuacuuucacgguacuuaaaaauagaacuuuuguaguguguguauuuugugguuuuucuuuuucagugcugaggaucguaccccgggcuuugcucuuaccacugaguauuaugcccuaauugaucucuauaggcuuggaauucaacuguuacagauuugguuaauuugaaaugaaguugguuacuguuggagcuggagagauggcucagucguuaagagcacuggcuauucucccagaggucaauuccagcgcccacuugagggccacaagggucuguaacuccuguuccaggggaucugaagcccucaucagacaucaugcacacauaauaccaauacacauaaaacaagccauuugggggaaaaaagauuuuauguugggcugggauuacaauucuugguacaguauuugccuauaaugcaggaggcuauagauucacucccuagcaccauacuaacaaagguggcuaaugaagaaaaugaguuaauaucaaagaaaugaggauauauuuaaagaauuaaaaggcuuuuaaaguuaaugauauuuuuauuucaaaauggacuuaaaauauuuugauucaagcggggcagugguggcgcaugccuuaaucccagcacuugggaggcagaggcaggcggauuucugaguucgaggccagccugaucugcagagugaguuccaggacagccagggcuacacagagaaacccugucuugaaaaaccaaaaaaacauaauugaucuagaguggacacagcacucaccuuuagaaagacgacauugcuuuauuacuauuggagauuuucuuuuuccuuuuuuuuuuguuuuguuuuuguuuuuugagagaagaguuucucuguguaacccugguagccuaaccuggaacucaagagacccuucugccuccgccucucaagugcuuggauuaaaggccugcacuaccaucgaacuucucuucuuuucucacauauuauaucccuccucucccccuagucucuccccacccacucuuccucagguccaucccaaccucacccccucauaaaagagcaggccucccagggacaucaaccaagcauggccuagcaaccaacaguaagaccaggcacaugccaucacaccaaggcuggaugagccaagucaggagaggagaagggucccagauagcccccgcucccacuguuagaaagcccacaaaacaccaagcuaugcagcuaugacauaugcagagggccuggccuagcuuuuuuuuuaaauauagguguaugaugguccuucuugcuuccaaaauuugggagggggaugauuuauuugaauaaguuuagauuuuucagauguaagucuauuguaauaaucagaaguuagagagauggggaaggaggaauauaaaaaaguaauuuagaaaaguauacuagggcuggagagauggcucauagguuaagaacacugacugcuguuccagagguccugaguucaauucccagcaaccacaugaugacucauaaccaucuguaaugggaucugaugcccucuucuggugugucugaagacagcuacaguguacucacauacaugaaauaaauaaauaaauaaauaaaucuaaaauaaaaaaaaagaaaucaacauguuaaaaaaauaaaaguguacuaauuuauaacugauuuauauuuuaaauuuauuuauauaguucugguuggucuggaacuugcuguguaaacuagaucuugaauucauagagucaccuggcucuggcucuggugugcugggauuaaagugcaccaccauuucuggccuuauauuaagacuuuuuuguguauguucauuuagaguggugggaaaugguauucucugaaaacaauuaaaaauugagucuguucucauauauguuguccagccugaugaugaccuugaauuucugauuuucuugucuccaaacuccucagaguagcacugcaagugugugccauuaugccuuuuuuuuucuuuucccccagaggggaaaaaugacagcagcuuuauugagauauuuguuucauauagcucacccacuuuaaagucuagaauucaguaguuuuugcaauuccagaaaguaguggagacguagcacaguagauuuuccauuagcaucguuucaaaaguaaccuguuacccagugacaguuaucuucuucuguuuguucaguguuuuugcuguggcugaaacagcccuuaaaguauuuucccgaaugcuucauauaaaugaaaccauuuaaugagguuuuuagugacuuaauuuuuuuuauuuaacacaguauuucaagauuaauacuauagccgggcagcgguggcacacgccuuuagucccagcacuugguggguagaggcagacagauuucugaguucgaggccagccuggucuacagagugaguuccaggacagccagggcuacacagagaaacccugucucgaaaagccaagaaaaaaaacaacaacacaaaaaacccuuguuuguuauaaaguauugaaugucaucucauagccucguguauaauuugaguuggcuuuguacuuaugccuucccuuucuguuacagugcuuuuuuaggaccaaaggacauauuuccuuauucagaaaauaaggaaaaguauggcaaaccaaauaaacggaaagguuuuaaugaaggauugugggagauagauaacaauccgaaagugaaauuuucaagucaacaggugaguccuuuuauaagauuuauuauuagaguaaaaauauugucauuggaaaauacuuaauugaagaaccuuaugaauuuuagauuguugcgcucuuuuuaggguuuuccuugauguuugugucuaaaugguuauuaauuaaaugucuaaagagaucucagaaauuagaaauacuugguuguucagcuauucuugauuaaaauuucuuuaaacuauuacugaauuuaaagccauagcuagggucuugcuagauucagggcccuaaaauuuuauuauuguauguuugauaugggugggaacauaacgauguccuuguccguguggaggucaaguacaucuuugugaaguucuccauucgccuuuacaugggccuggggauaacaaucaggucaggaggcuuguaucauagagcugagccaucuuuuugguuguuuguuuguuuguuuguuuuuucgagacaggguuucucuguguaucccuggcuauccuggaacucacuuuguagaccaggcuagccuugaacucagaaaaucgccugccucugccucccaagugcugggauuaaaggcgugcaugcacucacacacuggcuucuuucauuuuuauuuucucuugguacugcuaauaguuuuuguucuauuuauuuugugguuauaugggugugugcauaaugugcgcaugugcuacagugcgcauauaguggucagaguacagcuuuguggaguugguucucuaucuacuuuugccacguugguuguugcgugugcuuauuuuauuagcaagugcuuuuccucuuaaaccaucuuguggucccgugauacuauucuaauaauguuuuuauauauugcaacuuuuuuauauauugcaauuuguacucuugaauguaugaaagcucuugauaaaaugaacuacuauagcaaggcagugguggugcaugccuuuagucccagcacuggggagguggaggcccauggaucugaauuugaggccaaccugcucuauagagcaaguuccaguaccgccaaggcuacacagagaaaccauaucuuggguaggguuggggua

SEQ ID NO: 1965 - RNA, 5323 nt, Mus musculus
agaguuucuguccacucuuccggggacguugcucagaggcacucaggaugguccagcguuugacauaccgccguaggcuuuccuacaacacagccucuaacaaaacuaggcugucucgaaccccuggcaacaggauuguuuaccucuacaccaagaagguugggaaagcaccuaaauccgcauguggcgugugcccaggcagacuucgagggguucgugcugugcggcccaaaguccuuaugagacugucuaagacacagaagcacgucagcagggccuaugauggcuccaugugugccaaguguguccgugacaggaucaagcgggcuuuccuuauugaggagcagaaaaucguugugaaaguguugaaggcacaagcacagagucagaaagcaaaauagauaugcacauuuuuuaaguaauaaaaaucaagacuugaucuaaaaaaaaaaaaaaaaaaaaaaaaaaaagaguuucuguccuaagaugauguacugggagcagggcgugguggcccacgccacuaaucccagcacuugggaggcagaggcaggcagauuucugaguuugaggucagccuggucuacaaagugaguuccagaacagccagggcuauacagagaaacccugucuaaaaaacaaagaaagagagagagagagagagagagaggaagaaagaaagaaagaaagaaagaaagaaagaaaagaaaagaaagaaagagaaaagaaaacaaaccaaaaaacaaaaacaaaaaaaaccaagaugauguacuggguauauagagaaaggaaaguugcuaaauaauggaaugacaugaaguaguuacaaaaggcugguauuccuuccuuccuuccuuccuuccuuccuuccuuccuuccuuccuaaacuauagauugaacacaagaccuuaguauaugcuggagaagcaugcuauacacugagccauacacauccuaagccgugugugugugugugugugugugugugucugugugucuguguguauacacaccaugaagcuguggauuuuguggauugaacucaggucauuagcuguggugacaagugccuuuaccugcuaagccaucuugcuggccccuauaauuuuuuauuuugaggaagaaucucacuaaauggaccaugguggccuugaacucauauuguauuccaaauaggccuugaacuuaugguucuacaucagccucuugaguagguagguauggcaauuaauaucgaucgagaacuugacaggcucuagaaucaccucggagauaaaccuucagccagacacaucuugaguuaacgaaggugggaauaccuuagcuguggauagguagcaccauucgagggcugagguccugggaugaauaaaaagaacaaugcaaguagaaaaccagccuucuucccucgcucccuaaucuuggaugcgaucugacuucaagcuccugccacggagaugucccuacugggacagacugagcccuugaacuuggagucaaaagaaacccuuccuuacguugcccuugucaggguuguuuguuccuuuguuugcuaucugucugucuaucuaccuaccauuuuugugcuuucucacacacacaacacagggcaggguagaaccccaugcauguacaugggaggacgugugcacccuuguauacaugcggaggccagagggauaucaaguguucugcaccaucaugcucugucauuuggcuaggcuggauggccagccaucaagcuccccaacacugagugcugagguuuggucuguugcuguguauuauaaugcuaaaugcuggugccugaagucugguugccucccauggaccaugagauccucacgcacaccaaguugaugcuauguaaccuugcuccuuaauuuacaacuacugguugaauaaagaugccuacagccuauaguuggucagaaaaaagguagguaggguuuugauucucaggcuuggggucugagguaggaccagaagaagagaaggggagaaggagaagagaggagaagaugccacgggguaggugaucaugagaacuggccaagagggcuggccgcuaggaguaacagggguuauuauuagggaaguagacauaauagcauagaggguagauuuuguccagcucuaguguuuuaaaggcuuauucuaaauauaaaaguuuugugucuuuuaucugggaacuuaaugaucuaagguggaguagaaaccugauugagacuauccauacuacaacaacugaguguuauaggcacaugcaagccaugccugaagucuuuacaugugugcuggggauuggaacucaacuuuccauguuugcgcaacaagcugucuuacccgcugagccagcugccuagcacacuugcugaggcaauaagaauaauaacuaugcuggguacaguggcacaggcccuuagucccagcacucaggaggcaaggcagguggaucucugaguucgaggccagccugguguacagaguuaguuccaagacauccaggcuguacagggaaaucuuguuuccaaaaaacaaacaaagaacaacaaaaauacuugguccccagucuauuacacuauuaggaggcaauagaacuuuuaagaggcagggcccaaggguaggaaaaggucauggugccaguccuuguccucaauauugaauucucucucucucucucucucucucucucucucuccuuguuuugagauauggucuugcuauauagccccuuaucuggccucaaacucauggaaauccuucuguuuaacaucccaagugcuaggaugacaguuaucuaugcuuagcucuguaacucuguuuguuuguuuuugcuuuuugcuucuuggcaacuaugaggugaucaguucuccuacagcaugcuuucccaucaugcuacgcuguguuuccacugguccaacacaagaugaccaagugaucauggacuggaaucucugaaaucaagagccaaaauaaaccuuuccuccuuauaaguugaucgccucaguccuuuagucagaguaacugaaagcugucugcccuggugggaaugguaagguacuuacaaugagcaaguauccuguacuucacuuggacuggucaaugucaaccaaauaggcuaucaggaauuacgugugugaagcauaauucuaguguaggauagagaggaaggaacacguucuaccugccuccuuugguacagcagcagagucaggcucaccaucuaaacaaagagacuuacagcucaaggacaggcugaaauggauacuaacagagaaguggcaugcaggaagguaguaugaaagcaaacaauggagacaaagggaaaggacagagaagagaaggcagaauuccaaaguaaaguccuaacacaucagugaugacuucaaucauuuaaauacacagacuaaaggacagaggggaguauugugcauaaaaaggcaagacccgaguacagugaguuucuaggaaacaccucaaauauguaaacagguuaguuuaauaagaggauggucaagauauauauauauauauauauauauauauauauauauauauauauauauacauauauauguauguauauacauaaauauauguguauauaugugcauauauaccuauacauaaauauauguguauaaauaugcauauauauaauuaaaaauaaacaacuggaaaagucauaccaugcaaguguuuaucagaaauaagcaugaaggccaggcaugauagcauaugacuuuaaucuccgcacucaguagguggaggcagcugaguaggugaggaucucugagcuugaggccagccuagucuacagagguaauuccaggacagucagggcuauacagagaaauacuaccucucaaaacaacaacaacaagagcaacaaacaaaacaagacaaaacaaaaagagcaagcagaaagcuggguucaguggccaaagucuauuaucccagcugcucagaggaucgaggcaaaucacaggcuugucugguauauaagagcagguucaagacuagccuggggaauuuccugagacugucucaaaguaaaaaaguguagaggaaagggcugaaaaugcagcucagugguagaaugcuugacuaguacauacagggcacuagacuuacugccaagcaccacacacaaacacguacaguaagccggaguagccaagguacuagauaaggcaggucucaaggggaaaaacaccagccaugaaaacaaaacaacaacaagcauacacacacacacacacacacacacacacacacacacacacggugggaugggguugugggguacgguagcauauugcaaggcccagcaaaucccagcaguuuccagaccgguguuaucuacacagccaauucuagaagagccagggcuagagagugaacugucucaaaaacaaaacaacucuccaccccaccuccuaugaaucugauacuaucaacuaaaaagccuaauuguugaauauuucauuuaauuaaaccauuccuuuaaaaaaucccgaaucuaagcguguggugcuucuuauuugcaacgcuuuccauaauaagauuuuaaaauguauuuuuuuaaaaaaauuaaaauguaaaggaugcucaugcgcacaaggcggagaggaggagucgcaaaucgcagcgcccucugccugaugcucccuugcgcaccccucccaccccacccccacccccauccuucccaccucucccaccccccaccuccgcccagugcugcuaugcucccucagugaggaccuccaaccucuuuugugaagaugcagcugaggagacucccagcugcacaagaaccccaagggaggagcagagccugagaacaacgaucauauuauuuugaagguaguggggccggaugguucuguggugcaauuuaagauccaagaagcuugaaccacuuaguaaagcaaugaaagcccauugugaacgacaagguuagugaacuccgcagcucagauuccuguuugauggacagccaaucaauggaacagacacgcccacucaguugaagcggaggaugaagauacaagugaaguguuccugcagcggauaggggcucuuuccugaaccuggagacugcuacuuuacuauagaaauucguugcugaucaagaguccuucucaggagucgggcgugguggcgcacaccuuugaucccagcacuccggaggcagagccagguggauuucugaguucgaggccagcuuggucuacagagugaguuccaggacagccagggcuacacagagaaacccugucucgaaaaaaaaccaaaaaaaaaaaaaaaaaauugc

SEQ ID NO: 1966 - RNA, 1286 nt, Mus musculus
cuuuuuuuuugugggugcagcgaacuuuauugaugguauucaagagaguagggagggcucccauugccccuccuguuauuaagggggucugggcuggaaauugugagggagaugcucaguguugggggcugaguugggauagggacuccucagcaaccgaaggccucucucuugcucuuaguguccuugcugggguggguggucaaggguuucuuacuccuuggaggccauguaggccaugagguccaccacccuguugcuguagccguauucauugucauaccaggaaaugagcuugacaaaguugucauugagagcaaugccagcccuggcaucgaagguggaagagugggaguugcuguugaagucgcaggagacaaccugguccucaguguagcccaagaugcccuucagugggcccucagaugccugcuucaccaccuucuugaugucaucauacuuggcagguuucuccaggcggcacgucagguccacaauggacacauuagggguaggaacauggaaggccaugccagugagcuucccguucagcucugggaugaccuugcccacagccuuggcagcaccaguggaugcagggaugauguucugggcagccccacggccaucacaccucagcuuuccagaggggccauccacagucuucuggguggcagugauggcauggacuguggucaugagcccuuccacaaugccaaaguuaucauggaugaccuuggccaggggggcuaagcaguugguggugcaggaugcauugcugacaaucuugagugaguugucauauuucucaugguucacaaccaucacaaauaugagggcaucagcagaaggggcggagaugaugacccuuugggcuccacccuucaagugggccccggccuucuccaugguggugaagacaccgguagacuccacgacacacucagcaccgaccucacuucauuugauguuagcggggucucgcuccuggaagauggugaugggcuucccauugaugacaagcuucccauucucggccuugacugugccgucgaauuugccguggguggagucauacuggaacauggagaccaugcaguugaggucaaugaaggggucauugauggcaacaauguccacuuugccauguggagagcagauggcagcccuggugaccaggcgcccaauacggccaaaucuguucacaccgaccuucaccauuuugucuaugggaagaggcuggcacugcacaagaagaugcggcugucucuggaacagggaggagc

SEQ ID NO: 1967 - RNA, 2589 nt, Mus musculus
gaguguacuguauacaaggaauccuaguccuaucuuguuaauacauacuacuagaacaucucauuugcuuaauucguguuauguaaaccugggcaggguagaacacacacacauauccaaagugaucaaaaccaggccaagggagggaguguucuacccacuugcccuaggaaagauuuauuuguuuuuuuggaggggaguggguaacaggagggcaaagggcaagagugaggguaggagagaugcagaggagaucaagacaggcaaugagaagaaugaaggacucuguacaaagacaugcaaaaaugcuccaagcagaguaugaauuuaaaagaauaaacagucagucuugguuuauacaucucaagugaaccuauuuacucagcacauuggccaggcagacaggagcaucgugucuugugaaucagggcuuacaugagccacugcgcugauucaggaauggguagggggaugcuuugucuccuagcaaagaagaggcaggaacguuagugccacaaagacagugccaggucaguucaccaugcagggugugugggagagcagcacaagggcuggaguuuucaccuucuugaaaaccuuuccagagccagcagaggagagcucucuuucccacacaggggucuccccagagcauccucuccaccccuggauuccacaacagaagugggcagagccgguuaauaauugaugccuuugccaucuuagaggugucuuuagucagcaucacauuuggcaacaggaagccuuauaaaaucuugguauagcacuuagauucucucuaucuugaagaaauauacuuuuauacuaucuacuucucuccauuucuguuaaaauaccaucuucuguucuuccuucccuucaacauuuuuuuuuuuagcuaaagaaagcauuaugacuauaaaauguccucuguaucccuguuaugcagaguucaggggacaaggcuagaauuagcuugcagaauuugugcaauuuuggcaaccaaguuuuuaauuacuuuauuaagauguuugguaacugcuuauuauaaauacacaggagggaaauuaaaaacaaaagucaacacacugucuuuacucagacccgaaguccuuuuucaaagugcuuuuuucucuucaguccucagacuggcucaugaggugacuuagcacagcauugucaacaucgaucugauguuacuugucccaaaaucugucuuccuuuccuugcaagucuacaacaaagacacaucuccacgugucacucucaguugacuaaaaccuuaccuggaaugugacugcuuauagccauaggaguugggaggaagcgggguaucccucagccaugcagaaggugugcaaaugcagccuucauuccacuuaacuaaaacuagucacuguugacccaccgcuaagucacccuuuacucagaaauagccagcgcgacaaauuaucuggguccagguauucugggcuguaacauuuuuaccauccuuccuucaagccucugaucucuaauuuuguaaagcuuacacucucucaaauuccuaaaauggagaauuugccuuucaaauauaagaucuucacuguuuuaauggcuacaguucaaauaauagagcccuaucuuauucugauuguccgcucaguuuggcaaacagguucauccaucuuguuaaauauggauuuagaguccauuauugaaagauacuuguguacacuuagcaaaugguuuaaugccaaacauuuaagguuccccaaacaguguuuuucagccaccauucaugagcaguuuguuuacagcacacacacacacacacacacacacacacacacacacacacacacacacacacacuuuuugaccaggaagaaaagcauucuaauccuuuccucacagaauaugggcaaccuccuccuauuugugcaggaaaauuuuccccaauugcaaugaccacacccaacacuccccaaauggauggacaugggauugaauuacuacuucaaaguaaccgagaacagucagcaacucucuacugacccuuuauguaagaagucaucuguccacuuaauagcuggggagagcacauggaagcagccuuaggauuccugaaaacacagucguugugcauaugugcuuggaggaaagaaacagggaggugggggagagagaggaugacagaaagaggcaggagagauggaggaggcaggcugauugugaaugauuguguacagcaggcaacuggugggaaagccuggcccucuacucaauuuccccuucaccagggauaaacaggcaauuacgcauccuuuuauauuugauggccaagugcugaacuggaaagcacacuauuaguuugugucccuucagggccagggcaauaaguagccgggagaacuggggccggagcagagaggguguugucugcuguuagugugacagucuugucagcagcguucacauuacuggaagguaauaaagugacaaguacguuauuagaaagauaugaggugaaauugaaccaaagcuucuugcugcucagcccuggauuuugcuuuuccucuuuguaaugguccgcuauuuguuacaaac

SEQ ID NO: 1968 - RNA, 400223 nt, Mus musculus
ggagggagcaggccgagcggcgagcugaggcggccgaggggcugguccaggcgcggccgcuaagaggagaccaagaggcgggggcugcacuugacaaccagcaugccgagaugguaagaaguuuccaccuccucuccgcuugcgucugcacuugguagggacagacccgggcgggacgccccggggccgcggcgggccgcguucuccucuagcgccgcggcgugaggaggcgggcagccggcggcgcucccgaaauccaccccccacucccccaacuuggccccaaguucucgaggcggcugcgggagggcgagcgggcgggcaggcggacgggagcgagggcuccccgcgccuuaggugagcggcggccagucggggacucuggggaccggggagcccucggggagggcgcgggacacggggacccgggaugcacggggcugccgggacccgcggcaacuuucccaacuugccggccuguugagagcccugagcggcggcugggcaugggugccggggcgcggcccgcggcccgcguggggaccgcagcgaugcccgcgcggcugcggaggacgcggacgcggccagucaaaucccgcuagacagacacgugugugcuuucccgaagugcgguucugaagcagccggcccacugcgcuuacacgccgacuggacggugggauuugagaccugaaaggggggcagaauuuaaaaacauauauauauauauacaguagugguggagcucaggacaaaacuagacggaaucucccgugggaugaggcgaagauuaaaacaaaacaaaacuuguaagugccaaguggugguggaaaagggauggcacagcgcagggggacuccagcccagucccuggaagggacggcuucucugcagcgaggaagcaggcaauuaguucacccagugaugagccucacugucugcuuucgggaagucauuuguuagaaauggggcuugaccacucuuuuuuucuuggaguucccuaccacccagugucgcuguuguuagccccacuugggggcucugauacaaagugggcccuauguacaugggauguauaagaaacggggugauagcagguugacauuuuuuuuuccucuucccuucccccugaugugacaucucuuguuucagagaucaaagucacaacuggaauguaggagaugguacugucaaaugcagacauacacacauacaaaaugcacccaggacugcgguuacaguaaugcugacagaaauuaaagagguuuugaaagcagcgugcgauuuaugaugcuucccauuuacccuagagucaagcuguuguaaaacugauguacaaaagacaucauaaaauaauccuguguauccaggauuaaaguggcagaaaguggccuguuuuauuaauuuuuauguacuucgugaacauuuguaguuguuggauccuguguuaauggagggaucaaaacaaaguaugaaauauaucuccuuagagcuggagaguuucuuguaacggcauuuuacagaacauuauuaaagccaguugcacgccuuuucuuccccuggcuaguauuacuauuugucuacagaucuauucccauauacuaaucacugagcgguggcugaguccauuugucucccgcuguuuuguauucugccuguuuaggugguuucaugcccagacacacaugcuuuagguggacuuuauuucugacacuaaguauuucugcucggaaguuuuccucuaguaccaauccuugucuaaguuugagagaacuuccuuuuacucuuuggaaucaugcacacgagaauccuuugugagcccuuaaaggcucuguacuuuauaugauauuuguagccguuuccuuuaaacuuguucaguuuuaaugaaguucugaguuguagguacucuuucuguucccagagagcaguggauuuaaaauccagauugcuaauuacuuuaccaaagcauaggaauaucuucaccugagggaaggacuagcaaaccugaaucugaacuuuguauagaagaucuuucuggaggcaugucugaaaugcccugacacccccccccccauccacugagaauauucaguuggguuugcauguaaaaacuuuggguaaaaacuaaccucaugugauuuuugaaaauauugaggaaauauuaauagcaauagugcauugcuaauaccugauucuuccuuuucugccugagacguaaguuaucugucaggcaggaauaugugauuacagaaaggagcagacaaaagcagggcugacuguugcuauauuaaaauguaaguguuacaguuugaauuuucaagugagaguuucugaguucagugcuuuacauaacauuuuguccuaaucuugcuugcugucagggauguuucaugguugugcaauugcugcagucaagaaugccaauuugcauuccacgacugucguuugauuacuuuuaucugcgaagcuccaagaccggcccagaccucucguuucaucuugccaugucacgagucaaugcugugucgucuuuucaaaaaucugccugauuuagacaagaaagaaaaguacuuucauguugcagccgcaguccccugcuaacuugucagcagcaggauaugauucacuugggcccagaagaauggaacagagaggcggguuagacgguucaauaaagcccacggacagguagugugugacguccccagagagcugcaguuaaugaagaacaggucugcuuaguucuccacgcgcugaccuggugcuguccccacaguuuucucauuugaucuuucccagcaaauugaucuuuucuuguauuuuuuugccuuccaaguuaguccuugagggacugaaauuagcagagcaacuuaaguuggauaauacagcuguucagaaaagaagaaauuggacacuggcaaaaaaaaaaaaaaaaaaaaaagagggggggggguugggggugggagaggagagagagcuagucuuuuuguuguuccugggaauauuuccuagauuaagggaguccaaaguaggugaugacucgaagcuaacgguuucccuuacuuuaaauuuagaguuaagccucagggcuauuuuaaauauucuguaaauguuugaaagauggcuuuagcaaggaugaagaguuugauuuagcaaugcucauauucacuuguuuggcgugaucugccaguguaauaguggcuuuuauggcuguuguaagaugaacaaaacaucaauggcacacuucaacuauguuauuuauagucaucuaaauaaguacaauucccaaauauucaauacugaauugcugaaaagauuaaacaauaaaaaagucauuaacagcauuguguauaaauauuauggugcaugaagauuuuuuuuuaugaaucaguaucuuuguuuuacauaaauuccacagaugcacuguucauagggugggcuagucucuccucugagguuuuucuuuuuaaauuuaaagguacacuuuuaaaauugagaccagguuacacguuggauuucuuugaaggguucacauguugguuuuugagauuaaaauucauuuuguacaaggugaguaaaucucaguugagaaagcaugcacaguugauacuggcuacaguuucacuauagaggucuuguacagaaagcuuagguugggagcgauuaauagucuuaacuugaugaauguauaaaggagugguguuuucugaauuccucugcagauggucucauuuaacaucugcauccugacaagaaacagaguuuaaaacggcaguucuccugcaacaucucuucuuggucaggaguuacauaguauagcugguuaguaagcucucuaaagagcuagagggagccucaugauuuuauuagauauacuuaagguuuaaaaaaaaaagaacucuggcagucagaauguugcacaauaacuggcuuagaguuuaggcuuggaggugacaccacaccacacaccacacacacacacacacaccaguggugauagcaacagaauuucuuuugagaaaguuaaggagucagcuaagcuuucuaggacucuaccuuguaggugauuugaaugagguaaagugcaaccaaauauucuaaguguuugaauauguguaaccacugggucacuuugucaacagaaggaguuguucucauguuggcaggcccaccuucaaacaccaucaagagcaccuuccuaggcagccacagaggagaaggcuacccuccuuaggucacuaagacagcuacuugucuccagagaugaugaugugaaguaguucugccuacaacuccagguucuggagaaaacaucccugcaaaagaagggggcuuuguguugucaccauaaacagcagaucauuuuaaaacuuggcauauuauuaaucaguaaauaagcuacauuuaaacggcagaguugaauguuuuccuauuuacucuuuggcauuuguuaaucaguccaaccaguaccauuugugauauguuuauauuaaauaaccagcgauagugauugauuuucauuauucauaugcuacuuuuuaggggcauuauuuugacauuuauuuaccguuuaaguaaaucuuauauccagggagauaaacugcucagauuugucuucuugcacaguagcucucauuauguugcuagccaauaaaagucuuuauuugcugcuuauuagagcccucaguacacucaaaaguucagcuauaauuuaauuuggguguucaaagagccucccuuguuuuaaaacacguucucaguauguauuccuuuaucauuuguugugagccuauauucuaacucaugaauaugcauaagagcaguaguacagacaugccauuuuaaaaguuuuugccauaacagaaguguaccauuuuaaaaaaaaaauuauguauauaacaauguaaauucuguccuuucuacugcaauuuccuaggcauucuggagcauuuucacuuuucccguagucauuuaaauuguuuaggauuuguuccccaaggcauacaaccuugaagguguggugagacaggggaaagcuaaguuuugcagucaagaguucugguuaaagugcuuucacugucauagccccuugaaauuaugauggguuuguuuuguaauuuacaaauugccagaaugguaaguucuucauagcaacugcugggcaguuuuacagaguccaagauacuggcggguuucaguugaaguguaacugauuacacaagcugaggaccagagcuccaguauccgggauccuuccacggggaaggcaggcuguggaacugcuaagugagucacugcaugugugucucaccagugggaaucacauccagccuugucuucuacagacaggauuuaagacuuaucaaaauguacaguauugucuucgagcuggggguucaugaguucgcugucccagcucuuuuguguguuuagaacaaagauguaacagcccacacaaaaacauuuuuucucuuauuaugaccuuaaacauuugccaaaagugccccauacugaaauuccuuuuuaguaucuuuuuccccccuuaguccaaagccagacguguacccagacacaaagccucuguguacagcaagcuguuuuaaauauugugacucggcacugugcuguccuuucucugcuugagccaaggaucucugcucagugucuguggauuaccaagcuccuucuuuauuguaugucuugucagcuauuccuauucauuuaaccuuucauuagugucugugcagcuucacugucugcaaaggcaaggagaacccgaaaggccccacugucacaguuauuagauuucuucguuacaucccagcaaccacaaagaaguaagaguggagacuauugucgugcgugcugcuguccuggggugcagcucuucugugcaugucaaggacaugugccacauguugauaugcgucccaggaauaaaugcgcaacaugggggauaggcugacagaggcaguaaugagcuuuguaggaguuauuucgaagacuaacaguuagugaaggaauuuugcuuaaccggccaaggagauagacggaguugagaguugccaagaucugccugugcggagcuugucagucacauuguuuucaucuaaaccucauuugaggggaaaauugaauaccuuugacaggaaugaaagucgucuuuacuccuuuaaucuuggagggagggggaaaauguuauuucugaugacuauuauggugcauuauaacuaauuuuguaucaacuaugauaugugaaugauuauguuacugugucucuuaauuuuuacacacugcaaaaucaugaaacaauauuuuaauaggcauguguauguuuuauaaaucuauuuuuaaaaauggagcacaugaaucuccuuguacuccugcuuugcuguggcucuucaugucacaguguggcuaucaccugguuuuuauacauguguuuucaugguugcugaaauguggagaagaggaaugguuacgggucauuuucacauaauaauaaagacaaauaguuggagauuuagaauggaaaggguuucauuuuuaagcaucauaaugaacucucagagcugggaagggagcuuaguugguagagcgccucccaugguagcaugaagacuugaccugacuccacagcauguacaaagggcccaacauggugcccugcacugcugcucuccgugcugggaaggcagugacaggcaggucccugagguucacuggucacccagcauagccucauuggugaguuccaggccagugagaagaaagcagggaacaacaaugaaugucauugguucuggugucgaaucuuuacccgcucaguguuuggagaugucuaucuuggaaagcaguuguuaaagggagcauacaauguaacagauuccauaaaggcuuuucaguguauacaguucuuucuacaggcaguuauggcacugccuguucaccccuauuagccaaacaaccaguuugguaaucucuaaggcugucuccccgcaagugcuugaugauagaaaugauagugguuuacuuguaguuuuaacuacuuuauugugagaugccucacauaccauguaaucaucauuuaaauuguacauuaauaauuauaggauacacaguuucuuuuaccuucaucaauuuauggauuuuuaaaaaauuauuauggguaaugcugcugagaacuuuccuugggagaaggucagauguuuuauaacccuugggugcacaccaauaagaagaauuguuggaucauguggccuucuuuguuuuccauuucaguugucuucaaacaaacaaaccaaaaccaaaaaccaaaaaccaaaaaaaaaaaaaaaaaaaaaaaaccucuuguggucuuaaaaaauaccacgugugguaaaaguuaggucuauaugucccgugguaccuguugcuucucucuuuuaccaaguagguuucagggguugaagucagguuuucaagcuuggcggcaaacaccuuuaccugcugaggcauucguuugcccuagguugccguuuuauaguugaggucuaaaagcuguugauacagucugguuacaguccucaaucugauucaagguuugcaaacgcuugcccccauucaaugagcugucuuuuuacuuuuuugauguccuuugaaacaauuaaaaaagguuuuuuuuuuugaaaggaguuuaagaauauuuuuuuuuccaaccaagauuuuauugcauguuaaaugguaacaacucaauucaagagcaacagugacccucagaaaaguuccucgcacugucaucuaucaggguaggaugagaccuuuuaaauuuugaugaaguccaauguacauaauauuuuccuuguucucacuuuugguauguugucaaaaauaaaacuaaccgaccagacaagcaaacaccaaaccccagaccauggccucacucaaugucaugaagauuuauuccuggauuucuuucccugcuucuuucuguccuucuggauaaugcuaugauguaggguugcuagaucauaaugugguagucugccuuuuguaguuugagaaauugccuugggggggggcauggguaacaucuguaccauuuuaugcucaugccaagagugucugaguguugcacuccacguuaucaccaauaccuacuguuauuuuaugauaguuacaggaauaugacaauaacaacugcuagguggcauaucucugugugguuuuguugucucugcuggccuugaacccuagggauggugaugcuccucuuuagccuccagccuccaguacugauauuuuaucaagagccucacaaggguguggcacucacucugcacugagcuggagugugcguccagcuccuuuuguauuuuauuuccagaccaagucuuacuaaguugcccaggcuggccuuagacucauggauuucccauccuucugccucacucucuaguagcuguuaagggccugagcuagcccuagcuucuguuuauccucuaaccucagcucucuuguggugugugugauagguagacucacaccucuuuuuggcguuuuguccauuuuaagauuggguuacauagguuuuucuaauuuuugaguuuuaggaguucucuauacauucuggauauuacuuucauaucagaaauuuacuuuacaaauauuucccucucauuccuuggguuaucucucauucuacuugcuucuuuugccuugucuguauaggagcuuuuaaguuuucuguagcuccaugugucuggucuugcuuucuuugccuucaguaguuuacauuuaaaacuuagauuuaucugauccuuaaaagaguaaaggcuacaucaagaaagaacauucuauuguuuagggguggggggaaaaaaccacuaacaacucuuggugguacuccaggggacaagaaauaugucauucaguagccagaagaugauaggugcugguucccugugaagcagcuugguuuacuuugauguugcuuaauucuccuugaguuuaaagcaaucuagguguucuguaugauaacagacacacuucaugcccuggaggguggaauuaaguaccuagaaauaauuguuuuugguuucauaaauaccucaaaaggaaaggaggaaaaaacauuauugagaaaauuugucuucuagacauuccaucaugaacaaaacaucaccaacagagauaaaacugaaaauuguuuuaugauacccaaaccuaaaauaaccggcucaguuaaguuuuaaguaaauacuguguucaaaucugccgugauguguuugcaaacagcuugcucuccagucuaccagguguacuuuucaaagccucccgccacugagucagcggagccugugagcaggggaaagggaacuuaauuuagaggcagcgauguuagagcaucgcugaguuaaaaggaguauuuuaaagaaaaugucuaauuuucuuuucacucauacuaauaaaaccuguauucauuucuauuuaaauaauuacuuuuccaguauccugaugggccauucuuacuuaauugcuuugucuuuuuuuggcuuugugccaguuauuuuagacaaaguuucauuauuauuuggcaucagcuauuaauuagguggccaaguggucacguucauauucggagagaaugugggguuuuuccccucacaaguguuugcacaugaaaaccguaauuagccaauuuaaagugauaccucaugacauaauuugaggauuaacuuucuucccuguggauauucuguaaugaauuuaaaauaauuuuuaaaauugguaugacaaaaauuuuuguaccuaucagauacaugaccuuugauuuuauauauauuuucuucuuuuccuggggauuggacugaggccucucaugugagagauaaguacuuuauacugacccacaucaaauuuuauaauuuguuuucauuggacaagcaguguuacauuucuauucuugguaugucuugucauguccauauuggauuaagaaaguuauguguaauuauggacugauaucauauucgaggacauaaagaaugucacuaacuagaaugguaaauuauacaaagaaagaccccucagcucccugucccaagacuucugauccuuuuaauucuguaauuagcagauuagagagguuuacucuaucagcaccugcuauguuugcauccagagauauaguaggaaaguuaaaaguuuucucucacucaaaaugauugggauaaaacacauguuugcauccagaaauauaguaggaaaguuaaaaguuuucucucauucaaaaugauuggaauaaaacaucagauuucuuugaaaacagucucacuccagggcauauaaauaaaauuaacaauggaauuugcuuuuaaucucagcaguucugccaggucucaagccaaguuuaaacgucaucaguuuacuuacaauagugucuagugcaagaguuaaauucauuucucagagagugcacuucuuaaacauucuuuauaucuuuaagagaugaguucugcauccuuauuucuuaggugguugguaccuuacucuaaagaagggacagcaaacccauacccucaguacaucauuguagccaguaaaugccacuuuuuuucugguguccucuuaguggcuucaaugaacccuuggggcaaugagucuccugauguuuuaaugcuggagcuugggaggcagaagaucucuguaaguuugaggcaagccugaucuauagagggaguuccaggacagccaagacuauauagagaaacccugucuggagaaacaaacaaaaagaaaauuaucauaggaaagacuuagagcuguuuauuggucauugaucacgguagcaccugugaucacaauggcagacaguuuguaugaguguguacaaauguguagcaggaguguccuugagaagcugggaaguguuccuguggucccagcuaccugaagauugaugugggaagaugacuugugccuaggaguuggguaagagaaagagaaauaaauagagacuggguggacaaauauaaguauauuuauucaugacauagaucaauaaugaguggaucaccaaauguuuuaguaguauuaugaaguuguauaucuaaaguacugauaugacaguauuauaaaucuuuuuuuuuuucaugcuugguaccaaacccagaguggcaugggacaagcauucuauuccucucagauaugagagcugucaguuggaugucuguuugcucuauguagaauagcuugcuggggguuuuacaugacaugagaccuuagacuggugguucucagccugagugucaugaucccuuugggggucaaacaacccuuucacaggggucacauaucagaaacccacacaucagguauguauauuacagcucauaacaaggaagaguggacuggaacaugaagggucugguggagggaggauggaggguccuaggagagagagcuggaaaugggaggcauuacaagggugagguagaaaccuagugcaguagaaacuccaaggaaccuacaaugaugacccuggcuaagacuccuagggacacagagccugaaccagcugucuucuguaaccaggcaaagcuuuucaguggagggagugggacaucaaccugccacaaaaugucuauguauuauuuaucuuaccugcaagguggcacaguacuuguggguauggccaaccaaucacucuccaucuugaggcccaugcuaugagaggaagcccaccccccugacacugccuggaggaccaggaacagagacuggauagucuagagucccaggauggaaauaaacaugaauggucaaagaaaugauuuuuaaggauacucguagaccagaaccuggagccuagcauaaccaucaccagaaagucuuuaaccagcaacugaugcagauuugcacagccaaauguuagaguggacucagggaacccugaggaagauggggagcguaggagccagaggggucacgaacacccccaagaaaaaccagagucaacuaaccagggcucaucaggggcucauggagacugaagugggaaucagagagccuucaugggucugaccuaggcucucugcauguauggguguauagguugauauucuugugagaaguuagcuuugacacuuuugccugcuuuugggacccauuuuucuccuacuggguuuccuugaccugccuaaaaugaagggaggugcauagucuuuuuguguguuaguauccggucuguaguggaggaaacgaucuaggugugaggggagguuggggggaaagacuuggaggacaggagggaagggaaacugaguuagggauauaauuguaugaaagaaugaaaaaaauaaaaauguacaguagcaaaaauuuuuauaaauuaggaaugauaauaauuuuauaguugggcgucagcacaauuaagaggugcuauauuaaaagguggcagcuuuaggaagguugaaaaucaccgccuuagacaguuguguacugauugauuaaaauaagaaaagcucuuaaacuuugugauugauuaaaauaagaaaagcucuuacccuuugugagguuuuuauguuuaaguucuacuuccuguccaggugugugaguucuaguugcuuuguuuugcaaaguagaacuuaacuuuuacuaugcauuuuuagucuuguuuuguuuugagacagaguaggguggaguccggguggguggggugcaggugaggggugcugguaucucaggcuggcuacaaaguugcuauguagcccagacuggcuuggguuuccugacccuuguugucuacugcaguaugaacagguccacuucaggcugcauuuccuuuauuuauuuauuuauuuauuuuuuauuuuuuuauuuuagaagguaaaauuugucaaacuuuggaguuuuuaugauauaaaaaauuugguguucaaggucuuauguguaaaguagaagcuauaacccuaaaauuaagcaacacaaaauucaguacaggguaaauacaauuaaagaauaaccaaaguguaaaaacagccuuuggucuucuaugcuacaccuagaaaaacauuuuuuuucaauguuguuuucaaagcaaccuuuccuuuaguagcucaucuuucuuuuuucccacugacugagagguaggaguaacacacagcacacacauguacacacacacacacacacacacacacacacacacacacacacacacaacuuuaugcauguuugugugggaguaaggggcacccauaccuguggaugugagggguaagaguagaguguguguguguguguguguguacacgaaaauacacacacauauacacacacaggugaaugugaggacugaaaauaaucacacagaccuguguguguaacacacacacacacacacacacacacacacacacacacacacacacagaggaacauguguaaaacagucuauccuaugugggcaaacaucucuguguuccuguagauggacuugcauguccuuugcagccugauucuccguuuguugcuuuggaauuugaucagagaacauuacggaugggcaugggagucuugagugcuuccugucagauagggagagauuugauuguguugauucuagggugacucuggccccucucauaggcugagcaccuagguaaagaaucccagcagccuugaccccuugcuuuuuuucugcuucccauuucugcguagcuuaacaucucccuuaucuuuauauacauauuaauauucccaagcagguguccaggaagcuccuuacagaaguggcugcauccguuccguuuuuuugaggaguuugaugagaauagcagugcucacuuuacucauuuaaauuucuuggggaauguugcaugcugcguccuuauguguagcaugguguuagugugggguaggugaccauggagaugggccagaggcgaagacugcaggcugagggaagaagcagcuacauccuuuaaagaaagggcuugggucuaguuacaaaauacuggagaaggccaucuaucucaaaaccaugaugugacacugaccuaauaggaagagugaauugcuuuugguauuggugugagcuguguuccucucuuguuuucugcuucucuuuucucuuaaguuugggccaauauuagauacuuaauaaagauucuuaauaguauuauauacugugugauaucugacuuccaauggcacuguuuaugaugaacaagagaucagagagugaaagccacauucuuuaucauuugauaccagcacggacuuuuuagcgauacuuauuuugaguuuucagcgcuuuguuccuucaugaacacuuuauggagacagacuuguuaugaguguuaugagacaagaagguaucaagauaguaagacacucaacauccacgugacaguaggacagaaguugguggggccaccaguucucacugcuuuccuauguacagucucaacuuuagucucaguuuucaguggugugcaauuuuaagagcacucauucucaguuucucacauuuaaaauuuuacauuuggagauuuguggucuaaauagaggauuaaguggggagggguggaagggagaaugaagacacgacagagguguggaacaaugauggacauagagguagaaagguuuguugaagagcuugagaccuagccugcccagagagccccauguuuaaaugcuguaggccuuagaaucaguugaucgaucuauccuuaaccagacccaaccccaaccccaugaucauuuccagcaccuauugcucaggacacccccugcucccaucuuccucuucuguccucggaauuuugcuggacagguuucaucagguagacccacccuccugucacucacagcuuuugcugccaccauccugcccuaggacacaucaugggcaaugccugaguccuguguuuguuggcugugacauuuaaaaauuccaucaugaagcacccacacuuuggucuuccuucuucuugggcuucauauggucuguaaauuguaucuuggguguuccgagcuuuugggcuaauaucaacuuaucagugagugcauucaaugcauguccuuuuguuggguuaccucacucgggaugauauuuucuaguuugauccauuugccuaagaacuucaugaauucaucauuuuuaauagcaaagcaguacuccguuguauaaauguaccacauuuucuguauccauuccucuacugagggacaucuggguuuuuccagcuucuggcuauuauaaggcugcuaugaacauaguagagcauguguccuuauuacauagugaaguaucuucuggguauaugcccaggaguggaauagcuggguccucaguuaguacuauguccaauuuucuaaggaauugccaaacugauuuccagagugguuguaccagcuugaaaugccaccagcaauggaguguuccucuuucuccacauccucgccagcaucugcuguccccugaguuuuugaucuuagcuauucugauuggugugagguggaaucucaggguuguuuugauuugcauuucccugaugacuaaggauguugaacauuucuuuaggugcuuuucagccauucgguauuccuuaguugagaauucuuuguuuagcucuguaccccauuuuuaauaggguuauuugauucucuggagucuuaacuccuugaguucuuuguauauuuuggauauuagccuucugucgaaguaggguugguaaagaucuuuucucaaucuguugguugcccuuuuguucuauugacaguguccuuuccuuugucuuacagaagcuuugcaguuuuaugaggucccauuugucgauucuugaucuuagaguacaagccauugguguucuguccaggaacuuuuccccugugcccauguguucgaggcuuucucccacuuguuccgcuauaaguuuaaguguaucugguuuuauguggagguacaugauccacuuggauuugagauuuguacaaggagauaagaaugggucgauuugcuuuugucuacaugcugacuccaguugaaccagcaccauuuauuuaaaaugcuguauauuuuuccacuggaugauuuuagcuccuuugucaaagaucaagugaccauagguguguggguucauuucugagucuucaauucuaugccauugcucuuccugacugucccagcaccaauaccauacaguuuuuuguuuguuuuuuuaaucacuauugcucuguaauacagcuugaggucagggauggugauucccccagaaguucuuuuauuguugagaauaguuuucucuacccuggguuuuuuguuauuccaaaugaguuugagaauuguacuuucuaacucugcaaagaauugaguuggaauuuugauggggauugcauugaaucuguagauugcuuuuagcaagauggccauuuuuacuauauuaauccugccaguccauuaacaugagagaucuuuccaucuucuucauuaauuuuuccaucauuuugaauagcuuagaccuagguuuuuguuguuguuguuguuucuaugauugacauuucuagaaacaacuuuauugggauauaauacauauacaguuuaauguugugacucuacuaacacucugcaauuacaguuauaauuuugaagauauaggaaaauagaugauuuuuguaauacuggaaguacuacacugacuuuaaccucuuaagugagauaaaauuguauaauacagccuugaguagcucaaugguagagagcuuaccuaacaugugcaaagcccuggguuugaugccccuccccacaucacaaccaaaacaauauaauuguaguauucaggagguagagggaggaggaucaggaguucaaggucaucauggguucaagacuagucugugcacaugagauucugucucaaaaagaaaaaaaaaaaaaacaacguaaccuuugaagcacuuuaaugugguauuugguaagauccacaaaccugaaugaauuauuaaaguaauuaauguauuacuaaauauucuagggaaaaauaaaaaaguacaaaaaacagaaauauucacuauucuugauaaauuaguuaucauggaagaucaugaaauaauggugccauagcuauaaaugccugccuuagagcucuucauucaaaauugguuuuagacaccccauguauaacucuuguaauucuaucaagauuucuauuaccuaagguugggcuuucugaaucauuguauaacaugaugaaucugguuggugaucaaguaauauaauuccauuuuugaucaaaaaaacaaaauuaaguuuuugaauuaauaaguugacucuaaaaauagucauaaauggugagucacacauuugagcaaguauaauguuggaaguguccuguaaugacagcauugaugauaguuucuuuccccuacaaauuuuagaucuuuaaaucuauuuacaaaaaaagaaagaaaacacagcuguguaagaauugaugugagguuuuuuuuuuuuuuuuuauacagauaaagaauaauguauacauacauguaugcuuggagcaucuuucuauugaccagcuuguuauuuuauagacuuacauaaccaacuccaugugccagaccgcugaaaguucuacuuuagggucgauuuuaucaauucagaguaagaaugcuauucuccaucaccuauggaagcuucuggagagaauacagggacaaggucuggcugaguauuugaggcugcuuuccagcucaguccugauucacuuucccaagaguugccauugugggcgagugugaccacauauagcuaagagaaauuuuaagcggaaugugagauggcaggguacucugugacauuaaacaguuuuauaaagagcuuuuaggcucaaaguaaaagcugacguauaaaccuacauuguauauuuucucuugguagagcaaaucuaugugugugcauaaacaaauacucgugacauuagaaugguaaaagcuguggaagcacaaauuuguucaaauauuucugaggcugauuuuuauacugauacuccacucauaucaaaauggaggacaguuauuacacaguuucuauuguuuguacuuugauacguguggacugugaguguguguguguguacaugugcaugcauguagguacccaugccuguucugugcauguggaggccagaggguagcauccaguguuccuuuguugcuucucuuuggagauggggucuuuugcugaacuuggagcucaccaguuggcuaugaaggcuagccagcaaacaccaggccagcugugccuccaccucucagccuuuggauuauagaugugcacugccguauccagugauuacgaggacacugaggaccuaaguccauguauauuugguucuuuuuagcuccuguaaauuguguuugaaagaacauaaaccguuucuuuuuaugacuucuuggguaucaauuaaggaaagaauuauugauggauguggugauuuguuuuuguaauuugagcguucugggacugaggcacaaggauuaccaguauuuugaaguuacucuggacuccagagugaguucugggacagauuggaccagugugagacauugccucaaaaggaaacgcauuuuuauuaguuagggugauuuuggcuaaacgaugcuguuaaacuuucuucugcuucauccuaccaccucucuuaauaguagaaaauacuaauuuuguguggaaucugcagaucuuagaaucauuuuauagacaauagaaaaacaacuuucagaauucacacuuuuuuggagucacauucuucccagaaaaugaguagauuuuuaggguggggguggugugauagcucaaucauuucuuucucuccagcucuaucugaaaaguuggaacuuguggaucuauaaaaauucugaggcacucguguuggaaguacacauuaguacuguuuuuuucuuguuaucuguaaucuacuacauaucuucuuuuagcccaaucucagucuuuuguaaagcuuacauaauaggcuucuuacauaguucugugauggaagagaggaaucucugcaggccuuauuuuaagauggcaggcucugcuggaccaaaaccugagggcauaauuaacagugucuuuggagggaccaugugugcugacuucauggaccauuuggccuacaagaugggauuuaguucauaauucauugucaugugcuguauuccugugggaguauagggucuagcugcuuuacauugaauaaguucugaauguuuuaucuugguccaggauggguuauuauacucgagaaugcacuuaauuacaagcuuuaugugucuagcauccauuccgcguuaccuccucuucacugcagcugacaucaucuaugggauuucauuugcagguugaguacaguaggguuucaggaagucugaagcugucagauuugaaaucugcuuucugucguguguguguguguguguucauucaccuccucauuuuggaacuuuuugcuuagaauuuauguauuuaguauuaauguuaucaacuaaacaaacauauuuguuaaaauucucaggaaggaggcaucauuuaugaguggugggugaucugagaauguugaugcauaugccugugugcucaaguguggaggcuacggguccguguugauggugucaucuggggcuuuaguuguugagacaaggucucuuacuaacccuggagcucaccccuuagcuagccugccuggccagccaccuguggguagcuugcagcuaccucagcagcacaaggcugcagaugugugccucuacagucugccuuuuaacaucuuuuuaauguuacaauuuuauuacuggauaaaaucuaacuggucaugauuuacuacuaaauuuuuuuauagaaucauguuccauuuauauuuauugauuuauugauugauugauugcacaguucuuuugguuugaggggcagauaucuuuacaucucucagacacacuuugucaacauugucccguguguuuuauuuuucaagaguuuaacuuauugaugauugagaagccuguaauuagauuucaggauuuuaucaggauuucuaaaugcauuugguuauugugcaacuucuuuggaagauacauauuuucccucaguuuaaauuuagugugugcacucucgugcaagugcauguucgugcacgugcguauacaugggagucgacuuuuuuccuucaaccaugugggucugaggccucaaacucagguugucaaccuugguggcaggcgccccuguccguugaacagucccaccaguccuguucuuuuucuaucagaugaauuuuauuacguaaacuucuuuaauguggaaggcuuagagaaagaggggaguagggcucuuuuuuuuuuuuuuucauuucuccugagaagucuuuaaagagauguuuauacaaaucaaauaugcuuauaacuuaaaagaaauaauuugguguggcaaguuuuagguaauaauaauaaaaaguauauacacacuccauaaccuuucuuugagucuuugguuuaaguccucugucauacagugccaaagcguuuuucugaaguguguguguguugaaacaugcacgccuguccuagugucguaacuaauuauaucucucccaugcuuacuucuaguaauuggauggcgaccucccacagcaugcguuuuaacuuuuagcuuuaucuggagggccugcuauagaaauuacguuuuuaccacauagcagcuuagcugugcacagugugcacuguuuaaaacauaccauauacucuaugcuuugcagaaauaguguacguucagggggaagguuuuuuuucccccuuuuuauugagaauagauucucuucuugcauaauauauccuaaucguuguuuccccucccucugcuccucuaaguuccuucccacauccuuuccggucuggauccauuucuuuucagucuccuuagagaaaaaaaagaacucuaagaggugugcauuaagauaaaucauucuauccgaguuggcuaugacaaaacaacagacggagaagguccaggagauggcugaagaaccaggcgcuuguccgugcccucgggaaucccugauguaaaucgcuaacauagaacccacagcaugcucgcagaggaccugcugcagaccccaggaagcccuaagcgcaugcugcucagucucuaggagcguggcucagcugauuuacaggaugcugucuccuugguguccuccaaccccuccggcucauacacucguuagcaucuucuucccccacaguucccugagcccagagaggaggacaucccauuuaggauugauggaggauuugauggagaccucgaguuuaggguugaggguuccagugucucucacucucuguguaaugucuguucccaucugcugcaggaggaagugucucugaugauggcugacgaaggcacugagccucugugguucuacagauuguagcauuguagccugguuaucauugacuuaacagcuauuacccacacauaagugaauauauaccauaagucuuucugagucugaggaaaaagcuuuagcagugaaaaaaaaauuguaguugggcugacacgcaucugccuuugcugauaauuauacacugugucagcugacuuugguguuucaucucugaauuggaaacugacagcucagugugagagugaaguuuuucagaauuuauuuucccuugaaguuuuucaaagaucaccuguaggagagacuggauggcgugcuggucacuuaaucuucguggucgacaaugauuugacacauauucuaugaaaaugcuccgaggagaguuuucacagacuaauuuagaaacucuugucuuggacaugcuugugacgagagcaguaaauguuuguuaugcgcacaagcauguaugaaaauaugugauccuuguccaugccugcugaaagagaacuuuaccaguucuaagucucugaacugcagucucguagaaauuaaagucuuaaggcugggagcaguuaaugcuagugaugguuuguggugguuagcauugugccgugcugccuggugacuguacucuggggacuuaagagauuccagucagcacuugggaaggaauacaccacagaauccgagacaauuaaagauuuuuaaagagaaagauucaaagacuuuuuacuguuaauaaauaggccauuggggcuuugcauacagaaagggauuuugcaguuaucuuacugauaauuacuuaaaaucuaacgcuguuuugucuuaagaucuuuauuugcuaucauucuuuugcuguaguuaaaaauaaaauagcuguauggguguguacaugugcacaaauaggugugugugugcauguguauguguacauauguagaggccagaagacaacaguuaggcuaggcuggcuggccaauaagguccagagauucucuugucucugucucuccaacacuagggauaccagcaugugauaugaaaccugccaguuuuaggucuucaaacuuucaagacaagugcuuuaccaucuaagcucuuccccaaaccccuaaguaaaguucuuaaauuauugucucagauauaacugucucuaaauuucaugccaccuuuaaaagguuagccuuguuuuggucuugaggccagcaguaguacagaggcauuggacuuacaugguauguccugcagugugaaauuuguauuccuaaauaauuuuuguuuugaaaguugaacucccaaggauuucuacuuaauaaucuauaguaguuuauacauuagaaaaagguagauggccaaauuaaaauaauggaaagggucuuuaugcuuuuccaauccauuucuguuagccacuuuuuucuguaguaucgaucaaauuaaugcauauauguuuaauacuaaguuaggugagaacauuagaauucacagcugguagaccacaugagaagaagcuaagucucaaacugugaguccccagcagcucuguggaaagcuagaugucagcguggcuaaucacaggagcagccuugucaguggacugaacucccaggggcugggaacgcugaggcuuguagggugcugaacuggggacgccuuguccuccgcagggaguuggcagucuuacuagacguuuuguuugucacagaugacugaguuagggagaccugcugcugguuagacuaaugacacagacuuguacagagcccagaagacuuugugccauggugaauucgguaagacccacucauaggcgucacuggacagcuaacugauuaaauaaaauaaaaacguaacugguuaauguagaugggagguucccucagaauucuaccuaacaaaguccuucccuuagaaagacauguuucuguuucuuuaagcuucuucaugaguggaacucugaauuccacuuccuaacauucuugaguaaaucugauuuguaaaggcauauggauacuuuauauacuuggcacacuaaaaauauuuagucauaagccaacaaaucaaacccagauauacugacuuauguaaaugccaaucauauuauaugucaaugcuugguaaauuagcauguuauuaagugcacugaaacucaugcuuuaauuuuaaaauauugugagaaauugcuaaccuauaaauauaugguuuuuuuaaguagugaaauaacuucuugauaaaaacuaccacccuaccaccaccacuguaguauuuucacauguucacuguuguuucuuggugccaucagcuccgccguugugacuggggagaacaaacccauuuauuuuguuugcuuguuucugccauuuguuuuuaaaucuucauucagaaauaacuaacugauacaguguuuaggaucuccccuuacaccagugauucucagccuuucuaaugcuguggcccuuuaguacauuuucucauguuguggugaccccaaccauaaaagaauuuuccuugcuacuucauaacuguaauuuugcuacuguuauaaauuguaauguaaauauuucugguuuuuuuuuucugguuucuuugggguuaugccacacagauugugaaucacuggcuuauacacacaguugucuuagguccugaacauacauacauacauuuauuuauuuauauauuuauuuauuuauuuuuuagauuauugagacaggguuucucuguguagcccuggcugucuuggaacucacucuguagaccaggcuggccucgaacuuagaaauccaccugccucugccucucgagugcugggauuaaagguguggguuguuuuuaauuuguuuuguuuuguuuguuuguuggguuuuuuguuuuuguuuuugcuuuuuuuuuguccugaacuuaauguagcacagaauuuuuuuuuauuugaacauauuuuuauuuuacaauuaaagaaauaacagacauuucuauaugaauaaauuuuccuucacugcuuacauuuggauguucuuauacauuacaaguuuuaaaaauaaugucaucuuguuugcauacauaaaaacaguuguuaaagauugauggauagaacauagacuuuagaauuuccaauuaaaacauauuugguugggcugaagagauggcucagugguuaagagcacuggcuucuuuucuagaggucuugaguucaauucccaguaaccacaugggggcucacaaccaucuauaaugugaucugauugccucuucuggugugcaugaagacagagcauucacucauauauauauauauauguguguauguauauauaauaagcaaguaaaucuuuauuaaaauauuuauuuaauagaguuuauuucugaaagggaauguaaauguguauauuagugaagagauuuauagugauuuuaacugauaucucuguacuguuaccuuuggcuuuacaauaaagggaaugauaucuuuggagcuaacaaagaucugaauuugaauauuaauuguacuacugagaaagguagagucuugagggcauuguuuuaucuguuuuuaaaguguauaauucacaaacuuuaauguuauauguccacauuauugugucuuaacaaaauuaacuuuaauuuuucacgcccauauggagguugaaaaugguauaggacuuccuaaauguccuucaccuagauuauauauccauuuaguuaucauaaguauauaauuauaugccaugaauuggaucuuuuucuuuuuucuuuuuuuuauuagauauuuucuucauuuacauuucaaaugcuauccuguaaguccccauacucuccacccucccuccucugcaaccuacccacucccgcuuccuugcccuggcguuccccuguacuggggcacaugaucugcacaggaccaagggccucucaauugaaucaucuugaaguauagcaucaccaguacuauuuaauucucauguguccccggcccccguuguaccccuaccucaacucuuacucaaacguuugaugucuuucgccuuuugaacaguauuuuauuuuucuauaaaacaggcacaaaauaugcuugaauuuuuugagauaauaugcaugaaaguaaauaugguguuugccugauacaagagauaaggguccguuaguuucuugucuuuaucauggguacagaaauaucagaguuauauuuauaggaguuauucugagggaugcgaugccaguuuguuuuagugagaaauuuugugcuaguuuagcaggcacacaauauauaagaauuaaaaaacaaaacaagaaaccaaaauaaccagcauagguuaauauguuaaaauaaucaaaauggaaguuaaacacuuucaaauuuucuaaaaguacauacauuaaggaguguuucacagaaauaaauguaggaaauacgucucuugcaaagaauacguaucuugcuuguaaguauguucauuaacauuuuacuguggaguauuuuaccuuuuuggauacauuuucuaauuucauuguuuaaggauuuucagacuuggucuuuucuggguuucaaacaaggcauggugaguacagcucuguguggaguguuuaucacaggugugccagcuuggaaagaaacagauacagcaguuauuuuucaucauauuaaauaaucucucucugucucucucugucucugucucucucugucucucugucucucucucugucucucucucucacucucucgcucucacucucucgcucucgcucucucgugcucucgcucucguguuacaaguuagccaagaacucuuuuauccuucugccugagucuuccgacuguaacauuuuuuuuuuucuguuuuuguuuaaaauagaaagaguauugugaaagcuuccaagucauugcuaauggcuugggggaaaugcugggugaugugggcagucaguaccuccaaagauauaaaaggacaguaaguuccuuccuuuuuaaugccagggacauugacauucucuaaaaguaaaauaauugggggcauagguaucuaccacaaugaacuugguaaggaguuagaugauggaaacauguagcuggaguuagcuacguuguggguucuuuuuucuuucacccuuccccauccuauuucuuccagccuuucagccuccuaacacuagauaggagagaaaaaaagaauagaggggagacagggcagccuuaucauuagacuucuugcugcugacuagagcaucaaguuccuugggccaaauuugauuuuugauaucuuaaggauaucuaauuucuucuuguaucuucuuugcacaugacuacuuacaaaccauggcuagcagcaaccaacaacccgcccugccucucaaggcccuagcauuuauauucucucugaaaaguccccaacauuucaaacaucacauaauugcagaaauuaucugccacuggcaaaaccacgccccugcuagagcacaaggcaaaucauagucagcuguuguggacaaucugaaguggucccauauuccacaccugggauuaaaaugaaaaauaaucuuauaauauuucacuguguguguuuuuuaagaaauugaaacuccaaauugucacuauagacaugaagagaucaaggaacacuacaggucaggguaaaugagaagcacuccagguagacacugugguauggaccaaaaggcacagaucugggguuucuccaacugagacugucaucaacuagcuuuuugaucuuuguaacuucuuuggcauugcuuucauccuccuuaucugaggguagacuaaauuaaagauggaaaacagauuucaauucuucaucaauauugauggauuagcaauggcuguuuaagacaagaauuuugagacuguaccuacagauauugggaaggaggucuggggaacacuccagcacuuugugaugacuuuuauaagucuggugguuggauugugauugcaugcauguguguagguauauauacagagacuguugacuaaguaguuuguaaaaccuuuucaauucaaauugcauacaacaggucauguuucucugaacuauagaguuggguggaucuuccaaucauucuuguacaucucaaugacagagaaauacaggcuagauccuaggagauaggcauauagugauagauauaagaagaaaugaaguggauauugccagaaauaaaggguauaugcauacuuaaaauaggcuuacaugggauucuuuuguaaccuguagauaagcacuaaucagacuugaucagucccuucagaaaaguggucauuuaaugauguagcuaauuaaagauuauagcuuaauauuaucuguagggaauuuauuuuuaaucuagaguacuguucaaaccaaguuguauuuuaguaucacauagcaauaaggccaguaaagggggggagauaaaguauggccuuuacuauauuaauucuuagcauaauucaaacuuaccauuggaagauggagcccccagaaacucaacaaguacaaguccugauaggugcaggaguauugagaaugaauaagauugucaucggguggguacauagucuauauauaaaccagagagagaauuaagguuugaguuuaggacaaagaauccccaaguuucuagugacuuacagaagaaaauuauccagguuuaguccacuguguuagaaacuguacauuugacuggucuuucuguauuaguccuuuguacaaggagggacuuaaguaagagcuaaguuauguuacucaccuccacagacuagcaaaauuacuaguuuuccuucauguguguucuguaagaaauuauauguggcagccacaucugugguacucauaggccaguacaauagccuuuuuguauuucuuuguaucugucucagucaucaagaguguccccugggguaggagucauguuuuauuuauauuugaaucacuaaaccuagcauaaacauggcauauaacaaguauuccauaaguguuuauuuaauaaccagaauacuaugcugccuaagaggagcccugagcuaugugcuagugaagacaauauccauucuguaguauaaaauggccaaaucuguaaguaaacuggcccuuuccuauagucuauuuuguggugauugggcuuugugcguaaauccuuuugcuuuuauguuuuugaggcuaaguucuacucacaauguaaucccaggugggcuggaacucaguguguaggacagucuggccugggauguggcgcuguccugccucugccaucaugucaugcuaguaaauugcacuacuuugcucguuuuccuauuaagggauaucuagaauaaaucuauuagcagagaacuguguacaaaauaaguuccaaacaaacauuuaugguuaaaaaauaugugguaggcuaaaaccuguguacaguauaaauuuuuuuaucauguaguucuuauuuaagugcauagaaaucuaguaguuuggaccauugcgcuugauagcuacagaagacaggauggaacuccauagcgcuuagcaucugcaugagcuggugucccucugcuguugagacuuuuacacuguucaucauaaaguacagaagccgaaaaggugauuagagaguaugcacuuacaguguggcuguggaggugaugaucacaggaggcaaggaucuuaggugccuuagaaucagcauaguugggcucugaugcccuggucaucugcauuugcagugguguaagaaaaccgucguggacacuguagcacaaguucauuaguaugauaugacaucuugguucuguguuaaaaaugcauuaaauacugcauuucugaagucuagucucaccugcagcugucacuucagaacccccauuucuagguuuugguuuggccuauucuguaggagaaacaggacuaccucaaaugccuacugauccucuaggauuauauuuuauuauguuuuaguuuuauacuauugauauacuuucauuugcgcuauuuauuuugcuccaguaauauggaaaagaacaaaguuucauaaauguuuguuaauucucuaaguucuuuacuuacauuuuagauauggauaguggaaggcaaauuaugguaugauaauuuuuuuugguagagccaaaauacucuaaacauguguugaaccaggugacauaagcugaagaguuguaguuguuaauauauguggcuuuuucaccgucagaauccuguggccagcccaggggcuuuucugaagaagcagagaauauaacauucccauauauuucuuuguccuuuuuauuuuuagaauuauuauuuuuugacuuugagacuggcucuucuacuuaaaggugaaaaaauucagucagauguacuuuuugggauuuguaaaucucaauuuuaaugauuauuugaguugagcaguugaugaacacaaucccuguuccucucugucucuccccacccguuucugagcgccuugcuguguguuguccagauuggccuugugcccccgccccccccuccccgugcuggaguuacauauaugagccugcagacaugacuguaaguauuuaauuuucauuccucaugauuuugugagaguucauuuagaaccuaggagaaaaugacugagcagaauugaacuucauaagaaaugaaacguuaaauuacauucucaaauugcuuuuccuagauuuuuuuuuuccuggaagaaauaucuagccaaaguuucugaagaaucaagguuaaauuugagauuauuuuuuauucaugaacauauuauuucuugggcuucuauugaaccucugcuuguacacuuuuguguuaccaaugaucuaugcauccuaaacacauucauuccaacuuuaaaaucugaccuggauuucuuuguucaaaucaggacaaauuguuuuugaaagcagggucaugaggaucccuugagugaccacacacuuggccuacaaaggaaacgaaauuagggagaggagggaucugugccccccaaauccuaaucugggacccauuaucagggccaucuugcugugaggugcagucacagugugagaggcaauuucuaaagcugcuaagaccaaucccuguggaguucagagauucaacucuccaccccguguuauaagcacaugaaagcgauuaugccuugcugccugccgagggcagagauagauugccagugcagccagggcucuuaacuagguggggugggugcugcugcaguuuccugaaguccuccuggguugaaagcuuuauccuguuagaguaagucucaaacuuuagacaccaauucuucuaaaacuccuaacaaccuaaauguguguuucuuggcaagaguuguaagucucauaguuaaaaugugguacuguagcuguguuuugcacgugcuuguuucugcuaaggagauguuaagauauguauauguauauguauauguauauguauauguauauguauauguauacacacauauacauauacauacauauacauacauauauauauauacauacauacacacacacauacacacacacacacacacacacacacacacacacacacacauauacauacauaugggaugggggaggcaccacaacuuggcuuacaaaggaaaguauauaugauaaguacagauagaguucagcuuuuguucuuccucuguaaauuauggauaauaaugcuacccaauugguagguuuaguaggugaggugaaauuauuuauugcauguaaagcauuuauaagcaugcuuagaagaaaaaucaagcuggaauagaaucugaguuggagugagguaucuagaauuuagauuaauaacauagagaaagcaagcgacguuugcucuuuaugaaguugcucugacacagcacccauaugaauugugucucccauuuguguagggcgguguugaucauugaauacucucaguucuuuuaauaucaugaaauuucugacaguagugauaugaaaccaguauaaauaagacacacugacuagacuuuuguuuuuuaaagugucugugaguucugugauugacuuguugucaaggaauauugaaguccaugugagaacaguaaaccaacacaaaugugacagccagaaauauacuacaugcugcugaaaaucuucugaaaaccugacaguggauguguagagaauccauuccauauugcauucugucuucuaagaaguguuugugugugucuguagguauguauguagcauaugugugaaugcaugccauuguguaucauauacgugugucuguggaagccaaaggucaauguccagcguuuucuuuugcuguuuuucuguugaccuuauuuuuugagguagaaucucacugcgcccagagcucacugauuggcuaaacuggcagaaaucucugggaauuagccuaccuccauaccccagcgcuggcguuccaggugcacacuccaucacacccacccuuuuacauggguauuugggaucuaaauccauaccuuaugcuugcagaggaacacuguaucagcugagccaucaccccaucuccauuuucauccauucauccucaagccaugucuugaguacuuguuuuauaugauagauucuucacuaauaagcaggguuagugagggggcaagcaccuaaagcuuuuuuaugcuuauggaguuuacauagggaugcaaagaucuguaucauuagauggucagacagaguugcagaauggcaguuaugguacuugggaaagcacacauuggcuuccagguauaagucuucugaauucucugagcaagacaucauuguuuuucuaagaaggaguggacgggagaaggcaguggaauugccugaggucaggcaggugggacgucauagagucuggcuuaguuugaccggaaggcuugcacauuuuucucuuuguuuucugcggcaggcacacauuacaagccaaccuggggaaaggaguaaagagacccuaguuuucagaaguauugaucuguuuuuggaaugugugaaauaaaagagguuuuggaaaguagaaguuuguaacauuaauucuuuaccaguguaguguaguuugagugaaaauuucaugcuaauaauaucagaauuauuauuguuguugcuauuauuuuugcuuaggaauuccucaaaacccccagauaggaagcaggggccaccaaauguaguuuugugguuagggcagacaaauuugaagggccuuuagcugaggucagauggauaaagagaaaugaagucaccucacacggagggcauggugcucuugaggugaggaugcaggcugucacaggugaugcagagagaaugaguuaugauuggugaguaagcuggggcugucccucgaugggaggugccuggagguuuucagcagaauuuugacucagaccauucuuucuguuuuaaagaacauggccauugugucagucccucugaagugguccuccuggauccagggauaucacuugucccaugugcaagaacaaugauuccuuauggaaggaagccaagcacccagcaauuucuaacaugccacggaucagggaggggccuacagggacaaugacauugaaaacccagaguagaaacauguuccuuguucauaauuaagauuaaaggaacacauagugaguagguaaagucagccauuacugcucugaggacacuaacugacuccaguauuguaacuucucacucuggcuuccucuuggcauaucagcaccugcagucacaugucccaggagccagggcaacaaagaguugaguuaaacucaaagugggcgacugccuuccuucuuaauagucuaagugagugcuuuaggagcagaagguugagacugucagggagguguuuggaguugguuguugcucuugccauucauuuguaggcagagggcaucugaguuagaauucaccaugugagaaacuggacaguugccauucgaagauagggagagaaguugccaguagcagagagaggguggagcacuguuugccuucucuccuccagacacauaguagggucauguugggcaaaugaccaaccauuccuuaagccugauuccuuguuuguguggagaagauauuugaacaaggucucaaguuuuguucagcguuuucuuccauuuaaauucuauaugggaaguauuuaaaauugaggaauuauugaaaauauuuuucuuagaaauuaguauugcuaugcuuugucuuaaggguuccaaagauucuagcucacuuguuuuauagucaaggccaugaguaggguggagggcuucauggcuuuuuauguaaauuuauguuguaguccuaguaaacuagucagcauuuaaagcuauuuuuuaacuuacuaugcugcuggaguuggaagggcucauucauguuaagcaaagacacuguuuguuuuuuucgagacaggguuucucuguguagcccuggcuguccugguacucacuuuguagaccaggcuggccuccaacucagaaaucggccugccucugccuccugaaugcuaggauuaaaggcauacgcugccacacuguuauugcugaagucugggacuucccagcccaaagcuguguucuuaaugagggauucuuucugucccugaaacugggcagaagaugcuggguucucuguguucuguuucacaaauugcugcuugucucuagaauucuuuacugccuucaugguuucuuuucccuugguagcaugacacaugguggugaccucaaagaaccaggccagcaggguuuauauagugaguuccaggccaggagaacauuauaagaucuuggggaggggagggguggggagggaaggaaaaaggaaggagagguucaguuagguuuuaagguccacauuauucaaguguccuggucuuccuuaacucgcucauaguugaugaucugcagugcccuagagaaaaggaaggaauugcugucacauuuuauuuacuuagaucuuuaaaaaaagaaagauucauuuuacuuuuaauuauguguguauauauaugagagagagacagagagacagagugagcauguacaucugaagagggcauugaaucuuuggcagcuugaguuacaggcaguugugacccaccugccccacagacacacacauacacacaucagguggcuuacaacuuuaacuccagcugcagaugugucugccauccucuagcaccgcagaggaggucuauuguguacauaaaccccuccagacacauaucuacauauaauucaaaaucaaguaacuaaaccaagagauccagugcccuacugaccaucucugucugucacucuuuccucaucuuuguggcauccaacaugacagaaacaggcuuguuuguggcuuaguauuccaccaugguggaaaagguguggaucgcugaccacuauggcucaugcaugauggggcauguucacaucucagaagaccagaaaacagagcgugauuggaaacugcuuuguccucaguggcccuaccucccagugcccccuucuaccaguuagaccccaccucccuaaacagcaagaccagcuagggaucaaguguuuagaacacacaagcccacauugggggcgcggggcaucgagggggaaggcauuuuacauuuaaaucauaaugccauucuuuuaaagaggaaaaguguugcaaguuccauuuaaaaaaccugagaagaauaagaaauacuaaaaaaaugaguacgaauguuuccaaguguuuuggauacacaagcuuaucccucacugguucaaugcuaaggaucagggaaaaugagaauggcugagaaagaagcccguccgucuuccagacacuuggcacuucauuuuacaaaugugcacauuuauaauuuuggcuuauaaagguuuuuaaauauuugacuuuuuuauuugaaaaucuugacaggccuuuaugaaguuuuaaaaucugguguagaaagguggcuagauuggacuguaaucaucauaaagugugcccugcaaauugugcacacccagaugauuucugguuuuuagagguugccaauggguguuuaugaauuggacuucggcgaagauuauuuuagguugucuaacuggucaagaaguucaguuucucucacaaggaaaugccagcgcucucccuuggaggaggaaacagagaaagcaagcguuucccacuguugugacccucucccuggcuucuuccugccugcuuccaguggagccaguuucuggaaggcugaagcagugcccugcauuucugccgcucucucaggcaggcuuccacguuaaguuucucugccuccaaacacccucugugucgucuucugccaggucacggcugugaauugggagucaguugaugauuuaccccauuuucugcucucaggcaauaauuauuuugguuccuccccauaucccuuuuuggugauggacuuucagaauccagaucacuuaugggucucucaggagggggaaguuugauguuuagaagcugaagggagauuauaagcuggcagucgucaccuugggugagagagucaggugaaugcugccugccauuggucgggcugguagaauuuauuggcccuagugaauguuaaucuuuggcaauuugaagaacuuaaacaucacguaaacaguuguauaucguaacuguauaucuuauagagauaauuauauuccagagcaguuauguucugugucuaaacaauguuagaaaaccauuacaguuuuucaugaaauaaaauugugcagggccugaaagaaaagcuagacuguccuggcugaacagcuuuugaaggagucuaaauuuccacacagacuucuguagucuugucacagacucgagccuucguguggagacgguaguggaugcuuuacacauauguaggcaggaguaggcagcauguguuccacacugagggucuggcucuuucugauuuucuuuagugcuguguuuuucguuccucuggggaaauaaguuaaccuauuuauguuuauucaguauuuuugagcuugguuacuuaaagaaaaaacauuuccuguuacuguuuauaugaauauuuuuuggauuuuguacauuaaaauuaaaguaccuacugugugcuagauauuaacagaacuucugcuuuacuucugaacuuuuaacacugagcacagaucuaauuuuuuuuguuuuuuugcaguuauacaggagggcaggaaguaaggugaaaauggauuuuuggcccuuguaguuuucuagccacuucuguguauuuuauuuuaaaaaauauuuuuuaaaaaguguuuugaauuaaggaaucaacccgcauguccaacuugugaaaaacuauggaaccacacaccaucaucaaaaagggaacauuugcuaucaggaauguggucccucagucaccuaauaaaagggcgggcgcuuagcuacacaugggggcaaagaaacagaacucuucacuugauagagugagagcaguggccagagacagcucccuaccccaagacagaaugcuucagaaacauguugccauuaauauuuaagacagaaagcagcauucugagccgcuccucucuuccccucuccccccuccucucagccuucauguuuuaguuugcucccaaaugcucacaaguccaugccagacggaaauucgcagaggccacucaggaggugcucagaggaacagucacacucaguccuucaggccugguggguccugaguccucugcagcuggggacucccugccucugcggccucugcuggagcugcagccccuccccccagacucuggagucgcuuggaggccaucuaguccuacgcuguccgucagauguguuuacuuuuucccugacagccgacacaucuggagcacauauucagguuacuccagugccacuagacacauuccacaagaucauuucagcgguuguuauggcgaucuuccucccuccagugauuuucaaguugcaugacagaaauagcuggagcuaaccagggggacaaaagucaacgggaucaggaagggcuucuuucacagaaugaacuaauuagugacccugcuugcuucacagggcagugagcauaugguuuaauaaagugagccugugacacuuuuuucucucucucucucugucucucucucucucucucucucucucuguaggcaaagcugucacugacugaagacuguucuguuuuuacuggugggauguagucuucuaucuuucaacagaguuuucuucgcaaguagaaaaaccauuugcuccugagaguuaaacuucagaacuuucccuuggcuuaauacuaccuaacugcagcagguccuuccacuuaaagagacagugcucuuuuucugugccugcaacugaaaggcucugccucacuuaagucuuuucaguuaagguuuucuaucugauaggaauugguuccuggaggguuagauaaauaagauucguuguuuauuguggguuuccuauaaaaugugaucaauauuucucacuggauuagcuacagauuuauuuguuucagugauuuuuguugaguauaguuauagaagguauuauuaaaagguuugguuaagcaacuccaguucuuaucacauuuuaaguaacaugcagacuucugguuauaauucaguuuuuuucccccucugaggcuuaacuuuuuacauuuuuuucccuagguuucugacaacuuuauagcauaaacacaucauuguagacauuggaauuuagacuugagaucauuuguauuaugaaguagaaauacuacuuguaguuaauaguggauguauaguacuacaaaccaguggcauuugugauuguacaugaaaaguauaaacaugccuuaauaaaauaucuucagcuaaacagcuugagaauauggauucagggacucggggagauggcucagugaguauggugcuuggugugcaugcaugaggggcuggguuugaauucuguagugggaggaggcaaacagacagauggaucaugaggacuugcugaccaacugcccaauugaaccagccagcuccaguuggagagaccuuguuuccaaaaaagaagaugaagcuggagagugacggagaaaaacacuucacguugauuucuggacucuacaugugcauauacagucagacugaguuuacagugcuguugauuauaaccuuccuauuuaucaaaugauuuucuucuuucuugcuaguauuccuguacucuuaauuggaucuuuggaaguagagccaguugcauguacuuuguacuuuucaacuacuacagagauccccucuguacacuugagcccacaguggcuucuugccuuucuugcucuuccaccaacaucccuggcuuucucauacauaccacauuuuuccgucuaguccccaggcauuagagucaugugagcagcaggucuuccauuucccuuauggcugaaacgccuguguguugacugagcucucugcaucuugaauauaugacagugggaagcaaguaagagaauuagagcuggacucucuuggccauguugacuuaauucuucacucuuaauucaucuguuuaauguucuccccucuuucccacccccaucaaauuccuauugcauggguccugcugaggcuggucacuaggcuguucucaggaagggucgaaggacacuaaaggucacauaauuagaugagaauuuaauucacagagaccugcuuuucaccuuuuguguuucugcuaguuacacauuauuaacuguggugccuuucagggccucaauuguuugggugaguauguaucaagcaggacuaaaagucagcuaggaauccugagagugacuguaaaacgaugugaaccucuccagauguaacucugaagaaguuaacccugaugcaguucaaguguuguacguagucaguguugugguggcucucucuaaguuuaaccgguauugguuacugccaucacagcacuucaugccgcuuauucgugaacuagaagaagacagagagcgcacuuguuuuaacccgugguuuguuuggaugcaggugaggaagccagcuugucucuguagcacagugacaucuguauuauauauaaugaugucgguugagauuucauacuuuaguggcccaguguauacaucugacuguccugccaucugucuuuaccgugugcuuucaguaguuuguuguccuguuuuuaaggcuucaucuaguacaaagcuacuuuguucccaagggguuauucaguuucccguggugaaauacccaugccuaccaaaaauggcacuuguuauucuuauuucagucauuucugccaaacuuugaaagugaaggggucccacagcaaucucuauauuuuauaaagaaccuccagcugcaauuuucuuugcauuuuuccuuuaaugcucuaguauauggcaaccagcuuaauucagucaggcaaccacugugccagagcagucagccucugugugauagcuaaacaaauaguggauucaguguggcagugauaaucucaacuuacaggacugucucaguugugaaauguuuguguuacggaugacauuuuuguuguuucuguuacagucugacagcugaagaugcuuuuaaaaccuucuagucacuuagagcagagcuaugccgcccaggcucagugauucuaaaaggcagggccuauccauccaucacagcagcagugaggcucuggguuagggggguagauugaggggugagggagugagacagagaagagggggaacugcucuguccaguuuacauuugucaccagugacuagcuuuuaaaaaauguauuagcuguguauggugguaaguaagauccagcugcaggggauuacugcuuugagugggucggggagcuuggaaugcauucaguuccaucaggggauuugugucccucgucaucugccugaacauugcuaaagcaguaaagauuaagaacagaccagugucaccugccuugaacuuugaaaaacccuggagcuauuaaauaaguaggguggugguuuagcaagugucccuuuucugugucccaaaguguuuuucaaaugacauacaugaaguaaaaggaaacacaucugugugcucaggugaaaggcuguauugugguugacugauuuccacaacuugcugaaccuggugcaguugugauuuacgaugaaaacccagcuuucacaaauaacuuucugcuaaugaacauuuuugugagauggguuccaaaccaagaugaacagucaguaguuaggagggaauguuucugagagauucagccucacuccauaggagaaaaagccuuugcuugguuugguuuuggugacucuccccucccccuggaagaaaguuaagagaacaccacaaagguuugcuuuucucagggauuuugaaauucagcauucaugccagcaagcaguuuagaggcaggaagucuuuccuaguagugcagucaugaacugguaaacuagaagcaucuguaaaaauuuagagggaauaucagcuuucucaaagcuccagcccaguguaaugaggugcaaaugacagcacuguguaaccuuccccaccccaauuguggaaugggaugcagagaccagaaaugcagaggacagggauugcagagagcagaaaugcagagcacagggauugcagagagcagaaaugcagagcacagggauugcagagcgcucccucacugcaacacauuucauuuuucagaugcauaggcuuucagaugaccaaggauaaccucagcuccuaggguccaccagguguaaacaagugauuuucugcucagcaucucuaggugccacuuuggaaaagugguuguuugagggucugggcgugugaaaugauacaccuacuuaucugacugaguuaacaagaguuuuuaguuugaaguaaacuucagcugauuuguaucucuggcaggcauuucuuucuucaagggggaaaaaaaaaagagggauaagggaaaaaaagugauuuguuugaagaggcacaucuggggugugaucugcuauaucguaacaccagauggcaaguuuaggcugacagcugaagccauguuagcauggucagacuggaucguaaugugucgcagcccccuuccccauccugccugugcacaggaaguacaacaguuauucgcacccugggcuagcagucaucuugcguuuuuggcuuuggaugcuccuucugcuguuuauagacaaggcuggcuuuccuuggcaacuccugaaacaaguuuccucugcucaugccauuucagaacuauguuuuguugagccacaaagguguggugccuuaagguggcucaugcuugucacgacaggcauggcuuuagcccggcugaguggugacuagaagugacagcguggguuugaggugccucggggccucucuguuagcgcucuugccugaacauugagaauaugagggugcccuggaacaccuuugcucauguagaguuaacaguuaggaagagcauggcucugagggggcugaggacaggcauguggguuuguaccucuuuauuuucucgcaggagauguuacuagggaggauuacauauguggccuuugggacgauagaaugcaagcugagcaagggaagccaggagccacagaaggaggaauggcugaaaaucacagauggagauuguagguuuuuguguuaaauacuugcuacaugugucaagcugacaaaauguuuacagauaguuuuaaagacccacaaaacaaaacaaaacaaaacaugggaaaccuucacuugacacuucaaaugagccauaccugguacagucucccuuauagucacuugauuuauagcucuucaguagcaacagucagagccuguauuugguauugaucgacaagaauucucaguagcuuuuuauuaccccccccaaaucauuggguuuuauuauaaguuccaggaauucuuaggcuuuuuacuacugauuaauggacaucuguauaaucuauacaaaaagcuguaaaauacauucauuaaucuauucuacaaacuaagauuaauuugagucaucuguggguaucuuauaaggucacgguucuaauuuaauuugguaggaauuguuagagauuugaaugagauuuuaaaaucacuucccaggagaaggaaaaauaccuuuggaagaagccagugaguguucuucugggcaaagcuugaauacuucuugaauguucucuuccuuccuagaugaaaguucuguacaccuggugugauaguagcuauugaaaccaugagaguuuuuccugaguuuaaguuguucucuugucacaagugaaguuuuucacguauaauuuuuguuuucuuuuguuuauuuuugagucagggucuugguauguugcccaggccaguccuaaauaccaaacucaagagguuguccugucuuaaguccagccauugugcuuggugagauaugugguuguuacaagccacuauagaacuguuuaauauacaguguuugacauacagacuucuugcucuuauagaaaaggaguuuguuagggcaaucacugagcagaauuuaaugaguaacgagagcuugcuucuuuguaaacuagugugccuuguaaacaaaagaaaacacugaguugauuugaaugaaacucagcucagcuuuccauuguggggaaaauucagcuggguagagaacuaauggguuucaaugauuggguuggagggagacuacugauuuauaaaauaaaaccauuuuuuaauuccuuaaacuaugugacuaguuguaguaguuugaaagggacaugucaaaaguuuggauucaucguauacuuuggaaugcccauaauuuuucaugguuugaaauaaauaacacgcugaguauaguaugauuuuuagcauuuacaagguccuggcuugcauuccuggcaucagaaauaaacagaaaaacuauguaugguuacauuugcagaauaguaaugauguuagaaugcuugaguuuauaauauuauauacagacauaagccuauuuuauaucugaauuagaauaauuucaguuagaauguuucuguuuacaaaacaccauuuaaguccuuuucuuaaccuaucugccacucagugguuuuuuucuuuaacuuuugauguagauuuucuuuauugcaucugacauauauggauaagugacaaccuugguguuuuauacauguuccuugauuugagaaucagccuucaaugaacuucaauaaacuucagcaguuucaagguuacuauccugccaccacguuuuaaauaguuuuuucuuagaggcuauguaguggaaguccacccacuugucucagaauugcuguacuggucuuacuuuaaaaguauugggaguuuaaaagaaagaacauuugcauuuagacuugcuugagauugaauaacugcccuaugaccauggacagguucccuggcgccuucauuuuagaguaaaaguugggcuuauucuguggguuguuaugauaauaggccaauauuaaguguagaaacuguuuuauauagagccuaucacacuauaggggaggaagguguaauacuugauaguuacuauuguuuucauuuuaauagaaaucuugaaaugugaaaaauagauugugacuauuugaggaguuguuggauacugaguaccacauagguuuucuaaugucauauuuggaacuuauauucguaaugccucugaaguauaaauucccagacuuuuucccuuuguuuuaguuuuacuucaggcuccaggaaguccuuacgauuuaagcugaauguauggccuugguuguacugcuccuccuguuucuguguuucauccuguagagguggacagcaucaucucccuuuacugcaucuguaucuucauacaugcucauggacucuccuaauagcaucugcauauguuuugccuaauuuuuggaaugaacuauucacagaucacgauugggagccuuugauuggaggguugucucuuaguuacuuuggccaagcaguuguuaguauauaguaauuuggaaaacuuacuaaaauuuuacauguagggcagauauguauauauaauuuuuuguucauuuuaccucuggguaaauuuuuaagaacagaugugaucaacaaauuaaauauauauugaauaauuuucaaauacgagauugcaaaaaucauucuuauaaacauuaaaauaguauauaggccauuucauugauuggguuuuauauauguuugcauuuagacugccaaagcguauuuuauguaauauagugguaacaccuaacacuguaucaggguuuacauuuuuaaacuauaauuucaguuguaaaaguagaaguguagguuaaaagacaggcuguuuauuccaaaccaguugcaagcugagaauacuguacauaccuuucuuugagauuccuggauucuuuuuggucuugaugcaguuuuuugaaauucgcucaccuugugcuuuuagcuuucuccaccacacuccacuuguuuccacaccauacucuuggggaaguggcuuaugcaucggcugcuagaacaugcacuguaucauucaaaacucaagaaacuugaccaucaagaugguuccugcuaccaagcuugguaaccuuagugggauuccuagguaguucuugguaggaggcaggaacugacuccagcaagucguucucugaccucccccuggcguucuuucuagacuuucuacucuucuccccuccuuccugggcuuuaacucuuuuuaaagaguggcaaauuugccauuucuguuggugauugcacauuguauuaauguugggccuucuccagccugcuauccaauccuccauuuucugugacauuuauuuuagguuggcaucagacuaacagcacaaacagugaauaugaaucaugcuuauaucgaaacagugaggcaaagaaauugucauugggauccuaaaaaugacucucauucacucuugcuuucuuuuuaaaguguauuuugcuucugguucuugacuuaaaaaaaaaagauaaaucauauuuugugaugauagaaauugaagacaguguuggcauccaguagaaagucagauuccuauugaaucaauugcccugcccacauaggaacaaaaaugauaaauccagguccucauuccauucuuugaccaguucuuucuggauaaauccagagccccaucccauucuuugaccaguucuuucuggauaaauccagggccccaucccauucuuugaccaguucuuucugguuuauuggaaucagcagcaugaccugcucucugggaagagugucaugaauuuugggacacacuuaguguguggaguguuucugucagcgugacucuaucucuacagcagcucucugcgucugugauuuacucuuuugagcuuauggguaaagagaugagaaaucagaguuuaaauaggcagugcuagguguucucaccugugauuuuaaaauauuuuucacacaauaagaaagaguuuguggcauuagugagguagacuuuuuccugccguauuuaaaauuguugucauuuucucuacauuauugccacuagauccaugguucucaacuugugggucgugaugccuuuggggguugagugacccuuucacaggaguagccuuacaccaucacagaaacacaauuauuuacauuauaauucauaacagugacaaaacuauaguuaugaaagagcaacaaaaauaauuuuaugguuaggcaucaccacaugaggaacuguauuaaaggguugcagcguuaggaagguuuaggacuauugcuguaggaaggucaguucauaggauagccaguugccuuaagagauggcuagauguggugugugugugugugugugugugugugugugugugagagagagagagagagagagagagagagagagagaagaaaggcaagcaugagugaccccgguagcggagguuuuuauuccuuuaguccuuggaacacuaacaaacacccaccaguuugcaugcuguuuauacaaaugcuugcuuuaccucaguagaaggcagugguuagaauuuucaaguugggaucagaguguccugccuaugugcauuuuguaucuaaggugaaauacugaccuagaacgcaguaaaauuucucucagggggaaggugccucccuacccucucauuuccuuguuaguggcaagugacacaagaaggcuuccaaacuuuggggaguccuggaugguuagcagaugagaucauuuccagugaaacuuaccagcugccccugaauucccucuucagagcacuaugcuuuuauuacgagauuuaauuauaggauaaggaaagugcugugagcaucuuuagaccacacaugugaagcuacacacuugagucuaggaguuuagaguugagccacuuaaggaaaaagaggccgcacacucacacucguguugcugugacugacgguugcgaagcuugcucugcaucuggccuugaguuucauauguuuuauguguuagguucucucaauuucuuagcauuuuuauuuuauucuuauaaucacuuaauaaugguauuggcaccgaauucuacauguguguuuuuccccagcuuuucuacacgcucauuguggcuguauacuuuauguguagaaaacaucagaaagacaugacaguugcuuuagaacagauaacucagaggaagguugucgccauuuacucagggcuagcaccaguguucccauucuucccugcagacuggacaucugaguucucgugacucagguucauguucuuaagcucacagugguaauauggcaaacgcucaagaucuccgacauaaaucaggacugaaguguucaucagaaccaguauuggguacaaggaggucuuacuggaagugucuugcguauuguucaaacacaagggacaacuggcuuuugcuuuccuuggccagaacauugucucaagcgagugauuaggcugcacuccagcguuaacccagggcaaaacuuaugcagcccuaccagcagugggguaauuaagagaagggaaagugaaaauauuugcuuaaaguuuaacugcauuuuaauuaaucaugaaaaauaacaaauacagcuaagaaggaaggagacaauaggggcauuuuuaccuuuuccuuuaacguauucuagauaugcccauuaauucuuccagaauauuauuaauccauauuagaaauaagaacccaagauuccacaucugccuuuggguugauaugugagcuguaggauaauucugucuuacuuacaagaaaaugucacucuaucaaaucugugaaccaguaacaguugaguugauagagaggagucuuucaaaguaagauccagauacaaagcugauaguacaaaucuuuagaguuaaaagggaugguaacaacugcaccuacacauuauggcuaaccagagcauuauguuauaagaaaagugaacgauucagucacugcucauugcugagaguucaaaugcuuauccuuggcauggcuguagaacuuagauugcuguggcuuucgaaucuaccuaggcuggccucccgcagagagagguacccuuaccagccuucauuguguaaacucuuuacugcuguucaucuugccuuuugucacuccacagcuucuauacaaacaucagguuuguuaaugcugccauuuuccucaagcauuguauagagugugaguuuugcccgcugugguccuuggaugacuuuccuacugcaucuguuugcccuccuaucugcuacacuagcuguaugacuucugcuuuagguaucccuucagcacaauacaacgcuucucuccucugcauccucaucucugcucuuggaagaguucauccuaagcuucuaaagucuuuuugucuuugauuuuuguuguuccagagagccauaacccaggcccauguguauguuagccaggacccuacuucuuagcuacgcuucugcauaaaaguccauuuuaaaugucuucucuuuucaugaauaaccuguaguacuaauggauugguauucuccacacaauuuuuauauuuuguuugguucuuuaugucuagggaucuagucgguuugucauggauuuaugugcucuuauuaaccuacauagauuaguuagcauacggccuaugaauaccuuguaaagacacaauaucucaugucuucguuuauuaagucgaaauauaaauauuucugauuauuucaaggaacacauuuagucauuuauacaguaguuccuuaauaaauaauacuacaaagguuguagccagaugaccaagcuuugauauuugguaucuaccauauuacaauuauguguucuuguuuugguuucuuauccauacaauaacaauauauaguaauauuucccuuauaggauuauuaugaagaggaaauaaaucaauacauuuaaagcauuuauacuagcagccagcagacuaaggcuguacuauguaauucuggagccaguagccacaugugacucuucagcauaaaauguggcugggccaaggugacaugcuuuugagguaucagugcauuaaagcauagagagaugauauaaaaauaauaaaaauucucauuuuuguugauuuuuccaugggaauaaaauuuuagauauaguaaauuaaauagaauauauuaaaauauugccuuuuaaauuuuuuuauguguaugugagauguguguauauguauauguguguccauucaauucuuauauauaaauauaggugccagaugccagggcacacauggaagucagagggcaacuuuguuuuccaucuuuauccugcaucuuguuugcucucucucguuuucaacuguggaugcuaggcuuacugacccaugggcuucuagaauguuccuuucuuugcuucccaucuccccauaggaguacaggaauuacggacauugaugcugugugcccaguuuuuauauggguucucagauccucacgauacguagcaagugccuucauccacuuagcuaucucacuagcccuacauaauuuuuuaaaagauaagcuacuaggaaauuuuuguuuuuguugucuucauugagacagguuuucucuauguggcgcuggcuguccuggaauuugcucuguagaucaggcuggaacaggguggaccaggcuagccuugaacucagaaccugucucugccuccugagugcugggauuaaagacgugggccaccauuaucuagcagguacuaauagaaaaucuuuaacuacaucuguggcucacauugcgugcccguuguauaacaguagagcaugcacuuuguugacuuguauuggcauguuguuaucacuguguuuacauuagaacuggugcuaagaagcuuugcccccccuccuuuagcuuuuuauucucuccuaucgcggcugacuuuggugauucugaguggaguguuagggaagaauguuaggcauggugagaugauucaaaugcggaguguaaggggguggacagucugaccucaagugagggaggacuggucuagucucacuucagagccacaugcucaaaauccaugacuuuaccuccccgacuugggaggcugaaacaugugccuccccugcuaucaguacuuuuuuccuuaguauagggagugaaugagcugaauuugguuaucaaagucagacauccauuuauaauagugaaaacgaaagcuuguccaaaauagauuacagcggaucucuuugauagagaagauccuaagauaauagcuuaauaacacacacacacacacacacacagagagagagagagagagagagagagagagagagagagagagagagagaacuuacauguuuuccuuaugcuaauuuuaaauaguauuuuagcugugacaacgucuauuggcaggcaccagggcuaugcugaacauggcugacauauucucggucugucuuaggcaucagucaucugagauggauuuguacaaggcaguugugcggucugggaguugguuugugugagucuuggacuuuguagugcgacacuguuuuugguaccagcuguacugguauccuugccuccauuggcuuguucacuggacugucauccugaggguaauuuacgggauugguuggcgcagcucacaacuuggaggcuggaaagacugcagaguguguuaguguuuaugaauuuguuggguuuguuuuauuuuguuuuguuuuugagaucuuccccauaguugcuuccuagggcagcuuguuccuuaggcugaguauuuagaucugaugggugucauguguaaacucaggagagaucuacugaucuguaguaucaggcaucucuaguguugguuuccuuugagaucauaagagaccgucacuagccucaucugcuuggcgccuuagaacuaggacucagaaagcccucaggugcaguggaugugcguggcuuauuugucuugguaaguuugaaacagaagaaucauuacaaugggaagguuccaccuccccccccccccaauauuuuuuugcugggcaauuggaacaauaauacguuuucuuaguucuguccaaauaaaaauucacaaacaguauuuuuauuuuuuuuuauucaaacaucuggucaguaucuguuauggaaugcuguuuuguggugucaccuguuaacccacaaugugaaguuuacaaaaggaacaucagagguaguuuaaauauggacugcuuuguuugcauuguguuucuggauguaucauuucaaacuuggaugguguuaggaauaauuaauuauauuagauaauacuaguuucugauggaggucaaaauaauguuuaauaguaagacuuuucuagguuuucaguuauuugaauugugaacuauuaaucacuacaugaaggaaaaagguuuuuuauguaaaucuuaacaugucuauguacccaugccaauaaagauguguugggugccuggaacugagagagacagcaacagcaagcguguguaugugugcacauauaugguggucuauuaaguauguuguaaauaccugcuuuucugcauucuuuaccuaauuagaaaaggcgaagcauuuuuuuuauugcucuugccuggaguuacggccaccuuccucucacugugucagagcaacacacaaaauaguaaaugaggagccgaaacaauugggacuagaaaacccuguccacagcccagugguccgugucgcuguuccucugcuuccaggauauauugcauaaucaggagaggcaagacaagccaaauccuuuuagaacaccaugucuggggagguuacagggucccugagguuuguuccuucuugucauuguuauagucucccugugacaaggagaucugggaagucaccugaggaugugaugaaaaccacauuccucucacuguuguuuucucuucugaacguuuaauagauagggaauaggcuuggguuucauacauuuaauuacaaauguuauauaugccccuauauaaaacaagccaaaaauuuaaaucauaaaacagaauaaccaagugaaagaaccuguaucuguuuucacgugcuugggguuccaugcaagaauagcacuuccugaccagucagccaaggcucuugcaagaaaacgggcuggcuugacuuguguuuacaaggaaucaugguagcagcaaucagaagcuuuguagccuguagcccauucuagagacaugucagguuaggaaaaaacugcucucuguccuggauucuuggagacagugacacacagacuggcuuggaacuggggauauuggcaccccgaacuccugagugcuggaauuucaggccuuuccuaccaugcccagcaaguuacguguuucagaaacccgaggauaaugauuucucagcuuguuuuucugaugauaagcaugaaagaagaaaaagcucuuuaaaaaaaaucuguuucgaaauuauauuuuguuacggaacaaaaacaaacaccaggauauauugcucaauguuuguuagcuuugguuagcuuuguucuguaaauucauauuauauuaaaacuauuuccugagaauauuucauuuuucauuuguucuugagguuuccagaaguuuucauuaaaccuguacuuugaaugauuccaaccagaauuuaaaaaaaauaaaauaaaaauaaauuuuguuuuaaucugugcagcuguaguuuacuuugcaggcaugagaaauaccuauuuuauuaaguccuaugaggaauaugugucacauacauuuaagaaaaaaacuauuuaagaugaaaaauuccaaaaaugacuucccccuggugugaaguaaaacaaaacccccagcacaucucugucugugguaaugacauugaggugacaaacugcaggcaggugagguuccugggggugaucucacaccugcaccaugagcuugggaaacagcugggcuuggaacugccugcuggcccugcuuucuguuugaugcaagaccagcucucaggcugaggcccuugccuuuacacaggagaucccaggucuuugaaaguagacagaugggacuguggugggcaguauucccugguuuuauggagcuucucuuugacauggagugaugaagucaccuuagugcugucccuaccaggcuccaagccacauggcucacagcuacccagaguugggucugccaggcaggugugacucaggaagccauagacaaguguaucaugucgacuccaguccuggaucuguggcccauugcguaaccgagcuugaauuuaguuaagggcacuuaaaacuguugggcccugccuuucucuuuagcuaccauacagaacucuggaggcagcagagcugguggucuuagccauuuaugcuauaacucuccugcaacuucucauggaauucuuaucuaugauucuuuuccaugcuuccccagagaaaagaggcauguguacuuguuaagguacaagaaaguagauuucugucugaaagcugcacccaucuguuaaggcuucucaagauucuagaaaccaccaggcccacagauccuuuguuuccaguuccuuuagguccauaggcuuuccucucugcucucuagggacuguuuuuucccuccugggcuagugugacuguguacaucgacucccaggaaccccgagaagaaauuauguugucuuacauuuuugguuuuuuuuuuuuuuuuuguuuuguuuuguuuuguuuuuugagacagaguuucucuguguagccuuggcugucguggaacucacucuguagaccagguuggccuugaacucacgauuggccucccucuaccuccugagugcagggaucaaaggcacacaccuugcuuucugcugccucuguucucucgcacacugauguuuuccuuugaagccaggaacccagaacaguguguccugauccagccuucagguagguuuaguuugcccugacaauguuuuaaagcuguuggagggguuggguguagcucagcagaaugcuugcuuagcaugcacaaggcugaguucuuucaacacugaggggauaaaaccuugagccuuuaaacuuuggagagacuuuguaugauagcccagaguucugguuucacuuuuuauuaucuguccucccauggaacucuagguaggcaagcuccaggauagcgguuuccuuugaauuacucuuuuguuuuuuaccuuuuuaacacacgcauguuguacauguaguuuuuuuugccacgaucauuuucccaaagaacacuugauaacuuuuauuauucuauuuaguuaaaacauuaaugguccaaaaacacuccgguagaccugcacgguucuucuguuggcuuacagacaauucugcuaggcuccacccagcugcuaccuagguuugagucaacauggaguauauaagaauugcucagcuaccccagcuuguucccucccucccucccucccucccucccauucucauucauucccucucucuccauuuguugccagcuggccucuucuucucuuccucccuccucucucuuucugucuuucucugucucccuuuauucucugccucuaucccuuuuccagguccccuucccuucccccaauaaacuuccuuuuguacuaggccugucacaugauggugaugccucuugggaacaccuuggcugaccugcugaggugcucccuccuccuaaaugugcauugcuuuuuaaugcuagcccuagccuucagcagcauuucuggcuccaguauucaggcauuguccuucccaggaaagaaacaguggccuguaggccacucccucugaagccccauuccagaagaggucauuaagcagagggcuggauuauuaggauccuuugguuuuucgaaggcucaagacaauggcagaguaaaugcugcucaucccucucacccguuugcuauuccaccugccaagggccuuauuucggugggagcuugcauacauucuuaugcaacaggccuugacuucuacgacaauaaauagcuaugaugaaaauaucuccccacccuaccugugucuuugauuuuugaggguucugugauacugcagauauacacacauagacauauggaaaugugagauaauauauuucugauguaagcugcuguuuuauuaaagaaacagaauuguaucuaucacagcugccuggaaggcuucaggucuacugcuguuugccuuuugaauccaguguggggauucuagggguuaucuugaugacccaaguuauuacaacacguuggguuuggguccuagaaacuucuaaacuuguugacuuuuaggaaagguuuccgcaugcacauuagcauaagcuagugaaaucuggugcugcaguaauaguacggggcauugaacugcuuagguucauggugcuggcgcaagcagagccugguccuguucccacacaggguucccuggcaguauugacgccucuggaguuuuguaguugcagccuuuuuuaaugagaaggaauuuauaaugaccguuuucaggucugcuguaggucuguguugagugauuauacacuggagagcacucuaaaggucaguaaagaagggugcggcagaggcuuacguguguuuccaaucucagugugagcaaccuuuccugacagguaagucccgucacaagcagucacaagcagcugggguagaaggaaucuacugcucuaagaaagaucacugccaccuaggcuauuuaaaccucagccaggagaaccgaugcauuuaaaaucugacagcaacaauaucugguuuccuugcagucaaauagaaaucaauguugugucugauuccaaaucugugacugggcuugugacauguggcaaagcuaaguccuuccuaauauauggcuggugggagcaagaagagguaggucccucuugcuuggugaacauucauaugcaucauugucugaguuuggguauggggaaaacagauuuggcuucuugucccagucaccaacuugcuggcccuaggcagguuguuuuaaaugucucugagccucuuggcaaucagacgucacauuuauuaugcugccuuaagcuacuucucucucucucucucucucucucucaagcuacuucucucucucucucucucucucucucucucucucucucucucucucucucucacacacacacacacacacacacacacacacacuuuuuucuuauuuaaccuguauggccuaucuguuuuuugcggaaauggaucucagaacgucucuuugauuguugcauguguagcuauugccaguguuuguccgugcucuguccuguauuuuagaguguguugacuguuaggaguuuauucucauucuagacaagaauagcagagaugccauucuaggcagaagcaaagcuuuuaggccucagaaaucuucuuaggugggauuuguucuggugcuggggguugaagccagggccucagcaugugguaggguaguuuucuuccauuaaguuacacccccaaugcaucagcaguguuuuuauauucagauaacaauaacuucuucacauuacucugugaauuacuuacuaguuuuuauaauccauggguuugggcaaacagcuuagaagcagauguaaggaggaauccagucuucucuuccucuuuauucucaucuuacaaacaaugucuuggauuuuauaagucucccaucccagagaauagucccaucuuggccuucucucucccuccuccucauuuccuuucuucauuccaccacaucuucuuccucaauaaaauuuacauccuuguuaacuacaugcaaacaaaauugaugcauguggucaaggagaugauauuuugcauacagaugcaacaguggcagccaucauguauggaacaaauagaugugcaucccuuuuugaugaucaugggggagauuagaagaauuggauaaaacuuguuagcuuuugccuuauaaacccuguuuucauggaagaggaugcuaucuugugcucuguuacuuaaaauaacuguguagauaagauuuaaugcuuuuaccaucauucuucuaauccauucuugucagaaagagaucuguggucccgauauugucuuuuuauugucucagaaaugguaauuugucaagugguuuuuauauaaaggaugcuaaaacuuaagaacauacucguaagccggaaacauauaauuuggcuaauggagauugcuagucauagauaauaaucaagauauuaguaacucaaagcaguguaaagcuguuuaacauuacugacuuaacugcaguguggagagaagacugucccugucagagguaauuucauagaauaccaguuauauaaagcuguagagauggggcuugggauggucaguacauacagccaauaauuuaggaggaguuucuacucaugguuuaauucauggauaguugugguuuuuauuaauuccuucauauacgccaaaccagcuauugaucuguauguggagauaauuuuagaauuuagaacuugcucugaaauuuuucuuuguucuuucuuggcauuguauucuaggcacaccuucauaggacucucuuccuagugaagcagcugguuaucacuccugccaaggcaguuuugaaaaguugguucaguguuuucuuuuuuucuuuucuuuucuuuucuuuucuuuucuuuucuuuucuuuucuuuucuuuucuuuucuuuccuuuucuuuucuuuucuuuuuuuuuuuuuuuacauuaaucaauauuccuaccuuuaacuacaguggggucucuucugagacuucagggcaaucacccucuuuauuugcuuauuuaauuuuuagauauuacuuuuuuccuaugaacgauuucaggucagcaucuugauauaucagagugucugaauaucggacuauuuucacucaacuuaguuuucaagaaguuaaauauuuuacuuuuaagcuuuuugcgugaacuuuaagcagaauucagaaaugucaccauguuuauguaagcaaaugcagccuaagugacacauguaauuacuugaauuuuucucuauggagcuucauguaguuuauuaugaaaugguuuugaauaaaaaauagucauauuuuuaacgauagccuuauagaaauuuaauuguguuuauauagcccuuguggaccuuugcacagagucuuucuagcuccaaagaugccacauguucucugauaaaucuuaguaugcccauggauuauuagucaugugugcuugaugaucuaaagaauuuuauauugaucaguagugguuacauaccaauaagaucuucacaacaccuuugaguccuacagaacaaaaaucuguucucugaugugagaaauaaaugcauccuuuugcuugcaaauacuaauauuugagauacuguuguuucugcguauuucauguuucauagaucucuuacuuccaguuauauugaacaauugaagagauccugugaaaucagucuuucuccaggaugagcaaauuaauucugauacagcagaaggaugauaaucucuguuuuaaugaguaauuauauucucuaucacauugcucacaugcagcauguguguauauauacaucuguaugcacacacauauguauaauacaguauauuaguuaagauuuggggucuugauuuggacuggauguucugacuuaguuauauuggacaaucaggguaaccuuugugucuuugaauauccuuaucuguaacuugaggacaaaaauaguacccacuucaauuuuugaaaauuagguguuuauguaguuagcucacaaguguucaaucagugugcauuauuuugaaaggaaaauuauuucaugauguuuuagugauaaaauagccacuaguauauauacauacuucaaugaaauaaauuuauaguuagcagcaaccugcagugacuucauucuguacuuguauaaaauuguuugcuucaguguguagcaugcaaaauccugaaagaguuaaaauuuuuuccuuguuuuucaggcuuuaauuuaggcucauuguuauacaaaaacuguuagccuggguaaagcugcaccuugagcacugauguaaacugaguuuuucaaaguacauuaaaauuugccauagucuucccuugacaauugagagauuugcaucugguagcgauucacucagccgaauggaagaucgcacuccuuagagugcugauaagcggacacaugacauuugcaaagagcaguuugcccacucgagugccagggcaaacuggagaaaauucugugcuuccaauuucaucagaaacguagggaauauugcaaaugacacuaccaaaucaacuguaaauagaugauaauuugauugacaucuggaaagcugucaccggcugagcagcccauaacaggaacauuuacugagugcaaaggcagcuuucaaguaaaucacuuuuuguccaguggggcccagccagauuauaauugcauguccuucccuucauugcaaauucccuauuaccguuaccagcagugucucauuuaaaggaagguugucuuccaaauauucacagugucucauguuaacucgucaccucccuccuugaaggcuugcuauuuucuggaaaauccaguccuuaccucccuucauuguaauaaaacucauuaacuuggccuuuguguauguguguauguagagguacauacuauaaauuaauuauuuggugacaugauggaaguuagaggcuaaagacauuuuagcaugauuucacuauaguccuuagaauuggguccucugucguuuuuaaauaaacauuuuggcacuggucauuuuugaaaugucaguacuucaaaauggagugagcacuuggugccaucccacuuggaaauguacaagauacacgucuagggcuaaugcuugggaauacugggagauaaaacagcaaaacacuuguagagauuguguauggagcaagagacacuugagacauuauuaaggcaguguugacaaguuuagucuaguuuguucuuuaaaagccaaggagguauuaauaccugguuaauaagcucacccaguaguaacaaaguuaucuggccccauucuucaagucagcuguucuccauugaucaagaaaaagaaagaaacacuguucuuacuuggucuaguucuuccuugcuucuaaauuuuguuaacauacuccgguuuaggagaaugcauagauguacuaucagaacacuccagagucuuugaggaucucaaaguaauguguuuuugucaaaaacccuuuugaauuccugcucguaggcaugagaaguucccaccagagaagaauaaugugaaacaaguugauccuacucuaggaguagccucucuuguucaaagaggauagaaccugagaguucuguugcuagucaagaccagugugcauuugccuugcaccaaguucucuaugucacaaacaaucaaggaaccaucuccggcuguacagauguaguugcuuauuguagccccagugaaagaacaugggagccaagaucuugcuaauuguagugagccugccugcauugcaagugucagaugauuugauaggacugacgugcagcuaaauggaauaggaaaagacacugcaguggacuguugguccauuaguuugcucaggcaucuuguuuuacuaaggagcucucuaaugguuucucggcaauaauuacucucucucccucucucucucucuuccucaugcuauucaacaugacaggcacuugccgaagucacagcuaauauauuugcacucuaacaggccccaaugcugggucuccuugaguacuuuggcuaagaaaugagugauggcuaugcuuuuuuuuccuugagaaaaaucucuaaugcagaagacaaucguuuuauuuuggauauuaagcagguaugugguguagcaugagugcuugaggaaaaaaaugaugcauugcugugaacuccccauuguaugucucguguauuaguaguugaugauauugaaacagagggaaacuuuuauggguucauuuacuuacacagugauaacuucagacuugcuccagaaccacagacagggaggggucucaauagacaugagcuuccaggcaacaaucuugaagauacacaguaugggaugauucuuuuguuucagaugaugugcaaucgggaaguaguuauccuacauacaguuuuuuuaaaccaaagaaggugucuuagaguaauuuagcuuaaaaauuguucuuugggucacugcuuuuugacauauggucgauuuccccuauagcgagauuuacuuuuugguagucaauuugaacuuuuauauuaaguauuuuaguuuaauugauaauuuuuggauucuuuugagauuucuaacacaguuuguuaauguauaacuuuggaaacaguauaugucauaguccuccacaguggcauggccauuuuucuuacaucuuugagggguguggucauaaaauaauccuugugcuagaaaauauaagagcaagaagagcuauaaacaaagugucagguguguagaggcugugcuuugaguuuuggcaucucuucucuauguucauguuuauaaacucuuaggagaggugaagaaaugagcaacaucucaauuucaaauacuuauguuuuucuacauacagcugucucuuagaacaguuucuuacuuuuuuaaauaaaguacuuauguuuugcuguauaagaaagaagaagaaaauaucuuagaaacauaucuuaagcauauaaugaaaugaucgaaaggguucugaagaauccuuuagaaucuauuuacuuugugcagguaccagauguugauguuggcagcaguuaagagggucacagggcauuuaaaaucacuaggcuguggggaauaaaauuccaggucuauugcacugaaaauuauuuaaaacuuguguuuacucagugguaaguaguacagaaagcauuuuuuuuuucuauauugaguguguuuuaaacagguaccuucgacauacaugaucaaugaaaaugcuuaaaacacguuucugucccaggggcuccuagcacugcaggccacugguuccacugaaguccguuuuacagagcugaucacucgacauuugaccuugcuugugagcucuucauuucauggaguagagggcuaaggcuguauagcugugcaaaaaggggggaaagccauaagugcuacacuuagguaguauuuccuucguguuucuggcaguaauuuugagaagaaaauaggacuuuuuaugcccacuccacuccuguuguuuuugcaacugagcuaaguuuguuucucacugauaaaauguaguuucaaugccaaaauagaaaguaaaaaaaauaaaaugauuuugaagaacaaaacuaauuccaacaggggguaccucucuguacucacuauagauucuuauuuauucuuguuuuaugggugucacacuugagugaguuagguugccuccuuuuuuugguuuuccaaaggaguuuaauauauagaucuccaguuugccucauuucuuuaguuaggaaguuugaaccaaugcuguaagugcaacgaaauccauuucuucuagucuguguuauccaucuuacuacuguccaucaaggauaguauuccagcuuccugugggaaguacuuuaaaugcucuaucagguggucagaggggacggggcuaggaggcaaaggaugaucucugcagcucccaucucugagauugcgacucacuucuucauuuuuaccacaccuuucagauuguguauaguuauaauuauagaguugaaaaaggaaaaacuaugugugcugaaguuaauuuuuauacaccaaagaaguccagauguugcauguucugguuguagauccugggccuugguuuuauucagugacaaagagaggugucuuguuauuuguguucucaugugucgcuugacacuggggacaugccaggacauuuagauugaauuguuaugugaacauagcugauuauucuucacaguccuagaugguauagcuuuucauuaagguuaugugauacauuauuuugccucuaagucacaagacuauacagcauauuucuguucugcauauugcagucaacuggaacagauauuuuuauaucuuuuuuggggggauaauucauauagccuuuuuccauuuuuuauuagguauuuucuucauuuacauuucaaaugcuaucccgaaaguccacuauacccuccccucccugcuccccuacccacucacucccacuucuuggcccugguguucccuuguacugggacaacccaaucacaaaagaacucgcaugauauuuuuauaucuaaacccaucugaacacagaaaacguacaguaagaaugcaguagaaaugcugaaaacgaugcacauguaggggacacuucuuacgaguggagcuuauaaaccuaaggcgaggaugaguuggugagcaaaugcugugugacugugaagaccuggagcauuauaauaaacuccugcagacuuuguaagcccugugcacauaguucuuuagcaauuaaucaaguuacuaaauguuugcauucuauaaaacuuguuuuuaaaugcucgaaucuuauacuuagcuuaauauacauuguacaaggcuauuuguuuucaagaauuuuuuuauuuaaaaccuuuuuugauuaagccuaagucugaaacagugucagaaucacgucuuguuauucuggaaagucuuccgugguugugacaagaugaagauccccuuugcuuggaaccuucucucgagcccuucugaggacugccugaggauuccuuucagaaauauaucuuauaguaguuucucugguugguugguugguugguuucuuucuuucuuucuuucuuucuuucuuucuuucuuucuuucuuucuuucuuucuuuucuccuccuccuccuuuucuuccuccuccuccuccuccuucuucuuuaaaucauagauuuauuuguaaguagauaauuuaccaugaauauuuuguuacaacaauaaggccuucauuuucuuguccuucagugucuuuuuuuuccaacuauguguacauuagguaauuuuauaaaaaucauuucauggcagucugugggaccacaguguacacauggucuauugucaaaugaaacauugucugaacagcuagcugucacacauagccacuugauguuuggauugguaguauguauagccauauaucuuauauccacaggguuucugaucaccaaagauagcaguuguuuuaaacugauauaucauagcuuaccauuauugucauuauuacaguauaggucauauauauauauauauauauauauauuaauauuauauuuacuuguauuuauauugcucaucaguguacuuguguaaaagaaacagucuuauaugguaggcagcauugaagggaaguuuuagaaugccuuugucaaaucuguaguuuaguggaguauguaaaacaaacagugccuacugugugauaaacgccaaagagcuaaucaguuuuggauauuacucucaguuagaacucaccuuaacuguccuauauuacaguuacuuggaaaaauauguagaagucuaguguuuugagucaguagauuuguaaccugugaaguguuauccagggguuagugcaucuaacuucugagcuuuccagucacugucugugcagugaggaugccaguagugcuuuucuuugggguaauaugaggauauaggaauaccuuuuguaaauuuauaugcaguucauuaacuuacuaagguguucuugccaaaugaccuaaauuagaaggagggugauuuggaucaagucccugaguucacugucuagagucaaauuacauuuguccauucuacuuggaaagggggggcaaucaaagauguaugguuuuaaucuuauuuuuguuagaggcuaugacuacucuaacccccauagcuucaauuaaaaaacuugaaaauaguucauuuucuguucuaauuacuuggcagaaauuuagaauagaaagaaaugaguaccaaccaaccuuuccuuugcacuuacagaucaacaaaagagauucuuggguccuagagaccaaagaaagaaucagcaggaaggcccagggugaaugauggauugcagagccuggcugguaauuacuuucacugagcuaaaacauuaacuugauacaugggagcaaggccagaugaaaaucgggagccggaccucuuccucccuauggacugcccaugcuuaccuuguggagguaguuguuucuuuggugggagaguccaguccagcuuccuuucccgaggcucgacauggauuuucaccuaccacccuguagacaaggagugguaccuuuauuuuggcuguuguaaugauauguguuuaagucagccugcuuucugagauggcaagagcuccacaguuucucaagacuuuuuaacaggauaccagauauuaacagagauuuacucgucuuggggcucagcuauuuuuuuuuuaauuuuucauagcaugggcuguugaacccacagccuugggcaugguugauaagcaucuuagcauuuaaguucauucuggacuuugaaggcguagguuuuggauauuuguaacaugucuacuaaacagauuucuuacauugaaguggagaauauuguucucuucagaagagcuaggggauauuuuuaaugacauaugauaguuauuaauacuucacuacuucgcuaucuaggaaugauugugaguccguagugaagcucagugaugugcuggugaagccguguaguuuucauacaagcaugguuucagauggccauagaaggugaagcacgugagaaugcauucagugcucugugcucuucaugucugccaucacagcauacaguagauuugaacucaaguuuucugaguucaaguugauuauuaccucaugggaauaacaguuauugucuugagaggcuuauaguagauuaaaucuuaaaaccuauacuaaagacagaaauggcacuagaucuugaacacucccagacuguuuacuuuuguuauuugcaucaugcuccauuucuccaaccaccauguuuugugcuggucaggcaguucucugucguaugccauauuguugaaagucuaacuuucugauaacagaguccaugguuucuugccauccccugaagaggcugaccugaacaucuauugcugugcuagccaaaagggguacuuacugcucuagccugccaggguggggguacuuacuucucuagccugccaggguggggguacuuacuucucuagccugccaggguggccauacuuuagacuguaugaaaagaaugcuuaucaggguugauguuucugacauucacggagagacagaagggcagauaauggauauugaauuuacagaugcuguaaauucuaauguuagauuuuguauuuuguguauuuaugaguucguugucuuucugacauauaaacauuuugcacaugugauucuacaaauauauucucuuggaacagacauucuguggaagcaugauuucauuguugagacaucuaacauacuuuguuuucuuagacaucuaaauuggagguauacuauuucaaauaucuauaaauacucagucuagccgagauaaaaguuuaaguuguaaggcuucaauuauaaaauguguuaggaugcgguuccuuuuuuuuauauuagauauuuacuuuauuuacauuucaaauguuguucccuuuccugguuuccccucugaaacccccucucugccuucccacugcucaccaacccacccacacccacuuucuggcccugacauucgccuacacuagggcauagagucuuuccuguaggaccaaggaacucuccucccauugaugcccaacuaggccaucuucugcuacauaugcaacuggagccaugagccccaccauguguacccugguuggugguauaguuccugggagcucuggggguacugcuuaguucauauuguuguuccuugggaugagguuucuuuaaagagcugaauuguguggaauuuuaaauggcacgagaauauuauugauaaaaaggagcauuuauuaaacauuaauugaaucagcggugacacuguuaguugguuuccucucugugggauguccuguugacucauugccagcauagcuuaguagaaggaacacaggcuguggaauaauacugguuugguggcuuaccuauucucuuuacuuacgugcuuuggaauuggguguauuguuuucccaaaucuucauugucacaaacuuggagcacagggcuggagaugguccaagugguuaaacacacuguuccucuuaaagaggaugaaucuggggcuugauuuccagcacccaugguggcucauaacgucuguaacaggcauucauguggugcacaaagcauccauacacauaaaauaaaauaaauaaaugugauuuuuuuuuuauagugaaggugcuacuuucuuuguaagauuccuaaucuugaagugaccugcucuaucuuuuuuuuuuuuuuuuuuugaccacaacauuuccuucaaccccuuuccuauauuuuggaagaaucaaaucauagcaaaagggaaauugggacguuuuuguuuuuauccuagcauuuuucuguaguuagccuuguaaaucaugucuuuacuguguaacucucggcuucuauaaaucucaggcccuugggaaugaaacccaugacaaucaugaagugucuuacuucaaaaaaugagaaaaccaaggaacuucaauauucucugcagcagaguugugugugugccucuccuuagcgucaccuggggacguggagaacagcauagcauccaccucuuacuggcaguggugugcagggcguggaggaagcuuuaggauugaguagaggguuauaauugugugacugucuggccuuccuugaccauucuuuccccuuccaggauuccuguaacugucaucagaugguucagacucccaaauguuucuaauaaugcagugaugucaggaguaugguuuguuuguuuguuuguuuuuaaaggcugggauuagcaguuacgguuuuucuucaagcaucuuuggaguggggaaacuucugucaaacauggagaccucuuuucugucuucacuagaguauucccacuacuuuugcuaacuuaucccaccaucauugcuuuggaaucuccacccuacaaaaguuagaaauuacucugucaacauugauaaucccaguuauacucagucuccacuucuauaccacucuuucuggggaucuuuauagaacauuucaucuuucuugggucaguuaaaggccucaaggagguugaaaauuggucuagacaguggaugagcccugugaagaaugauucaagccuuggggguuuccugagauagauccugaauuauaccugguauuauuugaaugccugaggucaaggcauuuaguuaucagaacagaugcuccaauggaaagaacaagggggcagggcacagggguaugugcuacaguuuagcuuaaaaauaagaaagaugucauaaauuuacauucguacuuguuuccaugcuuagggugggcacagacacaggaggguggcugaugagcucagaagcuuuuuauucucugguuuuuaggguacuagguuuuuaucauugucuuaguuacuuuuauauugcugugcuaaaaugccaugacccgggcaacuuauaacauaaguuuuugagguccauaguuccagaggguuaaaguccaugaccaguguaguagugagcauggcaucaggcaggcaagcguggugcuggaacaguggcugagagcuuaccucucauacacgugugagggagagugagagcuaauugguaaugguauggacuuuugacaacucagaacccacugcuagugacacauccucuacagcaaggccacgccuccauccauucucaucaguuccaccagcuagagagcaagcguucaaauacaugagccucugugaacuacucucauucagacuaccacaaucaucauaaguuugaaaacauaaaaaaccauaauggccacaugugugucccugugcauuacauguguguccagguacaugcauguguauacaccuguaugucuucugucaugagacuugacccugauacuaccuuuuacuuauucuugucucauacaaugaauucugacuacagccuccccuuccucuacagcucccaguuucuccccaacaucuuuucucccccaccaucuuucugaaaagaacaaaucucccagggauaucgacuuaacaugccauaaaaagauaaaauaagacuaugugcaaacccuuacucauaucaaggcuggaaaaggaaacccagucagaggaaaaggauccuaggagcaggcaaaggagucugagacacccucacuaauacuguuaggaggcccauuuaaaccccaagcuaaacacccauaagguguaugcaggggaucaagugaagagccacguaggcuccauaauugccccuucagucucuuugauccccuaugaguccugcuuaguagauuuugugggucaugaucuccuggcauccuuaaacacugguccuacaauccuuccuccucuuuggugggguccccugagcucugccuaaucuuuggcaauagguuucugcaucugcucucauuagcugccugaggaagccucucuggugauggggcuagguacaaagcuaugaguauaacagaacagcauucauuagcaauuauuucauuggcuuucuuuuuugccagguguguugauccuuaggugucugugccaucuagcuucuacuuccuggccauccaggcagauccaggcagcgcuaggcauggucccccucuccugguguaggccccaaguuagacuagucauugguuggccacuuucacaaguucugagucaucaucucccaguaccucuuacaggcacggcaguuuguagguugaagauuauaugucuggguuggugucccagugcuacuacuggaagccuugccugguugccaguucaggcucuguguucuucauuaguagguguucuugcuaggaucacucucaaaaguuccuggaaguuucuacuauacuagguuucuccaucacccucuaaaugcuccccaacuccaguugucuuucccuauauucucucccucugucucuccaucucuaacccaauuccucaugucauagaauaccaacauuuaaaauacagaaagaacucaaacuaugcaucaacaaaccaaauauuccaauuaaaaauaagauacagacuuaaacagagacuuucaaauaguggaaucucaaauggcugagaaacacuuaaagaaacauuuaacauucuuagccaucagggaaaugcaaaucaaaucuacuuucagauuucaucuuauaucugucagaauggcuaagaccaauaacacaaguaccagcccaugcuggcgaggauguggagcaaggggaacacucccccaucccuggagggagugcaaacuuccacagucucuuuggaagucaauauggcuguuucucagaaaauuuggaauugauuaagacauaccauaccacuccugggcauacacccaaagacacuccaucuuaucacaaagacacuugcucaacuguguuuauagcugcuuuauucauaauggucagaaacuggaaacaaccuagauguuucucagccaaagaaugaauaaaggagauauacauuuaaacuauggaguauuacucagauguuaaaaaaaaaugacagcccaugacauuuucagacaaauagauggaacaacaaacaaacagacacacagacaaacaaacagaccaucauccugagcaaggcaacccagacccagaaaggcaagcauaaguggauuuuaguugcuauagauaaucauacugcaguucacaggcccacagaggguauauaacaagaagggagggcucuggugggggugguguacauggaucuuccugggaagggaaaacagaguagauuuuguaguuggacugggggcagguggaaauaggaacaggagugacacuauuuuucaaggaaaggaaaaguugucuaaucgugaaaggacaguuaauuuaucaaauauauacauacauacauacauacauacauacauacauacauacauacauacaugauucauugacugaucuaaaucccuauguucuucccccaacgcuaauucuccauagcaaagacuuacuauaaagaggcggggguuauacuggaaaguguaaaauuaaugauaacguagacuguuguucugauugcuuuuguugucugagaaaucccucuuuuuuaaaugcuguggugagucuuacaauaggaaaacaguucccuguccucugguauuccagauaucuaaugguaaaguauuuucuuagccaccgcuggauacugauagaacugucucuuuuccuuccuuccaccgagcaaccccucaauaguuuucagacggaucuuuacaaauaauugaggcaaguacuugugccuaacauugaaaacucugaugcccaugcaugcccccucuuuccagauggcauaguguggaccaggagcuugaggguccuagaucucaacaaagagggaggugccucaggauuucaguuaaagagaugggcagccuugagaguaggcaauggacugaguuuucuccagugcuuuccgagagggacuuugcuaggagcgggaagagauuaccuccuaccuacaguuuaagacauuaauugcuugcaguaaggcuaaaggcaaugagacaucccuccuuucugagggagacucuuaccacagugagagaggcagagcugugauggguacucagcacugggcaucaccccugacuuacuguuuuauuaucuuaaguucccuuccuagaauucucacccucaguguagaagcuacagaccugccaucagcuuaugcuaggccugccguuauguguucugacucaaaaaggagcauaguuacuccuuuuucuucucuucugucuuuauggugcuggcuagggcuaaaucugcuuucucuagugcuuugggccuccuuccugccuuugaagcuuuugugucugccuuguagcuguuuucuuccauguggucaaccuccagcuuggcuuaacucaaacucuucuccguucgauucucugacagcugcugagguuuacagcuuaccggcuuucaagguuuucuguucaacuuuaguaaaauuuucuuugagcaucuaacaagaagucacauaauguauucaauuucaguagaaucuuauuuauuuauuuauuuauuuauuuauuuauuuagugauguugcaagccuugguuggcaagcucuccuuucugguaagauggugaaguagacaguuuucuccccacauggaagcccacugauggugaagucaccguauuaacuaacuuguuuuuacuucaagugucaccuucuuggaaaaugugguagaguaaacuguuauuuuaucucugcugcuuacagacugagucucuuuccuuagucauguuacuucugcuuugggcuguuaugaugacagagaaagccuguucugagaaacgugaacaaccguugucauucuuagagcagguaguuuucauugcuaguguucuuuggccugccauguuugcuugagugucugaguuuggugacaguucuguuauuauauuaaagauguuuccugccauauauuuuccauuucaguuaagaaaacccacuuuauuuccuaagaugaauuauaacuaggauuguuugguacugagaaucucuucucacuuaauaccccuaaugagauacaaauguucaaaauguccuuaugagcagauuauauuuagagaggaauccacuuauuuuaguuaacuaauaaucccuuugcuccuguaucauacauccuuauuaggcccucaacauuccggcuccuuauggaauucuugugagaucagaccuuugcaagcaguaugauucacuuucagggucagagguauugagagugucaguggaauuuguugaugcuccauaccuuguuguaauaacgcucuuuuuagacacauuuaugauaaauacaagacuuuuucuauucuuacaaagugaguuuuauuaguucucuucuuguauuuaugucaguuuucuauagaauaagauaguggaguucuuugaguuuuguuuuguuuuuguuuuuuccgcucugcucuccugccccucuuaccuuggaaugguuuucuaacucagugaucauuguuuguuguacuugaugugugucccaggagauugaacuggguaugaugcugagcgcuacugagcaagaucugugcagcauccagggaucagugcuguguacccuuccugauaaccguguuuaucuuguacagaaagcagagagaaacagcauuuugaacaacuugauuugugaaguugcuuuuugaguucaaauccuggcuuuauugcuuacuguuggccuauuuguagaagaguuauuugacuuccuuauucucugguauucagacaguggugauuauaaugcugcuugccuuguggguggcuacgaggauucugugagcacauuagagaguaaugccaguugcauucuccguguauauuuguauuguagugucuaguugaauuucuacaaguauugucuaauaguauucucucuugguccauucaaccgaugaaaagauauuauugacucuguaaaaggcaugucauaaaaacauaauaguagcacauaauuuuguuacugguaucacaguuggaauuguaggacaaauuucuucucaucuauuaaucuagauggaguugggucuucugggaccucucugcuucuuugauauuauaagauguaggaagauucucaaguucuguuuuuuaaaucuguggugauucaguucauucauuuuaaaaguccuuauuaaguauaagugugucuucuuuuacaugacucuggccuuuacuugccaugguuaauuaacaccaguucccuaucaguauagucuaaaguucagaaaucauguuaaugaguuauacuucacuguguuaauggcauuaguucuuucucuuacuugguuuaugaagagacagacgugaaguuauguuguccccuugucuuugauaaacucaugugacaguucaaaagaagugauaauggaaaagaaaucugucaagaaagcgcaaaguaaagcaaagaaauggaaaguauucacacugaaaauaagauuugaacucauuaugcacaggguuacuggaacaguaucgcugaccaauggaacaucaagccucacaguuauagaaacuguguguaguugggaaagcugagggauggguaucuaauugauuauaaauugggagacugcucaugucagaaacgguugggaaaagacacgaaaggaugauggcaaaggcuucauauuaaggacacucucagugauauuauauaauuguggaaacacaaaggaugaaauaauugaaguugauccaacccaaacuuagagccacgaauucaucaaggcacagaagaaguaccuagugagcacuauucaaucacaauucuuguuuguaaauucaacaacacaccuugaaagugugagggagaaaauaaacucuuuucuccugcccguuauugguaccacuguuauuuuucucaccccuguaguuuagucuuuuuuagaauguaauacauauguaaaucauauaguaaguauuuguaaguguggugguuucauuugagauucaugucuguaguugcaugcaaguaccuuugggguuuaagccgaacugugagacuugacugaagauagaguugggaggacucuuguuguaaccuugccagggucugguggaagagauggagaguagaaguucaaugugaguccucgguucaagaauccugcaggagcugaaacaugucucagcugaggcccuuaggagcugaaguggguucgaaagaagggcuggccugguguggugagggguggggugacgcccagcaggcuauggggaggggaagaagguacuuucucccauuguucucugcucuuugcccaaaguacuuuucuggcuaccaauuuggcuucauuaaauggcuccuuuucuuuccauuccaccuugaaaacacaagacugugcuuucagcgucgggcuuuggaucauuacuguugucaaaucgggugucaaguuuauagggaccagucuuugcugccuucuagggauggcauggccacugcgcucaugaauucacacugcugugcauguggggaaggggcuugugagcucuugaggagcuguuggcaguuacucuugcuagaggaggaagugucauucucuucauaaugauagccauugucaacuuacccaagcuucaguaaauaaccacugacucgugcuccugcaagcagccuuaguuaaacuggguuggccagaugauaaaaagagaaaaaagaaaggagagaaagaaggauaugaaaauaggagaagugagaaggaggggcucaguguugagggaugagagaugauaaugggguuaaaaugacuaagaugcaauauaaaaagggacaguuuccuuuauagaauagcacccaccucagcuuaucugcuguugcccauugcuuuccacggggaacaaaagcauaaaugucaccgagacgcuagugauuuggggccccuuugagcugcaagucaagaguucagugaucccaaacuagcucuaggcuuagggauucucuuucuguaaagaucuugguaaaucuucuaccaaaagggauucuauggauucuuuuuaaccuuuauuuuuaguacuggagaaugaaacccagggcuuguuauguauuuuccaaguguccaucaacugauacauacucccuguucuuaggacuguaguuuuaaagguacgguaugcaaacuagauugaacacuguggcaaagacauaaugguaaaguaaugaagcauuguuaauucuuggguugugaucaccuuuuccuuuguggagucuucaucagcaggguccugaagcugcaucaagcuaagugggggauucuggcuugauuaauaagugauuguaugugguguaggggguagaguacucuaaaaagcaguauuauaaauagcuauacuuaccaggagaacauuuuccaaaagguaguuugcucauauaaauacuuguguuggaaagauauuaccauuaauaaaaauaauaauaaauggaguuacagcugaggugcauuuuauccugauagguccauaagauaaaaagacguuuucucuucuguuauaggcaguaagcugaggcaaugggaauuuagccuaaacucugauagcuggugauagcggaacagagacucaaacucaggcugucugcuugagagucuguauucuucuguguauauguguggccuuuagaguucuagcauguuaguaccagaaggacucaugaagcacauuccauguccuucauuuuaagaguggcgucuucaggggacuugaagacgaccaugguauccuggacuaaaugagauacuccucccagaggcccugccacugaaggaaguguauguuugcuuguuguugguuucaugccagggaagagagagauauagcucaucuaggaagacucgcagaauugguguuucacuccauucuuucccuuggccucugcccucucuugccuguguagauguuaauuuguucucuuccugugcccucugccauuuguucuucccagggaggcuggaaucaccauuaucuuuucuaggcuacccucuauauuuguuuagccaucguuucuucguguagucuucucuuaccagcaguuagggaaagggagauguugcuguaccacugagcagggcugguguuuuggaaugggggaggagauggggauucauagaggaucaggauauacugagagaccuugccugaauuuguggcagucauccuuguccucgaccuguaacauggucaccaucucuugggcuugaacauguguucgaccucuucucccauuuagaguaggguguccucucacugauggaauuuguuugaccaaagcauucucgggucucugauuacaagagcaucuguuugggaagggaagcucuggcuugaccagauuguauuuaauucccugauuguuagaacuuauuuugaggagccaaaauuggggaaauaaguuauugaaauauuuguugucuaucuauguauaaacuuauuuagguagauggacugacacccauccgcuugucaucuguuccacaccaggucucuguauguaaaaaguauaguacuguucuugcugcugccagcuacccauggguccuagcuugcuuucuguuguguuaaacaccauguacuugugagggaaggggcuuacguggcuuguggcuuaaacauuccacaucacaguccaucauugagggaugucagagcaggagcacaagcaggaacagagaugggaaccuuggcagaaagaugcuuacuggcuugcuuccaaguucaugaucaguuaccuuucucauaccucucaggaccaccugccuacggaaggcacugccugcuauggucugggccuuccacauaacccaaccaagaagcugucacauagacaugcacacaaaccaaacugauagaaguaauucaguuccuucuucccgggugacuagugugugucaaguugacaaaagcuaaccagcaugccaggagugaaggagaauauuaaugcauuguauucagcauucaccgguggcuuacuuuuucuccauauuuucuguaauuaagaauguccuucucaauuucaacucaaaauaccugaaaaaagaguccuuguuuaguuaagagagaguaaauuuccccagguaaguucccauauguuuucuguaaaauccagcacacacuuuucuuuguauuucaccccugucggaugagauucuuagaauaaucagccaggcuaagccacucagcucccauugccuugcauuuuauugggcaauuuuaacucuuguuuuggugcuauucagaagagucugcuucuugucacaacccuggcauccuggguucugugauccuucuuuguuugcagguccugaagcugcugaacuguaugucugcucaccuaaguagggacauaugcuugggggcguuugccuucaggguucugggaagggccuugcagugugugcacacauggucacuguuuuugugaaguucacacauguguguucauauccuacccuguccuccacccuucccgucccuuccagagguuuucccuccuuuuguugccucuuuccucucuacuuggugcuucguguaugcuaagugugcacacaacuauuuauguguagcaacggaccccgagugcuuuuucuuaaagcuuuuuuaugguuuauccaaggaguaacuuaaggaccuacuaaagguauuauccucuuucccucugccuccuccuucucuucucuucccuccugcucccuucucuuccccuucuuuccuccuccuucccucuuccuucuaucuguccuacagugcuggguuuuagcccaaggccuugcaaaugcuauacaagggaguguggugugccucuacuuaguuccaucucuggcucaagaauauguucuugaauagcuccuucaagaaauaaacagugcaaaccuuagugcaucuuaguuccuggcccacuuacggccucuauccuuccaugugugauauuagcuucuuagaauaauucaggccuuugugaaguaucgaauagcuguuuggccugucagguaggaugugaaggccuugguggaauccuuugcuagugggauacuuaaaggcacucuugcacuacacugagagcuuacuuaugggcacaaauuuaacuaucuauuaggugguuggguucagcacaguuucuuuaagguccugggccuuucugugaacugaaaacuugcucuuuccucuaaaaguccucauacuguagaagugacguuucaguacuuauaucuuguuuaaacacuucugccacucucaucucccacucucaccguucaguggaacuuguaaauacauuguuucauucuacaccauccuuuguagaugcuuccccuuuaaaucuuuuuugaaacuuuaguuguaauuucucuggcugauagccugggguugguuuaugaugaauuuuuaucacuacucauagccuuacuaggcuuguuacaguagcuggucaggucaugcgugccuucguuucucuacaggacagucguguuuaaagaaaaccuacugaguuugccaguguuccucggcuguguagccaaugccucaugaguauugggagcucaccugucugugcucacuuuucucugagucuuuacauguuggguaccaggcuuguuguuuccuacuuacguuucuuaaucuuguccuuucuuuaucauaucgucccuuuaguauagucaucaguguauuuaugugcugcucugaacuagguauuaacacccuggaaguacuuuagccggguauaguaaugcaugucuuuaaccaggauugugagguagaggaguguugaucugagcuccaggucagcuugcuccacauaguuccaggauaaccaaagcuacauaguaagacucuugucuugaaaaaccaaaacagagcaaaacgcagagguacuuuaucuuauauuuuugcagugguagaugaccaaauacuuagugggaaacaacaaagagcacaaaauuauuaaauacuuuagggugccaccaaauacacuguacccugauucucugauucugaaagccuccaggccuaggacuguucuuuuguaauucccagaacuagaauaguacaacuacaacuguuuggccugagaagauaaauuacugcuuauucauguggugccuccccuuuauuuaaguaggguuuucaaaauuaauuuaccccaaagucauuaauuugcuauuugauuaauuggggaugccaguaaugucauuuuugagaguuuaaauuauuuuugaaacauuaaaauauuuuaauguaccuacuuuaaaaagcuuuauuuugccaaagauuuagcucaguaguuagagaagcauguguuguuugccuagcauacauguuguccugggguuuaaucuccagcacuguauagaccucuuauggugacaaagauggggcaaaucccaucccaugcuuagagguaaagacagguuacccucagcuacauggugaguucaaggccacccugggccauaugaggcucugcaucaaaacacaaacacuagcaacaaaaauuucagacauuuaaaaggauuuuaaaauuuaugucuggauaaguuaccaauguucuuuuggcuaauuggguugucaaccaagauuaguuaagauugaucuaauuuaaaucugguuugauguuugaguuuaauauuuuaaggcagcauggagaggaggugagugggauaguggcuucaauagagguuuaauuuaugaaugaauuuuaaauucaaguuuguuguauagauacugugaucaagugcuaaauaaguaaugugaaugauauuguuuaaagcuuuucccaaauagaucuuaaaucuuaaucaauauucaacugucuuaaauuuaaaauuguuucacugagcuauggguaaauuuguagacuucugaaucuugcagaaugcaaaaguguaggcuuagauaugauacaagcauaaaccauuaugauuuacauaauuuaucuccucaguauaaauauuguacuuguaaaguuaaaacugcuguccuggaaaucagauuuugguugucuugaguauuugugggccuggcggagguuuuaggguuauguuuguguuuagauuaaauuugaaugguaaguuaagauuuauggugaagaguguguagaauauuuuauuugcuuuuucagagcuuaugaauaaaagcaacaucugaauuuaauguuugagaaccaaccaaauucaagaaauaugauacaauucuauuuuaauugucucccuuaauuguuccuaacuucugaucauuuaugguuuauguguuuaugauauuaucauauuuaguacccugucauugguuacauuuaacuuucuguagucguacuuucaggauuguuuuuucucuuaagauagaaauaacguaagaccucuguuugcccagaguccugcaugauucugacacugcuuaucacaggggaucugcucacauggcuugcuucugaguaaaucguuuuaagaauuagucagucuuuuuccugaaguacacaguuuaccuauucauccguucauauauaaaaccucucuucucucucucucucucucucucucucucucugauauuggucauagguuugcuguagcucuaggguaaaggcaguccuuggauuagaaaucuauaaaacaaaacaacagcaaaaaaaugauucugcuugguaagaacugcagcuaugaauacaacagugacauugcgcucuaaggaacuuugaauguagcagaggggagaaauaaaggagauccucaccaguccacacacccuggaacuguccugccagaguucuugcaauagagacagggugcaguccaaagacuuucuggaggaaaugucaccccugccuuuauauucuauuuuuuaacuuaauauaaaguuuauucacauguauaaaagguaaauguaacaagaaguucauuaaaauuaagcacaguuauauuuuaagaauucuauguauuaaaaauauggguugccgggcggugguggugcaugccuuuaaucccagcacucaggaggcagaggcaggcagauuucugaguucgaggccagccuggucuacagagugaguuccaggacagccagggcuacacagagaaacccugucucgaaaaaccaaccccccccaaaaaaaaggguucucuuuucuagauaauacaaauacugauacauuuguacagguuaacuucaaacugucaaggaaagguuuguaaacacaaaacauagaagaaauacaauccaucagacugaaugcaucaacauauaucguacauguuucgggugaccagaaacaguagcuagaaaugguaauaguuagcuagauguagguuccagaaaagugagaacggacacacuggagaccacuguguuaaaacuugaggcaacuagaacuccacguacucaaccagcgcucucacuuaggucaggaaaagcuguacacugcaucuuaccugaugagaaggugagaauguguucuuugagagacuuuccuccuuaacagaaauaaguguuuguuuuagaaaaauuugaauuugguauuuuuuaaccaucagucucuaagauaccuuguugauagagcaaauuugaaaaugaaucucuauugaaucuggacaaaaaagccacgguuugaggcuccaaaagaaacucauaccacuagcugucaucuuucaauauuagucuucucuaaauaugguaguaaaucuuuauguuucugucuguugguaauuucauacaaauggaauuguguauguuauuuugcauuaaucuuauuucauuugcauaccguuuuuaagcaucauucacaacauaucuguuacauaacuguggauaauuauauaacuugaauaugggguuacaguaaauuugacaacagcagagggaucugaauccacagcgacaaaaucccugaugauucaaaaucaaacaugugaugaguccaguguguguuugugaccuugcuaacacuugcugugcccuguuacuucauuguagucugcuuccugaaggcacaggacuugcaccuucaucuacagucugucauacccuguggcuuuccugccagagaaaccucagcucaggauugaaacuauuguaugcuauuaaauucagugcuuuuacuaaaccuugaaaaguuucugcuuuuuuuuuuuuuuuuuuuaaagauuuauuuauuuauuauauguaaauacacuguagcugucuucagacacuccagaagagggagucagaucuuguuacagaugguugugagccaccaugugguugcugggauuugaacucuggaccuucggaagagcagucgggugcucuuacacacugaaccaucucaccagcccaaguuucugcuuuuacagacaggaugaguuaauuaugcuaacaaauacuuuuaguauuuuucuaccauuauuuuuagcauuuaaauacaaagggauauuaaugaguauuugggacuuuauuguguuagaaugcuugauuucacaauugcugguuuuuuguugagugucuugugcacacuugggaggugggggcuggaccagcuuagggcuguguagcgaguuugugaggauccugggguauaauacccuguuuuacccacccuuccucagcaggaaauaguuaucaugaggagcuuaucugaauuucaugaacaauugcuauggcuugggguagaacagaauuuccaaccauuucuaagauggcccuaaacauacuuaugucauguuuuaucaugucuuaugugaaguggcaucuuuagcauugaucaauauaaaucaaaugccaucucuagcugaaggaguuuaauauuaucuguguccugcaguaucccagauuuaauucccuauguaaaaauaagcacaaacaaagcaaacaugcccaucuuuguaugcaaauuacaucaauaaaugcacacacacauauguauaugugcauauauauacauacaccaaagaauuuuuaaauaauuuuacuauugcuuuugauaugcaucuucugcaucuguauacuuggaauuacauaagaauguucugauagaaaaugagcugugaguagaaaaaauuagaagccuuggcugauaccaauacuucaauauaucaugucuuccuuaucuauuuaucaguugauggacuaaauacauuuaacuuuuaaacuaauuggggggagguguucagaagaaaaugaggaaggacugaaguuugaagagccccaauuaagaaccuuaaaagcuugagaguuuguuaguguugaaagugugugugcgguacugcugagagaauguagucagugggagaggccucaugguuaaagcaggaucacaugaucgguagaccugucagucucaccugagcacuuacucuuuccuucuccauucaccugguaccuagugaaucaaaauuacuuguucuucauuuguuuguauucuuagagacaguguauguucuucuguucuguagccaaccuauuaccuuaaguuccugauugcuaggauuacucuaccagcagacaggggcucaauauauuuugauuagucacuggauuuuuauuauuauaauaauacugucucuaaaggcagacaaaggaauauguauauauauauauacauauauauauguacauauauaauguacacauauauacauacauacacacacacuccuuaugcuuagggacuagaaauccuuaauauggccucaguggcugucucacauugagaccugcugccuuguccucuguuuuuucuauuguaugugaaaguuucugacauaauacaggcuuaguaauuaugacuugcauuuuuauuuuagguuauugauuugacuacaguagcucagggugaguuugauaguaacaccuuuuaaaaccgaaagugauuuauauauuaugauaauacaucauucuauucuguagauguguguguauggaguaucucuguauguguguccgugugucugguguggauguguguggguguguguggguguguguagguguguguggguguguguggguguguguggguaugugugggugguggugguggucaagggacacuuuguuggagccacugcuuuccuugugcuauguggaucccaagauuucuggcucgcuggcgagcaccuuuaccugccaaacugucuaucucauggcuuaacucccaaugucugcaucuuugucucacaauauugcuuuccugaagcuugaaauuuuguguaauaucuuugccuggcuucagcacacccuggggucacggcuugcagagaccauaauuccuugcucuaagucuuuaugauguuacacuuuaaaggcagaacaaacgucccaauuuuuuucacuuuauuuuucucauccucugcuccagguuuccggucuucgcacucucuuaccucuguuuuccuugguaaaggcguccuuggugcccucaccugccacacguggcugcuccugcuuagcgguuaccuuuaagcaguccuuccuucacaguggcuauggcuucuccugauuccugugauuaacuucauuacaggguucccauuauuuuuccaucacauuaucucaaauuuggaauuaaguguuuaauuuuauuaauuauuuggagaguguuuucuuccauuuagauaaaagaauuaauugagugguuuacauuauguaguacaauuaaaagacagcuuucaggucuaucaucucuugcucuaaauuuggauauuauuaaagauacuuucagcaguuggguagcauuucuucuuuuugaaucuuuucauuugccuguggcaaauuaauaaauguuuaaagaguauuaagugucuuacagaguaugcacuuaagcauaccguguuguagaguuuaagggcauaguuuugaagcuugaguguguaucagaugcaccugcucauaggguuuccuaugggccuugaacccacagcucuguucauacuacgugguauugaucgagcuggcccucgucccugguacaucaugcuagauuccaaauggcugggcccucuucacaucuucucuuuuguaggucugugcuacagccugagaauuuacaucuaaugugcugcuguugguggucccaauaccauauggcauggcaaacaaguacucuacuacugugacacauagccccuugagaccaugcuuuuuuuuuuuuuuuuuuuugguuuuugagacaggguuucucuguauagccugacuauccuggaacucacuuuguagaccaggcuggccucgaccucagaaauccgccugccuuugccuccugagugcugggauuaaaggcaugcaccaccacgcccggcugagaccaugcuuuaagaguaauuucuauaaaggaacauagaaauaauguuuagaucgucuguaauuuguuugcuuuuuguuuuuuugagacaggguuucucuguauagcacuggcuguccuggaacucacucuguagaccaggcuggccuugaacucagaaauccaccugccucugccugccaagugcugggauuaaaggcgugcgccaccacugcccagcugucuguaauuuuuuaaaucuguauuucuuuuuucuuuauaagaguauaugagacaaaugccuagcccugauuuaguagauauggcauuuaaaaaaauaaaaagcgggggcugaaaugaugggucagugguuagaucacugacugcucuuccagaguagcugggaucaauucacaacaccuacguggcagcuuacaaccaucuguaacuccaaacuuagggaauccaggauuggcuucugaggacacuucauacacauggugcagauauauaugcagacaaaauacccaaacauaaaaaauaauaacauaaaaauugaauuaaaauaaaaaacuuauugacaaaauauaggaagggccagugguguggagaagacucaggaacaaggacguacuuuaaaauccagguuugucgcugacaccauugcauacacuagcaagcguuuguugcaaggaccgugauauugcugucucuugugagacaaugccggggccuagcaaacacagaaguggaugcucacagucaucuauuggauggaucacaggucccccaauggaggagcuagagaaaguauccaaggagcuaaagggaacugcaacccuauagguggaacaacauuaugaacuaaccaguaccccagagcucaugucucuagcugcauauguaucaaaagauggccuaguuggcccucacuggaaagaggcccauuggacacgcaaacuuuauaugccccaguacaggggaacgccagggccaaaaagugggagggggggggaguguauuggggacuuuuuggauagcauuggaaauguaaaugaggaaaauaccuaauuaaaaaaauuaauucuaaaaaaacaaaacaaaacaaaacuacauguuuaaaaaaaaaaauccagguuuguuugagccaagacaaaugccuuuucauuccuuacacucuucgguuuuguuuugguuuuugcagaaaaugagugauugccacgugaucugaggcuuuguuccugguucagcaggcaggcacuuaguguguuuaagcaguuagaacuguugccacacaaauaauagucagaguagccuuuuuacuuuuggucacuuauuuuuuuauguguauguguuuugccugcaugugugucaguuucucauguucaugccuggugcccauagggcuagaaaaggauguuggcccuggagaaacagacaguugggaguugcuauguucaugcugggaauugaucccagugcucuuaacaccccagagcauguuuaauagcauuuuuuaaaaguuuuuuuuuaacaaugggaauuuaaaaugaguugagaaaauacauagugaaaucaaaacuuguccauaaagcaauagaaaucagagcuacaaaacagguaauugccuauaggucaaguuugcggguggaauauaggauugagcccagaaaagaaaaggaggugauagggaaauuuuaaagcagugaauugaaacuguuagaugcuugugguucauuggauccagguuuagcucggugcauaguuccuuaucagaucuuguagucacuguacuuccuagagacauggcaguuuggacuuuuagauuugaaaacuucuauaugacagccaggaggguggaauaaaaagacugcagcugacuguugaacacauuauuuguauuugaauauaaagaauauacuguuagaaugagcagaggagggaauggcuuuugacuggucuaguuaggcuugguuaaaaaaaaaaaaggcugcugcugguuuagcaaaagauacuugguuccugcaaagacaagccccuuguucucagagggcaucacuaugaacuggaacucagaaucuucuuaggaaggcuuuucagcuauucuuuaauuauuaguguauuccccucauccuguuuucguggcauggcauauacagcccuguguuccugucagcaauuaggaguaaaaucccaacagaauaagaaauauguaugacaucgaaauguuugguuuguguuagauguucccuugugagcaguggguguggguaguuuccagaagugggggucuugggcaaggcuuuucuguaagagggacacgcaagcacaguguuaccuaaaacuuucaucgauacuggaaagucguuagcuuuuguaugacacugccauauucuacuacuacugugugauccagagcucaauaacuuguauagugcucucucucucucucucucucucucucucucucucucucucucucucugugugugugugugugugugugugugugugugugugugugugacaguggaaacauuuuaugaacugcggugucugauccauccgucugucugggcaagaaugucccuugauaguaaaaagaacagcaaucaggacagaauuggucaaugcggcaugucuaauggugggaagauauuugaaggacuugcuauagacacaauagucucucuaaauagccucuuugcacccggagucuuauugcaaacagguucauuaaggagagacauucugacacacagcaucaccguaaugaaaguagcccuguuuuucuaauauuguaucuuccacuucaguuaugcugccuguacaagauuucccuuguguuguuguauauuucuccagaaaaggaaucagucuucauagaauauacaauuauuuuguacaggaauguauaacucauaccuaagauccagccuucccuguuuaugugcacuagugcaaaaauaauuggcaaacacaucuuccagaccaaaagauuccagcaccuucaauuugugggcuagaagauguugaaccuuaguuauaauaaacuuaaaaaaaaaacguaauguuaaaaauggauuugugaucaaucauagaagaaaaaaauauuaguauagcuucccaugaggcauacuacccccuugagugagccaccuccuuuuaggauccauucaaaagggggaggggggaugccaagguguccaucgcuaagcuuuacauauaacuacuauaugaugacuuccaguauuggauuuucuuucugcuaauguacagcgugaacauuaugaacacgggaaaaaaagguuauauugguuuaaaaguggauauggaaaauuuaaugugcucaagugggaacaauggcauauuaaaaaaaaacacucaugacacagaucuaauaauucacuugccccuguaggagaaggguaucaguucugauacuagcacauaguuuauuuuuauauacacccucggucccugcaguauacccuguguguagguuccagagaaaagacagaaaagaaucuguagggaaaucagccuggaaaccuuucauuaaauacauugugcuuuuguauugucucguucacagaaucuuccagaaauaaagaaaggggaagcccguuaucagccugcaugugugaaauauuauauuugaauacuaucauuuguuuuaagauuaaggcugaggcugcagacauauuaguuauuauucacuuaggucugguagauaauacaacagggauuugcagauucuuuuuuuccauuucuagucccugccauccuccugccuccaccuccaguaguaaagauacuuccuuauccaaaaauugugcuagcuaaauauuuucauauuggaaaacauggccucuuaauauagaguguugggggagugagagcaguaaagggggucuuagcauucuugguggaguuuaucugucaguuagcaagagaugcacuccugaagaaaguguuaaauccgcuccaucaugugaaaacuguccgcaguaggggucacagggaggagugccaccuuuaucaaguugaauguucuuuggagugagccuucaucuugucauuauugcucauggauugcuggugguggaguuuuaaaaacugugaacgucuuaccuuuuuuugcugacuguucaugcaggauaugcuaggcaagccgacugugacgcauacucugccuguauuuguacaaaaugaacacacauuuuaauaacuaaacccuaagugccaaauagcaguauuuaaugaacuuccgggaucccaggcagugaggguuacguugugaacucucauaccuuggagcacauugucuuacacugucugcugaaagauuuauuauuuuugaagcagcuuauguugaaaaccuuguuuaaguauagaggcccauaagccuaccugucucaccaaauugauaccuuuuuucacaccuguuagacucaaagccacuucuuggccuugaggacagggagagcacauuccacuccugguuacguugccuuuugaauaaaggagcuauugagugaauugagauaggguuuggaaaguggagagcuucuagggugaacugggagaugggccgccauggccauggaggagguugcccugaaggucauagggaacauuuauuuuuauuguuuuggaucccuuucuuccuuagguuccccucaucagucggggguuuuaagccauagacaauguucauuuagaauuguuggugcuguuuaacaguuaugaugaagaaguauguuucauugccagggauauuuuuuaaacaucuuauuuuccugaggucaguagccucugagaagagguuuuccagacuacuuuuuugcuuugccuaaacugagaaguacuggccacucaccacaguaagucuuggucauaagaugucugugggugagcauccacugcccacucuauuguauuccaaggugagcaguaucccuaagugagaagucucccacguuuaaugucuggauccuaucauccagguucucagcuagcccagagaugaauuggugugucugguuuuagaugcuucagaaagaagugcucuuuuggcuucuagcaaagccugacacucauuuuaggcagaguaagucacugaguggaacacuugagcugucgacauagagacuuguggacccucugcuuggagucuuuguaggcuucuuaaagcccccguucccugcuuucuaugggcuuugcuuacuucagagcgcuuacuaacaucauaagaccuugugagcuacugugcacacuacaggggugucuugagaugauagaugaauucuagccuugauaaagcccccucuuuucuuucauacaggauacggaguuuauuaucaagugguuauuguguuuuagaccugcuugucucuucguuugaucuuuacaccguaagcuggugacuugaagaucauuuuuauuuucuauuugaggaagcuguaggaggaagggagcucugauuuucagauuccugccaaaguguguuuccaggucuauguuccuuuaauaucauguccccuaaauugaauggccuugcucugucccauucuguuucccguggcuuucaugccuuguaaagauuccuucccaggauuugggguccagcuccucaccuuaucacuuggugagcacuugaccauguuaguuuuuuucugagugagggacauuuugcauaccaguaaaauaggggaaaauaauucuucuucccuaacuugguguaaaguguaguagauagagauaauuucucuggggcuggaaaaauggcucagcaguuaaguguacuggcuguuguuauaggagaccaggguuugguuucuaacacccacucgguggcucauaaccuuccauaauuccaauuccuggggcccugauucucuuuucugaacacugcaggcagcaggcauacaugugcuguacaugcaugcaggaggcaaaauauucacacauaaaguaaaagaaaccuuagaaaaaaaaaucaaaggcaaugugucugcaaacauguuauuucgugggcauguaguuuaucccaggucuaggcuagaaccuccauuaagucagugacauagacagacagucuuaccauagagaagccugcagaccugugggcaugucagggcaaacuuaguguggugguuuaauuuuguaaugcaugucuacagugcaugaaggccccauuaauuuugacuucagguuuuagauguagccuuaauugguguuagguuuuccaggguccuaugguaaugauuaaagacaggcuccugcuuccuucugcauugcugggguacagaggccccacacucuagaguucccuugcucuccacauccuguauguggaggaaggaaagcuccugauucuuugucacugucccaccuguuuucuuuuucucuucuuccugccuuucucugaguucugaacucaguggaauaccuccuuccugucauaauagcaugcucacuacuucaagucuuaccugucucugguaaauuuuccuuuaaguaguuuguuucagaauuauaauuguuuauauaggcagucaguucauuucuugagcuauacugcaucccugaacuucaguaucuauccuagacacacacauacuugcuuucaaaugugucuuguacuaauuuggacuuacucucccaucuucucggccugcucauucucuucuaccuagcugcuuggcauuuuccaguuauucuucuacacguucagaugguagauuuaaggacaaacacacacccucagcucuccauuucuuguuguuuccauuucuuguuagaagucuccauugucuuaucuaagcucagcuagccucuuuucuuuggccugucuuuuggagcucucuccgcguuucucuuuccuuaccugcuguccucauuacuccuucuugguguguguuguuugcaucgacugcuuuguuuacaucucuguuccugaacuagugaugcuagcauacagucuaaucaaguaaggccugaaaacuuuuuugauagccaccaaagcauuuacuggugaaaugagcuguccaagauuuauuuuuugaauuuguggaaacaaagagauguaaaggagauuggggaaagucugguagguggaacagggcugaucagugugcugauaauuguugaagcuggguaaucagucugacaaggggguuauaaugucacuuaaauuacuguguuuuugagaaauuccacaaaauauuaaaaacagcaaauucuggcuuucuguugcuuaugguagagcauuuucauguuccuuccccacuccuuacauucccucugaugcccccaccuggguaauuugacucuguuucccugacagcauuauucucaaaugauaaaucaacccugcuccccuguucuaauagcucaguuugggucuucccaggucucucguguuuauugucuuucgagccuauagauuaugcuguaauaggcuacaccccuaccccaaggacugagucuccuucagcccccaguuuuucaguguaguaaugcuugcugccagguacuugagugcuugggaguuaaaggacuagcuacuucugguguccuguggagagacuagaagugucuccuuggagguaccaucacuuucugggccuucucaggacuguuccaggguggagaggcccugauuucagucuguuuauacacaagcagaaaaggaaacccagacuauucucuggaauugaaguucauauuauguggagaugcugaacuaaacuauggcauaaaaauguaagauggccagauaccagcuugccagcauuaaacuguucucccaacuuuugucucuaacaauggcuuauaaaaugauuaagcuucucagaauugugaggucuuuucucuccaacugaacccgacuuuauuuuguaaaacuggacgagggaauuguuuuuaccaguacaaauuuguguaagaacagccuucagccagccucugccagagcccaccuuagagguuacauuugauuuuuaaggugagcauagaaauguucccccucuaauuaccauacugcaauacgcccauuauugauaacuuaaugauuccaaacuaaacaggacgugagccugaagguaaaaguagaaaauguuuaaaaaugcucagaaaugaucuucguucuguggccuagagauucgaaaagcaagguaugaguuaaucacuguuuccaaacacaugaagugcuuuuacauggaagguggugccagcuguuagcuauuugaguaaaaauaaacaaacggacuuagguugcagcuggagggauucuaguuagauagaaauuuuucauuaagugguucugggugggaacuggguucccaucccaguagauuguugacuuagguccagauuggagggcaguggggugggcuugaggaauucaugcauccugaaaaucaagcuccgugaagcagcugugaaugcccuccacgcucugagcagcacaccgagagccccucagcccucccauccucgcccaaguugaaagaaauuaaccucaauuaaaggaaauagugauggauugcuauggagauaaauaugauauaucacacaggaaaaacuacauuaaaagaacauuaaaguugggacagaaagcaguaaaaaagugaagaaauucacugcuaagggugaaaagugauaucguuuacaucucugcugauaaguagaccuaacaggaggcacuaggaaguugugagcaugcucugauuuggaaggaggagggcucaguagacaguuucauugccuggauuuaagcagagcucaucucugagugaucauagcccauggaggaaaagcuguuccuuuaacuagaagacuuagggguuuuagaguuuggcuguggagggccagguuguaauucugcaccacagcuuuucaauaccugagaccuuagcuuuagugucacauaagucaaggacuccuucugaaaggcuugguuuaauuugugcauuuuagacauugauuaacaaguaaauaauuuaauaacagguuuaaugauauuagugccauugugacuucugaauaaaaaaauuuagauuguauucauuucauaagugggguuuugaauauuuggggaaaauuaggguugugugguagagagcccuuacucagaaucaaaucuaaucaccauuuaaauuuaaaaaaccauauugugacacuagaaaacuucugauuacuuccaguuuuucuuuaagguuugucuguuuauuauguguuuacaauauuaggagcagagaucccuccacaggcucuggaacacuuugcuugugguguagaauguaugcgugacagaucuugaagaguauaaaaugaacccuuagcugcuuugucccuucuucaaguaaauaaagaguaauuuccucuccuuaaaucaagagcugggguugaacuuguuaacuuaccaacccagauggcagaggggguccugugcuuccugaaggcaggccuggcucgcucgcucccucccucuccuucccuuugucuucccccuccucuguguucccuacuauuuccccacuugcucaguucccagaacuccgaguccccuuuaccuucuccucuccucuuacuuccuuaccccucuccuuugguugcucccguccuuuuggauggggaggaauuuugaguucuuucauagacgugcucauuugagaaggcagaauuaacccagcuaccgaaucauugcacugaugagaacaaugaugagagaacaauggaguuagcgaauuuagauacucuuggucagcuuucugcuaccauagccagugucagaguuagucauguuagaggaaggguuuauuugggcucaugguuucaguucauggucacuggcucuguugcaguggcccaauacgugugugugguacaguagaagaggccuguucaccucaugggaguguagagaggaagaagcugagauucuaguauccccucaaaggacccacuaucagggagcccacauucucccucuaggagccaccuaccaaauauccaucccucccaggaacacgauagguuggccaccaagauuuuucuguguagacuuuugcaaaccuagaagauucgaacugaaguuaauauaaaaaucuuacuauuuuuuguugucuagaaagagaauuuguuguuuaguuuuagagguacuauauguaggauaguaacguuaggaagcauauuucuguguugaaguagguaaaagauuuuacuugugcuuuuugagggaugaaacaugagcugcgguuacuaguuuuccauuuguguuguguucaagugggucuuauacaggggucaaugaaauuaccuuaagugaaacaaugauuagccagguauucauggcaugcagaccugagcaauaguaauuugugugugugguaggauauauauucauaucuucugucacagauguuuaggucgaguuacuuccuaaguggauguuuauauuucugauuaauuuucacaaccuuccuaaggcuaaauauuuagaauugaagucacuuuuuccuucaguguucacuuugguacauuucgauagccuguuuuuuaacacaaaauaaaucugugugccugucuggaguuuuaaaugcauuauaaauguuaugcaucaucagaaguaugcaaacauguuugacaacacaguauuauauggaagcaauuacuggcagugacugagcuacacaccccaaggaugggguggugccaaaaaaaacuaaagguuucuaaacagaauuacuuuugugugggugggaaagagagcaaggguaacuucuauuaggaaccaauuccaguugugauuuuuaauucuaaucacauauuugauagcucaaauaaaugagugguaaagagacuucauguuaggguuagauuauuuguucuucucuuaguggggaggaguuaguuuuuaccaagggaggacagggcagacacaauuauuaaaaaguccagcguucaucuagcuuuucuguuugcugacaccgggccgcgccuaaagaugaucuugcugguuuuugugccaugaguguguuguauucaugcuuaacagauguaaaaggauggaggaagguuagauuuuuuuuuaaucauuuggaaguaacaggcucugcagcuuccuccuauuaacuaguaggcagaagaacauagacuggauucucuguucuguccccuauauuucaauuuuuguuuauuuuugaacgucacaucagaaugagauuuuuaaaccaacgugauuugcggcagcgucuuuagaucuuaaccguggagagaaaggaaguuguuccuguacaaaaauugguuuguggcugccauuuuggagaauucuuuguuuuuacuggaaagagguuuaaguggauuuuuuuuuucuccaaagccagugccacucccagucggagagauguuuuguuggaguccaggcugagcugaacagcuguguagauagcacaggggcuuguagccccuuaacuggugucagaacaucguuguauugaugagugaggccuggucaagucacuuaaccuuucuuccuugguuuucucuuauguagacuggaaaugauaauaucugccuuugaucucacagggaugcuucaauccauuagagucauuaaagcacuuuaaguaagguauaaggcacuagaaucaaggcgccuucguuauuguuaucauuauuguuauuuuauuacagugccauauacagaggaggaacuuauuaauucuaaauagucaggucucagaauauguuguguggaugugaagaguuagugggggccuucagaggucagguuucucccucuuuuguccccagugcuuaggcacuguuucuccuuaccuccauuaauuuggagaaugcaaaaauuguaacaaaggcaaaaaaaaaaaaaaaaacgcaaaaaugaacauagaaagcgaagaggcagcaaucucuuccuuaggauccgauccugugaccuucggaccuccuaaaauggaaucaguuugaaggcccugcuccacuguucaucuccugucugugaaaagaaaagaauguucagggguucuaaagugguuucaaaugaucacgcaaccacccucccaccugccccccacccccagccugccagcuugacuuuuuuuuuuuuuuaaaguacuguuucucuagcaaagaccaaagcguuuggaguugauggguaaagaucuccgacugucucuggaaagcguucaaagaccuuuuguacaagccgauuguguuuccuagaucagccccuucuggcauuuugucuugaguguuuccuuccucacaccucauauacugucccagaaggcgauggacuuccauauggccuuggguggcaccaacuugaugucuaugaaaaaguggaagauggaguucuauccagaacagagaguuggcuuccugggucuuugaucucacagaugucacuguucugaaagaaccuaacuucuccuucaugucucucugcucccugaagcugacgaaaacgcucuguuccuucuuugucugccuucuuauucacuaauacucuggguacugagauuauguuuagucccucauuucugagcugauccaucucaaaugcuuuugacgugguggcguguaacauuuugacagcuacaaagcacuaacuucucaaauaggagucauuauagucaacacauauagcccuuguaguuaacaaccuuauaauuaagauaggugagugucagagucuggacugcaacucucuacauagcccuggauguccaggaacucacuauguagcuagacuggccucaaacucaacagagauaugccugccuuuauuggauuaaaggcacauauccuggcuuccccucccccucucucccucucccucauuccccccuuuuuugcuuuuguaaaacuuuuuuguccaguaaaaaggugauguuggaaacuauccauauuugauuacaagcacugaagaauuuacaauccccaaauagauaaagacuagaauaaaguugcucuaaccuaucauuuauuauuuggguuuuaugcuaguuauuuaauaauuagaauccaaaaguuuugacagauaugcugcuuuuaaauuauggguagguuuauuuguuuuuuuuuaaacuccuaauuuuuuuuuagauuuauuuauuauauguaaguacacuguaauugucuucagacacaccagaagagggcaucauaucucauauggaugguugugaaccaccaugucguugcugggauuugaacucaggaccuccacaagagcaguuaguguucuuaacugcugagccauuucucuacccccccacuccuaauuuaaaaaaaaauauauauauaauuuaaaggcuaacugaauuuuauagaauugauuuauuuguauagagacaauuagaucauguuuacauaauaauaaauuuuucuggaauaguaaaguuaacgugaaauuguaaaaguaaaugaaauacaguuauugugguuacaauauuuccagaaucaagaguaaucucuuuuuuaaaaaaaauuuuuauuagauauuuucuucauuuacauuucaaaugcuauuccaaaaaccccuauacuccccccaagaguaaucucuuaaguugcaguuggccuuugcucccucuacaucuguagaaugugacacacacacacacacacacacacacacacuuaugaugauuugguauugaucagagucagacaagcuuuuucuucaugguaaucugcauucauucauucauucauucauuuauuuuuugaagaguuucagcaggacucauuaucuucuucccuguugucauuugcuccucagauaccaugugagcaacuucauuuccuguuacauuuuaaacacagguaauugcccaggccaccuucuccucugggcuccuucaugucucuuugagaguccauaugugaccuuacagacagugauaaguuuccuucauucccuggugcaccugggucgauuuugaagcagauagggugugagcaagaacagugccugcuggggcugcgggaaugggggagcaaggaguagacagugagggauccucuaggugcucaacuccccgcugcagccagggucuaaggagucuucuuuagaguuuguuacugcuucuguucacuggccuuuucccaguaccguugaauuccaaggaauaaaauguaaucggcuaggguugagcuuugaaggaccauaaacugauauuuugaagauuuguguuuuagccccagcauguggacggagaucaucuuaaacaccuuaguuacuuauacucccccuaauacugaguauguguccuaagagccaucaaacagagauggcauuuggauaauuacuaauugcccugaggagauuauacugaauuuauguauuuuuccuuuggucuuaaaugggagcugaacacuugguggcauacugagauguuguuuuugguaacuuuauggcauuucuucucccaguagaagcaguuuauuguauuuuucugguuauaaaaguuauacauucauauuacaaguuaaauuuaaauauaccuaacucaugaguuucugauucuaaaaguugaguuauuucauauuuaugcaacuucuguucuuuaguauuauugugggaugccuacacagauuuaagauauacaaacaauaggacugguuguaaguaaauagccugguggagaauacaucuugaggauguguguugacacuauguguaguauguuuuauccccuguuucuacggggauuauuaacacccauucacacuauucacacugaugcuagugaggaaacuuacauucuaaccaaaggguaagaagucuggguaaaacaaauuggaaaaaaaaaaucuacuuaguggagcuuuuguuuguuuguuugguagauuggauuuuguccaaaaggucuuaauaaaauaccuuucuauuaaaguccuuucaaaugccauuggcauaguaaguucaugucccugauuaaacaugccuuagguaugcccuuuaacuuuucuaugggggaaaauauuuuuauaacaaagcaaaaguauuaaguacaauugguacaacaucuuaauucaagugcuuaaaccacacuucauaacguugaagugugaagcuauagccuauuguuggaguagugacauguaauugguacacucucucuacgcugcuuucugguguaaucugaaaauuauugccaugaaguugaaguaugacaacaaaguuuaggugacuucguuuccuagaauuuaaucacuuuaaaaugaaaacaaaucugcugaggaaucacuguguagagaacgcccccaagcugaccacagaguauuucauccacccaagugaaagauaaauacauuuuuaaaaagaauuucuuauaaguguauguaugugugacuaucaauaaaauuaauugaugguuugaagguuuuaauuguggugacaagguggauacaucauaccauaguuagguuuauuauacaguuaggaauacuguuaauucuuacugugaggaugcugaccugaaaacuuuacauggcuugucuggucaacagcacaguagcuccucauuauguaaaaauuuugagaaccuguaaaauacaccaaggacauguuucugugugcaguuaaaaugcuugaugugcaagcaugaggacaugaguguagauccccugcaccuacauacaugucaggacuauaugacagcgguccucauguaauuuuggugcuugggaaguagugacaagugaugccuagaauaaacucaugaucuagacuaagugaauuggugagaucuggguucaguugagagguccugcagaaugaguggaccaagcauccaacaucaaccuuggggugugugugcacauaagcacucacacacacacacacacacacacacacacacacacacuuuuauauaggcaugcacaccacauacauucaaaauaaaagagccugcaaaucuuaaccuuagagauguuagagcugugauuaaguuuaagaacauugagauacggagguacuccugagugaucuaaauagaccuaauuuaauugcauggguuguuaagaguuacgaagcuuuuucuagcuauggugagggagagagcuguaauaauggaagaaagaauggucacagaaucagggggccacgagccaagcaauacagacagccuauugaagcuagauaggacugggaagcagauugucucuuagcaccucuugaagaugcuacacuuugaguuuggcucagugagaccuguccaacagaauauaaguuuuucuuguuuaaagccauugaauuuuuguuaacuugucauguugaccacgaaccuuauuguuuuuuaaauuuguuaaacauuuaucaaaauuuaaguauuauaaaagaauaaaaacuauuugguauaguaaaaaauaugugguaauuuauaagacuuccuuacauggagucugguaacagcucaguuugguacucaaaugaauugaauaaauucagaacauuuucauagacagguuuuaucuuuuaaucaaagguuggugggccagggauguaucucagugauaacauacuugcccagcauaugggaggccuguguuuaucccuagcauugagacaaagaaaaaaaucauuuuaguagugucaugguaucaaauauauaaccaacauuugaugguugcugaaaagagcaggguuucauugacaguugcuuugguauugucacagcuguaguuuugacaaaugaguuugaagacauacucaaacauaacugguuuugucauacagaagaaacacuaucuccacccuugacacaugagggcauuucuaauucugucacgcuuagcaauugucaagaaauuguauaagggcuuacuggacacaaacuccagggccugaguuuaucuguuuucacuuaguacucuucagaaagcaggaguggugaggugguggaauccuucugaaaauaguuaccuauuuaguagucauugcaaaaugacaggauucaagauagucuacuauaucuggagaucuaagauuagaguaauuaucuaauagguaaguacaugaagauaaaaugagcuuuaaguaguuucugucccuguuuuaccuagcuuugaaggauacccuaggaguauuuaucuagucucuuuccacuaguccuggggauauagguccaaagagcuuuaccaugguuguauguaguggcccaugggggagacagaagauaaacaaauaauuaaguucugagaauuagugcaggaggccuaggcaaagaaccugcauaguggcaagaaagaggacaggguuuagcuguguuuuuaauuuguuaaauauuuaucaaauuuuaaauacuauaaagacauaaaagcuauuugguauaauacaaaauaugugauaacuuacaagacuuccuuacauugagacugauaacagcucauuuugauacucgaauggaaugauuucagaacaccuucauagauauuuuuugagauuuguaugagaugacugguagaaacacuggucacugggagaggagucaggugaucaaaacugggaaaguuggcagagguugaaaaucauguuccuuuuagaggaguuaggaaacccagauguaauuuaaaaauuaguuagaaggagaaaaugcaaauucacaaagcugaaauagggggugaaaguggguacgugcaugugugugugugugcauguugggauguagcuaguggacuagagaguaggugaauguagagauauuggaaggagcuagagacugauuccaugacaaaaguauuagaacaacaacaagaauuucugggaaaugcaauaauccugccagcuacagaagcacaaaacacauucucaucaagaaaggacacaguagauuacugggcaggcacugaaagguaugcacauggaagguagcucgaaccagcugcacaguuaggggacuguggcuuccauuuuauguggaaaaguagguaaaaauaauaggaugauaacaguguuuucccuuugggauagucuauuccaaguuuccaugagggcauuuggauccaagacagucauuuauucauauguugaguugauuugcuaaguaacgaaucuuacuaucucuauacugguguuaucacuauacuguaaaucuagagacuggguucaaucccuagagagaucuaucucaguuccaaagguuagaggaaggacuccgauacacugugucuccaaggaaacacuuguuuuacaaaauuaaggaaggagagagagguguuuuauaaaaggagaaagucauuuccgaguucagagugacggauggcaucauuugcuaagguggggcagaguugagaagucagguaugaaguugcugcuacacagggccuuggagauagauuucacuaaaaaauccaucuguuauauagaaagugauugucuuagaguuuuaaugcuaugaaaagacaccacgacaacucuucuaacagaaaauauuuaauuaaggcuggcuuacaguuucagagauuuagucuguuauggucaugguggcuaacacagcagaaugcaugcagguaggcauggugcuggagaaggagcugagaggucuacauuuugauccaaaggcagcagaaggagacugggugccaugcuggacauagcuagagcacaggagaccuaaaagccuacccacauaauaacauacuuccuucaacaaggccacaccuacuccacaaacaaggccacaccuucuaauagugccaauaacucccuagggcccaaucauuuaaacauguaagucuuucaaaccaccacagugauguaggaugagaauagggcuuugugccccucaacuagguggggcuugggaccuggcuggguguguaggcgugcagaaagugagaggagaaaggagaagggcaugucuuuuucuguguaaucacagauuuaacacaaguaaaucauccuuaagugguugauccaggagucauaguccuagcagcggcuauuauuucuaaucuuuuauuacuuuuccugaacagugugguugaacaauugggccgccaacacuuguaguccagaucugugccuuccacauuagugugugugcuuagggguuccuccccuuggccuuucccugcuuuacucacagaguuguagauucucggggucucuggggugugccgacuguuccccugcuccugugccucccuugagaccuggugucuaucguucugucuugcuuccccccuuugaacuuuugcuuauuuagaaauauuuucauuuguuuccacacauaacuuguagauguuuauucccccgcacaguuagguauccguuuacuggcuuauuuauuuggucuggaauguguuggguuggaggccauagcacagauucuuugcucucccaggagaaugggggauacacagagaaugguuuuguguggcucagaagugaaggugaagggggaagugucuuauugggaagaaauacccaaguuugaguuccaggugugcguccagaguagauucacuuaaagauuauuuuaguugcugcagcacauugaaaaaugaaauauagguaggaaaaauucucauuuguaaaauguuuuuugaucuaguucaauuaagacugucugccaucuaccguacuagauagaucaguuuguguauuuuuugcccuggaaccaccugccuaaaucagccuccuguucuaguaaaucuaaguagauucaaagaagcagggguuggcuuccugugacaaaauacuucugcugacugggguccggcaaauagaaaaguaggaagagauggcauucaggaacaucuuuccauuuuaugacgacaagugucggggaacugaaguauaaauacaaucaagagaaagcaauggugguguggacagagacuuuaccaacuggcggugugaaauauuuggugugcuaacaguuuuaauggguuugucuuagacaguucuucugccaugaaggugucgguuaauaauuuacccuucccaagaggcagaggcagcaaucauaggcugugagcaggcacucuggguccugucaucugcuggagcccaucuugcuggcuagagucaugagcccuguugguuucgacaggauaccaugccucugaacguugacaaaugaaagcugcagagcgcuaaauaaggcagagauguuuggagugauuuacuucaagcaguaucugaaguaauggguuacuacuguagcuacccaucugcucugcaucaaaaaggauguaacucuacaucuuuugaaaaaaaaaaguuuauuuugaaguaggguggagcuguguauggagggaagagaauauggcagggagauaaauuauuucuacagaauauuuaugaagcuuuggagaaaggacaaacugggcuuguugauugauaccuggaauauguuuuuauugucuaacaaaauauuggaugcagcuguacauguaagacuuauccgcugugugugugaucaucagugugagaagccggagcguguuagcccuugccauacacuguuuugaugugauaguaagcacaacucugcuguaggcuucaguacaauuuaugugaauuguaucucccuguuuagucauugaaucauauugcaaugucggcaugguaaguuuuguaauuugcuuuccugugugaagagcacuuuucuucuacugaagguucauugcugcauacuuuuuuuaggaggguugggcguuaugucauuacaaagauuuacaguuauuuaauaaugauuuauuauagucauuuauucugccagcuguggcacauuuucggcggaauuuguaaaucaaauuuauauagaaauuuaccaggacaugcauuucaggauuuaauaaaauauacucuaaaaucuuuuugaagugcuuaguuucaugguaacacauuugggauuagcuuuaccuuaacaaccauuguuaauguucagccucugccgugucuuucccacaaccacugcaaagaggacccuguuaagucuguuaaaauaguuucugguuuauccacuugacuucuagacuguuagugccauguuguauuugaccugggaugcucacaugaccuuaaggaacaugggagcaucuugacauaaggcucucugcaguuucuuaaguuugaaucacuacuaaaaugcucaucuagaaccaaacugagagcauauuuaggagguugugggagccccuuccuuugcccagagcucacuggcuguagccauguaggcugcaucgugucuugguucauuuggcaacucauacuuuuucuguuccuuuguuauauacaaaaugcuaaguuguguuucauuuuuucuuuuuaaggcugcguuuacuugauggccugucuuucauuguugucuuuuagaagaaccagaaucuaaaaguguacagggucugcugugauuuguguuuucuuuucagcccaccagcuuuagaggcugccuuugauguguguuugccacguuguuuguaaacgugacuuguuuuccaagccugcaggagaauuuuaguucugagauuaaaauacuaagucaccuguuuugugugugaccucaugaaaccuuuugacuacagggcugguggcucacuacaccuugauggcguugaucaaauguuuugauauggcaaugacccucuuuaauguuccuuaaaguuucagccaccgauuaauuauaguuaaagguggagguuuuggaucaagagggaagugaaaacauuaagaguauuccagauucaauuuuuuuucuaaugguuuauauuuauuuaucaugcuaggcacuaguaagucagaaggaauuuaagcgagaaacaaaggcuucccaaagggcuucccaccugaaagugaaccuuugucacucagccucauuuggacuacaagggaacaaugacuucuaaauuaggggguuuaaaaaggcauaauauuuaaaagguucuuagaaacauugcacagcaguuggauuuugccuuccgaugggaauucugucuuaaguggaaucuuuacacuguuauauuaagaagagaauaauagaaagacagcuuaguggucgagagcuggucaugcauguucgagguauaacccauauccacccacacuggcaaacaucuuuaaaaucguaaucauuuaaaauauguacauaauaauuugcuuaggaaaacauaccuugaugaaguuaauauucuagaaaaaccuuuauaucuccuuaagagcuacgacuaagagcaauugauaaaccuguaauauaagagauaaguuuuaugagagagaacagggccugcauuucuucgggcauguagagaggccuggugguccagcccugaccaagcacucuguccugagauauagccccagccagaagagaggcucuucuugaagguuuuaauuugugauauuguagagguagcacuugcuuuccuuaaaagcauuccguguguuguggugaggauauccuagagggagauggaggucuuucuguuucauugucucauccaaccucaaguguucaugguacccuaggcagcucaccuacagucggguaaauaggauaggaaaggacauuuagaagcauaucuucguguuucuggacuuagcuuggacuuuuauuaauucauuauuuuauuuuccuuuuguuuugaucugaaaaucuuuaaaauaugauaauaaguagaaacuugaaaagaagagagaaaaaucagcggugaaagaugcuucaccuuaggaccgagucuugacuggcucaugauggaugcucugagaggaugaagagcugagggaaacaaacaaaacaaacacgcggugcucagucagcaaaggcugccagugcugcugagggagcagcccagagacgcacacccugggcuuagccccucuccuuauccaguguucauuccuucauccaaauuuccuaaauaccuuugaauacugggcaguuugccaaaugugguaagaauauagaaguuaaacacuugaauuugcuuuuaagccccgaugaguaggagguuuaauuguuuguuaacaaaacucugaaaugggcugggaaccguuauaugggaacaguuaccaccgucugauucacacacacugaguuuggggccugaguggaaggcucuugaguguggaaaaucaggaagauuuaagugcuugugugagagaacacacauguugucugcguggguuugcuguggguucuggagagaggcuccuuccuagagagcaugggcaggugauccccuauccagauguauagacugggagaagucuucucuuucaggacaaagccauaaguacuguuguuuuggaaggagcuuccaguagaaaaaugacaauaaacuuaguaccgguacucugcuguguuugauuugagaaauuaucuugagguagaaauauuugggcuauauaaauacaaauacugauacuuaaauuuuucuguaaacuaguuuuuugagguacaaugcaggaucuuuuuaaaaaauggaaguaccuguaaauuucuaauuuauuucuucuaauugcugggguuagggccucaggugcuauugugucaugggcuuuauuuuucuguuugaauauacuguauuuccaaguguugauauacuuguagcguacagaaaaacaacaagcucgcuuguucuugcaccuugcguucuguggggauguggacguacaacaccgccccacccccgccaaccgaauacuccagcucccaugucucucucucuucuuaauauguaaugcccaucauuccuuaggaaaccauacagcuugccuugacggcuugaggagcucgguucucaguucaaggccugugcaguuuaccuguguaaucucaucucuuauuaauaccuugcgucuguccaagcuaugaugauccccgcauuuccucaugcugccuuccuguuucgagcgcugucacaaguccucucaggaccaaauuauuucugcugcguucauacuucagcuagugacacuugcacugacuuggggacuucuuaagaaaaaggagcgacuauuuacaccuucucuuuccacuuagugucugcacauggcugcccgacuaaccuguaagucaggaaaugaggggacuuuguugaaaaugguacaacucugauggugugggcaguguuuccagccuccuccagagaauaaacaaaguugcuaagauuuuuuggaccuauaaguccuguaauucuauuugaucaucuguuuguccaggccacagucucgggcccuucuuuccucugucccucuuuuuauuuuauacuuuuagacauuaauaacacacacugugagguucugugccuuuugugguuguuuuuuuuuuuuuugggagauguuucuucuuagcaccuacauuuucuuuuuaacagcugcuuaauauaccauggaaaaggaucauaauaaauaaaaacaaaagauaaaagcaugaaaauuuguacauguuagcuauauaauauguaacuauaacuacauaaaaggauaacuugauagauuauugaauuuuuaaaaaugguauauucccagauuuccuuugguuugaacucuucuggaaaauaauuuccccaagcccuaaagauagcacuucauguuaagugauguucacguugaaaaaacaguugauaaagaaagacauuugcuuuuuaaagauacaagauaguauuuaucaauuuucaagggaauucuuguuuaaaaaauaaaaagcagacaccacagacaauugagguaagcacaugcuuugaaaauaaaccaacucagucuuacugcaacaagauuuggccaagugauuucauccugcuagcuucaguuuccucaaugauaaggugugaauauuagugccuaccucaugaaaauuguaaaggacaaaauuaaaaguauuuuauacaaauggggauuguauacacacacacacacacacacauaucugagauaucucuuguucucuguguuaacaucaucugacuuaacucucagcugacuuuggcagcaaauaguaucucagauacuguacgucuuaguaaacuugcuuggauugcaucauaggcuuauacaagagcucuugguccuagcuguagcuuuucuugucuuacucucaucuuuuuuauuucuuaucucuggucuucaacucaacaccuugucauucaggaucccuguccugcuggcucaggucaagcagauggauacuaaucuacucuaguguguguguacacauauacauauauauguauauacacacauauauauauuacuacuauaauauauuauauacauauauaugcacauaggacuuaaaaucuacacuauuaaccaaggucauaugaccucagaaagaaaugagucacaucuucucuugcaugcagaaucaagucaauaauguauguguagauguuaacagauguacuuguggauucaauguaacaugaagauaacaugaagaaaagcucaguucaaggcaaugaagaggucacugauguucagaucauugaugaguuaaggguacaggguugauuuuuuuuuuuuuccgauugaaauucugucauggaucuugggcuggguuuuuuuuuugguauuagauaaguacauaaaauauauucaauacuuaaaaguaaaauuuaauaugaagcuucauagauucuacuuugaguugcaauucuaacagaauauaaguucauuaaguugcauggacuuugggucugguauguagugguuuuauuuauuugcauuuauauaauaaggcuuauggaaagaaaaauggaauguauauaggggaauuuugguccuuuucacaguaucuggcauacggcaggugcauacuaaauacaggguaauguucccuagacucugacuauuuauagugauuaaugugggaagaguucuuguuacuggauuuuuguccaacuucauuuuuauauaacuugucacuaugccuuauagaauaagagaucuuagccaguggacauauuuacuuucuuccuuaacucuuuaaguauaugauuuggcuuugagaucucuagaaaacaggauguggaaacauucuugauucuauguaccauauaaaaugcccaaugcuagaguuagccgaaagucagaauaucuaccagugguugugcuuguaaaaguucauugucuggcucauggagcuauacaaagagcuugaauuuguccaacucuugaugacuuccagucuugccuauuucaaguucucaguuuaaauacgacuuggcuaugagguuucuugaaaguuuaauauuugcuuuagucaagucaguaagagaaacucugguauaccaugaguucucagcauuuggccacugcuuugaacucuacugucaaaguagugugguauagacccaagcccugcaaaaugguccuuguucuguuaccaacucauuuuguguuuuagccucaguuucccugguuauaaagcaauugaauuaaauuaucauccuccagccccggcagggugccucagauuacaaaggcucugcccugcucuucccccauguucagaguucacauccuuauucuucagagaaaagaucuccauugauugaaagcaaguauguuucagaacuaccuuuacagaauaacucucacaaagccugugcauacgguaauagcagcagaggcuagcaauggaaaacauuuggagcugugcauaguggugcacaccuuuaaucccagcacucaggaggcaggggaagguggaucuuagugaguucaaugccagccuuguuuaacuaccguuuuccuuugugcgugggaaugaacucuccauauguaguacuugaauggcucacagagccaggcaaacaacaaaaugaggaaaacaggugagggugggggaggggugccugcuaagcagacaguagcuuguguuccagcccagcuuacaguugcuguagaggaauguuucugcugcaucuucaguuucccaauacuuuaccuuuugccucacuuuaacucaccccuccacccaugcagcugagaacuuguauuuuaacuuuaauauuuauuggacuuuauauguugcccauuaauuaaaacacaugaagccaaacaaaaauguucaaggccaucuaguuugaaaucugaacauacacacacacacacacacacacacaccaucuaguuugaaaucugaacauacacacacacacacacacacacagagagagagagagagagagagagagagagagagucauauuuguugaguaucuaugcuuagaaacuagguaaaccuuuuguacuaaccaaaguauuuaguuuucacaacaauucuaugacuuaccucuacuguuacuauuuggagguggaaacuuuggguuaagugauuuggccaguaaguaaguuucuacauauagucagcccugcguuucgaaaaugucuccuugcuggacuucucaccacgauacacaguugacugcugggcacacauggaaugcacaugggcugcuguauggcagagauugcugcagcauacauacagaaaaagcuguaagauaccaguucagugcauagugacacaguucgugcaugcaugugcuugauaugauaaugcacuuaguacuauguacuuucacaucuauaacuuuuuaaauaaagcucagugagaucauugucagguuuuuguuguuguuguuguuguuguuuuaaaaguaaauuuuagucuuucucuuugcugcaagcaaaccagacucacuaagcuucggaucugguaccaucuguguccaagggcaaauacccccuucuccucgccauauguaaaccccacccauggaaaggcuccaagucuugagugaugaucacuuccuccgggcaagaguaugaagaggaaaguaaaucuagcaagaguaguaaauccccacagacacagauaaguacuugaggucagagacugcaucuuuuauaguuugucuacauaccaaacucauuaauaugaagagucaucuuagcaguagugguuguaguagcaaaaauaauacaaagaaguuagucucaguccauguuuuccuaucagcuuucaugaugucuaggguucagggcuaucucuuugaggaagaaaugugaaaucaucucucccaugcuuguccuuuauuucugcuucuuucacccucauaaaauguuuuucaaccuucaaaacucuugccuauaggaauaaagcuauaagauauuaggaagaaaaauaaaaccacuguggaaaaaacacuauauguuuguccauuuagguuguuucccuagggggcuuuuuaaauacuucaacacuauaacuuuuguuuauccuucucuggaaaaaauuuucacuguauauauucauugugcauacuauuguguuaguuacauaagcacauuuuauauacauauaugcuauucauugagccuaucccccgcugcacucccuccuucccccuuuauagcuuauccacuugaugugggauggggagaaggaaagagccaaugccccugacaguauucuucuugacaguccauacccaucaugugaguggaaaguacccaaaaccccauuuucagaacuguaucuagagucucuggcuccugaagaaaaccagugugguuccgaugugggacgggaagagugguuugcguuggcagcggcccugcgggugcuuuggggcuggagcgccacagcuguggguuacagaugcuugcucuucaguauuaauguggccagcaugugaaaccauggcacccacaaugcuacacaaagguccacgccucugauaguuugagaaauaacucccagcugaagacauuucuucuuugaagggcuggaauacauuccagaacagaagguccucuuucagaaaugauagaauuaagcugggcaucggggacugcaucacauguaucuaagggccugggagcuuuaaccaaaaauacaaggcgggaaaagaaaugaagaaauaaacgaaaguuccuuuaaaccuuuggcuaauaacuuccacacuccucgcugcguguguaguacagacuuuguacacacacucaagucauugcgcaguuucuuugagaucacaagugcaaagcagcagugaaagcugucaucugaguuaagguacgauagacauguuucuaccaauuauuaguucgcugacaugagcugucccugaggaugggagaauccgaggccuuuauauacaaaugagaaauguauaugaugcucgguaucacuuaaaguucaguaacaaaaauuaucuucuagggcuacacagagaaacccugucucaaacaaacaaacaaaaaacaaacaaaaaaaauagcuucuagacauaggaauuucuucucucucucucucucucucucucucucucucucucucucgauguauauacucccuucuaaugguauacuugagagagggucuuccaucugccauuguuagugagaauguuuucucauccagguuacaauuuccauugaaauaguugcauacaaguauccagaaguuaguuuauugacucuuauugcacuucuggguaucuaauaaauaauguauuagccugauggauauguggcuaccuaacuauggagcaugaaauaugcacuguuucucuaauacacuguagggagaccuguuuauaaaguauuuaguauugguuuuauaaugcacuguugacaacaggagaccacgaagcucaaagaucaaucucauuuuggcccacaguauuaaugcuacuuuauaaagcuauaugacaggucacuuagacagcggucccuacagaaaggacucuguuaggaaggcugguuguaguggcugucagcacagcagauaaaugucuuuguccaugucccugagguguuucuucgguggcuguugguacuggccaugugauggaacucaucauuucucuggucucuagagggacucuggacuaaaagugcugaguucuccuaauguaguccucacuaauuggguggagaguugaugggacuuuggaucagaagugccuggacauagcagcagugacggguggggggacucaccuccucagcguugucucaugucugcuaaugaagcaagaugcuuagacaucuccucuuuccuucauucaaaucauauaugugauauaguucaaaguauuuccaauuuuuguuugcuuuggggaauuucuuuagccaggaguaaacuuaacagccauuuaaaaaaaaugcucuguauguacuuagaauugggcuuaugaauaaauaaagaucaaauaauuugcuccaaaaucuauuccugguauuuuaauuuuuuuuacaugaauucaucacuaugggaauguaugugaucacuauaguucccagaguucuguuuccuccuaggccauauguucuggagcaaggcauucagaacccuguguugguuuccaggauuucagauuuccgugccaguauuuccaacuccuaccuacacugccuuuaaaaaagauucuuuaaaagauaaaucuuugagaagggggguguacauaugcacauauguacauauguauguauguauguaugugucuggucaucagauccccuggagcuguaguuacagcaguugugagccaucucacguagguauuggggcaagaaugguacacgucccuaacuaccaggcccaugcguugugacugggaggagacuggcuuucagaggcagcccucucugcggcuggcuggcagacccucauggagucugaucuccaucgcccuucugaguagacuguuccuuugcuuuucgccaguucuucucuaguuugugcuuuuaacuggacucguaauaucuguguuucuuuuucaaaacacuaaguguauuuauuauuguuuuaaguaaaauauaauuacaucauuucucuccauucccuuuccuucuucuaacaacuuccauggccccacccuugcuccuucucaaguuucuggccucaucuucuuuaauuguuacaauauggcagggccugaacaaggacaauggggagggggguggguagcagagggaaaucccauggggucccaaccccagacaaaaucuacaggcaacuaagggaugcugagagagguugccuucccuaugcaagaugcccucugauuaguuauucagugccaagugucugguccugaaaucacagauaagcaagcaacacugauuugacugaguagguucuguuuauauauuuacacacacccacacacccacucacaccccccccacacacacacacacaaacacacaccaauuccuguauuucuuuggcuuuguuuuuguggguuugagacaggguuucucuggguagcccuggcugucuuagaacucacucuguagaccaggcuggcuuccaauucagagaucuacuugccucugccuccugagugcugggauuaaaggggugugcgaucauugccuggccuuacugccuacauuucuuauuuuugguuuuuccaaacauuguuucucuguauagcccuggcuguccugggcuuuguagaccaggcuggccucaaaaucagaaauccaccugccucugccucccgagugcugggauuaaaggugugugccaccaugcccggcuacugccugcauuucuuacccgggaaguuuuucgguaucauuccuuuggugucugagggauauuuuuacucccuucagagaaccuuuucauuuguguucuuaccgcuuucucuccugggacucuucauaugauuuucccucuggcuuagaucuucaauauccuucucucaucugacuuuguccccuuugcucacuguagacuuuucuuuuuaaaccuuagguuuaaaauaaacccugcuaacuuuucaagccacauuucuuguacuugguuuucuuccuuuaccauuucugccccuuuguguuuacagacugcacauuccuuugcuccucugauggagcaugacuguaucccucuauaucauuugaugcucccgucucuagaaggcgcugccaaacagaugccuagugucacacuggcucuugugaucaacauauuuaguccugugucugucuguaucuugggaggggguugugugugcacacucgugcaggugccuacggaggcuggaagaagaaguuggauccccuggguuggaauuacaggcaguggugagccaugcaacauggaaacuaacuugguucucuaaagaguggcaugcucuuaaccagugugcuauguguccagcguccuuacauguguccugucuguccuucuuagggccuuaauuucauccucacggugucuuguguguuucucuuuuaucaucagccuuaucugcuuauuuuaccuauuuauuauaauaguucccuaacugaucgcuuagcuucauuauauucauauguuaauguguuguccuacauguacuuucuuuaaaaauacuaacaaucacccugugguaggcuugucuuuuuguagaguagacaugacugauagcuugguggaucacaaaauugaacugagaggacugugggacucuuacccguaguucugucacccgcacauccuuucauuucuuacuacuuuauccaucauacucccuaagcucuagucaaccuggaucacuucucuagggcaaaauugguggccucucagagcccagagcaaaggcagccuuugcuucggcgguuucuuuccccgugucagugggaaggcacccuugccuaaaucauaagggucuacuguuccugccuuaccaccgucucuauuuauaugaggucaucuucaagcaugacuuuuauucuguaguagauuauaaacccgugagcagggaucgggucuuauugugguguucccuacagcuucuuguacucaguaugugaagcuugguaaauaguucuucaacagugaguaagaagguuuauaaugauuuucuuggugaucagaagaagaaaauggaauaaguugggguacuggcuggauuguagcucugugguagaacuuguguuugccagccccggugucagauaccugcuauccaaucuccucucaaagcaaagaauccaagugcggugcugguuugguucuuagcagaaguaugcuuguacacaagaagccacccugaguuugccucucugcccuguugcccaucagugaacuauucugcuauuccucacuguuguucuuguacaguucauguauuuaacuguugguugcuguaaaccuuaguaacugacccuuuuuacaaguguuugagugcucagaggaguguauuacauuugcagguuuuaagauaaagugucuuguugcaaccaagauuucuguaaaauacugccugcagacuauauauaauuucuuuuucuaaucucucaacaggcacguuuugugcccuccccgccuccaaauugccucaguuacaaaucagagggcaggcuuggugagcaagacuggcaagcacauuuuaaggucccgugcugugggguugauccaucucaacuugagguauguuauucuuucuuauuuaagucauuugaauaugcucacauuguuugacuguccuauugagguuuguucccacauaaucauucuuuguuccaaccucuugcugucuuucacacucauaugcgugcuaggaagugaguguguuuaacuggcuucucaaugguuuuuaccucggaagguacuguaugaaguagaauucuguggcagugacugggaugauuuugaucaugauaaaaugucuucuuuuauuucacacccccccccacuuuucauuuuuuacacauaguucuagagaagauuuauuguaaucgucacugcuuuuaaaauggauguguuaguguaguagucuuugaaaauugaaaugugacauauagauuacacgcacacgcgcgcacacacacacacacacacaagcguagacugaugaguuuucauaaggugagcauaaccgggacaucggcuggauggacagacaugcaguugugugugaaaagcuuccuguuggcuugcuuccagccgaggucccacaccagaggccuccacucucccauuuaaaauuuuuuaauuugaaaaaaauucuagaagucauacaaauaugugcaaauuugugugcauguuuauauuuauguuuguguguauaaguauguagcuuguaugugcuuguguaugugcuuguguaugcaugcauguaugcauauguguauauaugcuuguauuuguguguguuaguauguaugcauguguuugugcagguauaugugcucuuguguguguuuauauauguguaugucuguuugugaguacacguguauguguguauaugugugugugcuuguguguccugagcccaaccuugcaacaugguuuucuaguguagaagugaaucucaaucuuuuuucuugacagauauuuaaacuauuauuaugacauuuuuacuggagcugccagcaucucugucugcaguuuuuagaaggaaguaaauaaaagcauuaauauuaucuuuauaauuccacaacuuuuguggucauaggaaaguaaauccccagugcacuccaugccccagccauuggguuuugucuuuugcuuuugcuuuuuauuguuauuguuauuuuauugucauuuaaggaaagacaccgcugauucuuugagaagauuuucucaaagaacaucaacuguggcuugugguagugagacagcuguugucacugcuuguacacacaaaaagauuaaagucauuuuuucaguuuuuagaucaaaacaaaauagugaaauguuugaucuuuuguaggcaugagauuuguacugacugaagaugcuuuuuugaaaugugaaucuugauuccaagggauucagcauuccuuagcauuuuguaacaccuaccacaucuguccauuuucauaucuugauuauagcauuugaguguuuccuugaagugcauuggggaacucagccuugacuggggugucagcaggccccgcaucucagucaaguuaggcaaggucaauuggagcacuuucucuccuuuuggguaaaaucuuuaggucauauuuuccuaaggggaauguuaaugucacucucugaagugaaccuugcuuuagggaccuuguguuucuuuucuggucacauaaagauauuuuuuaaugcauaagguuuucucugacaguguuugucaccaguuuucuuuuuucagugcguaacagcuauuauuucugucuugcgcacugaugugguugguguuccugugaguuaacaucugaguauuuaguauaugcauaaugguuuggcagaaaaccaucuaaaaaugaaggcacgggugcacuuacuuaaaaacugaaccauggucuuguucccuggaaucuucaggcuguuuuggcugaagcuacuauauauugaaaugcccaacucagguugucucacacacacacacacacacacacacacacacacacacacacacacacacguauauacacacacacauacacacacguauauacauacacacaaacacauauauacauacacauacguauguauauacauacauacacacauguauaugcacacacacgaguauuuacauacacacacguauauacauacacacauauguauauacauacauacacacauguauaugcacacacacggguauuuacauacacacacauauauauacauauacacacauauauacauagacacacguauauacauacacauauauauacauauacacacauauauacauagacacacacacguauauacauauacacacguauauacaugcauacacacacguguauacacacacacacacacacacacacacauauauauacauacaugaauauuacaaauaugaaggaacaaguaaauucuaacccggacucuuggaggagaaggaucacgauugagauguuaaucaaagacgauaauauaaacuuagauuuuucuucuccuuuuuauaaagacccuuuaagcuaacuuugaauuagcuaauucauggacucuaaaccuaaauuuuuaucuuaaagauuuuaauagaaaaaguaauagacuauguaguucagaucauuuacacaugacacuugguuacauuuaguuguuggccugcaugaaucaucuuuuuuuuuuuuuaacauagaaucuuuaaaaagauccuucucugcuugaaacucacuaugcagaucacaguggccccagaugcacaguggucugccugccucugccucccaagugcugggauuaaaaguuggaaccacuauguaugcccugccuauugugucaucuuuaaaccugaauuaaagacuucuaccuacauacuugguucaguugucuaauaaacugaaacaagaaaaacaauugcuaaauaaaauuuuuccuggucccuuaaaauugaaaccugcggauccaugauugucagauguugcugucuggaauccauuggcaacuaaaauacgauuguccgucucuuacaaagguaguaauggaaaaaaauugggaaucaguuggcaagcaaagauuuagguguaaauauuuaggugaaucuuaauguaacggugaguaucuuuacguuaaagaagauaauucauagaggcaggcagaucucugugaguuugaguugagaccaggcuuauguauauagugaguuccaggacagucaaagcucuguagaagaaccugucucaaaaucaaaacaaaacaaagcagaaacaaaaaacaaaacaaccaaacaaaaagauaacacagaucuugaucuuuuauuuauuauuacuuuauuaauuauuuuuuguuauuuuacuuauuuacacuucaaauggacaacauuaucaaccaaccaggucuugaucuuaagaacuguuuaaucuuaccuccuuucuuuucuccacaacuugcacauacauuugcuuguguauucacuauguuuggguuuuauguuuuaagggaaacgaauauuuuacuguccucucaucaaauuguuaucugugaguuuagggaaagcaauaaacauagauaacuauauacuuauaaagcaaacacaaaaaaauuggaaaaauuuaaaauugaaauuguuacuagcuuuaguucuuucuauucuuuauaucgagucaaaauuguuccuucuuaacuuugugucggaaaagaaaccgcacaauaaaguaaggauggcaggcuucagaggggaaaaggcugcugucaacuuucuuccuuaggaauauggaaauuuggguggauuaucuguucagaggaguuuuccuuuauuaauucuuucuccuuuuuuuccacuuaagacaucuguuaacauuucacacagaccaacagauguugcaaagcaaguccuacacuuuguucucaagaaaaaugacauuuccucaauugccugccccaccucugugacugagcccagccugcugcuccugcauaauuugcauauauuaaguuaugugccuuaaugcauuuggaaccugagcuuuagccuuacuuuauauguuaaaguuacauuugauuacuggcuaguuuacauguugccuuagucuucugagaaggaaaggggcauuugagaaugacaaccugauucugugcacugagguuggauagccaguuaacaucuuuuuuuuuuuuucuauaaaaugaaugaguuacagaaagcucgaguuguuucaccgugaggaagugcugauugucaugcgauguggagcgucauuuuuauuauuuuggcaagaacagggacaguuuugucuugacaagccauuagaugaauaccagcgugugucacaugaaaaaccacugaucuuuaacccagcucuguacuuaaccaagcuuuggaagugaauugugacuaaaggaagagcaaaggccaguacacugucauuacagauuacagaguccgcuaacagcggcugaacugaacccagggaaucacagguauggcucuguaagccaucagaaguccucaaacuguguacacaaaccauacauuuauuuuauauuuguucaggauuuauguugugguagucauagcuggggggaaaagagagagagagagagggagggagggagggagggagggagagagagagagaaagagagagagagagagagagagagagagagagagaaggaaaaccuucaagugcuuucucagugcagggccugaguaucuuagcacagaaccccagccuuuacauagcuucuggguucccagucacagagugacuaaagaaauuaaauacaaaaacgaaaggaaagcugggucugguggagcacacccuuaauccuagcacuggagaggcagaggcagaggcaggcagaucucuuggaaucaaccuugucuacaaaguaaguuucaggccagccagccagccaggacuacauaguaagaccuugugugugugugugugugugugugugugugugugugugugugugugugugugaacugauggguuauauccccuuaaacaaacaaacaaacagcaacacaauaaacaaacuagucuacuccaaaaauauaugcaauauagcauucuuuggcaugguccuucaguaauugugacuaacuuuugcaucaauguguaauuuucaagaaaauagauggaaaaauccauauucaccucacuguaaaauauugaaaagauaguaaccuucuaagcaguuacuugugggcaugacugcuuacagagcuaacaggaaagaacauacugccuuccucuguuggggaacugcacugcaucucccuguagucuuguuaucccacgcuaacugagaugcagauucuuuguaacuaauugcaccucauugaggguacaugcacaguguguaguuaugugcaaaaagggguuuaaaaguaccaauuuccuguaauuacaacuuuuaauuacuacccaaagugugugcauauagugcaggguuaguauauaugcuugacuuguuaaaauauuacuuagaaacaugacuggugaaauguuugauaagguaccggauagaaacaaaucuuuacuuguagcaacuguaaauuggacuuuagcuauuuuuguuaauuaagguuuaggacuuaggaucuugaagccaguugaguguacggauggcguguuaauaguacagacuuuuuguuuuuuggguuuuuuguuuuguuuuuuuuuaaaacaaaaccaaaacauuucaaauauuaaaauaucauuagucauucccaaagcuguuuacccuaaccuuguucagucuccuggucuuaauaucacugguauaaaagucuuuauagaguccuguaugugugugugugugugugugugugugugucugucugucugucugucugucuguuacugcugaguguguguuaugaggaggagucacuccuaguucuacaguuuauugaccuugagagcucauugguggacuucugagcauacacagccuaacucucagucacagggaaugugaggaacuucaugugaccuuucagacuugugauccucuaaucugaacuacaugacuuugaauuggggaaaaagaaagcaauaauugugaaaaugguauuuaucccaauggccuaguuguaaauaacuuagauacaaaugauuucagaggguuauucuguaaucuacagaguguagagccaauggagacccucagaugauaucuuggugccuugguucuguuguuuguuugucuuggaccugcgucuuuauucaugucucuuauucauggcuagaagaccaucaagguucuacauuuccuuaaggcaggcucacauaacauauuuugggaauaucuacagaggucagaguuuuguuuucuaaaauuuauuaaaagaaggauuuuaaguguaaaauuugcaaaagcauaauaaacauucaagguuugugcuucauuuuaacacauuuaucuauggcuaagucuuugggcuggugucguuauaaggaagcuuuuacccuuuuuuuaacugauuuuaggaaguaguuaagauuuuguuugacaaagaucccucuaggaaguacaguacuguguaauugugauuuuuuuuuuccuugugaaucuuacgaggcugucuugauguuuuuaaggcguggcuacggcaggauuauuuagguaauaauaguucugcugcagacuuguucaguuagaccuugcagucugcgagagacugguuugcauacucuggguagcauuuugucagaggacuguggcugggcauagcagauuuggauguauuagcuagucaaccuaauaacccuguacagacuguauugauuuucuaggagagaguuuaugaacuaaauaaacuugggguuggugucuuaauaaacugcuucucucagucugucacauuuaguuauggaacugugcaguuuagggggaaaaaaggcuaauucuguuacagauuguucacagcagggucuccaaauuagcccuuuguuuuguaaugccaccuugcuugggcucgcguugagcacauuucucaguuuugcccuaaugaguugcaacacugauaauguggcugaugaucuuucauugauuucacuaucacuugcuugucugguaauugauccguugcugagccucuaguuaauuauaucggcuuugacauggcccgauccauggggaauuucaagucuugcagaauaacaguuuuaauaaaagagucuauuacugcaggugcuugcugcugcaugccaguugauuuuuguguuuugugugugugugugugugugcgugugcgugugugcaugccugcauguguggggguuggggggauaccugggaaagaggaggaucucagaacugagaaaaagggguggggcuggaaaaauaggaagagggagugagggagaguggggaaggaggggaaggacaaggagagagggagaggaagcagaagaggcaagagagaacacgcaggcaggcaggcaggcaggcagagcgauacacagugcuugaggggagcgaggaggaagcuugcuauugacaguguccuuaagccucccacaaauaacagccauuagugggaaggucaggagcugagcaggcagcuugacugaggcacugagugccacuucagaaaucaagaggcuagcaaauuuuagagggaguuaaguggguaauagcaguaaagguacagucaccguugacaauugacucauaggggcuuuucccgcccuccccugccaaagaauauuuuuauugaccacagguggacuuaauauauuuuaaggcaacaauucuuuggguucuuguuccucuccuuucagauauugaauuugcuucuuuugagacuuuuuugugcuuaaugguggugaacuggagggaaguuuaacagaaaagcuuucaggagaugucaguucuagaagggaaggcacauuugugucaacauaguguacgcuugcucaucuuuucucauuguccacuaaugacacaggcugccaucgaaacgcuuuucuguuucuuuuguuguuucugagagcaagguuuauuguuauucuuuaguuaagaaggagcaagcagagugcuacauucguccucaguauuuguaaguggcugaagaugaauguuccguacaguggaaguuuaggaaggauggcuuuuuccugcugacuacuuuuaugggguggcaugaauuuagcuuuccauuuugaaguuacaguguuuauguacaguggauuuuguucagcucugcuuuuccauaaauaagggagauaaauacuaucuaauaaaugguuguuuuguuuuaaaacugguuuaauuaaaaauaugaccugcuaucaagguuagauuucaucaggcagggaaacauuauagaacuuuccauagagauccuaaaugaaaaauggcauuuuuauaugcauugcuuuuuaccugaaauaggacaggcuucuuuuuuucuucaucuuuugccuuuuuuuuuuuuauauauaugauuuaaaagauugguguagaugccuuaccugagaacuuuaacaaaggauuuuauucugcuugugagcuuuaagaaaagauauucacuuuucuucucugcuuucagggucucuuuacuuagccuucaguuugguaguuaauggccugaggugcuggcuauuaagugguauauauuuauuuuuuucauauguuuauuguacaucuuccauguuuaacuggaagcuuugcuuguucacccuuuagaauauaaggucaaaucucuguauauuauuuucucuaugaguuuauacgugguuauaaauagcccagcauuacggugugacuuguggcagcuaauauuuaaaaaaaaacaacugagcaaacuuuauguuuuccuccagaugaauacuucacuugcuuccaguauguuuagaaauauuuaagugucauauuuuugcaaguguuaaagaaaagacugguguuggauauaacauguuacagcagacagcauuguuggggaaaauucccagggaagggcccuggcuuccccuggccuugugggcagugaucguggcguuucguggaguacgcacgaguguguaucuaucugugugucuggagagggguuagugcagggugucauuuggugccugacaguggaacagugcagugacuccuagcucugcuauccaaugacaugcaguggcugaggguuugaagcugaugguugggucuccagugcagccugcacaccugacaggcagcuguuaaaccgagcaaaggcaagcuaggggagucacaaucuaugcauaaaugauagggauaucugugcagaaggugcgaaggaagcucugaccccccucccccagaucucccccuucccaaaugaaacgcacaguucagccagcuucuuaacuacaguauacuccugcuacuggcugccaagaagcucaaaaaauccaccuucacuuuucagucagaagaggcagaaguggaugugagagaaagagacacacagagagacagagagccaaagagggcaagagacuugacuuuaagagacuccuguacugacaacuccaugcaguucggaaccagaacaacugcggcugaaccaggguucauggggacauggcaaaacgcugacacuaaccucuuauucagaaugucccaacagguaaguuacuuucauuuuuuuuuuaaagaaaccucgaguuguuaugugcccuuuucuuccugcuacuuuucuuucuaaauguuucugaaauuuaaaaauauauacauugucauuucugugcuacuggauugugcaguguuacuuccuggcuuccccaaggguccuuaaggaaaaggggggaaaggacaucgaaguuagagaaagcaaaggcauuugcugcaaaguuucaccguguguagccuggguccugcgaagccuuaauuuauuucuuuguuucccgcuaaaaagagaaaaagccacuacucaacaaauguaucuuucugaguaugugaaagacuuggucaaagugucugcugucucgaaguaggucuuugcaagcgaacaguccuaaagcgcgggccccucacagcagcgggucugacuucuggugucuggagcagcuggacucagaccugagcgaggcugugcaggcuucccugccggccgggucaacccggagggcggcaggcugcgcucccgcuugcucucggccuccguuccggcucgcgguggcuucacucuccccuugcucccuuggccgcggcgcagcccgcucggcucgccacccgcccgccgcccgccgcccggcgcggugcacucacacucggcgcggccccugcguucucccagagccgcuucucgcucagccgccgccggcagcucggcugcuacccugccgggagagccgcccggagagcgccagggcagcggacggauaauuaaucacccgcagccguccguaccaagcgcucggugauuugcgcccugcgcgcccggcuccucuugcacaauugcuggcucuccggcuccgcgggggagcgaggguaagaggaagcgaaggggaaacaacccagaaacuuuccucuuggacugugcucaagugagggagggaaguucccuggugccucccuccuagacacgucuugcuuuucagaagccuaccccaaacccauacaaagcaagaguuaguuuaucauccaugcagcaccaaaguaguacugacaaauauacugggauguuaaguagauggcgguuguuuaaagauuggucuugccccacucauuuaaaauaacugcaacugcuauuuaauagaucucuuuuguaugugagaguucucggaaauugaauacuuuggggguagauuuuuaaauguuugguaaugaaauaaaacaauuuucaaggcuguaaacugucacaaguuuagaaauaacauuugccagagagugcauaaagcccggcucuuguaacauuuaacugguaaacaguuuuaucaaccaguuuuagauuggagaaauguauuugaauaagguguauuuugacauccuguagagggacccugauaacugcugauccaguaagcugggauuuaaaugcaaucaacauaaacccaguaagcaacucuuuauguguaagcuuuuuuuuuuuuuuuuuuuuuuccugaaaaguuccuuucuugucuggcagagaugcuccuugugucugcacaaggcuuugcgaggugcuuuucugaagcacuuuucugucuggguggcucucuugugguuguuggaacagaguguguuuucacuaaccuuagaaccuaauaacgugugucccacuuuaacauugggaucucacccacccggguuucccuggaguuaguggcauguguauguacgugcaugcuuugaaagguuacauugcuuuagguuuuucccucuagugaaaaaagaguuaauaaaacagauagagauaaugaucaauugauaaauggcuauugaaccacauagauggcguuagauugcugcuugggcacuagcccauuuccaaguagauuugcaucuaaggagacuuuaagugguggaaaacauuuaggauuaaaagaaauaaaagcaaauuacacagaaauaguucagaauuagggaaauaauuuaaauuucucauagagaaacuuguaugaucagcccaccaugguguuuucugugugcuuguuugugggggcuacagagauguguuuuguauguaccugugugaaugcauguguauggugagcaucagugccugugaggagaauaaaggcacaggcaaggcauccaugcuuaguggacagauuauaacacagagcaccaugacaaaggaugagaaucacaaucuuggacgagaccauuuuacuguuguuucuuuauuauugguuguugcuguuuugguguuguuagugaugcucagccucccauuaacuuucacaguuacuaaauauuuaccuuuugugcauuuuggaagucguaaaagagggaguauguguuuacauguguguacgugcuuuucuuucucuuccaggaugccauuucagguuguguagucuuaaauucaaagucugucuaaauacaggucugugcugugcaugcuuaaugcggcuuuuuccuuauguguaauggaucagcagcacuaguuaagagugugugagugggagagugugugcaugugugugugugauaguuucugaaaugcucuuuuaaagucaacaauuuagaagaauaauaguuucuauacccacauuaagccagcuuuugcuaaagauaaaaaguuguuuucuaauuuaaucaaguaugcagaauucuauauaucuaauuuuuuaaugauaaaagaggcuuuucugcuugauuauuuuaaucucuaaguaaaaauuuagcuaauggagcaaaugaaaucuauuaaauacaguuuuucaccguuuucuauaguagaauaaaaacuuacauuuccuugacuaccuuguuaaguguuagacaagacugauuaauagagcuaguguaugauguuuaaagacugagcuguagagaacucagcacguaugguguuagcuacagaaaacguaugcuugggaaugucugaugaacacugaaguuuaauaagcuaggucugugucuucuaaaaguaagcuaggcagaggcaugggacaaucuguaucuugcauuuccucugaaugaaguuagauauccuuaacugcaaaucuuuccuuuuaucuaacauuagcaaaugauuugacucagacucaguuaagucugucccccuuaaagcuuuaaaugggacuuccugacuucaucacccuaccuuacauuauuuucuuuaaaaucaaagugugauuuguuguuguuguuguuguuguuguuguuuagaaacauaacauuuucuuauagacagauacuugagagccuugaaagguauagcuguugacguuuguaacugagaguucuggauucaguuaugaauugauaauguccaaaaccguuuucucuuuuuccuuaucuccaaagccucaaagguuauuuuucucaggauaacucucauaagguauuguuaaaaagacaaauggggaggugguagggagaaaggagcuugcuuuuugaagauauuuuuuuuaaucauauuuuggaagcugauuuuucuacauauuuuguacauguuuguguguuugagaaaguagcaaauaaaaucuuuacagcuuccuucaagagaagguauaguuugaucuaauggaaaucuuuuuaagaaauuacacuguacagguaauggugguaguacacuuuucccguauuaccagagcuguauaccuuuuauuauugcccagguauacuuaaccuguuucaaauaaaaugcagaucccuuaauaaggucucuuuucagaguagagugaaauacuaaguuagaauuauaaaugaugcugugcaucauuauggaguaauuuaggauucacccaaugauguaacaaaauuaacaacauaauuucauugugaaacugugucuuauuaaagaacaacugucugacauucucuuacaguugcuuuauuuaacuucaugcaaauauuauuaguagugacauuuuucuauuguguauuagauucucucauuagcaugauguguuaguuaucaccagagaaaucauuuucuagauaggugagggacaaaaucgagaaggcuaaaaaugaaaucagugauuuacauuaauaccagaccaucugcucaccagagauaggacagaguaaacuuuuugacuaguauaaaaccuagcacuucucugagaaaugauuaaaagauauauaagcaauguauaauagcguuuuuggaauucauuugcaagagcacucaauacaauuuuuucuuccaguagucuuuuacugcuuucaguuugugagaacaaacccaguuccagucauaggauuuguaguuaaaauggaaaugauguguguuuucucuccugauuccuaacccuccaaaaauaauuugaacaucucuaacaauuuuaaagauucacauauagcauuucuugguugucacguaucuaaacugugugcuguggccagguuguucuuuguaguuccugcaauauguuuuuauucuaaagcuucuccucaaaacuagacgucccuucuacauaggaugaauagucuuguuuaaucagagcuaagaguaaagcaguugauaguuaauggccuuugaaaagggcuuucauugagaggcagcauccauuucuagguuucccucucuauuuuccccuucuuccuuuuuuaauauuuccuucuuauaguugguguauuuggguaaucacagcuuacuuaaaaaggauuaacuugaccagacucacccuuaugguaaaauagguguuuauauuugguggcaaauaguuuuuagcuuguugaauuugcaugcugccaccuccguuguagauccucuagcuugagagauggugugcuuuguuuggaaauguuaaugauagguacauacugaaauuaaaauguaauccuugacauucaucuuaauacuguaacacacaaguaggaauauuuggauaauugucauagcaguauugaauuagaaauuguaguaacgaggugaguaccugugugucagccuuugcuuccaacuugguguuaacaugcagacuucacuuaacagcucuguguacuguauaaugaacugggaauguaguaggccuuguauguaugauacccuguguguguuuuauuguaauuaaguauguacaaauagauccucagauguguauacacauguauaaacucagucaccaacuuaaaacuaauuuccaacauauagcacuuaaaaugaauguaagcacaguuggagaucauuuugaaauuauuuuuucaauauuucuguuaucuguaaccaaguagcuuuauagagguugauuacuauaacaggacagacuuaggcuuccaacacaacauagcuuccuacaccuaugucagggauaagagccaugacaauucuucccuuauuaauuacaugcugagcagggcaugucugggaaguugggacaaaagugaaugggucacagccaaggcaggauugcaaggauuccagugauagugaaagcauucaaguuugccaggucgcugugacacgggagcugauuccaaaggaacagcccguuacagauagugagauggcgucacagacuucagugaaaaacaaaacccuaggguuucuucuuucccaacuucuacauugcacacacuuauuuaaagggagacgcagugggccuugcucuggucagucuucacuuagcacguguagguaaugccugucuguggcuaacuuggucaugaggacuagaauauauauaaaaaaaaaguauaaggagaggaaauuggaacuugccuuuacccuguauucauaagucaacuacaggggugaaauuguuuuaggcggagacugcuuucccccagaguguauagagagagcucugugcaguaaggaaaacugaaucggugagucgugggagaccuuuuucagugaaagucauuuucucuaggacucacuguucguuguuguugaaagaacauggaauauaauggucccaggaguuccuuccuuuggaaggguuagcaucuacugugauguguguggaggcaugaguucugcuccaugugccuuucaugacacauguuugcugaucacuaacuaggcuuuggccagaagaguguuugggguuguggggaaugauugaugucgcgcacaucugccaaagcugaugccacucuuauuuccaggggagcagcugguguccacauuuugcgagguuccccucauccucugaagcaccugggauuagaggcaaaggggagucaaauacccucucgaggaacuuugacuucucauaagcuuaagagaaauaaaggaaaaggggcagagugggagcagcagccuuuagguccuguuguggaaacaagauaagcagcaggagaauccuggaagacaagcuggucaagaugcagaggagguaggaggaaaaucguccuggggagaagaaagcaugugcuaugacaucacuaagaucauguuggagcuguggcuggggccacauccccccccccccccagccugaccuguaccgcaucucccucccugggcuuaaaaggaaguuuagagaauaggaaaaaaaauaaaaguauugauucuuuuuuuuuuuuuuuucauaccuucccuguaggaaaccucacagacuucacaguguacacuccacccuccggugaaacauuuaugacuggacuggacuugggcgagggcagagugcaguguucucucgauggggcacagcauuuugugccaugggguucgggcaugagagaguguugucuccuucugcagucagagcccuccuuagugggagcacugcgggcaaacaaugccuuacucaaaccagggaguucagaaaucaaauucuccgcuuauuaaucaucauucuaauuaagaaaaagaaucgauccuuuaacaacaauauaauauccuuuuguuuuucuuuaauuaagcccaucaguuuuucauuucucuccguaaaggaagaauaauguugaauuguaggaagcuacucauugaaaccacggauucccuugagcacagcugacaucuuauuuacccauccuuaggaacuguaauguuccuuugcugcugucuuuaguguuuggucagagaaggguguugaguuaugacucuuguucuucuuuggcugguacacauuuaccuaauggccuuaggacaagguuaguuuguucuuauucgccguuuccuuuuucauagaguucauuucucucuucuaccuuuguuucucucacuauacaaucgccuccuuaguuuuauugccucucuuuugccuaaugcaacagaauuaaaaugcgcuugaaaguaacaaccauugaaucaggcauccuuuugccaaucugccauucugauaagugcaggaauguggagcuauccucacauaugcacaugucagugacagggcuauccuuguuuuacuaccuacuauggaugaguauuuuaaaucagggguggcugcacaccuagggcuucucacucagaugugcuacugauagauguucaguuugacccuuaaccuguaugagaaagauggaggcaaagaaaauuugcuuccuuuucucuagaagcuguucuuagauuuaucauuuuauuauagacuuggacuuaacaccacacaaggauaucuucuuagaaguaggaacgguauaaagaucagggugaccaucaggaggugugcccgagguaaacugcagcuaguaagagcucagacauugaaaggaacaauugaaaugguagcagggccaguauaaacaugcuauuaggaaacagauauuuaaaacaucuguccuacauguggggauucaucauuguuuuguauguaauacauuuaacucauugucuuaaaaaggcauggaguuuguuaaaaauaacaagaucaaaaacauuuuuguaaauuggaaagauaggacuucugguauuucaccuguguguuuguaugugacugcuguggauuuuuucaacuuuauuaagguggcuauuaguucuccagacaauucuuuaggauuuacauuugaugaucauugugucugaacuggggguuugaaaaagaaaaacuucaggauaaugaguauuuuaccugacaaaaauaauuacuuucagcuggcuuaacauaauaacaaaacuaauauuaaaaugggaaucuccauuagcagaguuuuaauaauguuuguucucuucuuccauuacaaugacaagcaaggaagaugucacugagguaugccauuaggagggcugugugggacacgugaguaggcaugagaaagggcauuccacugaugugcccucugccagggucaggguugcugcucuguaaggugcugcgacauuacauuaugaguuuguucacgagaguucccuucagugaugaugccugcaagcaugaggauuuuugaccuccugucgaaccuaaugcagacucagcuaggauacuagggcaauacguaauacuguuuucacuuugcccuuuucuuuuuuauauauaaagauagaguuucagauggaacugacacugaaguccugcuauggacuuuugggacaaaaucuuauugcuuuucuauagcaaauguuacaaaucuaguauugccauggaguuauacauuuguacuacaugauauguagacacagaggcaggguaggacuguuagguugucugguugaaggcauuuaaaugauuuaguuugggaauguuggggaauuuauuaauaguugccucaaaugcaaagaguauaugaguuuacaaacaggagggccaccacaagcaagcgucccacccuagggauaggccagugccuuagauuauauaacuuuguguuccuaagcacacccccuucccccugcgcuguggugaacauagagccuuguuucagagauaggagccuagcuuuuuaaaugaagcuaggugccauugauugagaaauggugugacuguuuccuguuuugugaauugcccuuuucaccaaccguagaacugcaguuuucuagaagcaacugucaugauuuuaaguuuuaaauuccaaguaaaaauuaaacuaaggaagagacgacaccaccuugagaugugagcucacaccuguggugucuugucuuuucccuuaacagcugucuugccucguucgugaucaugggagggagugaaucuuaaaauguguugccagugcuguuuugugcuaaacggaauaugacggagaagaguuuucucguuuuugcuuuauuugugaucuuuauuguacguuaugcgaaaaagaggcuagggagugucagcagcccaacaucugggagggcuuguuucaguagcagccuggaaaccagaacccuggcuucauacaggugagauguguuaugggaauaaaggcccugugcauuuaaugaacccagccugccugucagcuugguuuuucaugcaccauuguuguucaaauaagaaaaagaaaguguucacagccuguggugagauuagaguaauagaaaugaaguguuaaucuguugauaggaagcacaucccauauccuacaucccggccacauucacgcauguauaauauauuccagguucucucaugaccagagaagccuggauguucauuauauuaaaaacacucuuuuguugaaagcaagaaguuggcugcucugacuuugaguaaauagcuacucuauucaauuucuuaauaaagcaacggcuccuggccuccgaagauucugauaaccugcugcucccaugccugccugcucugcacaucugcauacuaucccugcuacccuaacuggagccugcaccgggaugcccuuuugcaggaacuagugaccaguauggggaagguggaguuaaaggacagcagaauuuuucucuccauaaagaaagauuaaauaaaauuaaacauuuguuaauauaugcguauuuuucaucuuuuaaaauuguacauuauuuaaaaaauccaucaagcuugggacacuguagugcaguuaugauguguuacggccuuaccugaggguugucaggagcaccuaaaggcuuuggccaucaagggggauuuucuuuucuuuuguuuuuuucuuuauaaagcuauuuuggaaugauauaggaagagaauguuuuucuagaacuauuauuuuaauuuucuacuguuaaucacuaguuauuaaaaauaugcuuauaaaaaugaaacuguagucuuaaaaauaaugagauagggucagaccuacacucuagcaagguguuuuaaagaagaaaauggugaacacugguccaaggcccuuuauauaagagcaucaauuuaagaggcaucuucagaaaugaugucgaaagaaguguaaaaggggugggaagagauaaauuaauaagugaguuccaggugucuguuucuaauugcuuaaauuucaaacauaauagaaauuaggacgaauguuuuccauaaggaaugcaucacugccauuugaguaucaacuagaacugcauucguggugcccagacuuagcauauuuucugcuuuccuauucaccuaggacuuaaggaauucaguaugaucauuaugauuuugucaacuguuucaagcuguaggaguucagagucaagaaaauguugggauuaaagcucaauugugaaguauauuuaguguauauugagugauuccuuucuuuuaaggacaauuggaagagaaaccuuucucauagaauugaaacaucucaucuaaacacucuuucaaguguguggaaugauuauaagccagugugcuauaggugaucuaagucuugauacucugauacugugauauaugaccagucguagcacacuccauaaagucuguuuggagauccaaguuuuucuuggcuacaguaauuaaucagaaauaaccuguuuuuaauaugguuggauaaagugauaaguagggcauuuaaauuuguuuguaacacucacugauagguuuaaaugcuucgauguuaugccugauuggaaguuaugaacuguaaauaaauauuuacacuugcuuucaguuaaauaaaaaagccaaagguuagaaaugaauggcaacuuugucguaggaaucugcuuuaaggagcagccauuuuaaaauacgacguggaaaaaaaaagaagaaaagaaaagagaaaagaaaaaacaaaacacucuuagcugggcggugguggcucaugccuuuaaucccagcucucaggagguagagacaggcagauuucugaguucaaggccagccuggucuacaaagugagucccagaacagccagggcuacacagagaaacccugucucgaaaaaucaaaacaaacaaacaaacaaacaaaaaaccgacacgacuuguuggacccccaguaaugacuaucuaaguguauugucagaugcauauaaguggggccacguaaagauuaguauuuguuaugguaucugugcaucuuaaauguugacuuuuugaaaugugccuuaaagauauauacuauuuucauauuaggguccauuuuccacuuagguguacaugauaccuccagcagggaaguauaaacgugagggaugaggauacauggagagcugaguagcaguuugcaugggcguccuuucuaggcugcaaggaagaauggaguucaugggaaacccauguaaaagucugacacaucccuagaugaguguagguuauaguggaaauuuacuacuuagauuuuguuuuaaguuaugaaauugaguuuuauuauaguuacuuauaacuggaacaacuauauuuuuaaauaaagugugcauccauugucauucauuauaugaacucgugaaauauauuuaaauaucuguuuuuagaacaauagauuggaaauuuacuacuuagauuuuguuuuaaguuaugaaauugaguuuuaucauaguuauuuauaacuggaacagcuauauuuuuaaauaaagugugcauccauugucauucauuauaugaacucaugaaauauauuuaaauaucuguuuuuagaacaacuauuuauuuucuucuuuuuuccuuucccuuuucucuuuuggcaacaauucuauaagcuuuucugaaauaguuaugaaaguuuaaagggcaacaguuaccuagagugcccauguggaggugaugaauauuaagcuaguagaaugguuuguuggagucugugguagaccagaaagcucaucccucuaaccgcugagguggcaguccugggguccagagaauuguugccaggugagaauguaggccuccugguugccagaucaccuccuuuuuucuuuaaugagaagccagaaacacaauuuuuaugugaaaucucaugauuuugaaaucuuggcaacauauucaaauauuuaaaaaacugugugguccaaauaaaacucaucugcaggcuauauucagccacugccagauagaaaccucugguuuagauaauauuuuaauggaugaagauaauaguuucauugcgugugaucauucauugugggaauuccccacugggauggauugaguucauuuuucccccugcaauuaaaaugaguaaguuuaguaaacauauuuuugcuuuuuguuauuuuuugauguauagccuuuucuuuaugauccuauuaaaagaaaaaucaaauuuauggacagaauaaaauaaucauuauuuaaauauaaguagggaaaauaauuuuagaguuagaaguagagauauaagaauuuuagaguuagaaauagaaaauuccuaaauucugaaaagaaucccauaauuugugucaauaauugauaaagaugaaaagcugaauuccaguauaaagagcauuucaccucaccuucagcagugaaaucuuggcccugauucuuugugggauugcuauaauuuaccagucccauugauuaugaugucacgaggaagagauggaccacaaggggaaaacuuccccauacuaauucgugcaaggccaauaguauaucccugcuucaagaaaacaucauuuauauuguauaagcugaagcuuucaaugucagucuauauuuuuugaaggggcucuuuaaaagaaauaagcuacucauaauugaaauucuccaggcaaaucagauaucaacauuuccaacagaacggguaauuaauugguuuggauuucaaauugaaggucaucuuguuauugauuuccgugggaacaagaaacaagagcaucuuguuaagaugaugugcaaaugggaccaaggugugccuaggguucugcccugggucuuguugaucucugugucuugucggggucagaaaccagaagggaaccuucucuguaggaaacacaacaagcucuucaguugcuuccaaaacugcagaaaaagccauggauuggaggagagaccagauauuaacacuucccagucuuguagucagccacgugucucaaaucaagaguagaugcagauuguaaugaagccuuccucagugugucugcucucucagcaaguucauagcaacacagcugugacuagcacuuccagaaacuuuucaacugggaauuaaagaucuuuacuacaaggggagagaagaacuuuaauacuagaauaguaaagggaacaauuggaagagaaggugacacacccccugcgauauuacuggguuuuauaaaagaacauuuguguugaauguaugauaaauacuuuaguucuuaccugugccagggucuuuaaaaccaucuucuuuucucucugaugcauuuauguuuuuuugagaaagguauagugccauauuuagcuguguuaacuaggcagggguaugcugcagcuuucuuuuagaguucaaaguagaacucuccauaaaaugcguacaaucaaaggguacacucucuguucugugugcccuggagcuuuagugcagcuacuuccaaguugacauaccucuguguaggcaugacaguggcaccgaccuucuacauuaagacuuaacauuccacagaaccauuucagguuuauuaugagcuucaaagccugcgcaucccuaagagaauaucaaguuuaagcaugucacuuugccauagucacagcuaacuuuuuuuuuuuuuuuuuuuuuuuuuugcaucaaaacguguuuuuucauggcugauuaucaccaggugaaacuugaaacuucuccguuccuuacagaguccuuucuucugacccauuguugcugcccccuugaauucuauagacagauccuuuugguagugguuggacacuacccaugcaugaaaauaggucauaauugguuuaaaguucugaaacaauaucaacagcuuuuucuucaucccuugaccuagaacucaugucuuugaaauucauucuccacuccacuccuguugggauuucacagaaguguggcugggguagaaaagaauguguuaaguugcuaauguuggggcuggagagauggcuuguggugcugcucuuccagagguccugaguucaauucccagcaaccacauggaggcucaucugucaugagaucugaugcccucuucuggugugucugaagacagcuacaguguauuuacauauaaucaauaagcaaguguuuuuuuuuuuuuuuuuuuuuuuuuuuuuuuuuuuuuuuuuuuuuugguuuuuuugagacaggguuucucuguauagcccuggcuguccuggaacucacuuuguagaccaggcuggccucgaacucagagauccaccugccucugccucccgagugcugggauuaaaggcgugcgccaccacgcccggcuugcaaguguuuuuuaaaaagguuuuuuaguguuggguugauguuucccacuguaaaaggcuaaugaauagaggaagccaauggacugcucagccgaaucacauggugugccccucucuucucagggaaaggaaggccuuuccugagugguaaaagcagagucacuuuggagccuucugguuuuccgauccuacgucaguuaauagacuguugcugucuaugccuugcaucucagagaugggacuugacggaguagucagcauugcaaaggucacccuagcgcuauuggcaggauguacugccauuuguugcugagcgaugauaaugcuacuguagcaguuaacuggauguaucagacuguguggcuuucccagaauacuaaacuuaccuuacuuaguucuuuuaaacaccugacagaaugccgguucacaagcugucccaagugcauuuuucaaggaaucuuaaugauauuaaaauaccagugcuuuggccacaggauggauaauuuaugcagagcauuuaucuugugugauguuuugcuuuugugaaaauacuuuuaaauuauucucauuucuuaaaguuuucuuuuugucuaaaauuucugauguuucagcaaguuugaaaauucaauuaaaaaaauaacuuauuuacaguuugucuucuaggucacugucuuccaggcuuguugguuguaaggggaaacuuuuaaagaaauguuauuuuuucauauuucauuccucacaaauaucaaauagagaaauuacauuuucaauauuagauuuuuuuuuuacuuuauacauaguauauaaguagcugccaucuaucuuuccaugucauuaaauuuagcagugugcucacuaaagugcuauuuaaauuauaaucagaauuuaaaaggaacuccaugaucagccuccuuaggaggagcugugggugaacgggcuuuggcuugcuugcuuuaccugagguugggguucauaccuucugaaauaauuucuauccacaguggacaucuuuaccucagcucuugucuaaaagccaguaaagaucuaaagugcugaggugccugugacaccauuuguucccuucacauccgcaucuaaaacugagaggggcuaccuucucaaauguuugacuagccaggucggcuucccuuccaucugugcacaucacagugggcgagucauguagacauuuaaaguuccuucuuuggugucaaaauaaggaaaucauacuucugagucuugucuaggacagauucucaagccuuccucccauucaucuagccucguguuucuuauggagcuagacacggaucacaagagaagaauguauucccucuccaaaaugauggaagaaaaucagugguucaauaauuuuuguugcagcaacucaacaauaaagggcaugaagccaaaauuuuucaaauagaauggcuagcacugaauucagacacugaauaauauuugaaaacgagacacagugauagaguuuguguuguauguucuuugugacccaaauguugaaggaagcuuucucuauauauguauguuuaucuuacauuuagaaucacuuccuuuuuuuuuuucuaguugacccauucuccagaccuuuaaaaaaacauuuuaaguggauguaaauuccauuuuaauuagacuccuucaaucuaauacugcaacuagccuggaauggaaaaaaccaugcuuaauacaacccaaaucaaccauauccagacaauuccccugaucuuuauaacaguccacuccccaccuccacaauuaaaugacccuguuagcuucagauucaacaagacauuuaagguucacuuuuaaaaaugaucuuuuaccgaauuuuuuuuuucuguuuuauuucucuuucuucuucuugccacacagcugucacugguguaagagaaagauuggggggaggggaagaggaggcagcccuguucaaaucgugucacguagcacuaauucaucugcucucauuagagggagcgagggacagcagugauggccaagagcugcacuccacacaugacacgcgcacaguuuggggaauagaaaauugcuuucucaggaagcccagccaauuaaggacuugaccauauugaaugucaaguguuaauuuagguuuuucuucauuuucccaguaguaauguggguccugugaugagcaaauacaugucaaguaaaaguugauugcaugaaggaccuggguauuauaugucacugacaagucacaaauguacugaagucuuuuaaccccuuaggugaguguagugggggaggggaauaggagaaggggauuaugguaccauaaugauaagaauugguaguagcuuggauggacagacaggaauaguaauugaugcaaagaaaaaaaaaaguccuggggauuggcuaaucuugcuucauguauagaaacaguggcucuagaaaggcgaacgugcaugugcgcgcacacaaacaaugcacacacacugcacacacacacacacacacacacacaaugcacacacacacacacacuuguaugugauacuuccgcauugcacaugcacugucuagaguagugaauuuccuaagauuuuugugaaaaagaaacaugguacacucucuggucuugauucaggaaauuuaucauuacuuaccaccuuugaaguaaaugaaauuaauuaagcaaccauauuauguaggauaguuuggcacacugcagguauaaaauuucuggcuuuguacucuauuuuacuuucuaaucaguguucauuuaaaaauaacugugcaguacugucauaggaaagaugcaaaacuuaaaagaagguuuguuuucugagugucucuggaaaaugauauuuagccaauagaaguuggaggcaggcccaucauuguccuucacuuccuuucuguacccagugguggaagggagaagagcucagcuucagagagugagacacuucugccuuuuucaaguaaauguugaagguuguccaucaagaguagcgccucauuuccauugucagcauucauuugcauaugaauguccucaaaauaauaggaagucugccccuguugcaguuguacaauagcaaauaaaaacaccccuguagcuucaaacacugcugaguggaguggaguguguguguagaaaucuucaaagucaaagcaguuacaauguggcuacuuugugaaaauauguagaaacacuuucgccuuccuaucuuucaagacaagaucuuaaaacacuuucaugaacuguacccuuuuccauuuauuuuaaaauuguaaacagacuuagcauugcauauugacaaugcuuauuauaccuugagaagguaagucacauaacgcaugaauuuaggcaguguaaauuacugacaguuuuuuucugggugucaggacagaaacugcuauugucauauuggagguuacauuauauguguguguguauguauguaugcauguaugugucacaugaauguaucacauacaugcccgugcgcacacacagacauacauacauauauaauauaggaaaccaucucaggaauucaguguuucauagagcaaauucuccuuaagaaguaaacgucucugucagguagauucuucccucccuguuucagauaaccaaauaggaugaggcugguccucucuucauauccagucugauaagcuccaucuguggaauucugguggcauugaagagcacuucuuaauuacggucucguuugucagcagcuucucuuccucuggguguacugagagacuuaaggaaguuuccccaaaguaaauucugaugauggcagcucagguugcugauucaaguuauucuucucuucugugucacuuuugacggauggcaccuaaugcaaucaaccacugacugggagagccuuuuucuugguugcuuuaguaacuggaccacggguuucuuccccuccuccccucuccacccacucuuccccuccuccccugauauuccugcaggagcccacucuucccugccauccucaccaacacuagagcuaagggggggggggagugguuuacccagaacaggccuucccuaaaccucccuuucccaguggugaaagcagagucggccucccuucgcguguguuuuugauaaauuuaagaagucaaaucgcugacacagauagauaauccgaguguauagggugaagaguuauaaauuaacacauuauucccucuuaaugugaacuacuugagaaugcauuuucucagucccuugacaucuacccggcgaggguucucauuguacuuuucaaguggcauugauuuguuaaagcgcugaauuagcaucuccggccagcugcccuuucauucuacaggaguguccaggggcuucagucccuccugucucccccagaugccccguuuguauuucagcccccuccuuucccaccugauucuuccacuccuccccucauccuuuccugcucucaacuuuacuguccuuuccugcuugccuuucuuucugacugguccuguccagcaccaccgucuuagguuuucuuccucucucuuuguccauaccucuuuccuccuccuuccucgaaggcuuuccuacauuccuuccccucucucucucucucucucucucucucucucucucucucucucucucugaauuuagccaauccauuggcuuaaaguaaagccuuaaagaaauuaauuacaauauauuuguuugaaaacuaaugugugcuccuuguaguagaaacccaugagaaaaucucguuuauuuugguuucuacauuucaaaagauacuguaggaguucuggacucacgucuuuaaaugucauuuaaugugguaaagucuuccgauucgaacaaaauggaaaugaccaaugguuaccaauuuuuuaaucauuuguuuuguccuugcuagaacaacucuacaaaauuucuugaugucuuuaaacuucuuacauuugagagagagagagagagagagagagagagagagagagagaagcaugugugugcagacuccagaggucuauaucuggugcuauccucuagaugacuagagucucucuucucauugaaccuguagcugaccuauuauucuguuugacugcuuggccaacaagcuauagguuuaucuugcacagcuuuuuaugugcuugcugagaaaccacacucagguuccuccuguuugugugucaaggacuuuacccagugaguuuuccuuccugcuggcugagugaacuuuuuggugugacuuuuuuuuuuuucugguuccaugugauucugauuacacuuucuuuuaucaucaauauauuugcaugaagaaguaguuucauuuugauauuuguagcagucugguuuucuuaacuguaacguagugaauagauaguaaaauuggucagaaacuuguuugaaaaacuaagauugcuuuuaccccuucauuuauugauuugucauucagaaguuauguguggauguuaaugaagagccucuuguacagagucacagacuuggggucuuuucagucuuuagcuaugggucccuggaccagugugauggcccagcagauaaaggcacuugccacuaagccuagugagugcccucaggggccacauuguaguaaagaggagcuggcucucacaaguuguccucugauggucacuccuaugcuugguggucacacacaugugcauacaauaaauaaauggaaauagcuauuggucuaaaacacugugggaucacuguggugauuaauuugaugugagcagaaaagcaugccugcuggggcuuacacagacauggucuucugcaguuuuaaucuuuaguaggcuucaaauugauggcaucauaacuagaguuugaacuuauuaguaagucaaaugccuugaaaaaaaucaaguguccuuauugcuguauuuuaucgaaucuaaacugguaguuugacucaguguuuauauuuugaagugggaauaguuuauguuaaguauaacauuuuuuucuguguuggauuuucuucuuuuccaauaugauuuuuuaaaaauauuuuuaaaagaaauuaauguuguccuucucuguggacuuggcauggcauaguuccagcgaagggauuaaaaugacuuuucaaagcaugauaaugucuguguaaagggggaaaaacugucuuuuaacuagggcuuauccuaauuccagcuacuaaggagacagaaaugacacuaaagcagacuaucuggcuuugucuucuaugugcaugcuaaguugcuuugagaucaccacuuaguauuuuaggguauucuuuuaaaggagugagguguucuucuguuguuccugcagaggggcauggcuuccuugcaggggaugggcagugccuucuacagggauaauucagcucaccugcugcaagguggggccagaacaagcaggacuugcaucccuucugaccugcugugacuacaagagaaaggaggaagaugacaaguuugaaagugaaaauguuacccaggaaaggaauauuagugcucaaaguggggggaauuaaagauaggaaaaaaauuuguucugaaagcccuaccacagugauuaaaauggugguagggaaaaaugauguuuuguaugaacagaacuauagccucugguaacauugcugugauuuauucuaaacguccguugacuuuaagaauugagcugcaaacugaugcuaggacagguuuaaaguuuaggguuguggcacuugcuuuggaugucccagaccucagcacugaagugagcgccugugugcauuugcacaugcuuaauacggauuuuauucuuacugauuuaugcauuuuuaccaugcugaugauugaacucagggcuuugccaaugcuggaugccucugcugcauccccagcccagugcgugugacuucaacuccucauuaggggcaggcguguguugucuuguuccuucgcuugcuuuuuguuuacauugcuugcaagcaugaucuucacaaguaaugagucaagaaguucagauuuaaauccgguacaguugcuugcuucuguugugauaaggcuuuagcuaugugauaugguuaacuucguguuuuagaauucuucaccuuugauuuuuuuuuuucuucuaaaaauuuucuucuaaaauugucaggagacaucagaauuauuucuguuuuguauuuuguaagucuaaauuaaaugucacuuaaaugugaaagaacuggcaccuucgcuaaggaguccccaaagcaaauggucaugucaguaaucauaaccuaauuaugaaugcaaagugaaguuuguuucuuaaaaaagcacaaaacagaggaaaguaagccccacagcaucucacagcauuaucuagcccaggagaaagccuccuucugcgaagccauaggguccugaaugguagcaguaguaauaagagaggaugcuggcaucugcccaaggacuuguucagagggauccacaaauggccugcucaguguguggcuguacagaaguuccagggugacacaugccucccaagccagucacaaugcaagaggucaggagucauguucaagggcaggguguuucuggauaaggcugaggaagcagagguggccccucugugcucagugugugggucuguguacuccuuucccgucaaagcuggcccagcauggccaaaaagugguuccuuggcaggguuuaauggcaggaugauguagucuguugugacuagugcauuccuuucagguuaaacuagggaaauggcauuguguuaaaauuccaagucgcaugaauguuuuauugccacagugcauuuagcccuccaggggaguguguguggcagaggugggguuggggguggggugacuuggaggcgcaggaacuaucagaaggacacuucccuuggaaaauuuuacccaucagcaugaagcugauuugcucugauggucacuuagaaggguuucacuuuuuuucuucaacuguggcuguuuaaagucuuguaguccggacaauuagcagcugaagaaaauaugacaagacacacacacagaggccggcagauagagaggaggaaugagccagaaaggagcugagcugccuuguguaaacugcccaagcagggcucccccucccuggccgccaucccugucccccuuuccccaggcuguuuuugcugucugccugaaggccagcgggacugcucuguuaaccuugcaccacugacugggaggccucugcagcucaugguacuguguguuaccauuaccacucccccauuccuucucccuggcucucccccccuccccuuaacugcuucucuauaacaacgguuuauauuagucagaggcauacaauuuuggaaugcagaaggucugaguuaaaacaaaacaaauuuaaguaugugcucgcuuguguucuccccccccccccaacacuccugcauuuagaaaggcuauccugagccauucuaauucaauucucuccagacuuuuccaucgugauuuaaaaccaggaauucuggaauuugagcaguuuaaacagggaaguuauugaguaucuggaaggaagagugcuaugaaaccuugcguggagccucagguugaggguacaggccucaacaaugaccucugauuuugcacacugucccucccuugccccucucaaggaguguuucugccuccuuuauuguuucaaacauacaguugccugccgaggacugauagcuuguauuugugagcguuacaaauaacacucaggacucuuucaugauccgguucauuuguaagagauuaaaaugugcacugauggaacaguuuccucuugcucucuaccuuuguaaagcauuuggguuucucccugugaagaggagagcuauagcuuaagaaaagucauaguuugagcuguaguucugaauugccaguuucucuauguuuccaaauguuaaaauacuuccagaauauaacggaaauuuaacaugaauauuguacaaaaaaugaggcaugaguaagccaguguacccuauuuauguagaauuuuaagggcuugauuuguacauuuuuauaaaaugauuuugucaaaauagaccuccagaguuuaaucugauuagugguguuuguaugaugguuuguucuuuuuaaacagauauauugacauuguuuaugggaagucuuaaacuagcaagcaaucaacuuuacaacaaaaucgagauuuauauguggacuugaugcuucacauguaagacauauucauauacuaaccgucuucccuaagcucuugugguccccacagaguuggcuccuuuuacucuguggcugcucaggugauaguagaguuuggcugacucugguuuccagucggggauuuuaaaauguaggguuuugcugguauuuguuuuuuuuuccuuucuguuuuauuauuuauuauaaccaguuuuaaaguugucccccccccccacagggugugaaaauaaaagugucaaauaaccuuucaugugcauuuaguuuaucuggaaauauaguugauaguucuaaucauggaagcauuuuuuuuuaauuaugaaaaggauguuguagcucugcucaguccuuuccaaucugauuuauuaaaaguuuccucuuauuuuccaagaaggaaagagugaaaugacaccaacauuaaaucucucuaauaagaacauuucagccaaggcaggaugguuuuccccaagucagauuucauuaaaaacaaaucagugucuguccuuugagcgcuuuuuugucccuuuugccagccauuagcauauugggagcuuccugggauaacaaacuggcccugagugcggaugcuccugcugugaugucauucaggaaccucccccgucacgugaccuuggauaagacccuucagcgcugaccuuucuugccuaggauuuuggacagugucucaugcuguugcccagaaggucucugacucaagcucuucugccuuagccucuugaguccuaggaugaugcauucccagcacacauuuuuuuuuuuuaaggaaauaaaugaauucauuaauucuuucagucauguacccauucaguaauugagauugaaaccaggaucauuuguucagagagucuuguacuacugagcucaucuuugauucuaugauggagacaggauauuaaccuugaggaagggaaaagaagaauacacgcuagagguuguggcuuguuguagggccuucauagucuguagccccuugaguuguucuguagcuuuggucccuagggaagcuugacuguuuagaaacaacggaguaaagcuuuaggaaagcauuucuuccuucaccuguaggaagggagagaacaguguuaccagguccgggagguccaaaaucaucuccgucuuucugugauacccucugugacaaauucuauugcaccuacuuauccuuguaucgccagucuuaaccauuugcuuaaauuuuaaacauuuccuauuugugcuagauaaaaagccggaacaagugaguuguagaaaucgcuuggcccuucuggaaauuauuuguacuuuuuugaacauuucuccuuuuccuuucauuuauucuucucucaugcaauuccuccccucccuccauuccucccaguuccucucccccagauccacugcuccucauuucccuucagaagagaacagaucucccagggauaucagccaaacaugaucuaacacauugcaauaagaagaggcacaaacguuuauaucaaggcuggacaaggcaacccaguaggaggaaaaggguccuaagagcagacaaaaaugucagagacacacccccaccccccacucccacuguuaggagucuuacaaaaacccuaagcuaaacaaccacaagguauacacagaggacauauccuagacccauucagguucugugauuggagcuucugucucugugaacccugugaggccugcuuaguugguucugugggccauguucuccaggaccacucuggcuccuaaguguccuaccacauaccaccuacccccacuuccccagggauugccugagcucugagugauguaauccacaucuguucucaucagguaugagcacaagccucucugaugaccauugcucuagcagaguaucauuaggaaucauuucauugauuuuuuggggggugggggucgggggaguugcguuucguucuacacuaggucucugggccaucuagcuucugguuccuggccauccaggcaguguuaagcauggucuccaguuagaccagucacugguuggucacccuccuaaggucugagccaccauugcaccaguacaucuugcaggcaggauagguuguagguugaagguuuuguggcuguguugguauccuauagugggcuaaucccaccaccacuggaagccgugccugguuacagaaguuagccagaucuggcucuguggccuccauaacuaggauuucuuccuagggucaucauaaaauccaggaacuuugcauugcacuagguuuccacauagcccccccccccaccaaguaccccccaauuccauacaugccucccucuguucuucccuccugcaugguauuccuccuguucccauccacacgagcccucaguccacucacaaagucuaucccauuucacuuucccaaggagauccauacauuccagcuagagcccuccucauuauuuagcaucucccacccugacacuuugaaggugcauuuuaaaggggugugauucaaggaacugguaaaaccagaguaguuauauaugggaugagagcuguugcaucccgucuuuuagaccucugucuuggugcauggaguacuugauuuuagaaaaacaguaucuucauaccucuguacuuugaggucaugaggccugagaauugaagcuuguauuugauuugagugacaucacuguaauauuuagaagacgcugcucuguaagagaaaagaccuaagaauagcuauuucuuucauuguacaacuuuuuguauguuuaauuucaagguauacauauuuagauauucccugguaguaacauaauuuuaguauggaagaaggcuaaaaaaccaggucauaguuuuuugcuuaauugugucugaguauaaacagacucuucuucaguuugaaaagauuacaacucuucaguccccuaugugcauguauggauaaagguaagagcaaaacauacuacauugaauaaauugucuguaaaaguaauugacauaauuuuguguucucuuuguaacacauagauuucagguuuucucaccugauaaauuuauauugggauuuuauauaguacuuuaucagaaauaugauuucacuccugugaauacagggaggacccauauuuaucagcugacuauauaugcauuugaacuggucucuugcucugacugggaaaguuauggacucucccugaggcuugacuaagucuaauaaugugggacuuaggaaagagggcuguaauguguggcacagaacuggagagcugugugaccgcugucauuguccucuuuugucgaguguuguuauaguuuccaguccucagcuguauucugccagcauauguucaucaccuauggcgccagguucuucuugcaugcaugauguauaugcuuggcuuuucagugauuacuuaaaaccuaaagaggucaguuguguagaagcugacuuguuuugaaggaaguuaaguuagagagaaaucucucuauuccuacucuucacugggaaucagucacugagcagcauaauucuaaauguguguggcuuuuggguacuuuaugaaccuuuuuauaguaacucagaagcaagcaacugauggaauuaauauuuucccaucaagaagugauucuguuaaccucuucuccucugucuauuccaugugugcuuuaugaagauaggacgguauccauuguucagguugucucauggagcagagauacaaguucaugaaucugcaggguuuuuuuguuguuguuguucuuuuuguuuuuuuuuuuuuuguuuuuuuuuuuuguuuuuuuuuuuuuuuugugagccuuagcuacugcagucuuuaaaacaaagagaaagaauaagcuaaaacacaacaaaccccaaaacucucuacccaaccaaaccacaacaagaacaacuccccccaccccaggagagaaaccuucuuugcuucuuaguucuggauugugugggcuguuuguuguugguguuguuuuucaggacaggguuucuguguagcucuggcuguccuggaacucauuuuguagaccaggcuggcuuagaauguagagcucugccugccucugccuccugagugcugggauuaaagguguauaccuccaccaucaccugaauaucuucuuaauuucugaaaaaaaaaaaaaagaagaaggaucuaaaccauggacauuucuuuugcuuuuuaauagucucgaauuuuuugacaugacuuuuacaggaaggaugcaaagauacagauauaauuaggaaaaccagggaggaaagaguuagugucacuguguaugugguuccauuuacgaaucuuuugauuaacaucuuuucauuauauacauucucucucucucucucucucucucucucucucucucucucucacacacacacacacacacacaaguuuggaacauuagagcuacuuuaaaugauuaugcguuuauguuguauguauuuguggccuuaaaaaacucaagagugcuauagauauuucuuucauuagcaggguagggaauacaacucaguguauguguuaagcuuuuuaauaguggccaaggguuaguuucuagaauucucuucuaagagagaguagaagaugggaaaggagaaagagaagaaggguaagauaggagaggggaaacagagaaacuauauugauuuuuuuguuguuguuguuguuuuuuuuuuuuuuuuuuuuuuuuuuuuuuuuuuuuuuuugagaaaggguuucucuguauagcccuggcuguccuggaacucacuuuguagaccaggcugccucugccucccgagugcugggauuaaaggcgugcgccaccaugcccggcauaacuauauugauuuuuaaucuagucuuguacuauuguaucauaauugauucaaugaguucuugguuauuagacuauuuuaaaaauaaagaauuguacugcaguaugaauguccuugcuuggauuucuauacugaaugcugaauucaugauagugauauuguuuaggaaggagccuaauuucagcaucgauuaaaacacugggguagugaguuugggguguagguuagucaguagagugcuuaccuagcaugugagccuuguguuuguuaaucaacaauacuaccacuguguuagugcaugcuauaggagucuaucacuugagagguagauacagaaggauuagaaguucacggucacucuugacucuuuagcaagacugaggcuagccugugcuacaugagauccugccugaaugagaaacaaaagauggguuggcaggccuucucugugaaggcuuagggucauguaugauuucugcaguagcuauucaacugauagguucaaacaguggucuaucuaucuauaucacacacacacacacacacacacacacacacacacacacacauauauauaucacauuauauauguguguguauuauguauguguguuguguguauguauauguagacauagauguuuuucaauaauacuuuacuaaaaaagaaggcaacagggcugcauuugacccacaaauuguaguuuacuuaccucuuguuugaaacagauucaaagcugauuagggguggagcuucaucucaaauaggcuguaagcuaccuguauaccacugcauaugaggacucucuucccacuucaguuggauccauuucuguccaaauguauuacaaucagcacuuauguucaggcauuuguaaaaggaggguucagaccagcuccuagucuugaaccucagucaauuucaauuugaggggcuauugauguaccugcacguuuucauacacuuuagauuucaacacaggguaacaguuugaggggguaaauaaaagaccucuuuaaguuacauuauaggggaaacauguccauuuuccuaacucuagaggguugcuuguagaguuggguucuaggcaaaucugggaguaagguuaaauagaaguuuuagucagaaaagaaaccaugucauguccacaucugaugaaacccaucucagcagaaagauaccacagaauuaauuacugcccuuuuaguacuacgcauauaacuaaugaaguuuauauaaaacagcaauuauuggucuauaacugccuuagagguuuauguugaggaucagguaaaauaaugaaauaguuaaaauauuugucuuguccuuugugccacuaugaauuuuaauagauuuaugcguuauuuuucaaauauauuuuaguuuacugauguggauaaagccugugguaggugcuuuggaggaguacaaagcugaacaaaugaguuauggcucuuaguaaucgaaaaccuggcuuaaaauucaaggauguccagugcuuacguaauguaucuuagagugcuggggaggagagcccuuccuccucagcagcgucaggggaacucauauaguaguugccucugggaaauacagagacuucuaaagcacaauguguauggggaggggguugcaggggguggggagugacagccagaauagucucccagugaggagagccaggccagcacaucagagccauugaauccauucacuagacucuaggugacguauucccgagggaagagaagauaaaacugaaggacaggccaaaguuggacucuuugaggucuaagaagaacuuuaauugauaauuuguggggaacuuuccauuuaauagaggagaacacaugugaccauuuguggguguuguacugguuuguguauguggaaugauuaaauguugguuauuacuuaacguuuuuggaaaggaccuaguugauacuuaguagaauugauuaucugcaaggcaguaagguauagcugaggagacugaaaaacaagauuacacugacuuucaaaaucaguggguuugggauauagggagaggaauuuaguuaugaaauauggcuccaagugaacauuaauuagugauuuuuuuggugauaacuuugcaaaauguagggaaguuaggggugcacuuuagcaaagaaccaagagcagcauugcccuacuuuguuuguuuagugagauacuaacuugauaccuaaaaaauuuagggggagcaugccaguucaggguuagcauucacaugaaacagaaaggguagggauaugguauccuguucaucuggaggugacagaugaaaccuagguagcaaauaccauugaaagauuacagagggaaaagugugauuaguaacauuacucauuauuagguguuguuagcuauaugugagguaacuaauacccucagagacacacagacaggacccccccacacacacacacacaagcacuucaugugugcagugcucuguuuucucccagcuuucuucccccuucaguuuucaacacugcuagauuucaggaaugaggcauguucacuuaggaugaacauauaagaauaucuccacuggaaacuguaagaaauuccuucuuauuuuauuccccauuuccuauaauccgugguaacaaagacagcacuggugggaagcguuuuccauugcccuuuaucuuuucaccccccuuuugccuuucacuccuacagagaucggugcauuugcggugcguacagcacauuucauagaaagcaguuuuguacccguuuucucuuuuuagguccuuggcaggcuuagagggaggauugggcuguggagagccuaguuuguguuugagucgacagaguuuuuacaguaugaaacagcaggacugaaugugcugucggcuuccuuucucauuucaacuuuuuucaaguucaaguuuuguauuauucagagaaaaacagcuacuucuguuacucuuugggcacaguuuauugauguuuggucacacguuauaguuucuggcucucuuguucagauaacuugggcucuucugauuagugguacccaucuuuaggcucagucuugauugcuggcuuuaacuaauuucaaaugggaugucagggcucuucagaaguguucacaucuucacucagccauuugugugccaaaucuaguacuauuuucccacuguauuuuauuuaagccaucaauugcuacuuuauuuuuaaagaucacugguuucacguauaugguucagugguaacuugucaugucgugcccuuugugcuccugacauugaaaugugacauacucuaucacauuucacuucaacuggacacaaggcacaagugcauuuuuccgucaacccuuuccuuucuaauacuguuaaauuuagagagaaagaaagagagccuaauugauugguuccauugugugugugugugugugugugugugugugugugugugugugugcgugucuauaaguaaaaacaacugaaauagauaucuugucuucugaugugaacaccuuucuaaacagcaccagcugaaaagaaaugugguggcuuccagcgcuuuccuggaggcugcguucuuccucucauuggagaaaaaguccuccugauucuuucuuccucuacuuuauacucuaagucagccuugaccuugaauccagcucagccucucaugcucuggaaucauaggcgugugccuccaagucugggucuuccugaauuuuuuuuuuuuuuuuuuuguuuuucaagacaggguuucucuguacagcccuggcuguccuggaacucaguuuguagaccaggcuggccucgaacucagagauccgucugccucugccucccgaggucugggauuaaaggugugugccaccaugcccggcccugauucuugauuauuauggaaagccagguaggcucagcucagagaccugccauuucuuucacuguuugcuuguuuagagaaaggcuacacaagagaggguaauccuccugccccagccucccaagugcugagauuauggguguuugccaggacauuggucuagauuaucuuagugauuuucauccacaugguagugucuguccccucugucagucuccugcuaaugcuugcagcaggugugaauugggacaugucauuccuugaucauuucagcacuuuaucucgcacuucuguuucuccuggcaugcccaaugucuucgguaaaguuuaugauguuuggggagguuuggaucuuacaccccagugcauacccuuugucuuuccgcaguaguugugucucuaagugacauuaucaucuggagagcuuuuacuccacuaguaaucuggcuuucuauacuugaagcucagcagggcagguacacuguggaccgccaauguggacugcugguugucagucaagagcaugucccccagaggguuagguuucuuuagauguuauuuaguugugcuuccuaagaacuccgcuuuuucauuugaaaucaagccauuaguaucacagaacacucagaaaauggccugcuauuuuauuuguuggaggauuggcuagaacaggagugcagagggggacgugugcuguaaucuacacuuugcauggugaagacuucaguaucagcucuuuugagcugagauacauuuuucuuuucuuuuaacccugcaagagcaagaagccuccuaaaauuggcaguguuggacucuagugagacucaguaagaguuucuccuguaccuguacuaucccuuuggaaguuugcuucugucaucaucagacuucuuuccuuaguaucucagacuucugagccgugauugagagaugugcugggugccaauggacgggcauccucuguaugcucagaaaagugucacgugucccuucuuaccaaccucacuagcccuacauagggacuccuuuuauacugauauugaaagaaaaaggcucugagauaagggacaagaagugacaagcuuagauuugaggacccagaaucuccuaaggucuuucuguuuucuucuuugcuuuuuaguuuuaaggcacaggguuucucugugcaguccugaaaauugcccuauagaucaggcuggucuugaacucacagagauccuucugccucugccaacugggugcugugcuuaaaggugugugccaucaccaccuggcuaagagcauuguuaccugucuguaggaugguugggguucaacauuggagacagaaauauuggacacaggaaaacaugugaguuuuuauuaaauaucagcaauuaaaacuugacauuccaguaagcaacaacuugauguuuaauuccuaaaauacggaauuaaaagagagugcagccaauuaaaccaauucaguuuuguucauugaauuuuuaaaaauucuaaugaugacacgggauaaaauggcucuacccuuacuuucuuuagggcuaauacccagguaaacugagaauugaaaagcauaagauacgcuguaucaugugguaggauuacucuagugaaaguggcuauuacuaguagcuaaagcauuugucuccauuucaccuguccauguccauuuaucaaacauggaagagaacgauagugauacgccucaguuuucuuuaaagggaaauaugcaaaggaaguucucucuauuugucugaugugagaguuaauaaguauuagguauaaagcccuuuauguacucuagaggaaagauuguguaauuuuagcauuauuaaugguccauuaaacuccucagggugucacaaagaagagagacuuucaccauuuggcccugguuuuauagcauaaaaacaagguguucuuguuuguggcugugaaaaucuguuauugaaccugcacagguugcuccugccacagagcuaggagcacuucuccugggaagcuuagcagagcaggugggcuccuaaguucuccucacuccugaggcacacugucuccacccccaagucaccuuccauuuuugucaacucccaccaaccaagucccaugacuccagagcaucccuggcaccagccuauauucuuccucuagaauccuuucccaucuuuaucuaauuccucuugguacauuccugucucaucuaaagcuucuguaggaguggguauguuucugccauuucuuacuagaaaaaugaccacugcuuucucaucagggagcaaacauucauuuuccuguuuuagauucuguaugcuuggcccuuggcagucuuagcuuaggggucuaguacuuagugaucuagcacugagacauauagugacccauacuuagagaccuacaaucuugucuuuaguuaaaaugcaguugggaaguugagauguagguuagaggcauacacagccucuggagcucaccuuacugucucuguuuuuguacucaugcauuuggcagcagugagcuuuguuugcaucuucacagugcugggaaaucuuauuucuucucucugucucucucucucugucucuuucucugucucugucucucugucucugucucugucucugucucucucucucucucucucucucucucucucucucucucucucucucucucuccaggcuaccuuauuguaggagcuguuucacuuaaugucuuuccugagcuuguguuauauggguggcuuuuccucuugcuguuuggcauucugaaguacuguucuguuucccucugccuuggaauguaacaguucuugcacccagcaugccccugggucccuuuacaggaauuuacuccuuauuaccucuuuccuucauucuaguuuucauguccaaauuuguauauccauucuuuuucagguucuucugauuggcuuccucaucccuuucaucauugcuggacuagaaaucaccagaacacuuucagugauucagaacugaucugggcuuauagccagcuuaacugagaagcuuugagcugacauagaaguuacuuuguuuauuugggcugugacuuucaugaugccugucaggcaaaagcuuacaugaauguuucauauuugaaaggaaaauuaaauuuuaagggaagucaucccugugagccccacccuccguaacacauuacccccaagucaucauucccaugucuucucucugcccucguccuucugcacacccuccacucccauccacucaccuccaaauacuugguacugcaucccuuugcaauuugggccauuuuaauguugucuuuuuaaaacuguugccuaacaguuuuauauguauccuaaguagacacauaaaaauguagugguuauguguguguguguuagagagagagagagagagagagagagagagagagagagagagagagagagaaacagagacagagacagaaacagaaacagauacaaacagagagaggggggagagagacagagagggagagagacagaagaggaacucugguacauuuccucuucacucuacagaaaauguguuuucuggaagccuuuugacacggaagugaacgcucacuugcccccccccccccccacacuuugugaauucuccugagaggagacggagagaggcuuuugugcuuguugucuuuuuuuuuuuuuuuuugaugauuauauacaaaguagguuguaaaucacucucuugugccccaggauuccucugagguauggacaagcgagcugcuagguaccuagcuucagcuuucccuggagaugucacacggcccuucccaaggccucuaacucgcuguuucugaaccagaaggaucaaaacagaaucccacaaagaaaccuguggaaucaaauuuagaaaugcuaggugauugguucauuaauuuuucuucaacaaaaauuauuuuguuacucuaaaagcaaaauauacuagaagcaaaaauuacaaaaacuacaauaucccuaaagucuuaauccuugagaauauuuuguggcaaucauuguaguuucaucaguauuaaagcacacugguugcuaggacaaaggaacauggauaaaggagaaucuccaagucacuuuaauauuuauauuccacacacugaagauguccacuguguuucaguaugucaauucccaauggaguaaugauaagguggccaguugugucucuucuugcuguuugucacuaucugguugcuuauagagaucuggcucacuucugagguuuuaaaacuggaagaaggagcaaaguauuccaaauuacagcuaauuagucagucaucuuuuauguccuggauguugcuuaucuuucuugaagaauuucuccaucugauaauugaugacaguguccauugcaguugugguaggguauucaguauuauuagaggauagccaugcugaacuuugcaguuggauuugaaucuuaguugucuugucuuuagaauaugugagucuucuauugugcaucauuucgucuuuuucuuuuuucugugagaagcgcaggacuccagacuuggacgugcuacccacugcuaguucuucuuugugacugggacuguugaaacauagugguggcuugcuacacuuuuccuuucccaacugagaagaccuuguuuccucucagaacuguauuucuaagugucugaaguuguaauugaauguaauuauaguuguuuaacuuucuucuuuccucuugagaguguuuauaaagugcauucugugagugugaagaugaaaagaagcuguaagcuuaguauuugugacacaggcaaauaguauuaagauaaguagcaauuugcuuuguauaugugaaauaagguauuguuuacacacaauuuacaaaauauacauucuggcuuauggaaaccauuucaguccgcucaguagucacauuuguuaucguuuuauaggaaucuuucucuagaugggagaggauucauuuugauauugaauauuccaagauugauuuuuuuccuuuuccuuuuauuguucccuugagagaauuacugaugcagaacucauuagugccccuccauaugucaacugcagcguacaaucagcaucauuuccauuugugacacaacacaaauuccuaaugccucugcuucacgaaugcucagccuuuccccuuacuccacaauguagaguaugcauucuuguuuugaacgugcuuauguuguguguuagaauaaaauacaaauaguagcuaguuuccuauauugucuuuauaauauguaaagucaacaaaugccuucagaauugaugacacuaaaugggguucuucuugccucuaguaucuucuccuuaauuuuuuuguccuuuucauuuuugaccuggguuucuuuuaccgauauuauggaucacaauuguuuguaauuuuacuuccaagggacacaacacucucuuuuagccucuaugcauaugguacauagauauacauacaggcaaaacaccuauauaaauaaaaguaaaacagacauguaacggugguacugccugagucacagcacuggggugguagaagcaggcagaugggggauuuaagguaaucuccagcuggauagccagaggccggugugguuuauaugagacccugucucauaaacaaacaagacuuauugacugugacagcagaugauaacuaggcauuuuuaccauuuggaccucagcaugacuuaccuaggaccuaaacauguuugaaaaguugacuggguuagguuaugagagaucaacuuuagggcaagugggacuguaaaaaauuguuucgaacuugagcagcaaacugauuugcaaguugagaaaaaagaaggaaucacuuauguagcccauguggcuaagaagugaccuuuaaacaaggacauugguuaacauagcugaucuuuggaauuuggaagacucaagacaccagaggaauggaagguacaggagaucugucucauagucacuguggggaggugcgcguugguagauacaugugauuagcacagcuagcaugugcuggcaaauacugauacaaauuuuauuuuaugucuguuauucuggggguagaauccagagcuuugcuucaguuacuuaccucuuuaucuuugagcgagaucuccagaccccagagggaaaaaauguuaaaaguaggaaauagaaggauucuaaauccauuugucuucaucuugaaaccagagaugaaauauuuggaguaggcaguauucagggacgguccugacugauugugagagaagauguaauguugaaagaggaucuucauggauuucaggguugaacuccugaugccaagaaauaucuacuaaauuaaaauguuuuauuguuacuuuuuuauaacaaaauuuauaucauguuucauacacuuaaagauaguaaguauuaggucugggguuucauuguuugauagcagaaccuuugcccacagugugucaagugccagguucaggcuucuaacccauaugaaccaaauaguacucuccuuagcaaaugagaagcaaaacaagguaacaguauguaaauaaaauaacaauauuuacuguuaguauauccccgaaaaggagaauuucaacagcuaucuugaggguggaaagggacuucagacagcauagaacucugugcacucauuuucucuggaaauuugaagguuagguggaaagaagauaccaaaauccaggagaaagucuguguuucugucuuuucuucccuacuuuucuuuuuuuuuaaacuucucuucuucuuccuguccauagauauuuauguaucaaugauguaaauauggggcuggggcuauaggagaaaaauguauguguguauucucuucuuacaauuaauuaccuuuccauaguuaauuaauuaaguuucaugcauuuucaauauauuugucauagcaaugucaaauaugugucaguccaucauggccuuuuucagacaugcaguugggacaucccuacuucugucugguauagugugacuguaugcagccucugugcccagcaucuaauauggccauauccccucagguuccacuggcaugugcuggcagagugcugggugcagacuuuugcccaaaccuggaggaaccagaccagaggcuggaaguccagguuugagucuuacuguuuuauuagcugggcaugcugugucagaagcaguuaccccuggaggccaguauuaucagugcuaucaagaagugauaacccuugagauagguauaaagaggaauugauguaguauauaugcagcaaaaggucuuuguaaggaugaguugugcauaauuggaagaaauuuguuaucuaucuacccacccucccauccauccauccauccauccauccauccauccauccauccauccaagagacauagucuggaauagaagaaaaauccugaucucugacgccugguuguauagacuggcacauauugccaugggaucuuuggcaaauauaaccuaugugcuaaauaagaaaagcgauccuuaacaauaaguaucuuugucuuaguacauugggauacgugcaaaguacauuucugcugaaaauguuggcuugguauuuaguucacuuuguguggucuugaggcacuagaccuggcuugguguauuacacaauacaaauauaacgaugaugaagaacaucuccgcuucugugugcuuuuaaaauuuuaaggaauguguuugccauuacaauguacagacugaaguuucagcauggauggcaugaauaaaccuagucuuucuagaguuucaauuuggcaucauuuucuagguuuuucaggcuuuacagagcaaguauauugagugcaauauuaaaguaucuuuaacugauuuagauguaacacauaauaaaugagaggaauuuuuacagcugaguuccuuauagugggagugaggaugagcaaaaggcagggacgcuaaacuuuuuguacaccaucucuucacaccugcucuuggccuagagaagaccaccccagcuuuguugugucccaaacugguacugucuaggugguguauggaugugggacaauagaaaagcaggugugacacauucggguccugaucauguauuuccuaguucuggaaagcuaacagcaugugugacauacagacacagggcagcaaaaagccuguucuugggacggagcuugauucuugaccucuggcgugauauaggaauguuauuccagcagucacugugaguggcuugagggugaauguuggauaauaugucaugagcuugugugaagaaaauggguuugcaauaucaguuuacaauacaaaguugaaguauuuucuguagcauauuaucuuggcagagggaaggagggaagagauguaaguacaucuuuagugaaaccugguugcggugacagugcgguugacaagucauuaugggcucggcagagaaaaucagaccgucacaaaguaaggaaggugaucauguuacugguugcuuccuucuguaacacgauuuuaguagaugagggggaaaauuaaaucucgucaaagauugccagcuaggcugaauuggugaauuagcugggacacauuuaaaccauuuccuucucuuuuccucuccuuccuuguguauuguauggcucccauaccuuuuaauaauacugauuuuguccauaguaugccaguuacaaugaguggaaucugcucuggaaguauuuuuaagcuucacccccuucauucuugccguggcauuuacuucguugcuccuuuuccacgugagagaaguagcagugugcuucagggaguuccuuccagaccuugccggagucauccgcuguucuccggugcccgacacuguaagggagagaggacuacugcuuggccucaggauucucagaguaaucuccaggacaugucaguuuggaagcaauacuuuuauauuguuucuuaggaugaacguucaugaagggauaacucucaugcaugguguaguucucaucgacuuagguucucaugacccauugagccucuuucugccugucacuucuucccauuaaacccucgccuuuuauccuuagauuuuuuagccaucuuagaagcuucaugguuugaucauuuugagauuuucgauacuugucaucaugucuucggucucgaguaacuguccuacucaguaccuggauugacuuuugauagaaaaguggcuagaaagucagauuuagcucaccuuaugucuugccuuauuuuucugaguggcuucugaaguagaugcgaagcuggaauuuucugcuuagcuugggaauuuuauugaugaauagcagcacagaauugugcaccggcacgacugccuucuaggacaugguccuucuaggacagcccccccuuaacugcugauaaauguuuuguauauuucuaacagacuguuggccuuucuuagccuagcugcaucuccucauggauugaguugguacaguuaacuucgcagcucuucucuugguugagaguucacuaugugagguuugacuugguguuuuucacuacugaagugcuuagaaaauuagaguaaauaaugaaccaauauuucagaaccagauuagacacaauuuacuguaauguuucauaaaccacagacuccuuucuucagugaaugcgugaaggaucucucucucucuuuuuuccagacauaccagggugcaaguguaaauuuccauaaaauuuaaaugaggugcuuccuguaauuaaugaacaguugaggcugcucucuggucugcauuguaauuaaccgugaucaggcuuguuuagugaugacacuguuccuguaauaauuugacaagcuacugugaauuugccagguuauuaaacaaccugcagccuuuacuuacggagucagagggacgggguccacagcagcagccacugccaguuaaaugcagcacgagggugaaccagaagccaccccuugaagucuaucuaucaccacaagcagauuuauaugccugugacuuuggagaacuuaauuaauguggcauggagauaucuugaaaacuuuuguuuauuguaugaugaaccuacugggacaaagcugaucauuuuuuaggacacacagugaagccugcacauuaucuguaguauaucaguaugaacaaaauggagagaaguuucccuuuacuaccuaauuauagauagauauaacuaauuuuuugaaaagcucuuuuagguucacuuacauauaauaaccccauauaaugcuauuuucucuccuuuuuuuauuaggaauaacagaugagugugugcuaagagucacauugcagguccucagcucuaaguggacugguacccuuauguccucggucacuagcacaccacccccccuuucagguuaagagcuguucaaaacguuacugucuaguuacuguggugucuuucauucagauucuguuuauugacuaaaccacaaggauuccugcccaaaguaccaggcggucucugcuugacugauuuugauuuucuaacaucagcccugggguuuauuugaaaaauguacacacacugcagcuuuaacaagucaagugacugcguguuuuuuaccauggaguacaguauaucugaagaucauuaaauuuggugguggggguggccauggcagaacaugagugugguaguccuuguaugauguguguauguguguguaugugcaugugguguguauguguguguguguguguguguguguguguguguaugugugugugugugagagagagagagagagagagagagaugguuuuugucuuuucaucuucuccaagagccagaaaguuuccugccguucucuuuccagcuauugacaaaugauugccagaugugaggucuuugcagcgcucuuucccucagcaaaccugcagcgaagggauauuugauucucccuugcccauuucaucuccuuuccacaucugccagggacacacaagcaauacaucccuacaugagaguuuaaaguuuacucagcuccuuuucccccucagauaaaguguucagagacaacagaaugagguccgcaugacgcccucccgcccucccuguaugaaauuaguuguuuauuuuacuuaucuaccucuuaguaaucgaacuuucauuucagucuccauccaaggaaaaucugaugcaacucugggagugcuaagaguuuacuauugucugcaggcuacaaagagugucaccacuacagcuucccccaagucccucagcucugagaaagacagucuauucuauaggcugucccaggaaagcauuuaaucuacaaauaccaaguguuaaguguugaauguucuguaggaugcaauagucauuuaaaauuuuaaaaaacaaaaaaauccaauuauggguguggaaaaagucaccuugcuccaugucccuguguuuuuauccauuguucaaguugcuauguaggaggcuguaguuuaaucacaaguagcuuguuaaagagaaaguguagggaguuugggaggcguguggaauuaacuugcuuggggaggccacacacauaaucacugacaugcacaggggccuugugcaucuguuuagaaucuguauugauacugauguuuuuuguuucucaucucaguuugaaaauaguuucuaaaaugcccuuauagcucauguucaugcuauagggugggcugacacagguggccuuucuguuuuccuauuacacuuuuuggcaaacgaaaaggccccuuauucccugaauaagaucaggguauuuuuuuaaaacauuuaaaaaauaauccauaaaaugucugccacauguucucuaguuuauggaaauguuucccaaaucagagccauguauugaauucuuauuauaaaagugcuaguguguuuauuucuaucaccuuuuuagcuaccugugauuccuauuuuaugugaauuuguguuuuaugugaaacucaagugaagaauucaaugcauauuucugaauuuuuagacuaagacguuuuauuguugguauuaaaaguggucagguaaaauagccgugauugccuggcauugcagucaaaacaggaaauaguaacuuuauuuccuuuaaaugaaauuagcgaaauaauaguaacagacaaaacuaagcaacaaacccucaguggccccugggaaagcaaaacaaccucaaaaaaccuuaaacacuuaaguaagugggcaaagccucuaaaaaagaauugccaaaauauauuucuauguacuguuuuuauugaauaggcuagaggauaaucaugacugaagagagagacaauacuuucaaauugcuuacacauaaaaacaagacacuucugaaaauagccaagagugauuaggaccucuuugggaaguuuaugcugugguuguuccuugugauccucugggagagauggcaugguagccucuccauacacucaguggaugcuguguggagaaggaggaggcagagcccuuuccuaaguggcaagggugggaaccccagcagcagcuaagcuccuccaaguuuacaucacuuugcagaauuugccuuaacgaaugcauuugcugguuucucaugacuuccugcuuuuuccucaccguaguuacucugggaggcagagaggugcuaagcaauggaggugucauccggcuguguaccuagggaauguccuucagaggacaacuugucaccagccgucaaagaagagaguggcuuuguggucucugaacaucugguagugcugcacaggaagcugagggggugucauuaauugugaugaaauaauuuaaaccaucaggaauaaaugaggcuguuaagcuaaguucagauuccauuugccaugcacaugugucuagcagccugugugcaguuaaaaaaaauugaauuauauuagcucgugaguagaagugaaacagauacuguaaaugaaacaaguugcugugcagugaugacacgguauugagucacuucacagacucacaguuuguaggaucaauagagcaaaaguggugcauuauuugaugaauuuuuauaugaaaaguuguuuuugcaagguaguaaguacccugcaaggaccagcagccugggcaguaacgcggguaccacuuuuuuuuuuuuuuuuuuuaaacaugcugagaacugugguguagaccuugguguguacucacccagugaggaagaguagggguguggcuggauaaagcaagucggcagguccagggguggccuggcgggagcccuuugucggucuagaagcacagugcaccuucccguggagccaggcucuggagcacagauugcacucauugugaacaugauucgcaagcagcauagaaccaggcaucuccgacuucuucagcaagacaguaccguccaccagcuuuuaaaggucugagcagcucugagguuuuaugacccauggugugucggcuccaaaguauacuuccaaaauaaaacuuaacugcuguacacaagagcaaaguuucggauuugaaccuuuuuauuuuuuucgaacuaaccuaaaaaauuggaaagaaaaugagacugccuagguacagaaaacaugguugaaaaaaacaaaggagagguauuugcugucagaaaacaagaugcaggcgcugggcuugagcccugacacgcuuuggauaagagccacuggcugcagauacuuuaucuggccugcucccuccucucguguugccucgcugccucucuuucuguccacuccugucucuuuuguguuuucuccacauucucuuuuccuaucuguauuuucacauuacauuuuugccccuuucuguuugcuucucuuuacaucuuguucucauuuuccaccuuaccuggaagcgaaucuacaauuccacuucaucuacagaguugagcugauccugagaagauuggugcccacaauuauucugaagaaaaaaaaaaaaccauaaaaccugagauuaaaauugcguucauacauaaaguuguaugacuguugauggguuuaaaaaugugaaugaauuugauucagaaguuucagaaaggaauacaggauguuaauugagacaucucuuccuguuucugaguaaacauuguaucagugucauucagaguuucguagguucaggugaauacauuccuucucuuaugcagggcgauauuccuguagaaacccuugaguucagacuugcuuaaaacccagaagaguaaccuguuggaggugcccucccucuguguguuuuaucuguggauuucauuuuagucgaugcaauggaauaggaaauuuuucuuucuuuggugcugccucucauuuauggaaggaucagaaggggggauaguauuaguacauaaggcauuuuauauggcacauaauaacaguaaauauauucuuauuguguuauauauucccuaguuucugguuaccuaaaagcuaaugauuaaggaaaaaaucccugagaaacauagauaccuuggcuguguaaauauuauguaacaaaauaauuuucagguuaccuuucuaccaugguaaugaauuaaaaguugacaaaaaauuuaaauuagguaaugguuuuccucuauuuuuacugaguauucucugugcaucuguuuucuaaaaccaagaaaaugauagugaauucagcaauugaaauuuguuaguaaauacagaaaauuugcugaaugaauguaagguuuuccccauuuccaaccccccccucccuuuaaauuuuggcaggcuauaaauuaggugcuuuuauauauuuucauacguuuuucuuuuuaauuuuucuguugcuguugcauuauacucugcuucuguagcaucacagucaugcacuuguguagcaugaguuuuaauauuucagauauauuaugaaugaaguaaaggucacauucuucauagucuaaguguuuugaugagagaauguugccugaauuuugggggauggauuugacaugcgcuguugauguuggugacuauguguacuaauguucgaauggccacugugcguaugcauguuagaaauggcugagcgaggugcuguguuuccugugugugauugcuuaagcuuuguuguaacagcuuuauauggaaaggagguaagaaggaaagaggaagcuuuuaggucucaucuagaugagagaauuccguauuucaggugggcauguacaugugcauggguuuuuauaaaauauuacacacuauaccauacuuuauaguuacgaguuacuaauuaucuuccauuuguauauuugguugaagcuaauuacagugaauacucuauauuagaacauacaagucuuucuguuucuuguacgaggaaagaaaaccguuugauuuuguagauaggaucaucucaaguuguguguuagguuccuuaggacuuauaaaugaaaauuguaugaguuguaaaaaaccaauaucuuccucugaaugauuuagaaacugugugagaagcuugguaggacuuaucuccagaucaccccagcacucuucauugcuggucagagccuacaugauaucaugugcuuguuccuauuccuuuagugauuauacaaauuacauggcuuuguuuuaaaauugaaaagcuaagcuauauagucaauuugccccauguuccacacgauccagaagaacauaaagaacgcagaugucagucuuacaccuaacccuggugguggggucauaguucaggaggauucaguuuuaagcauugcagagcagucucggcagguuuuccguggaaaauaaaaucacauuccccccgacccccaauaugaccugugagaugugcugaagcaguacuaaggcauagaauguuuggggcugcuuguuuuuuuccugucuguuuuucuagugucuguuaauguuguucaaaagcuaccucuuaaaaaguaugaaguagaaauagucacaucugagugagcccuguuucaaaagcaacgugucauuugcagauauccaaagaaagggauugccucagaguaugaaaguuuucuuuuauguucagugagugccggucgaguuucuuggagcacagaggcagacuaaguucccuugaaaucguuguuacuuuuacaaaacaucuuuaagugccuuuuuggguaggguacugugcuugcauccuauaaaaugugagcugaacagauagggucucugcccuuuaggaguuuauaaucaaaaacauauaaugcagcugacaucuguuauuguauugagguuuuacaaauaaacguugaucacuuauauaaauaaaaguuuuauaacaaagaggagaaaagccuuuucuugccugauuaaauaaguaaacacacauccuuauccacacacugaaacuauccauagaaguuguaaaauggcugaauuaaaauaaucccaacaccagaggacucuauuacagcgugcuuuuagaguuuuggaccaugagucgaugccauugagggucuccuuugaaggaccugauucugggaugguuuguuuucugcugaagaagacggacaugaguucagucuuuuguaccuauggguuuucuccaguaagauuuuuuuaccuaagcccuuaauauuauuaaaaaucaugcuuuaaaaugagcccuuucucucuuuguucuuucaguagacgcuacauuaaaacaaacgcaggcauuuaaaauugaugcugauuaugaaaugaauuuacaggagugggagauugacuaagaacuccuugcaacucaaguuuuggugaaguuacacuaacugaaauuaaauguguauguguguggggggugaguacuuaguuggauaaguuuucuuuccucauggcuaauuuuaaugcugggcuuuaacaguuucuucauuuuugagugacuaacaacauugagaagacuaaacaugaacccagcucaaaggucaagacgcuuaaaaaaaaauggcuaucucuaccucacuguagguaucugucuguguaaauugaagcacgugggugcauaaauuaauuagaagaacaacagucagugauauaaaucaaacuuauuugguacacuggugaaaugagcauuguuuauaagauuaucuuguuauuuaaucucuucuguguaaaccuggcuggcuggcauuaugaaguagucacacaauuaaugcgaugaugguauacuuuuucucgcacaggucugguccugcaggccuuucuugauggauuuguauauauagaacuggaaauuuuaauuagccagacucccccccaccccuuugcguaugucugguuuucuuauuuuauuuuaaaaucucaaaauguccucagagauuuuuauuuuuauucuuuuggaccaguaaucugcugaccccgaaagaacaaauugccuucagauauuauuuuaucauaacuccucaaaguucauuaucagagcuaccugcugucuucagcuacacugugcugugcugcuggaucucaaauaaaaagaaaauuuuacucauaaaugaacccauuaggaauuucuugaauaaacaaaaggcggcuuuucuuugauguacaaaggaauuuugguuauaucuauuagucacauacgucuuuucuuuaugcagacaacgaucauuccuuauauuuuguaugaaacugaaugcugcucuauuagcucuggugcaggagauagacacuuuuuaaaccgccagacggagucuuugccuugugcgguuguuugugucucuguagcauuugcuucacaaccucugcuuacuuucuuguuucuggguucuguccccaccugcuacugacuuugccagcugauuucuuuguuacaagauuaaaaacuuugcucuggagaaguaaagaucuguugguacucaucucauucccaguuugccuaacuauccuuggccuucuuuuaggauuaauauuuuaugacagggcuguucaauaauuuuacaaaugaauugcaaaaaaauguaauuuuaucuucuaaaaucuuuuaugacuuaaguuuggggacuggaauuuguuguuguuccuucuuaaucuccuauagauagaucuagaacaguccuuuagucuugugcauagauagggaaguuuugaaugacucaaugcaaucucaauuguguggguuuuuuuuuguuguuuguuuguuuuguuuuuuuuaaacuuggguuauugacuucuuuauuggcugacacugguaauacacacuuaaauauuuggauguauuauuuagacgauuuguucucauuuucaugugugucauaaauuuuaccauuugaauagugauuauuuaucaugccauagcgauauuccuuacucuuaggaguauauauuuguacuuuugggaaucagcaaccacaaguuaacugaagaccagucagccaugaaugauaauuugcugagaacuuacuuaaugaggaaaaaugguguaagaccucacauuauguguguucucauacacuuucauccccacguccuugguuauccagcuuauguuguaagucauuguuaaaccaugcagauauauuuacagaggauuagguagguuuucugcaggcuucucaagguucuucguaccaaacguguauugaaaucaagguaucuguguacuggaagccaugccuguagugcaguagggcaccuucuguguugaagaggugacuuaacaucguuuucuucagcuugcugaucagagccagcuucuuguauaugguaggagggaaguuucuaagucccaugagaaaacaguauggagcuguaugucaugaccccaucugggaguggaguaugacugagccuaucaaaaauccagagauguauaaaucauccugauagaugcccguuggcaaaggcacagaccgugugugguuaaggcuacaugaaguaagcaccuugaguuuuucucagguguggcuucuccauagacucuccauagcuggaugugaagagucuaggcuuuccuccacuuuccuccucccucuccuuuguauuucucuuuacuaugaauuacaucauggugucaucuuccccuccauguuugauauagucaguuuuacccuagccauucauuuuaugauuuccuuugaaaguugauauaaccaguguccuucagagcagaucgugacauuaacaucuaagaagaagggucuuugucuagggaagaacuuagaggaggaaugagagauuggagaaccaauguaaagaagaguguggagaggagcagccuugcuuuugaguggugcugcuucucaguaaggcacaucaugaaaauggaaaaaaucuucauccuuuagcucucauuuucuguuaauuacuguggcucucugagcagccauaugccauacuggugauugucuggaaucauaaguacgagggagaagcguaaguuaagguggcgaguuagcgggcuaguuagcagucaguagcgauauuaguuaaugcaucuggaacacggggugaaauggagaaaauugagagcucauugggacccauauguugauuuuacuucguugcauagacagagcucugacauacuugcuguucuguaccucugggaacuucagugcucuucaauggguaaguuaacuauacuuguaaccaccuccuuacuauuugaaagaacggucugcauuucucccaguaauuuugggcaguucuuagaacacugacuguucauacuaggacuagggugaucauuauuuugacauaaguuaacuacuuuauccacaaacaaguauuaucccaauuauauuucaaaaucuucaauuuuggaauagggggaggcuguugccuauucagcuucucucuuuuccucccucccuccuucccuuacucucucucucucucucauaauauauacauauauguuuauauuuuucucuuuucuuuccuuuuucccucccucccucccucccuccuccuccuccuccuccuccuccuucucucucucucucucucucucucucucucucuuucuuucuuucuuucuuucuuucuuucgagacaggguaucucuguauagcccugacuguccuagaauucacgcuguagaccaggcuggccuugaacucagaaauccgccugcuucugccuuccaagugcugggauuaaaggcgugugccaccacuaccuggcuaaauuuuucuuaaaagaugaguuauuuaacaaaauuaugccauaggaugauuugacccauuguuuuccagauugucauugggaccucauuagguacaaugacugcuuuuauugaaccaugauacaugauaaguugaggaagagguagaagagaaaagaauguaaggaaaaccugaaaaguaguucccaguagaauugaaacacuacgugcaauuuauuaccuguuugacagaagaaucuuucacaaaccaacaucuaacacaaguagcugagccacacaauuauuauauguauuuauuacaguuauguguuuuauauuagagucaugguccccaaauuaaaggguaaccauuaggacagaucauuuggaggggaagaaaugauaucaauguuuucaguuggaaaugcagcucaagucuuuaaacagcuuuugcuuuuuaucaguacaggaacuggccuugauuucuuguuguauguuacuagguuucuuucuggcuguccuuuuauuagaguaguguguguuccugugggaaagagacuuuaagggagcagaggaaagcauggucuccacugaugugggaagguagaagacacacacugcaaaccaacuacacagauaguagcucacaaacuaaaaauucuccauuuacuuuauguugaacaacaaaggaacugaauaaagaaauaccagagagguagauuuuauuaugguuuuacaguugcuuuaacuuccucagucauucuguaaaucguuaccuaguuagguauuugugugugugugugugugugugugugugugugugugugugugugauuuguucuuucucuaauucagacacaggucacugcuccauuaaagaagaaaucaguuuaccaugcuagaacucuuuuagucugagugaggugaacaggugacaauuugagguuaacaggccaauaugguaaaaauucagccuuuaaaaaaaaauagagccuuaaguguguguuagaauauacuguguagaggacaaggagguuuagaguauaagaaaaaugacuguuuguggaaucuucaggaacaauuuuccugccuugugguuggucacuuucaauguauggcaguugcuuuccauuacaaucucaagagccaaucaauacguacaauauuaugcaacuuacaguuauauuauaaccaaaauaugucaagugugguuucugaguggcugauuuacaguaaguguucuucaguccccaaaguggguauuaugacuaauuugaacucccauagacaggcauuuuuuccaugugaaauugucugaguguuguggggaggguuuggagagaaaagaggagcaguaacucugucaauguacucacaugcagauugaucaauugucaucuccuuugcaucuacauggauuguuaugaguuauuugcucgcccugggagagacgugcccugaauuauaauaauuuaaaaucugugaaucuauuaaaaccauauuuguagcucuaaaaaaauugauauucacugggcaguuugcccaacaagagaaagucaaagagauuacauaguuauccuaaguaacagcaacugcccugccaguucuuccuuugaaagaauacagcagacccgaauuauacaucuauggguaagaagaggcaagaaaagaacucaauacaucaaaaucagaaagugaauuccacaauaaugguuacaauaauguuucaagaugugauuucagcagaggccuaagucacugaacuaaucgcaacuuggauagguuuaaaaugauuuaaaacacaucuugugguuuuuaaauauguuuacuucucucacuuauguaccaauaggccccgugaucacgugggcucagggcagcagcccuguuugauggagaauguauggacuauguaacacccacagacuauggucucaggcuguccuugauauuccucaucuacaggucauaggguauggugaugucaaagcuuucugaaugaacagucugaccuuuugcugugggguuggcaacacaaggcugcauugaaguaagcugguauuuccaaggcagcgcuuccaugugaaaugaggauaggcagcucugaggaacuguguugugacccuaggaagagucagguuuagucauauuucucugccuugucucagaaacgugugcacaugcugaaugaaugugacaaauacuguuuuugcauggagucgcaguguggauaggcgaacgaaggaacacuuugcacaacggacacauguucuaggugcauguuugaguaaaugugggaccuguggcacuagagaaaaagcaagcucacuuaaaaacgucucuccuugagggcaaaugcauguuugugcuuaucuuuauauucugcuguuucacauguagcccugcucauaguagacccuggcaaagaguaucauacuacuuccuguuuuguaaacuugaagugaauuuuccauauuuccaagaagguuucuucuuuucauguuaagaguuugauagauguugggguucauccuguaucuuguucuguuaauguuaaagaccaaauaccucauucacuguaaucauaccgauaaagaguuggagugggguaaggugguacacaacuuugauuccaguacucagaagauagagcagguagaguucugaguucaaagccaaccggaucuacccauuaaaagacacugucucaaaaaaaaaaaaaaagcaacaaaauaauaacaacagcugcagcagcaacaacaaaaacgacacuugcuagguagugguggcacacaccuuugguuucaguacuugagaggcagaagcaggcugagcucugagugugagaccacuuggucuacagagcaaguuccaggauagccacaaauaaaaaaaaaucagucaaguaaauaaauucaucuugcagaucuuauugaagugaaacccuauuucaaaaaacaaaacaaguugaauguacugucuuuccaaauauuguuuuuacuuucuauacuuaggaauuaacuucuggggacuguuaaggaugauuuccaauuaugacacuuagaaagaggucuagagacccaccauucacuuuuaauuaaccacugcauucgguuuuuuuuuguuuguuuuuuuuguuucugucuaggaauaaucuuucccuuguaugaaguguaggcccaauaacggccucguuguguuauuuuauucucagguagaccuguuaaggcuacaaaguguaaaaacaaaagauaaacaaaaccucaaaggcaccccugaguaagaauaagccccccgaauugguuagcuguuaaauaaguggauacuguuguuagacaguagacauagcuaauggagagagguggguacaucucaucgcccugccuggaugaaccgacaaacacacccgagagacaaguaguuucaugacaucauugcagguacacucagcugaugcauggcacaugugugcaagguacaccucugaaauuagaauuuaggaccuguggcuggguccuaaguuguaaugcuccugccucugcuaccucccaguugcugagacuacagaugcauaaccagcuaguauuuacuuguuuaauuagaaaccugcagugcuccuuauugccuuaauuuauggggugaaaugccaccucaguacuaguucauaaacauuugaacuugcauauuguaacugaaaaguagaagaaaauaucaaaauaaaaaaaaaucagucaaguaaauaaaaucaucuugcagaucuuauugaagugaaacagauauaauuuccucaaagcaugacagauuuuuuuaaagguuauaucacuuuaugugccaauugacccugaggucauauggggucagggcaacaacucugugcauaugacccuguagaaaugaaugcagucauauuuuauaccaauagcaagagauaaacuugcuacggugguugaaucaagaaagugcccugaauuagauggguguaugccaggugugugcugggugugugcugcgugcugcaugugugcugcgugugugcugcgugugcugugugugugcuaggugugugcgugcuucccggugaugggguucagccacagaaucauccaggucucagcaauagaaucugacuuagaaguuuuuugaaaaacauuuuuacuuaauugccaacaaagcuuacacauuguuuacugugcuguguguuguuuuguucauucagguaauggaaaguauuuguuaguaguaacauuuugguguaugcuuuaauauguuguuuuaauuaauuaugcuaagugccuuuaaugccuugcgacucuuacugaaagugucgugauagaggaaacaaaauuaaaaaaaucuauauaguguuauaggaaaaaacauugucagcaaagauggaagagaucaagggaaugucaaaauuauuggagugaagaaaacagagaauugaagaugagaccaaaaccagguagauagagaugcccgugggcaagauacagcucugugugaaagugugccagaagguagaacuucacaggaaagguuuguuuuauggggacguacacaaaaucucaugaccuuuuguuuauuaaaauuaaaauuuuauguaagauaucauacacaaaguaugggacuauuuugcaaguguaaagauuuauugaaagcacaacaauauaccauuaauacaucuucaaauaaacuguuaauugcagauagcuuucuuacuauuuuuaauucugagaguucuuauugucaugguuucuagaaucuaaguacagugauuuguuuguuuuucaguuagugaagauuuccuauggagucuuggcagauaaaugguuacauuuuagaugguuuucagcuuuuaauuuuaaucuaacuaaugccuaauuaugaguaaaggaacuuuggaaauuuccauuuacaacaaagaaguuagauuauguaaauuacagaguaaaauucguucucuuuagagaugauuacaacaaggaccaccuaacaaaagaaguuacgugucuguguugucuucauuccagucauuucuaaagcacugcccugacugacggaguucuuagguuuagaguaggcagaguuaugcaguaucaaggcagcacuuugugguaauuggccagcaucccagugcacagaaaaugucgccaaauaauaauucccagugaaaacauagaagugacacagaugugugaguaagccacaagacaggauggcagugugcacugcgcucaugcuuggcuucagaacuucucucuuuaaaaccucccucagcagguaagagcacuggccauucuuccagaggacaggggaucaauucccaacacccacauggcagcucacaacugucuauaacucuaguuccagaggaucugacacccuuacaccaaugcuuauaaaauaaaaccaaaugaacuauggaagaaaauguucccuugcaaccuaacccaccuaguuugcuuuucuuguccccauugcucacacagcuuucugugugccucaguauaucugauccuacuauacauuugacauuguuuacauuauuauucuuuuuuguuaaguucuuuugaguuagguguuuucuuuauagccuuggcugucuugcagccugcucuguagacugaagcuggccuugaacuuagagacugugccucccgagugcuaggguugaaggugugugccaccacaccuggcuucauucuuauuuuuaccugugguuaugaugugauaguaucuugauucauggauugacugggaacaguagugacuguguguuuuuguuguuguuguugauuucaaacaaacaaacaaacaaacaaacaaaaaacuaaccucaccgagaaaggcauuuuggaaagcagaaaauucuuccuaauuuuaugccaucccaugucaccuuguuguuuuaugguagauguuuucucccauguguagguaaaaucuucucagcuaucucuggcuauggccauuuuaauccaugcuucuuuaaagaucuacccuauaggaaacaguugggggugcaauuaauauaaaaugcaauuuggucucuuguucacauaauaggguuuugucuuuuguuuuuguauuauguucuugaaagcauauuaaugcaaaacaucauaacauucaccacuuaggggaccaaaauucugauuauggcaauauccucauaugauacuaugauacuaugugaauguauccacguggaaaugaaccagggggaguugaaugcucgaagugaaccuuccuuuguaaugguuaacuggauugcucucaccuuguaaggcucuaaacccuagcccauuuuucuauggaaacauauuugcagcuguuucaaauaacuggugguuugaagaugaaucuucaugugguuugcuacacacucaaaaaccuagacgugucuaggcuguuugucucugaagcuaaggaguucagauuaacuucaaauuagucuuuauuuauugaauauucaaguuucaaaaaaauccccaguuaagauuuaauuauauaaagauauuuauaauuuucuuaagacauccauaaagacauuuauaauuuaaaaaauuaucaguuuuguuucauauuagagauucuuagacaugucucuaagucuauaacuacaugcacaaaguuuaaaaacaagcaagaaaaugugaagaccagaauuuucggcuccuuuaagaguagucuagugcaguaggaaugcauuagcauguggcuggggggaccccuguguaugggagagagcugauaacacugaacuuacaugguuccugggcuugugaggcaaagggcauuagaggcuucucguccuaugacccacucaugguuucaccccugaggaacuaccaugcagguaccuaagguacugaucacucucauauaaucuuuggaaguugacucuauggaugaauuugggauugaggcagggugggccucaguaccaacaguuuuauaaaugaggaaacucuuugagaaagguuauguaguuuaccuaagauuuccugcuugaacaaaugcuuuaaagcacaacaaacuaacauggccauguuuugcagugacauuuagggaaacugacuaaaauauauggccuguugacuauuucucccuuuuuucuuucucuucuacuuuauggcugcuuuucuuuuucuguacuuugaaauuaauguaaaugcauuuaagaacacacauuuucgaagugauaucaguuguaaacaguuuaacaaugagcauuuccguucuuucugcacacaguacugguuuagagaauuaccgaaugguagaugucacaguacagaugaccguccccuguaguuagccucaugggacuuguagauuccauccugcuccugcuguaggaauucuauuauugauccucucucucucuccuccuuaggaaguuuauucguuuaaaauguacuacuacagcuguucaacauacagguuuuggaaaaaccagaguuuagaaaaacaccucugauaccagcuuccauaagauaagcaaagucacauaaccacugcagucccuaaguuauccucuaguugauaauggucacagcaugaucugugcuaccauggagaggaugugaugcaucgguuacauacuagaguauuccuguccuguaguaaguacuaugaguaaccuccuaucaucuccagggccuguauauaguuccaccacucagaaaacuauaaaacaaacuuuuguucuaguucauucuuauuccauuucaguuaauaaaugcccagcucgucucuugugagacuaugccggggccuggcaaacacaaaaguggaugcucacagucagcuaauggauggaucacagggcccccaauggaggagcuagagaaaguacccaaggagcuaaagggaucugcaacccuauagguggaacaacaauaugaacuaaccaguacccccagagcucaugucucuagcugcauauguagcagaggguggccuagacggccaucacuggaaagagaggcccauuggacacgcaaacuuuauaugccccaguacagggccaaaaagggggaguggguggguagaggggugugggggaggggaugggggacuuuugggauagcauuggaaauguaaucuucuuucugcuuuagccucucacugucuagcuuguuuuugcuccucucuucagaugcuguggagaccugaccucaucucauucauuuuagauuuuacuucggucucugugacaguuguuucuguugaauaguugugcacacgugugcgugccugugugcauccauguuugugugcauucauguggcaagguccauggucggguauuuaggagcuucuuaagcuuuuacucauagcugacagcagcugucccuuuucuaucuugauugugucaacuaaaaugaaucuaggcauccccaagaguaucuagauggcagucuguuuccuacuuagaauacuuuccuguauaugacuuugcugaggcacuuaugaucccauauggugguuauuucacaccaugcucauguuuuacauuuaugcacggauguguuuaugugagaaugcuugugccacagagcacgcaugaaggucagaguucaccacgcagaauuuuguuuccuccuucgacuauguauguugggagauguucaucagacuugguggcaaaccgccuuauccccugagccuucuuguuugucucugugguugucagaggccagcguauucagggcuucuagagcagugcugaaacuguaugaucccuagucagcacguguucauucacugacuaugccagaacugugccccagacuuguucuaaauaauaagacacgacaauaagcaaugugaagaauuuuguuauuuuacaagaaagaacuugauaguuugauuuugucaauuuauaauacuuuuuaaagauuuauuuauuuacuuauuuauuucauguauguggguauaagguuguugucuucagacacaccagaaggcagccucggauggccauuacagaugguuuugagccaccaugugguugcugggauuugaacuuaggaccucugggagagcagucagugcucuuaaccacggagccaucucuccagcccuauauaauuuuuauaagugaguuuaagguuauauccuauaaaggauaugugaaggaaaucaucauuauuuuaaaaagagaguagauuuuugaaugccugaaucauuuacuuaacuuuucuaccaugguugauguacucuuuuuuauggcaaauuuguuuauuccugggugaaacaguucgggacauuuaaugguccuuuagacaugucagauaaauauucaaggaggauuuuuaauauagugagauaaaaagaagcauagcuacagagacuucuaagagugaauuaaguucauauucuagguaggaguguggugugugugugugugugugagugugugugagauaaguguccaugaugaacucagacuugugacugacucuaaucauugccuucacuguggugaauuugcagaauuaagguaucuaugaugucagggcaagaacauauauaaccgugggguguaccauauuuccuuuucuuacauguucuccagccuccuuucccccuccuguauguggauuucuguagucugaaguguaugugguaaguauucugauccuauggccuacacugucugcagagguguaugugagugagaccccuuuuaaucacccguauaaugauugguggcucccuguuguuaaaccacaguuauugauccaucaucgcugaaguacauagcugaaggagcuggugcugucaggcauugauugacuaggaaggaaguguagagauauucgaacucacuuuuauuuucaucagcaacaguuccaguggagaugcgagugagaccuucaugauggaacaucauuuuuucugcauuaagaggugucugaugugacugaaauugcuggaguaacucaaaggcugcguuuaaaauauuuagaacagaagaaacugucugaaacuucucaucuggcuuggcuaaugguucagucucuggaaaauggaucugaggguaggagucaaaaaggaaggugcuauaaaauuauucagaagcaaauuggguaacaaaugauauauguuaaaauuuuauaaaaggaauuuuccacauaagauaguguggauaaaccuaccauguuuuguguaaauugaauaauuuccuggcuguucagagaaguuuaaaucagaauuaguaguugucucauggaacuguucucacauuuugggauguuugagaggguggcagaaauacacacucucacacacacacaaacacaaacacacacacuauguaaggacaaauuaagauacagaagauacuuaggaaagugccccucugcuuucauuuagcuuagguagauuuuuaacauccgggugagcauuguuuguuucuaaggacuccuuaauagcacuauauguccuagcuguaauuagaacaaaauagaacaacaaaaauaaaugauggauagguauauuaagaacaaaagucagaaacaggacagaagccaugaucauaucccuaguggcauuuucccaugcucaaaccuuugucccucuuacugaauguuuuauuuuguuauaauuacaguaucuugccuguacuuugucccucugauccuuuguuaaagcccagaucacucugugaagacggagcuccuaggugugauuuauugagugacagguagcuguaggguagaacgcccgccucuguaccugaguaaagcauuagacaucacagagcugggguagguggaggggggggcacagaauggggugggggcagugaaaagcacggagcaguaacacagcagcuccuggauacagaucagaggagagguucugccacaaaucaccuagaaacaugucagacgcugcauguguguuguuuuacacugagggcacagccguaguccaaaaguauugauucuuuucuuuguauggagacagagacugucaggccuagcgggcugaccuugguauggugcagauaacuauuccccacccugcugacuagacgaaccccacaggaaaagcucgggcaagagaugccaguguccagcucucagacacagggagaaacagaugccugcugagccugcuucuguucuccccccccccaccagcucccccccccccccccgugcugccugugacagaacaugagaggaaugagucuuggagcaguguguguguguguuuguguguaucucaaaaugcacaaaaagaagcccuuuuuaaaaaaauuauuuaucuaugagauauuuuagagguccagugguguguguguguguguguguguguguguguguguguguguguguguguuuuguguuuuaggaagcaagaagaaaguauugucuuaauucaugugugacgccacauaaguguauauguuuggccacuuucccuucuugcucuguuucagcauccucagagacaggugagauaagaggaaaguaacuacuucucaaaguuaauugagucuaaguuauuuuuuaagguuguuuaagaguuaagcuacacagaucugucaaucugugugauuucauugcacucuuucucauuguaagcucugcaguacuuuaaaccauuuuguaccauuuaaauaauguccuacaagucaaguacauuuuagcugaacaaauucgugugcguuuaggauucauauuugcauuggcuaaauagaaaucccauagcacugugaaccuguaaucugcugggaaagaggcugcagugugccuuucagggagcagcugauccgacuggaguccuaugcaaggcuuggcuaguucuuucuuaaugaugcaggggcuuuaucuucauuaaacuaagaggaggaugccuuucucuaccuauuucaagggugcugcuucaugcacccuuguaggauggagcugucugugaagaaaagucugguaccuuucagaugugcccaaaggggacucucagacacuggggacacaagguggaugagcuuuugucugugagcugcagcuugaagauccuccucuucaaaagugagccuuuucuuucccaaacagaacacugcagaccaacucuguauacgaugauguguugaguuuguguaauccaacauuaauccuucuuugaagugaauauuuuaaaaguggccaauuggaagaggcagacagcaagcccauguaagccaugggcuuuucuugugugggaggucauuuuacugccugcaugcauguuuucacauuaagucaguuucaaugauucuuuuauaaccgaaaaaaaacaaacaaagaaagaacccaacuacucgucauuucaaacgaucauuugucaguuuucuuucuaaggcaugaaacuucuauacuauuuuaggguuucuagacucaagauuuaaaaaaaaaaguuucuccuaaaauggucguuagauuaaauuauuuuggcuucuuauguucauccuaaagaguguucacccucuuugucagaccuuugcuucugguuagaaaugcccugucuuuuacaaguuuagaacaguuagacaaauauuuauuaaacagaacuaaggagccugacuuaggauaugucauugucuuugaauaagaacacucuggcuguaaaauaguaaaugauuagugacuccuauuugugagguaccauauaagaaauacggugcagagagcagauugggaaagguuuaagaucugaguacuucgaacugcuauuuuaacaccuuacuuuuccuuuaauauaugcaugcuaaucgucuguccuucucucaucccuguauaucuuauacccaccagcuuuacuacuaaaaucauauugcuuuugaaagugucgguugaguuaucccuugucuuguuaguaucguguuugauuucuuggacacagacacaaaucaccauguaauaugcaggucuuuugaagaugcacccaagguuuauugccaguaacagacuaguggccuuauguggacuuuccgugaauaaaacagauugaugagccauuuuauagcauugcaagcuguauuauaaauauaucacccuuuucaguaauuuaacgugagaaacagccuaaugagcucccggccacgaucacucagagagcugggaguucuguguagcuucuaggacaagggaccagcggagagugagaaguccaaacccuauaacauuuucuucagcucagugacacaaucuuuguaauuagaaccauuugaaauagcaguuaaaucuagagucugucagaaguaaagggaaauagaaagucguucuuauuuuucuuguugcuggaagccucagguuuuugaaagucauucacuuuucuuucuuuuuuuuucucccauuuucuuuuaacuaguugaaguuauuaacaauaacggauaaaaaaacauuagaaauauaccuagucaaaauuuaccugauagcuuagaagauggacaauuagauauacuuaacacuguaaggaucuuuaaaauauaucuuuuauucuguauaguagacaccaguguuuaaacaacccacagaaucacaucacugcgauucucuaaugguucagaaagcacacaagacuguggugcuccaaacaucauuuugugcauggguucacuaccuggaagcugcugucugauuaaucuagaguguauuuccuuucucggaaugcaguugguaaugcuaugcaacccuugucuguguauaccaguuacaucuguauuauauauuuauagaguaaaacuaaagugucauuguuuacaaauauaauugccaaauaccuucauaaaauccaucaaauaauuuuuccaaguauccuuaucuauuaugaaagcaaacucuuggcagacucucauuuucauacuccagacaguguacacagggcgaguacagaauugaagaggcuuuaauuaggcuuuacagacuagguuaaagcaaauauguuaccacagggacauaaacauaccagcgaggaccuaaccugccuggcccaguccuacacucacucacauacaauaugccucagauugaaaaaaaaaaaaaaaaaaaagaagaagaagaagugaauggcccuacuuaugcccccuguuucuuauuaaaaugguugccaagugaaauucuaucaaaaaacauaacugcagauagucucaauauugcuuugaauuuuaaacaguugcugugucuuacaaaugauauuaggaauuuaauauucuguauucagggcaaagugcuuuugaaaccaagaauguauucaucuuuucuuuuugccuuuuccucugcucuuuugccuuccacuucaguacugcugggguuuagucccgacuugaugucuaagcucaucucacuaaaauucuuuguuucucugugucuucauuucugaaacuauggaaucaaauugaaccuuucucugggcaguauauuaaacaucauauagaguaaacuuacaaaagucucugcuuccacagaagucauuguuagacauuuaauucuguuaucugugagaccccagaaacuuagcacuaagugaauaccuugauguuuuaagguagauugagcuaaagcuuguggccaugcuauguaugacucuuauuguugccugaagguugcagugguacauuauuugagaagcaaaugcugacugauuucauuguguguacauuggaaauaaauguuguucuuuuacaaguuuugccacuuuauuacaaaaucauaaugauuuuaagccuguagauuaaaaacugguguguugaagucaccuucccucaugaagccccugacuucucaucaaaucuuccuugucuuuccuccaaauagcuaagggcagagccuuucuccugucuuucucucuguuaccuuggcuuucucuuaugauaacccuuauucaccagugcacccaaagcucucaucaaguucaguaauauuuccacaagaaaagcauaaggcuugugaaggaaagacaccaccuguguacuugauucucccuuuauuuauaaaauaacggggcucuugucuucucauuuugcuagggacucuggaagagucacagucagaacucacaguuucgaaggauugugcagcugcugcugaguugccucugauuggcugccugagaggcagcacauacucugcucuugagugguuuuacucuugguugcaauaugaagagacccacacucugaucugaggccucaagcucugggaaaccuuuagaaguuguguuaguuucuccuuuuuucuuugacugggauucaucauuugacagucccauuguaugaggugaauguauccauauugacacauacuugucuaugaaaguauucuucuaugugugcuauuggaagaaugcuucaccuuucaucgcaaugaugaaagugugccuuuuugggacaucguugguucuaugcagugauugauucaaacagugcaucuaucacaggcuaaguacuguucuuaugugccugguuuccuuuagaaggcacaguacugcuggaaaacuauuccuaaugaauugcaaauagagaucaguuaaguaaguuguguuaauuaugucaugugcaagauugccuaauguagaauuggacaagaaacuagaaacugcuugucaaaugcuuccuuuaacuaaugugauauuuuugugguuuucaaaugacacaauucguacaacguauuggauaaaaccucauuaaccacuccuuaguugacuuuagaaaaauuauguuauuaaauauguugugauagguucuaucuucauuacuuuacuuuuagcucauugaagaauguuugcuuugugacgccucucccuaguccuuggucuuugaggaagccaagugaguugcauauucagaucccuugucuaaucuguuuucuagcauuguaaacagccaugcauguaguugucauggcuguaacucugcagccaugaccuaagucuuuuuuuuuuugccaacucugcccauuuucucaggguuugacaucuugauauccuaaugcuuuaaauagaaauuuaaaaaucuauuuuaaguuucauccaucucccucccucccuucccucccuaccucucucuuucccucccucccucccucuccuauccacuuaucuauauaucuaucaucuaucuauuaccuaccucuaccuaucuguccauucauccauccaucuguccaucugucugucuguccguuuguaggucuauuagcccaaagaaacuaaaagagagugucuuuauuuccuaauauuggaaucauagcuagugagaauugcuuguuacagacucagggaauuguucucagguacucagaaagaacauuaaaugcccuuaacugcugaauaucucuccagccucagaaauaucuuaauuauaaagguucaguuaaaaaagcaaaauagaugucaguaguaauaauugcaaauggaaauugugaacuaauuuuccaccuuugucaguuugucuugucuaggaagucuuuauaucaaaagcaaaacuuuguauuuuuaauacauaauuuuacauuuucuuccauuucucuuuggcuauugcugagaaaaauaaugaccacguguauuugaaaauagaauuuugugggguuuauuagcaaaaucccacaguccuaucuucaaaggcaaucucauggauucuucauggugacugacuuuuaguauucaaauuuucugccaauauuucuucauuggugggcauauucacaucagcaauguauuaaauguuucauacauuggagcuugcugaaaaguugggaauauaguucuugcaguagaacaguauagcucgucuauaagugaacuugacugauguauuaguacaaauagucuaaaucucuaggauuccuuuaauccugcagaagaggucagguuggcuuucucuuuauacauagacaaauucaaaugaggggcauccacaaaacagugugcuggcuauaucuuacuugucauuuuuuugucaaagucuauuugaucaucuagccugaacauuuccuucuuauuacaaaaaaaaucuuguuacaguugcacuuagaucaagccaucauaaaucucuugucaucuguucuucccagagacaucaccccagagggguggaaauucuuguuaauaagacaacucagucuguauucuguauauugacucuucauuaccugcaguuugguuaccuguggaauucuuugccuuagcuacagccaacuaggcaugucccugacaaagucugucuauaaggauauuauccuuccuguggucuccccuuuucuucccaccuuccaucacccucacccauaccacacacauucuuccaacucugugcagacuuggcaacagauuccauccccauccuuguuauguaaccaaccaccuaccccuuuuuggcaagggacauccaacuuagcaaguugcaacaaagaguugaguuaauuggaacaugcacuaggcucaaauuugcaacaaagaagggcugauagaaaucgagaaaacacaaccauauugcuugagugguaugaguacaugggaaguguugucuacuaccugggugcauuuaaauaacucagcuaccauucuccacuucuacugacacccucccccucacugguaagacuuuuaacuugcucccucaugucugcucauggguggacauggcuuucuuaaauccaacaagugaaguagagcugucuuugacuaccuuccuuugccucauguuccucuguaugagacucaauuauauaugacauuuguucccuguuuuuuaguucacccacuuccaugguuuugugccuccucuagcccuugagcaugcuuuuccugaguaaauccuaauuuaaaaugcuuguaugaaauguauuuauaauaaaaguuuuguuuauuaaaggcaggaucucgcuauauaguagcuaugugucuauauuugaucauagucacucuguccuccaauuucucccagauaauccccuccucuaaaaauuuuuuaauuuuuucuuuuaaacaucaucaagacuaauuaguguugccuauauagauuuagauaugugcuuuuucuuagauuuagauaugugcuuuuuuucccccuuagauuuagauaugugcuuuucuacuggacuuaccacauguuguugucuuaaagaaaguuggcuauucauuuucuagaagcuaucaguugccaauagcacugcagcuaagggugugauuuuuaugucugcuucucuucuauauuguaggauuugggcugacuuacacaagccuuguucaccauacgugcaauuccccuguuguaucuagaagacacuauuuacuuguagucaucuacugcccguggcuccuauacuguuccugccucaucuucccuaaugaugccuggaccuugggaggggguaugauauagaugucccauuuagggacgagcauuccacaggcucuugauuucugcgcuuuagucaguugugggucuaguuuagucaguuaaucaccaucuaauaugaauagaagcuucucuccugaggcuuaaaggauucuuuaaucuguaaauacaaugguaagucauuaagggcugguuuaauacugucuguugagcagaauaaugguaguagguucuccccuagggcuuaugaccugucuaguaagagguucuugggcugaugauagugucagguguggguuucaucuucuguaaagggacuuaaauccaaucagaaagugggugguuauucucaugacaucucacuauuauagauacucuugacuuugagaaauagagggacuucccaguucaaccccuucaagagugggcgcacuuaacugucuauucugaagucucugucuacugggucagcauccuaaguuuuagagugaaugaugacuccagcugcugauggcucagaucaucuuaaaguuuguuuccucgacugguaaaacuuccacagcuggcaguaggagaugcuucugugcgccucugcgcuucugaaacaaccugacuucccuuucagccuuuaccuuugaggaucucuugaagauauguuagauaguaugauuagccucaguauuuaucuccuuaggcuuugaagggucuugaaagcacuagaaugaguguaaaugggaucgcugagaaguuccuuccucuugacaucuggaagccugauuaguugccgggcaucaccuugaucuggaugccaucucuguuacagucaggggacugagacucuguguacauugccucauaccgucuucucacauccuauuuauguacaugcuguuauuacuuccacuugacaacgcaagaagcaggcuuguccaugcuuaucuaaugaauaauaggacagcaaugugauucuagaccugauaccucauccugaugucauacaaauaccuuccagcauuccucuuccaaauguaaaacagacaagguagugucaauguacuugauacugaauauuauuuuuuuucauaugaucacacacacacauuuucugagauaaaguuuaucuguauaaauucaggcugaccucuaacuugugaccuucaugccauagccucucgagugcucaaaugcuugcauuacccaugugugcccucacaccuggcuuuguuuggguauuuugauauaauuauuaaagaacagaauuuuaugaaaaguacgaaaaugugauccaaacuagauuggauuguuacauagaauuucuuucacuuaagauccauaaauccugggaaaauaacaguauuguuuugugacagacacagaugauaaacgauugugcuaaauuugucuaugaaguauucaagacaagguucuuuaucuuguccagggcaguuuagagcaggacuucucuaaucugaugugugugugugggugcgugggugugugggugugugugggugcaugggugugugggugcaugggugugugggugcaugggugugugggggugcaugggugugugugggugcaugggugugugggugcaugggugugugggggugcaugggugugugugugggugcaugggugugugggggugcaugggugugugugggggggugcaugggugugugggggggucaugggugugugugggggucauguguguguguguguguguggguguguguggggugcaugggugugugggggugcauggguguguggggguauauggguguguguggggugcaugggugugugugugugggugcauggguguauaugggugcauggguaugcgugugugggugcauggguaugugugggugcaugggugugugugggugugugugggugcgugggugugugugggugcgugggugugugugggugcaugggugugugugggugcaugggugugcgugugugggugcaugggugugugugggugugugugggugcgugggugugugugggugcauggguguguguggaugggugcauggguguguguggguguaggugugugugugugugugugggugguugucuuguaggguacugaaugcaggcccucucuacugagaugaacccugugcuaaaccccauuguguugcugagccucuaaccuacucuucaaauauuuuuuucuauuaucuaagcuaagguuuaagaaaaacuaacauuuugcuuuuuauuugaugccggagaguuuugugaagauuagaaaagggggaagugcuguuuuacaaaaccuucugugggaacaaguugaaguguuuugugguuuuuguuugguuuugagaugugaaaggagagaaaacaaauaauauacaccaagggaagggaaagaacagagagagaguuuaggguaugcagacugcuggguaagccacaccuccuccacugagcaugccuuccccaccgcugguagcagguuugugcaccaugcucuuuacuguucaucccucccuguauacuauuaggcugacucuggauuuuaacagucucaugcuacuaauuaaaccuuuccuuuaaugauuauuauuaaaggguauauugugauuuuucuauaaauagugcaaaaggcuuuaaaaaaagaacauuguagaaaauugaagauuauucagacuuccacugacuauuggaagcuuauauaaauugcauuuggaauauauuauuuuuuucuguuagucauaauaauaacccuuuuuccccagguuaaggcuuuuuuuuuuccuaguuaaauuuauauguauuucuuaaauacacuaaaaugugaaucuuuacuuagucuauuaaucaaaaugcguugaagguacacgggaccuuagagaucauuuagauuguuaaguucacacuccgguuucucuguuccuguuacaauagcaggaagagugaccugggauuauucuggaggucugcuuucucuugcugccuuugccccuucguaaguuaagaaugaaaauaucucucuguaauagcuuuugauuuugauguauauaggaaacuuugauaucauuguagaaaggcagacuagaaauaaaagguauuucaaagacucuugauguagguuguaaaccugugaauuuccgccuugacucccuaaaagguuauuagaaagcuccuuuaaguucuccugcaguccuuucacaugugcagagaggcauucccagucacccugcuccaccauggcuauuuccaaacucaucucaccccuuucagcuauaauuugcugaaaaaaaaaaucucaaggaucuaaaacuugauuucuuucugccacgucccgaggaacauccauuaaagaugauuauuugaaaauuucuuaaaaacgaaacaauccauaacuuuaaggcguucugggguaugcuaauuccgaaguagacgaagaacugucugugccagcuacuucacaagagcuuaaaauaguauuugauuaacuauuagucucauuccuacuaagaaguguauggcuuuugcuguuuguuagcacagaauacuaauuuucuaucuuuacccccccccccaaaaaaaagucaaaacaaaacaagaaacaauaggcgaagcuauagaagucaagaauuaugaguggccuuagaaucucucaugcagauaaccacuguaguagaauuaugaguggccuuagaaucucucaugcagauaaccacuguaguagguguugauugugcuauaugugauaaccacuauauagaaguuaauuuuguaggggaguaagagaaggcugccaguugugauucaaccauaaggccgguauuuaaaacacuaacagagucuagacuggcccuuuccauaugaggccugaugcuuuuagagcacaguugcucuuugagauuagauagcuaguggucggaacugcuggcagcaccauccagguguccuggguuuagaucuaaguuuccuuaccaucucuugucuuagucagaaccuggccccagcuccaucuagaacaggcaggccugugaucuguaugcguuuauuuaguuuucuuucuucugugacaagaacagcucaauuuagugggcacuucacucgcgagucaggcacuaggucagaguuuuacuggauuauuuuuucccccuuaacuggggauacugauccuuccauuuuacauacacaaagagauuauguaacuuguguacauuuuuagagcaagaguaaguggaaaugcugaauuggaucccgguaauuugguuucagaaugugucucuugaacugcuuaguaguugcuccuccuccgagggguucauugcaauuucuuauuccuaaacaaaguuuuauguagaccauuuaaaccaugaggauuccaggcuucaguuugaaagccaauauuaagaaaauuaaaaauauaucuccaagacaguuacugcuuuguuuuccuguuucuugaagcuuaagagucugggacacuagagaugccaguucuugccaaauggacucuuggccaucaguggcagauuugucucagacaucucugucuuuaaaagcaaaagaaaagcuucggcgagguggguucccugauugggcugcugacgaauaauggaguuggcuguuugggcagcuuguggggucgaaacuugugcuguuuuaccuaagugccccaaauaggcaaaagaagaguugacuuaagaccgacaguauuuuauuaacauccaaauaggaccuuacuuagguuuguuaauguuuauagauguuguuuuucuucaguuaaauuaaaaaggaaaacuaacuuaaguguuuauuuuaaaguaccaaggcaaaguccaaagcuuguaucagauguaauuucaaguucaggauuuugagguuaaaagggcauguuggcaagguaacgccauaguaauacuaugguaacuugugagcagagcaaaggaagggcaugguuuauuuugcuguggaucauguugguaagccuuacuuaugaauaagugcuagucaggugauguguugcuuaauaacuugcugcucuagauagcuccacuuaucauggaugaaagcauucacuagucaguugauagaauaguuggugacuuaguuaaauuuuagcaacaaacagaaaaacagccauuuuguaaaacccuacucauauaguauuuauucuuuuuuuuuuuuuuuuuugguuuuuuugagacaggguuucucuguauagcccuggcuguccuggaccucauuuugcagaccaggcuggccucgaacucagaaauccaccugccucugccucccaagugcugggauuaaaggcgugugccaccacgcccggcacauaguauuuauucuuguuuuguguguucgugugugugugugugugugugugugugugugugcgccuuuguaccuguauggaagccagaguuuauuagaucuuccucagucucuccaccucaguguuugagauacaaggucuuuuguugaacccagacagagccuaagcauuuggagagauuagcuggcuggcaagccccagugaccuucugucgcuuucuuaccagcacuggaauauagauauguacugucacauccuagcugugcuaaacugaugguccaaacuuauguccucauguuugcacggucagcauuuuaccaggcgaaccauuucuccagcuccuucauuauuucuugguguguuccaaaaaggacucaaaaugacugugucuuugauaugugcauuauuucacuuaauccuuauuccugugugggagcauaauguuuacuuaaacuaagagugcuguaugacagaguuucagaaucuuaagacccauugauuucaggcagucguguaaguauaaguaauuuuacucgaguucuuuauuguugucuuauucauuguuauuaauuuagaaguucccagugauaaaaauuaguuuuaaaaguauucagcaaguuaaacuuaaaaguaaggaagcuuaaauaauguaaacaaguugguaaguguuaugaauuuaggauuccuuuuagagcaaauguaaaugguuucaugcuucccuugugagugaaaggggaaguuuuucuuuucucuuggcccugugaucaaaccuggcuuuucccaggcuaagcacuugcuuuaccaucuaucuacccguagccccaagagaaaggccuuuaaaguggggacacuuuccacgaacuggcucagaucucuucuuucuaauugaagauggcugggguuuugucucccuccuccuccuccugacuuacggaaugucuguagucugaaacuuuugaaauuucauucuuacauuuauuuguuuuauugauucauugagagggggcagagugagacugagagacuuuguguguuugugugcucaguuaugugcagccagugaugagcacguggagggcagaggagagggccuuuuugggacucaguucucgccuucuacuucauuguuucuaaggacuucacuuuuuggcuauaagcuuccuaacccacugagacaucuuacuggccugcaaucugaacuauucauuacuuuggucuauuuguuuuuguuuuuaauuuauacuacacauagcauaacuccauuauguaagaauauaaaagguaguaaauuuuaaaaaugguaaugaugucauucuuugauaauaaauuuccagugaaugauuucuauccuguaaaacaaagccuucacauucuuuucuuuccuuauaauuuccuugagcacagaucccugcgagcuuccuccugagcauuuaggcucuagcaacuucggaugcucacagugaugauguccaaaggagacaccuaacuguggacugcccauggagggcuuuguaguaccugauaguguaagcugcaccuuaaaaaccaaaagucuggugcuuaaugccaucugaccacaagggcagagucaggccuugccucuggcuguucuuauacccaacucgggcucuuugccagccuagcucauuauuagaauucauauacucgaugcauuauggugguaucuuucugaagaacauauggauuguuaaaauccuaagaugcauuccucagauccaagcuuaguucacuuuuccacagaacugcucaaccgauuagagugaugggauuguauaaugcaaaaucuuggaacauuuaauaagauccagaggaucugcugcucucugaagaaacuauuaacuaguacaugaaaauucgguugaaaacucauaguuaauaauugccguuuucuaacaugaaaggauccugucccucauguuuuuuguuaaacauuguauaggugccaaauuaguugggcucuaaucuguuuguauuuaauauaauuaguuuagcccauugagaaguggaagauggugggaaggguaguggcucaguggguguuggugugugaauguguaugcgugccugugcaccugugucugucugccuuugagcucuuggcuuucugauuuaaucaacuagaacaugugcacauucuuacaggcagcuauuacuccaggcuuuggugcuuucaagauuuuguuuucuuccuccgcuuaauuuucauggcuuggcaggacuaagggcagcgauguucuucaucggugucugcuuuuagugaagcagauauuugucaggcuucuucugacuuguauuagaaacuacauaguuaaaauagguucagcuaugaacauugaaauucuuucaauugucacugguaguuggaaacuguagucucccuuggggaauuuuuuucacauaugcuuaugugagguucauuuguuuuuguuguuaauaauaaaauuaaauaguauuugauuuugggaauuaaagugugcuuagaaacauguaaaguuaauaaacaagaauaagcuaagcagugguuccaucccauggugacucacugagagaauuucuuuuuacaaugugaaaucacuauuuaaacacauuuuagacaugucagucucacauaaaauaaacaguguaggcaaugagcuuaagcucuuucuaguuauuaguaauuauuaagagacagaugaaauuuaauccuagaguuaaauuaucaaauugucaugaauagcaagaggccagugaccacauugccauaaacaugagcuuucauaaccuguuauuuuuaaauaugucuucuuccguaucagucaccacguccauaagagcuuuaguaacucacguaaugaaaguaaaugcauuuccuauaacuucaaaauuuuuaaaauuaucacugaguuaaauuuuaagggaaaauagguuuuuauauaugaauucuaauuuuguuaagaguuuccuguuucagaguuccuccaugcuuuuguauuuucaaaucagccaucacuuaguaauuguugaaauacauaaucauuguguucagauguuaaauuccuuuuggagagccauguguccugucaaguguuugcuuuauuggauuugaagcaagucaacuucuaugcauuuagaaagugacuugguuugauucauauaaaaucagcacauuguauuuuuuguuuucuuugaugcacaucauugucugucuuaucaauagaugcaaaagauuguuucugugaguaccuuuuucuaguacugugcguuugugauuggaaaagcacauaccauuuagcagaguccaggaugauucagacagaaccuuaugucugagaagucuuuguacuuguaaagcucuuuuugagaauuuaauauuuaaagaugucucuacaucuuacucagugguaugguuauaauaauaacaacaaguuuuuaaguacauuuuuccauguucuuuuuuuucccacauuuucuguguuauuuaauagucaguauagcauuagcuuucuuaauucaucgaaguggcaucgaugaguuucauugggcuugauuuauaagaaguaaccuuggugacgagaaguucauaucucugugugcauuuuaacaccccuccccccacccacuugguugcagcugaaauaggaaauggacacuuuuagaaaaaucuuguuucuauacacagugccagaaaccaccaggcaguggaaauaucaugagaaagcuuguuucuacaagacucccagacugauuacuagaccaaagaaccuuccagaauuuuagcuucaagcaaucauuuaaaauuuaggaggcagauccaguccugcucagagacaccuauugcuaauuauaguugucugugauaucccagugaugucgugaucaaccagacccaaguguggcucccauuauuuccagguuccuuccaacagauauucucaccaagcacuuaaaaugaguuuuauuucauuccauguaaacuauaccacaauguccuuaacauuuuguaucuugccuaaaauauccuguuugcaccugauauagcagauggcuuuuccuuucccuguaguucuauugguaucuuagaacuuguagcagcugggaagcuagggugagaccuguuugauuuuggaguuugaguguauguuuuguuguguguuuaugucuuugaacaguaugagacuguugcugucuuuuuuuuuuuaagguacuauuuuuauuuuuaacaacgacaaauaaaaacuuugggaaaccucugaaauuuaguuguugcuuugaaccuguggaauuagugugguagagccaaaguuuauuuauauacugcugugauguaaauuguagucagguuauuuugggaaguuagagccaucaguuugucagaggcaggucuucccuggcaaaggcuuguccaugccaggucuggauagauggcuuugaugucagcugaacaccacaaccgaagcugcuguguucaugccgugagaaugguuacugaguuucccacuacuucuuucacauaauucugccuucaguauaggacuguguguaucagugagucucaaccuccaaaggcugcuauucuuuaacacaguuccucauucugcggcgacuccagucaugcagucauuucguugguacuucauagcuauaauuuugcuacuguuacaagucaaaauguaaaucuuuacuaugcagaauugcuggugugggacccacaggucgagaaccacuggaaggcagagccaacaaagggucagcuuucuauuucccuuuggcuggauggacaacagucuuacuccuuugcagucuguccaguaagagugcagaggcaaggcuugguguuggauaauuuugaacacaaaaugagcucuauguccuuucaugacugaugaaagccgaagugucuuacauagaagacaaaaccaaacgggucccuuuuggaaagcaagaggaaggaaaacuuacauucuaaguuuaagguugcugucacccuugcucuaagccacagcaagguuuauucauaagggucuucuacguuuucuucauuagcuggguuggggguaaucuuuauccuuuguuuucuccuaaaauacuggaauaauuguacgagaaaugauuuuaaauuacaucgagauuuuacagcaacacucuuccaguguacuaacuaaauaaaugcuauaguuccaaauaacaauuuaccuauuuauaagugagaacuaggauuccaggaacuugaguaaaaaagaaaggaaaucuagaggaaucuagaaaaacaucaccuuuucuuaaauaugguuugauauucuuuggauuuggagucuauuacuacauuccucucuccccugccauuucacagaguagcuuggccagacauacagacaugaaacaaaaggcuucguguaaguuguggaucuuccuaagcagcagacugaauggucagcaggcuugcguuuuaucagcuuuugccccauguuacucuauccucagauuuuacaauggguuuugagucuauuuucauugucauggcuacugccaugucguacaacuagaguacucuaggaagugcucuaugcagauuugaauuaucauuguauuuuaaauguaaguugcugucacccuuugaguauugaggaaccaggcaggcuccauuccucauuguacauccuuaguuuuaguauauccuucucuugcuucccacaggucauuaauuagccuuucuuuccaaaccccacaaccguuuuugucauggcaccuuuuaaaggaaaauuuauguuuucuuaaacucauuuuuaaaaacccuugauuuugacauuuaagcccugcauauuuauauguugagcuuauuuuaaaacuuugucaagaauguuuagcuuguugggguuaguugagguuuugcccucauuaccgauuucuucuuauguuuguuuaucucugucagauucugauaaaccuugauguuaucaaaauauuugaaaguauuggaaaauaggaaauuaaaccaacuagagcuuguuuuuaugaagaaaaaggacaaaauuaauaaacaagcaaauaaacaaaauuaaucaguaacuuucacuaagaaguauguuuguacagggaaguucuucuccaccaauguucaguuucuuucuuuucuuuucuuuuuuuucuuuuugguuucuugagacaggguuucucuguauagcccuggcuguccugaaacucacuuuguagaccaggcuggccucgaacucagaaauccgccugccucugccucccgagugcugggauuaaaggugugcgccaccaugcccggcucagaacaguuucugaacuaaggcaauuuaucgugucuuuucaaagaucccaguuauuuuguuaguaauauaacaaagaacaaaauuuaucccuuuuuaacuacagggagaaaacuccaaaggcucagcuucauacuaaauaucugaccagauaauugcuuaaauggugcagcaaaggcauacaaccacaacaacccauagggacuaauaguguuugucauuaagcaucacuuaugguggaaauguggccuccauaugggucugcucuauguaauuuacacaaauucuguuggaaaccaucuaccuaccaaguggcacuaaacaaguuaucacuccuguaaugggcuuuguaaggaaaauggugguguuccuggguugaauuaaaugaucacuuuccccaucuuuccguauguuuguuucuugguccggacuuuggcauucaauagucagacacuuguuagacuguugaauauuuagguugccugcugaccuguagguagucauccagguuuugauuaauuaugacacugguauuaggacacauugggaaaauaauacaagauaaagguuuuaguucugaucagaauauuuuaaauagagaaguuagccaaagucagaauacaacaauugaauagauaggcuggagaaaagaaugcuuuuacuuuggcaaaagagaaugguauuauuucuugcauauuuaauuucauacagaguuuauacaguguugagcuuaauuugaauauuauucauauauauauuucuuaucagaaugcaaagugagaggagccuuauuauggacagucuguuuaggggagaaauacuauaaauuguucauguuagcuggcaaauguaaaguaaaagucuugaccagcauaguuauagaaauagcaugaucccuacagguggggaugcuuucugcuuugccaaauaacuggcaguuauccuaaccuuugcuuguaaccaaaacaauuuuaagauauuugauagcuacugaaacuucuguuguagaaauuagguuauauucauggcuguuggcaucgaccaggcuauacugaccguguucuucacauggugcuuccuuuguucucuugguugggugacuuuccuuagcaucacacaaacauacuuugauuguaaacugcuguuuacuugggucuguauuggaaauaguguuacaauguuauggcaccaccuuucugaaagucuuagaaaugauuaggcugauaaagacaacguggcaaacguccaaaaacauagugauguaaaacuugggagcaguuuugguuaugaccggaccaugaguaggugcagaaauagcugugagguagucacaguacagcuggggaaaguuugucuuauauaaaugcuaauagcacaaguucuacaguuagauuuuuuuuuuaaguucuugagaagaaaacaaaaugagaacuuagguggcucaguacuaggcucuagaguggccaaaaggcgauacagcgugagcaaaaguaagggcauuaacuugucuuucuaggaaaggcucaauaugauucauaaacuuacagucuuggcuuucugugaacagggacagagcagaaccccaaccuacugauuuugaucauuguuacagggacaucauauguuaacaagcagaggauuuugccuucuuuuccuagacaauggcaauaaucuucaaguaacugcuguucguuauguugcagaggcaaauugcgcagaaaauuauggauaauuuuaaaaagaugaaauacagguggcucaucuaaaccagacuccaauuaaaaccacauuguauuaaauagagccuguuucagauaggcucuucuucaugcuaagucugagugaagcaacaauguuagguauaauagcugguaucuggauuuuaauaggaucaggucucaggcuucagggcccuaauauuaccagcugguauuaagaaaccaaguuucuauaaaaccugauuauauuguuuuccccuggaguauuguaguaggaauccucacgaacguugcuuuuaugggguauagauuuuacauaaauguaguugauacuaaauuuggauguugucaaaauuuguaucacaauuugugugugugugugugugugugugugcgcacacacucgcgugcgcauaaugcgccugucaucuuaccaaaugaauuaaauuugggauugagauggcgccucaguucaaggugggauggcagcuccccagaauaauggauacucaaaaaugugaccaggagcucagugcacacuguuuuugacuuacuuggaauacucauucaaguaaccuuaucaacuuaauaauuuaucuagguuuuguuuggccugauaauaauguacaauagccagggcuuugacaaaacauccucuuuacagauuuuuuuuguccguuuggcacaaauugaucugauacagugacuuagaaaucuugauucuuuuccaccuagucuuucuuuguuuuccugaaacauacauagccauagcaaccuugguuaguuauuuuuuaaaaagucuucucuaaugauaaaggucauaacaaugagcugcuggagaggcaagagaccuggaaugugcaucugucuaucugucugucuguguuuuguccccccccccccggcccccuugagaucaaagacuaaacacuguuaacgccagacagugguggcacacauuaauuccagcacuuaggaggcagaggcagguggauuucuuaguuugaggccagccuggucuacagaguuccaggacaacuggagcuauacagagaaacccugucucaggggugggggguaggauauaagaagggcaagacuagugcuuccaucauacugaagacacagcagacaaauaggggaggcucuggcucuugaggaacugugugccuagagggcuucugaguauucguugagaaaaccaggagcuggguguggaggcacacgccuuuaaucccagcacucgggaggcaaaggcagguggauuucugaguucgaggccagccuggucuacagagugaguuccaggacagccagggcuguacagagaaacccugucuggaaaaaccaaaccaaaccaaaccaaaccaaaccaacaaaacaacaaaaacaaaaaagcagggacuaaagcuguguuuacauuuguugaacuuuuggucaguagucuuuuccauguggguaucuacacauacucaggagucuauccaauagucauuucaaacgcuucuguaacaauaacuccucucaaugacaggaugugugauugaguugcuuaugaagcugucuaucucauccauguuugaaccgggguauccauacuuaacaguagaguacuccaagccugggguguguucugcaggcccacuguugcauuuggggaugaagcauggaagaugagucagugugaacaucggagugcugaguuagaggcucuauuuaaauaagguguugcauuuauuuguaagauaaagauuuagguuuauggaccauuaauuauguaaacucugaaucaacacagccucauuugucgcccaaauugugaaaguaugcuugggcauggaagugaugaggugaggggaggggaggaagccacauacagaaaccuuuccucaagagguugauaacaauguuugaauauaaggcagcuuuugauuuaaaaacaaaacaaacaaacaaacaaacaaaaaaauaacaaaaccgacaacagcaacccacccccaaagcuucucuccauacauuacaguaaugagauuucaaguauagcuucuagugagaaccagagauuuuauuuuuuaaaaaaauuauauugauagaaaaggggggagcacuuuuuucuucauguaguuuacaugaguuaauauaauuuuacugcaaguuuacucuuaauagcucugcccauacaguguuaaaguuuuuagggugcuucuagcuagcuuuuuuuuccucucccauauucauuuuaaaaccaaagaguauaauguauauaauguaagcuguuauuugcuuacccguguguuaugagcaucaucuguaucauaaaaucauuaaguuuugauguuuucuuaggaacuguauuaaaagucugguuuauacuugccuuuccuugacagaguuggaucauguacuuucauaaguugguuuugaacuuucugcuuugagguuccauguuagcuagugauuuaguacuguaguguuuuaaaaguguaacaucgcugggcgugguggcgcacgccuuuaauccuaacacuugggaggcagaggcaggcgaauuucugaguucaaggccagccuggucuacagagugaguuccaggacagccagggcuacacagggaaacccugucuuggaaaaaccaaaccaaaccaaccaaccaaccaaccaaccaaaacaaacaaacaaacaaacaaaaagcuuaauaucucccuguggcuucucuguggcucugugugcuguucuuauuuauggguagcuguggucuuucaaaccugaguggauuucccucauuugccuugucucauugaggaagguguggugccaucuuucuggcccgagccagcucuagugauagauuugaugaacgguugcuuuggaccuggcccucaccaagugcaccugaauucacuaagaaugaauuuaaaucccaagggucaaaguugcacuucauguggcaauucuuagcugcauaaaaacaaacaaaaaauauccauagaacugugguauaaacaaaaaaagaagauguaguguuguuaugacuuuuggauuagauuacugcugaaccaagcgucuuuuugacacaagcuaaaaauaacguguuuggcuaauuaggcgauaaaagcaaacaucaaaggcagaccuuuccguuaguccuacacuggcuuccuuguauuuaaaacgcuagccaacaaauaaaguguuugaccguuguuauuauucguuuuuaguugagacuuaguggaaaacaauaucccuagguauuuguuuuucucagcuugauacuuaacccuacuaccaaucacuaaguaauagugaaauguaacagcuacugccuugucacaacagacacuuaaaaacgauuucugcuuuuuccacauuaacacgucuagauuaggaaaguggagcauaucucucccuuucagugauauuuauucaugggaaugauggugugcagcaagaaaaagugcgugcauguaaaaauaccuucagcuugccagggagguugcuuuauuuuuuuuuuuuuccagaaugcucuugauuuacaagugaaacuuacucuugugugaagggcaaauuuaaauaguaggaauucaugcggucacuagugagacaucaguugaaaagucuggguguuguuuucucugugugguuucaggugugugugugugugugugugugugugugugugugugugugagagagagagagagagagagagagggggggggagagagagagagagagagugugucugucggugagcauccguguuuacugucauuccuugcccacucuguccccucucuuacucagauacauguauauaggccaccuucagucaaggcaugugacccgucccacaugugucucuguauguguccacauccgcuccuuuuauugcuuucuuauggcauucugcuuuacaaagugacauuuucugaaaacaguauguuuuuacauuuugugggguuuucuccuuaucucuguaauuccugagacuuuuucuaaacaagaugccuggcauuuucuaaggacagagcagagacagagccgccccgagcaggcagacacacuuacauugcuugugguuuuucaauacagcugcguucaaaugggccugccuuuucggcacugguuccagugccaaagucagacugucacacagcugguaguacuuacuguacuugcgggaaacuaugugauucauuaguuggaaccguaugguuuucaccaguucuggucauguuuuuguuaggaugugguaaaaacauaagcagagggugaagggacaauggaagcaugugacuuguuaaggacuggccccaacccauuauuaguuaaauuguucaccauaaaauguccucuguaccucauaagacaaaugacuuaauuuuuuauucuucaguugaggucauuuagucauaaguaguaaaaauuaucaacacuaagcucuuuuugucuuuuuuuuuccccuuucugcaaaguaucaugauccauuuaaaccccaaacuguaauaugaagagaagucaugcaaguaaaagauauuaauuugcugaaaaauguccaugacgggugaagaacuuuuaacuggagugaacucucgcuacugauaaaauaugagugugguauugcaguuaauaagaaacacugcuaauaccacaggauauguggagaacaauaaacgggaguuccuuuguccaagcucacuagaguuuauggguggaugaaugagucuuucaaauauuuuugucacuaauagaguuggacuaggguguuugcaguguuuguuacugggguugugcagagccgcugggcugcacugugucgccccuuagcccucuaugggguagucuuugagacugaguguuucacaccugcauagggugaacuacagccacaguagaguggauucugcagaugguguauugucugugcauaggcauuugcuuucaaauucacguuccuuugaauccucccaacgcuguaccuuugcccccucucuccuaaucuacuauugcaaaggugacauuuuugaagucuuuguggguagucuauuggcagauuaugcguccacccucugacuccguuuucuaaccguuuccuuuuagagcucugcaccguucaugccucagcacauaugcuccugcaguugcggcacucugcagaauuagaaccaggucugucucugacaauuagcucaacuggcuacagcauaaauaaaggaaugcgcucaggggcuguagucugugacaugguuuaacagagcguaaaaaggugcaucuguucccugcccacauucagucgccucacugucacugggaaguuaucgacacggagacaugccugugcuguuugguaaacaagcggcagguauuaaauuaauggggcugugagcgugugcaagugcugcuuuauuaaaagcucugcuuuccggacucacugcugggccacaggccgccacuagaguaucuauuaagaugacucauggcagggaauacuucagcacuuuguacucauuucuaggggggaccauugaccucuggaagccugauuagggagaaagggaacagaagaaagguggccagugaacaauugacacagaguuaguagacugagccagaaacaaggggaacugagagcagcacagagcuaggcugagguguaaaucggacuuuggaauccaaucccaaguugcagcugguguuucguuguuaguuucucuugcuuuuguaccuaacucuccucauggcugauacuugaugugaguucugagaugaagaaggacuaccugggaaguguaccuuucguuaccucuccuggguaggcaaugaaauucuggaauuugcuuccaagucauucaguuagacauuuguuauaucuuugagcauuugucugacuuugcauuuaauauuuuaaugguaaaacaguacguauauguauauauaucauauauguauguaugcauguguauauauguguuuuuguauauauacauguguauaaauauuauauaucuauguauacauguguauauaugugacuauauguauauauguguauauucauauguauacacacauacauguguguauucauguguguauuuguauguauauacauaugcauguggauauauacacauguauaugcauauacauacaaauauauauauacacacaugcauguauauauauguguguguguuucuguguguguauaucuaucuaucuaucuaucuaucuaucuaucuaucuaucuaucugaguaugugugugugugucuauguaucuucacacauagauauauauguggucuuuugcuuucacguagugacacaauaauugccaagguuuguuuuaucccagcuucagaauucuucauuagagugugacauguagcugaauaugaugccaugaugaguggcucuguauucccauugucuuauccucuuuaagcauucugaagacauacugagugaggucuguaggcaaacauaagaaaguaguacuuggugugcacaucugugcugaagaggccauuauuuaagaaggcucucugcuuucuuccuagguauguuucuuuuuagggccccaacuaucugcucauccauuagaagaugauguaaugcuaacgguaucucaccccuacacaauuugaaacaaaaaaugauuccaguuggccagacuuaaugugaaugaccagaaggcgcuaugcauucuccguuguauuugaagagugcaucuuggaaucucuuuucuggcuucccagccuuuugguucucauccuggagaucuuacaacugcaccugcaugccugcuguccagccucaucuuuaacugcaaacuuccauuacagaaugaugucuggguagaggaguggaaugggagaggugacaggcaugguggagaggaagcaucuguuuuuauuguugaagagaggcugacacaggaaaguaacccccugucuggacaguuagugaugcccgagacucuuuaucuuuguagcaucucugcuguaugaaguuuaauaaggcagcugugcggcuuuuaaaagccaguggauuccauuuuucaugugugccccuguguucgcucugagcugcucucacugccgacuuccuucuuucccccuuuccuuuuccuuuaucucaggggaguucccugaguagcaagacugaaaaagagcugagguuuauguuagaagaaauuaagguuaaugaucauuggcucauuuucauauucuguggguguggaugcaggguaaucagugcagguggcccugccaguugggaguuuuucuuugucaucaagaaaauaaggagagugcagggauugaauuaccacaacuauuucagggcuaaacauauuucauuucccugaucaggucugguuuaaggacacaaagcugacauuaauuuuauccaaagaaagcacagcuuuuuuuuuuuuuuuuauaauuugacugaaugcauaggguagaugcauguucaaauuuaauucuaguauaaucuuacaaauaauucucugaaaagcaaaggcguuuugauucaguuugacaguuuauguuucugugcccaauuaccacuuaguuauugaauguuaaagagcugccuucuaaacugcgcucucugacugcgccaauuggcuucccagcugccugcuauuacaugugaggugcuccuuucuaacuuuuaaaaggauguacacauuugaaguaguuauguuuagcuagcagaggaagugggggauuugguuaggaagugcuugcuggccuugaaaaucuaucucguguacauucuaauuucagccacauaaagacuucucuauaaagaaauauuuguuggauuaaggaaaaaaaaaaaggacaaacuuaaaugcccaaacuaggaaaauaaccuugacuaacaaaaaauuaugacuuccuuuuguuuuuguguuuucuuuauacuacugaugguucugcaagggaaguguucccgguuaaauacauggaagagggaauuuuaaaaauuggccagagacaauaaaagucgcugaggaagagggcccaggacucaccaugcauggcugguuuugcuuuuguagcaaaauguggcaggcugcucaaguggccuggucugauuuuaggcacaagguuuauuuggcugucccaccauggguguaauauuaaugauacugauguaaaauuaacuuuuauguugugugagcacuuuuuccuggccucuccuuuaaagugacaguuuucugaaauauaucugucuaggucuguugccacaaugaacauacauguaauuuugcuuucguugcgaaacauuugcuguaaugagguguuuaggccaaguccaaguggaggugggcugugcucucuauggugugugguaugagucuacaugcaguugaauauucaugacauggcuguuaacauaaauacuugcaguuauuaauaacacaugaagagaccauccccaaacauucucagagcaagaauguuucagggguaaacccuuugcugugagaaaauaagauuuaaaaagauaguuuaagaaauagaauugagaaguaacacuuuggaauauuuuaaacaauaaauuuagcauaguuuaagaagauacugacuaagcuaaaaugauugaaggaaaugaucuuaugaaagcuaucauuuccaaguuuaugcaaaggaugcuuuugguuuaagaaguaucaggcaagaggacagacauguguuaucucguuugcucuucaaggaguccuuucaccuuaugccuaaugauacaccuuaaaaugaccccacuggauuugguugaaugucucugauaauagccauccacauugugacccacauguauuucuuacuagcccagaaaugaacagcucugaaucaguuuagcuuugcuuuggcaguucccugggaaugcuuacagaagcagauaauugaagccaguguuuuacuuucacauagguuagagauguaaaaauuagcuuuagggucagcuuuaugguaaagaagagcuucuucaaaggucucuggguugcuuuucagagcuggggagcagcuuaagccaacccacggcuucuccacccagcuguugcuguggucaucugcccuugacucccuucacugaucauuccucuugguucuuucuuucacaaguccuuuccuauggacaugcauccuaucagagaauucacagguugcucuagucuacuaacucacugugccgggaccauagccuguacuucgcagcuucuaauuuuuuuauuguaauuuuuuuugggggggggugguguucuuauucuuaaguuuugcuugcucuucaguacugacaaagugaaauacugacauagccuauacaggaauagcaaugagaaucgggugaaauucauccugauccauuuugucuagcugggcauauaaaaauuaucauuuguauauguaacaaauagaagcacugauauucauucacaugacugccucuuggauacuguucagucuucucuuacagaaugcucaauaucugguggcugacuugacuauucugauucuucuacuggaauauauccauugggggucaugaaugcuuuacauauacaguggcauacaucagcaaggccuccacuuagacaagauauaugguuuaguuucauguacauguauuaaacagcuaguuaaauuugguccuauauugaauacucuccuauuuucgauuucauuuaucugauucagaauucugacucaaaucaucaauauaacccauauaacuaaaauguuuaugccugucagagagccucgagaauaaaguuguauguuccauuagcacucaugaacuaguaacacauaauuaaagauuuaaaaugucacuuggaauuuuuguugcugaggggccucauccuuauuccuccuuucaucaaguaucccugccaguuaguucaucuaaauguggaagcaacagguccuaagaauacccgucucuauaauugacuaccgaagaaccauucaaagaggugauuuauaaauuaccacacaguuaggaauaacugaugcuuucuguguagcuauugcugugccuuguaauuuaaguuguguagacucagaauuggugacagagccaccaaaucuuuucucagguucaguauauggcauuuaccuucggaagccucuuuccagcaaacuuccuucagucagauaaacaugacaguggauuugaauucccaagauacacauacaugugcauacauacaggugcaugaauacauacacauauauacgaacacaggcauggaacucaguuuuuuacuuuguuaauguguauuauucagggaauagauuuucuuuauuucauguguuaauugaguuacuaucugagacuuucucugauuuguauauuugucuagauuugaaaauacugaaaugccacugaaaacuuaaguuacaaaaguuaucugaagaaaauguagacgcuuguguuaaugggguuguuuguccauccuuuuagagagcagacugauuguacucuuagaagucaagagauugggauggagaacauuugacgagcucucaggguaaagcaguaaugaugcccucauaaggccaauagacagauauagguuguuuccuuauacauuuuacuuaacaugauauguaaaaauuauuaguguaugagugcuaaauauaaacaaugagacaaccaguauaaaugcccagggaauggguuucagcuuuuucuaccuuccaaacacuuacaacaaggcucuguuuggacuagcugcauuucaagccaucaguuauugucucguggcuggacaguguagguauacacacuaacccagauuucuuccaucacagcagugcaacagcuuuuaaaaggguggacuuaagaguuuugagucauuguuuugguucaugugggagaccuuugacucugauguacaagagaagaaaucauugaacucuugggguaacaagucuuugguagggccauauucugauuuuuuuuuccucgccaacauuuuugauuuuucaguaaaguaaauguucuuaagggauuuguugacuuuaccuuuacuuaccugggaagccaggcugucucaguuuuucuggccacagacacauugcaggcaguguuagaggagaagauaaugucuccccccacuucucuuuuuagagauugaaggcaguauacccuggcgcugcccugggccgaggcuguccaccaucuguguaaggaauucacaaucccagacaaaagaaauuggcaaaguccuccucugucugcucuccagauucucuagauagccauaaaacaccuggacaaaaucagcaggugauggcaagagaaagagaaugaucagucacaggcgucguugaagccuuugaacauuacuuauggccuggacguugcugucaccaggcacaguuugaucuugggugaguuuucuggaagagcuuuauucucuggcucugugacaacagcagaaccaaauaauacuguggguaggaaaaagaagaggagagcuaaggcuugccugccucaagauacacaguucuaagugguagugccuccauguguguaagaagcaaguaagguuguuagaugcaaaacugugcuguucagaacacaauuccuagcauaaccccauucgaggaguuaaaauauccuccuaccuacuuagaauucaugguuuuuuuguuuuguuuuguuuugauaguagguucuuaguugacauuguucaucugcuacauucauaaagacaguuuaaaaccuacuuuuuggacuuagugcggagauggcaaguugguguuacagaacuuacuggcuuuuaaguguuucuuguugugauauauggugcuuccauauagcuauugucccuagaacgucucugcauguguuucagaggagggugaaucuaacauuagaauccucagacaggcugugcaaguguauuuucugacauucuccuguugugcacuaugguugugguuaucuccucuguuccuuuugauacugaaucugaagugcugaguaaacacuaagacaucaugugaguuacugcaguugcuauggcacuauccuguggaaagagaauugcauaucacagcauuuagugaggacaagucuguuuuuaaugggucaggaauugugccguaaaagauaauucuuggaccaguagaaacucugagcaaaguccuuugguuguuaucgucagucaggaaguuagaguuuaauuuggugguacuuaaguuguuugcuccugccacuuuaaugguuguaucuuaguuaugcccuuuauuuccagagagaggccuaaaccaaagcagaagcuacacuaauucaaaauuagcuucuuuugcuucggcucugucuacaaaugcagccccuuuucauauaaauggcgucaggcuucauugaauuuaacucugucuuguuaaguacauuaaugcuguguucugucauucauuacaugagaauuaguuguguauuacaaagcaggcguuuuuguuuggagcccaaucuucauggaagaaggcuguccgugguugaguucccugugagccuugaagacuggucuuguuuaucuguaacuuguacacuaccacaugcaucaggcaaaauguugaugauaccauugggcggcccaccuuccuauaaacaaggaggcauaaaaagaacacuuaccacauuuccucuugaaaauccccucucccucuauguauuuugacgcacuauuuaaagugaucuauacaguguccguagaguguguuagagaaaguguuaauaucuuagagcagcaguaauaauaauccuuuugcucgggguaaucaugugcuaauccccugguaagucagaaguauuagaucauuugaaauucauugugucagcuuaguugaaauaacugguauggugcuauaaacauuuagagaaagggagucuuugaaccaaaauaauaaugucaaaaaguuuguuaguauuacagucucauguuuaaggguuucauaagcucaacccauagacaagagcauuucaguuuacacugguguguaauauauuauuuuaaccgaaggcuuauuuuuauuuuguuauuuggggaaauuuucuuugccucuggcacuuaggggacuugaguuuuaugguacaguuuucacuuugugaucacugggagccuagugugccagaguugcauuuuuuuucucucucccucccuccuuccuuuucuuucuuuuuaauucuccuuuuuaaaauaaagcuuuauuguuuguuuaaagaagaauuugggcuugaauuuucuccuugcucuccuuuugcauauuuuuggaacaaacacugaugcuacauauaugugcuuauuuuauugugaaauuuugaauggagagguuuugucccaaguuccccugcuuugcuucugagcagagcugcaccuuugcugggcuuucugugagucaguggaaugauucuucucuucucauucauagcuacagcggaaugagagcccuuagauaagauucuuuauuacugugaacugugugaccaacauauuaguaaauauuuuuuaaaaauauucuaaauuacuucacuuacagaaagcuggaaauuuuggugaguuaacuaaaguuauugccaugacaguaaaugaauaguuuuggugaugaauuauuccaauuucuuuuuuuuuuaugacacuguaaaugaccccccuccccaagccuuaauaaaguuugacucuggcugcuguaugagaccugaagcuauuuguauaaaaacacuuggguauuaauuaucuguugacaaagcauugggauagaacugcagcaaguaucagccauuuaauugauuaucuaaaaauucagaacuucacuuagaaauugggcagccaagucucauauuggaagaaaauugcaauuucucugcuucaugauauuauuacuugcuugaagcuugucuuugacuuguaguuuggaagaguuguagauuuuucuauuacuguguuuauuaaaagccacaauaagauugggguuagcaguucuucuuacugggugccugugguuagauaaagagagggacuugcacauuugcuggaugccacaucaggaccuaccauacugcacaugacuuucuugccccauguccuccuaggaacagaauuuagcaaugaaaugguucauccuagagcaaccagaacauaggauagcguucccuaugcuguuauaaaaauaacugagaucuacauagaaucacuggagaacugaagccuggacugagcagcagugucauuaaaugcaacuugagcauuuucaggcauaccucagcugagagaagaaggcugccagauggucugguuuaaaucacagagacaguguggccaacugcagacucaaccccugguggcccagacaucacacaguuuugcauggcaaaaaaagguuggggaugcuaguauuccagacauuggcaucacugaagaagagguagaauucuacggagcaugggcuuagagaccauagaaggcaugcuuacaugcccgucauaagguauccuagcucagaaagggcaggauggacaguuacauuuguaaaugacuauuguaaaugacuauuuagaggucaguugagguauuauagagaucaguugagguauuacgacuuaaccaggaucacuggauaagggcagcauggcccaguggcaaagagcuaggcuauuuaccuguaaauccuauuucuaucaccugaucccuuuugugcuauuugccaggucauggguauaacuacauguccaagugccucuuugaaguagauuuaguauuaucuacaaucucuauacuauaaguuaauuauggagaauggauagauauacagugccuacaacagugucugaaauagguaaggaccucauguguguuugaauuauagaguaagaccaaacacuaagaacauuguugaaaccaccaguuacaacaaucccuaguaaagcuggcugcuggaacacucucugcuaagcugggugacaggaaccaucuuugugccuuugaugaagaccuuccauuuaugcucuucugcuguguauucaaaaucacaagcagaugagcuaaucucucucuccaucugcacugaagcauggcugugugcugggugugauuucuccaggaaaaauucaggcuggguaaccucaccuuucauugagaaguaaggcugcauucaugcaugcguuuuauguuucucuucuuagauuuauuuuuuuuccuuuuuuuauuccccugcuuucuuuuuggagccagggucuccaacaaugcagcucuugcuggccuagaaaucacauuguauacuaggcuggucugaaacucacagagaacaacuugucucugccuccucagugcugggauuaaaagcaugccuuuaauucuguuuccugaccauacccaucauuucuuuugaaauacaauucaucagagaaagcuacuuuuauuuuaaaacuaaaaugauuaacuuucgguuuauaccaugcugagaauaucuauuguaucaucaauuuuaguucuucagagcuuauuucuuuggggaugaggaagagagcuuacagaauaagaucguaauauugacuacagugccaagauuagaguagacuuuaaaaguagacugaaauuugcauuuguugguaaucuucaugacucuaauucaguguccguuuuccaaaaggcauggugugauugucagaauaugacuacagagcuuucaacacuauaacuuaaaccuauaacaagucauguguuaauaauuuuaagaacuggguuuguguuuucuuauguuuccugaaagacguaguaacacuuguaucagaaacaacuaagaacggcuugacacagaagcgaaggaagugcacuuucauacacgccaggggugccacccuaaacacaucccaugcuuuccaggaggcccauuaugguaugacuaaagaaccuuagcaaugaucauaguaguuaaauuagccagcuaaauuggcauugucuugaugcaggggagcagauaaaauggaauugagcucgcagaauugguuuugaacacuagguuuucuguugaucagauacgagaccuuagccgagcccuucagaaucucugauucuuucuugcguauaugcagagagaaacuguggugacaguucaauuaacucauguccauaaaauaauauuuuauugaagaaggaaaauuaucccuuuccacccagccuucuaagcucuuggcuggggccccuguuaggaaaagguagaucagcaagaaaaacauguccaaacauuuauagucugacuuauacgugauacauagugcuuuuauaaggaaauaaaguccuaaaagaucaaugaaaacugaguugguuuugcuaggcuugaugaagaauagacaguggaaaaugaacagacaagacuguggauaaggauagccaucuggaagaaacagcaaagcaugcccuguuacguuauauucccaguuaugugcgcauccuauaaucugcuguggggaagagggugagggaauggcagaauggucuugucugagcuguuucuuagauuccuucaauuuaaaagauccauuauggcaagggggcauauaugggauuguguuuccugaccaacacugccauggauguaaaacauaauagccuguguucuggcuuacauaagaguuugaaaacuggucaaggcuaucauuauuauuggaggcaaaauuauuaaccuuauauauuacuaaagagcuucuccaagcauucauuaaagguaaugguuguguuggucaugucacauccucuuccuuggaugcagucauccuugucagcaaauauugcuuagcuaguaguagaauuguuuacagagguuuuaguuuagucccaucggucuguccauccagccaucauccauccauccauccacccaccaucuuuuuuccaugugggaaagugacauguaugguuuucaguuauggauuuggggaugugaccaggcuuugcucccaugugacaagguuccagcagugagcucuaccgcaagccuauuauauagcuuuuuuuuucaauuuaaugauguaaaauguuuauaaaacauuuuaauucugcuuucuucuuagcgauacaaacgugauauuaagaucauuaauguugauagauuuuuuuuuaauucuuguguguuuugcagucuguguuaauugguguguacagggcacauauauguggaggucagagcuugauguuugguguuuucuucaaucgcucucuaccuuacugugggagaaaaguuuucuuucugaaucugauaacaguucagcuagguuggcugaccacugaguucugagaaucugccugcuucugcccucaaucccacccuagugcugggcuuacagcaagcauaaccuggucaugcuuuugauacggguguguggacccagacucaacuuuaugcuugugcagcaaagacuuuacuaacaucaucugcccagccccuacguaaauaggauuuuuugaauucuuacuuuauucuaaacagguguuuuccaaguauuuuguuguuuuuaaaaugaagccaucacuguaacucgagugugguguggaagcaccugugauuuugccugguuauucuaugcuccacacagugcugaaugucagaggcugggaacaagaagucaccccccuuuguaucaaggcauucagaauuaauacucagggaagaaauuugaguuuuccacuagccaauuguuuaucuaggauucaaccucuugaucccaggauugccuauccccugcuacauuuuagucuucucugaauuucaugaugaucaacuuuaacacuuauguuucaguccccaguaccaguguguaggauuuugugacacauaucauaauuguguuuuaagccucacuucauuaggcuuacacuuacaguaccugacccagaagacagaaucuauuucuuuuuugagaaaguauuuuccauaaguauuuuccacuauauucuacucuuuuuccuuuggugacuucuuuuuuuuuuucauuaagacaagugccaugugauaucacguagacaguuaguuuuacauauaccaaagucugauacagcuuguacaauguuuuuaacacuauaugacauaacuggaugaaaccuacacucgucacaauuggaacugucacaaucacugucuucuaagucacaguugaauucaggaauacauuugcugggggaauagcugagcccaaccucugguagcaaccgagcaucuccaucuuacguugauuaacuauuaaguauaugaaaaauagcaagggggaacacuuguaaaauggaagaaauuuuaauuuaaauagugggaggaauagggacacuuguaaaacggaagaaauuuuaaccuaaauagugggaggaaugguauuacugaugcccuuugaauaucgauuuggagcuacuguucuucauggucauggaaugguccaccccugccuuugcuccugaguuuuaauaguauccuuugauaucauaaguauuuauuuaguucugaauuuaaacugauuuuaaguaaaaggucucuggucccaggguuagaauagaauuguucagucuuagugguacaaugucugcuuccuagucaguuauaacaggcuucugauuauugcuuuaacacaaugcauuauuccuuccauguaugauccauauuuuaacaugggacaaguauauuagauagguucauaugcaacuggcacuguaagcauuguauuagucauaugcuuggguauucucacuguucuuuaugucucacaacuugaaaugucauuuuuauuuuaguuuaguuuugcagguuacuuuucacagaagcaaaggagccuuuucuguuuuccuccugucaucugauaacugaaucuucugaaauaacagacaagagcuagauugauaggagaaaagucauacaagaucaugacuuauaugaggacguggugcaaaaaguagacacccaauaaccuaaucugaacucaaagcuuaaguucccaguucauggggaagagggaagugaagguugugggcacuuucagaaaaaaguaggugauauuuacaggggaugaaugggucuguagaacaaacagugguuuaagacacaguguuuugggcucucgacuuuguaaguugcauguucuuggccuaugcugucucaccuguauaccauugauaaugcccaucuucuuggaugacauucauuucccaucuugacaugcugauguugauuucugcgaaauuccucuugcacaaaugcugaugguccaggugacaggucuaagggcuaucaaguaaaacaagauauggucucugaccucaaagaccuugagucagcaccuccagaaagccuggcccuccuccaugugauucuuucaguaagccuuucuugcaccccaaagacgucuccucucugagucugggaacauucuguuuaucucuuucuugucauguucaucagcucccacuuaauauuuauguguaguuaaaguugucucugugcuuaggugugaauuccuugaggacacacacaugcuuacacaucagggcuucacauuguacuuuucacauuuuucaggacuacuuauugagccuacgaagcuacaagauuaacauuuugaccuaaaaauugauuaggggacucuugucauguuuacuaguuuuccuucuuacucuguauaguuggaaggauuuuauuuucaauuccuagugucuuacaaacaaauaaaauagaaauucagucuaacuuuaguacaagaaaagugacuggggaaugggaaacaguaggagaugguuuaguguauacagucuuccaucauaaggcagacacuuaaucucaggaaacagccuaaugaauaugaacacuuggaaaauuaguugcccauuucauuaauuguuuauuugugaaugaaaggggcuagucaagcuggacaauugcuugguuucuggaaauugcuauacuaaacuaucuccagauguugggagaaagcaagacauccacauuuuauuguguguaacauauuguuacacaauucauaauuugagccuggauuuuuagcuccuguuuucuuagcacuucauuuuauuuugguguuagauuucucuucuccuucaaacuugauauuaaaauaagcggaaauacucaauacuguacuuucacugaaguuaaccagucuagauuauccagucuagguuuaaaaagcuagacuugcuuuuguacagaggaaaaauuucccuugguauguuuugagaauuauuuacaugauaaauuguguguguauguguguguguaugugugugugaauuuugaaaguugaauugacuuccaucaauaauuguccuugacagggauuuuaaaaucaaacuuaacuuuuauuucagagaauucaguugacaugacuuuauaauguuguucuuucaaguuacuaaauccuaaacaaaaaugagcacagagugaccagcugcggcagcaagcugugcaugucuucuaucacuagcauguagagugagggcguucuuaccuugguuuucugucuuaauucaagcauugaaaugguagcccuaccauuaucugucaaucccaccuuccaacuaacagguauccuggcuccucuuugaagcugcuuuggagucuuaagauugauugauaaccaaaccaaagcaauaggaugaauguaaagaguuggauuuuuacauggcauuuaaaaauggcauuugugccacacugugcuuuacagcuauuuuccagauaauucgaaauaucagaaggaaacccuuuggguuucuuaggacaacuguccuauccaccuuucuuuucaucugugggccauagaggugacucaggcuggaugccuguugacuaaaauaucuggaaugacaauugauaguaucuuuccuuuguguugugacaaauauauuuaggcugcaguuuauuagcauaauucagcagaaccacagacauauuguacauauuagagcauagaauuagaacaucacaguguccccuugugcuuuuucccccuuuuuugacaaagaucuggauaauugcuucaacaaaugaacugcaguguucagcguguuucuauaauuucauaaauuguuugcaugauaaaaaccaagcaagcuuucacugaguuaauauaaaaaaaacccacaguguaauuagagaagauauaucaguuuuuaaaacguaugacagaaauggcagucgaacugacagcuacuuuuuccuugcucugucauaacaaauuauaacucuuuaaaguaugaguagggaggucugcccugcccaccucaucuuugaaaugggucuguacugaagaugaaugcccgggcccuugugugauggcagccucugguaaugacucuugcacuucagagcuucuucauguugcauuccugaacucuccagugaggagaacugaaacaccuugcauuugaaugagagucaagcagaacagagaggagacaaaucguuuacaagcagauugaaugucuucuuuucuaacucuauaugguagcauauucauugcuucucacuaaauccuauugaguaauuaauguagauauuuuugcuucaguuucuaugaucucugaaagcugauauguuaucaucauaaaccuauuuuguucauuucucacagucgucucaucugucacucucacacuauagucagcuuucuuauccauaaauuauugggaaccucagauuucuucuggggguguuuaggaaagauguagcucaucggccauucuuuucaacuuguagggaaucuaauuauaguggugcaucuggcaggcaugaaaaccauuagacaagcaaagaggacucccaaaugccacuccacgaguguaauuuaaaaugcuuccgauucagcacaucauucuucaguuaucuccucguguguuguucuguucugguguggcauggcagccuuggucuuuccaaccccugucccucauuguugcaccgggugagagcuguauuaugcuccauggucuuucucguagaauuaauggggacaaaaguuuuauuuacucuuaauacauaagagacucaaaugauuuucugcuaaggguaaggguggaguuauuuggcaucauuagaacaacagacagacagagagcugaggacaguuaagaauaugacaaagccaagccuguucuuuuuccuucuucuuaguuuagucaagacugaggauagugagacaucagaguccugaaaaacaaggaaaaguaagagaaagucaggcaugggauucacguucaagaccuaaugaagcaguggagaaaaggauuauuacuacgaaaaaggaagagcaucaguccuccugggaacgcaacagaaaacacuuuuugcaagauuaguuucaggcaguaguuggaguggaagugugcuggaaaguauaaacucuuggcuagacacugaaguccuggagagggaaugguucacagcccuguacaguggcuacaaugguaaagaaaaacaguaggaggcaugucccuauuuccauaaaggcuggggugcgugugcuguuuccuucaugcgguagaugugguuuggacacugugugaucauacuuaguauuucaguugaaauacaaccuuuuuguccuacaacagugaaguugacuugaaccugugucccuuuucacuccuugaucagugaagcaagacuagguuaagaggcgucuucucugcagaucauagcauccugcacacaccccaugugcugugacucuccugccuuacagguuaaaguucugcaguaugcuuauccgccucacacucucuuuaucuguaaagcccagcacagaguagacauuuagaaaauacuuguugaauuuauaauuucaugucugcuauuuguacuguaaaaguuuccaaagcuggucaaccaugguucugaaagaccccauggcaguugaccaccugcagcucugagcagagcuagccauaccuggucuguccugucucccccuuuuuuuuaaggguuuuuuuauuagguauuuucuucauuuacauuuccacuacuauuccaaaaguccccccauacccuccucccacucugugagcauccacuucuguguuugcuaggcccuggcauagccucacaagggacagcucuaucuggguccuuucagcaaacucuugcuaguguaugcaauggugucagcauuuggaggcagauuaugggauggauccccagauauggcagucucuagaugguccauccuuucgucucagcuccaaacuuugucucuauaacuccuuccuuggguguuuucuucccaauucuaagaaggggcaaagugucuacauuuuggucuucguucuucuugaguuucaucuguuuugcagauuguaucuuguaucuuggguauucuaagauucugggcuaauauccacuuacaguaagaacauaucauuugaguucuuuugugauuggguuaccucacucaggaugaugcccuucagguccaaccauuugccuaggaauuucauuaauucauucuuuuuaauagcugaguaguaguccauuguguaaauguaccacauuuucuguauccauuccucuguugaggggcaucuggguucuuuccagcuucuggcuauuauaaauaaggcugcuaugaauuaguggagcaugugucuuucuuaccaguuggaacaucuucuggauauaugcccaggagaggucuuucgggaucguccaggaguacuauguccaauuuucgaggaacugccagacugauuuccagagcgguuguacaagcuugcaaucccaccaacaguggagaauguuccucuuucugcagauccucaccagccucugcugucaccugaguuuuugaucuuagccauucugacuggugugagguggaaucucaggguugcuuugauuugcauuucccugaugauuaaggaugcugaacauuuuuucaggugcuucucagccauucuguauucgucaggugagaauucuuuguuuaccucugagccccauuuuuaaugggguuauuugauuuucuggaguccaccuucuugaguucuuuauauauauuggauauuaguccccuaucuaauuuaggauagguaaagauccuuucuguugguggccuuuuugucuuauuaacagugucuuuugccuuacagaaacuuugcaauuuuaugaggucccauuugucuauucucgaucuuacagcacaagccauugcuguucuauucagaaaauuuuccccugugcccauaucuucgagguuuucccccacuuucuccucuauaaguuucacugucucugguuuuauauggaguuccuugauccacuuagauuugaccuuaguacaaggacauaggaauggaucaauucgcauucuucuacaugauaaccaccgguugugccaccaccauuuguugaaaaugcugucuuuuucccacuggaugguuuuagcucccuuguggaagaucaggugaccauagguguguggguucaucucugggucuucaauucuauuccauuggucuacuugucugucacuauaccaguaccaugcaguuuuuaucacaauugcucuguaguacagcuuuaggucaggcaaggugauuuccccagagguucuuuuauccuugagaagaguuuuugcuauccuagguuuuuuguuauuccagaugaauuugcagauugcccuuucuaauucguugaagaguugaguuggaguuuugauggggauugcauugaauuucuagauugcuuuuggcaagagagccauuuuuacuauauugauccugccaauccaugagcaugggagaucuuuccaucuucugagaucuucaauuucuuucuucagagacuugaaguucuugucauacagaucuuucacuuucuuaguuagagucacgccaagguauuuuauauuauuuguggcuauugugaaggguguuguuucccuaauuucuuucucagccuuuuuauccuuuguguagagaaaggccauugacuuguuucaguuaauuuuauauccagcuacuucacugaagcuguuuaucagguuuagcaguucucuggugaaauuuuuagggucacuuauauauacuaucauaucaucugcaaaaagugauauuuugacuucuuucuuuccaauuuguauccccuugaucuccuuuuauugucgaauugcucuggcuaggaauucaaauacuauuuugaauagggagaaagggggcagccuugucuagucccugauuuuagugggauugcuuccagcuuuaggauguguuccuggcaccaaagaaacagcucccaaaucucucuugagaaggagauaagaacuguaaauugagggacuggagagaugcacccucacauauacaugcacacaggcaaaacagcaauuuacauaaaauaaaauaaauuauuggaaaaaaagaauuguagguuuggagggugugauauuuaagaaagccaaauaaauuauguaagcaaagcaagacccgagcuugccuucauuauguaaauauuacuguaaaucauguaaauaugaaguuuugagaaaaccugggaaguauuaagugucuugcacaugauaacagaggaaacuggcuggaguuugaucuugagucuauacucuagugaguaauggcauguaaaugacagauuuggaagucguaagucacucuuuauguuuccugacuuuuuucagguuuccuuguggaaucagcuuauacaucaaguguugagaguaguuagaaauguauaaacaguaugucuagauacuauauaccgcucauauuagaaauauuacucuagucuuaucuaaaaggaggauuaaaagucaccacaaugacuuuguuuaccauuuacucuuucucuggcauccuccuuggcucuuuguacaggguaucucauauggcugggaaaauuuagugugagagcaguugcuacaagugaggaauagagugucucugaaaagauaaauaauucacaaauaacacauaaggaagccuuuccuauucauagaauauggacauuaaggcuacauuuaguuuaaucagaacuccacacuuuucuggccugccuucuuccaaugcaaauuaauugucucaagacucuugaaguuuuugcucagagagaacguagcuuuguagucucuccagacaagguagccagcucaugccaugaggcuuuugauagcaggaagugcagugcuccucagaauaagucuggguauccaagaguauugacuaacugauucagaacauuugcacacaugacucauugacaggagacagagugccuuugcucacuuuguguuucuagaaaggguuaauuuuguuaaucucugaauuggguugucagagucugugauuggaaccucagggggcuuuucauguggaggacuaggcuuccuggagcuuagggaaacucacugagauuucuccaggacuucaggagaugccaucugggaacucuucuaggaucauccaugaacaucuuggcccagucugcaagucucaguaggguucuugguuucuauguauuuuuaacaacacugguaacguaagaaagcccaaagauuauuuuagcuuugaaaauuuauuuuguaaagauacaaaauugauuguuuacccugaagugcagccuuuauauaaugccuguguugagacuugaacuuguuucuaacaggacugcuaaguugaaauggucacagcuaauucuacaaauauggacugguccuaugguccuuuuaauggcagcuaacggaaacacagcucuucuccagcuccuaguaacagucuucuuucccuuuacuguuuuugcuuuuucugcuuuugagguaugagcuacuucaccuaauccacauuuguuucucccuuccccuuucuaacaaauauggcaccaucuuugcuagagugaccuuucuucuucuauuaacuuuuaaaauuaaaagucuuaaaauuauuucuacuuucuugaacuuuuccaaaacauuucuuuaacacauuguuugauuaaauuaacauugcauguuuuguaauuguaauuuuuugaucaauuaacauugauguauuaacauauauguuaauaacuuacaaauaauugauuaggaucuaaaaaucgguccaucaaugaagguguaagauguuuauucuauucuagugguggguauuacaaauagauuauuuuuuuaaaagaaguucuggaaagauugagaccaugucauuaaguauauuaauuauacuccagauauacaaauuuaguuuuuuuauggcucuaguuuugucuguaauaugcuuaguuucuucuuuucauagacugcauacuuugcguauuuuuacuuuggguuccuucucuggcagcaaaaugaacuucuuuucaagaggaauacacuuuugauuuccaaagguuugagagcgaaaggcuguaaaacagaaacugcagacuugguuagacuguuacaaauguggcucugcaugagaaagugggcucuccccucacucugcuccccccauauaacugagauuaugauaaagugaugcccaccuaaugauuugaauuaucuuuuuauaguauuuauuacacugaguauuauaugucaaaguaagacaacuuguccugcauuaguaaacucuaauucuguaggcaauagacaauauauggaaaaauacauauauuaggcucaaucuugggauagacauuucuucuuuucauucucuuuacuaccuauagcuguuguguucuguucacaaaacaucuguuacuguguuuuacagaagcaguuagagcauuguacuauuuugagauaaugacuuguucucuuaggagacugucagggugguuagguaguuaauaaugaaagagaugucuacuuucaggaaguucaugccugguucuuccuaaggaggagagccauugugugguacaguagcccuguuaguuuacuaaaacaagcacaucaggacagacugacacucagaaguguucuuggcuuuuacuugacaagguuuuuuguuuguugagauauaauucgagcacauuuucaaauucuuauagcuauuaccacugcaagaucuuuuaaauuaaaaauuacuuauauuuauaaaaauauaugaaauuuucuuuaaauucaagguauuuuuuuaaacuuaaaaaauuauuuuaaacaaaacucaaaauauagaccucaguaaauguuaauuaggauuugcuuucuuuucauaauacuuaauuuuuauuuauuuauuuucuguguaugaugugugugcucagacgcucaugcaaauacuuaauuuuuauuuauuuauuuucuguguaugaugugugugcucagacgcucacgcacacgcacaugugcaugugugugcacacauaccagugcauucauucagaggccacaggaggauauuggguaacuuccucuaauguucucuaccuuauuccuuggagacagggucucuagcucaaauggauauugguugaguuuuggccccagugauccuuuuccgcagccuaccaccccaugcaagggugacccguguguguguccguccguauuauacgcagcuuuuaucaugaguucuagggaaugcuuauucauagcacuguacaguguaugguguuacuccccgagccucugcgcaagcccucauaauacuuucaaauaguaaauguaugugugaguuugacagauacuuuucuaggcaugcuaguaaucaggaccaugacagagacuguucuauuaagucucucauuuuaguguauuauugauaaauuugaaaguagaucuaaauaaagacauaaaagcuaauaacucccaccuaagguuaugaggagaaauauuaaugguucugggauguuaauuaugaagcccacauacacaauauuacugaaaaaucucuugguauugcauauuuggccaucuguccugccuucugcacccucccaguucuguccuugauagugcugacuaggagggaugcucugauuacucuugucaaaaggcccuuugacaugacagcugaugucugugcccaugcgcgagugguccuucaaaaaucauacucuucagugacauaaaugugagacuuuuguaucaagugacaaacuugacuguugagugauaaacagaauugcugugggaacauuuaauaaaccuuuuaaaauucacuuugcaaaguacacuuucaaccugugucacuucuucuccuauaacguauguauucugucugaugcuggguggaagucacucuuguucuuagcaguguaucccaugcacuuggacugaagcccugcuggaaaccucuggccuacgugugguaccugauuucaccucuuuccggauggaggaacagaaggguuuuacuuucuauuaacauugaccuaaucuagaaggaauuuggugcaagcaugcaagggggcagcaguaccuucauaccacagaagccuacuuagagcugcauuguagaaugaaauuucuggaaguuagccacuuacagagaucuccucaggugacccaucaaauacucucuuuucacacagugagaugacucccuccauuccugcaguauuuacuguacuauuuucaggaucacauuauguacacaauauugugaaagaguaccacagaaaacagagcagaugaaauggucugcaacaucaaaugauaagacaucccucuuccugggagcaguuauacaggaauguaaaaauguccccgucugucuaagcuaucaguuuccaaugucgucccuggaggaaguggcugagaagacauuuccaccuaaugggcuguuagguugccucuguacuguauaguaaguuggugguugcagcccacuuccucuaagacaaagguccauggcucuaaaaucccaucacagcugacacuaauuggcauugcugucggccguagcuguggaagcaggccugugugggcagaguggggcacucugaagggggguguggcaccaagaggauggcuucucugacuuugcuggugacuacgcugauuuccuuucuccaaccuuuguucaugcaaauugcaucaccuucagcauuguuugcugacuugggaagucggcugagaaacccucuuucagaucacugugucauuggaaacccuaccuugcacaauguagacucuuggacuguuaaccuaugaauauuucccuuauacaaaugcaauuaucaauaguaaauaaacauaggauuuaacucaaaaauuucccaucugaaaaacuagccuacuuuuuucuuucuuguuuuucccccuuaagccagaaaccagaagagggcauguuagucuuuuaaaaaugaguuugggauccauuggacccugugcaguuguaauuccuguaaauaggcagagaaccugcuuugcauucauaggcuuaggagcaagguuuuaguugcuacuagaguuuagaaugaguagaaaagcaaauuggcuuuuuccuuaaaguuuaaacaugucagauugugauugcugcaugcaguucccauucugauuauacagacaagagggaagggacagauugcuggacaguuaauucucuuggcugcacugggcgcuuuuccuguacauuaucuuuuagcauuuacggaaucugcuuguugccauuggcaguuguaagcaaauccgaacuuucuuaaaugcauauugaaaaacuggcgaguaguggcagccaggaggaagggaaucccugggggaauugauucguauauuaaucauuuaugcccuuucccugcauccauuuaaaaaugaaaauggauagccauuuagguacauaguuccugcucucccuggcuuccucucuccucuucauccguugcagucucaggaguguggaguggguuccugauucaguugacuuggaaaccaacucccugggagaugcuccacucuuucccugggaaauucuuaggaaaccuuccucaggaaauggcucguuuccccacaguguccaaagaagcacucauuugguucuuccucucacuccgcaaguccuuuaaguaaagcauuuagaauuuauauuuuguucaguuuugugguauguuccuaugucucuuauggguagguaccacgauaguauaaaccauuuauagggccagggccagggccagggccagggccagggccuaugaggcaagugaaaggccugggguauaaaaucugauggaagaggcuucuucuugucauaguacauauuuuggagaaguuaugauuuauuguuugugauccuugaccucuauguaccuaaaaagccuggggagugauuaugacauaugcauauugucuuuguaucuaguaagugucugacuuuguuuuaaaauguggaaacauuaggcuuacuguaaaagaagagauugugauacaaaacauuguuuucucaaaagcaacugugcaaaucucacaguuaauucauaagacaccuucgcccuggcuaaaauguuuaaauaauaauaaaaaauguaucaucacuauuuucugugaccccagauuaaugaaagacacaguuuuacaucaaaggaauuauuauuagcacacauuuuacauuccuuaugccuccugucuguguuuugcuuccuuagacaaaaaaagcuaagggcccaacacuuguaucuagaguuuuaaaguauaaacuuguuauaauuaacugaugcucuaauuuuauuagcugauaacaguaccauauuauacugauugcuucuagcacugagagauucuucacccucguuaucaacuuuuaaaauaucagacaaauugauuauaggggaaaaauuuuuuugacacacaaaaucaaaacuucuuuucauagaaaucaauaccgaaacuaauauuuuggcagcuaaaauaugaagagaagaacauugugcacccuaacucuaacauuuguucauuauuaauggaggaauaaaaaucagaauuugucaacaguucaguuauguaauagaaaauuacaaugaacaagaccccauuaaaaguaauguguuucuguuugccuacuuucugaaguauaccaucugguggcugugcauuagggcuaagcaauuugaacacagguaaaguauuuuagaauuggaguacuagccucacauuuacuaauaaacagauuauuaaagcaugcuugcuacaagcucuguggacauauggauaggguuucagagaaaacacacuuaauuguacauuacugacauguuuaugggugacucagggagaacugacuaauuguaugaauaggguaggaaguggccgucuuagaaaccaggaguacuuuguggaaaucaaaaugaugucuccugaauaguaauguuuaugacaucuaucuagaaacauucugaggucauuuaaaauagacagcgaagcccaggcacguauuuuuuaaaaugcaucacaguucuugcaugugagugaaagagaaguucaccaacgcuuuguuggcuauacuuacuauuuuuuaaucacuccuagcccccuagaggugauugguuuauguuggcuccacccauauaguauuguacauacaucaguacgcauacugaggaaucagaaacccacuuaggaaguucucaguucuccaaugaaaggguucauaugggugaaagcacagagcauguugugguguuuuguguuuuaacugccauucagucuccaugggucugggacaguugacccauucauccugcuucacugcagggaacagcuugggaggacuuuaucuuguaugcaaaggauucaaauagacucuuucagacuauugucucauuuuacuaaaugagagauugagaaagcuuagaagagguguuagaggguguguuuugccaugccaggucucuguggcuugaagccagggaagaguaugaaauacuacuuuuucuuguuacuccacguguccugcaacaugaacaccaauauauugcucugaagaaacagugcacuaagaagaacaaggaggaggcugcagaauacgcuaaacuuuugaccaagagaaugaaggaagccaaagaaaagcaccaggaacagauugccaagagacguaggcucuccucgcugagagcuucuacuucuaagucugaguccagucaaaaaugagucuuuaagagcaacaaauaaugaccuugaaucucaaaaagaaaaaaaaagacaguuaauaaauugauagugccagucaugaguaaacauuucacauuaugugagcaugguugacacuaaacuucuaucagaucacuugucuuuuaugauuacuuuguggauggacagacaguuuauugguuuauuuucuuagagcuucuaacaacuuuucagauaguagacuagauggaaaaauaauauauaugcaagauaagcuacauucucuugagucucuugaaugaugcugcuguuuaugcuguuaauguuuagugauuguacaguaugauuuuuaagucacaggaaacacauugguuuuuauauauuuuguauauaguuguacuuuuauuguuaacuuacucauuuuuuugagccagaauuuauagucaaggaaauagggucaacugcaaaauauccauuuuauagaaauaguaauugaaaacuguauauggauagaugaguacugugucuccuaacuuuaacauuuauuuguuaauggaggcauuuaaaaacaaacggaauuugucagcacaucaauucuccaaaagaaaauugugauggaaagucccuccuuacaguugugccauuucuacuugacuauuugcugaagcagaccaucuggcagcugugcaucagggcuaaggaaacaacacuggaagcgugugugcgugcaugcauguuugccuucuaucagaguuggggaauauucuauuucauuuccagauagaagcaguugguguuuccugaggacuuuacuguacauccauugguuuugguggaaccagccucugguucuugagcuuggauaagucucuuucuuguguuugauuuuaagcagaaagaaaauacuuuucagcacuagagagcugggaagguuguaggagaagcucuuuuucucugcagugccaaggagaccuaaggcuagaacugguuacugaauugccuaaaguaaauagaccgacugccuuagggcagugguucucaaccuuccuaaugcagugaucuuuaaaacacuuccucauguuguggcgaccccugacccuaaaauuauuuuugugcuacuucauaacuguaaggguguuacuccuacaaauuguaauguagauaucugauaugcaggauaucugauaugggacuuccaaagggguugugagccacagguuaagaaccacugccguugagacaaggugcuuuggaugucucgaacuaccucauugcugcagugguguguucauucugccucagccgggcauaggagcuuucucucuugcuagucucauaugaauuugaaggccagguagagauccccgaacugugcuugcauauuaugaucggaaaugaaugcuggguuuuucuucuaaauguuauguuaugauuucuauuuuuaaacccuuaggucuggaauuuguagauaauacccaguuacuggguuuagaaacucccguuugagauuuccagaauuuuacaaaaguauacacacuucaaagucuuaaucuuacauacuuuccuucaacaugauaacauauagaaauguaaguucaaaauagauuauaaauugauacacuuggcagucuugcagauucaaauuuugagaaggucuuauaaaaccaaaacuguagugucuaguaagugauguaauagcagauuugacuuccuuuaauuaucuaaacuaccauuauuaauauccaaaucuguagggcuuguucagauagacacacagagucuguucgcucauaggcaaauaugccuucaaugaggcggauuggugguuugcaguguuuaguuauuuaaugacaccuuaaaacugaaguuuaaaucuccaaagcuggagacgacaaacguggaaauacaggcaugaaaggaaagacuaccaccucuuugugaacagcaggacuggcuuuguacaaacaggaccagauugauucuguuaaccaagauuauaggggcagaugacaaagugcaugcaaauaaugcauguguugucugguguguacaggacacaucuagacauaugucugcucauguccauguacagucaaagaaaaacaccuuucugugaaauaauguguuccuuuagaauggcuguacauguucauaauuuugaaaacauuucuauuguaaccuacaucaaaagagaagccaggguuuuugugucugugucugacuauacauaugcauuauaaaaaaaagugagucuacuguaauuaccaguuugcagagcgaauuccugcaggguuuguacucuccccauuaguaaaagagauaaguugaaauguauuaaaauuucacuguacaacugggaguuuuuguucacaguaaauguguuaauguuucuucauugcuugacuguuuguguuuaaauuuaggcagcgugcccaacagggacaaaauuauaggauaaagcaauguauaaaggaaaauccuucagagaacaccaauaaggcucuuuucaaaaauaagcaguuacacauaacagugcacggcuguagccauagagaaaaguuuuaucugucuauuucagaauuauuggaauuuuuccuucccuugugugaaaguuaagaggacugugcauaugucgauagguaaucuacuuggaugugaaaacaucuauuauuuuauucaguguuacucuugaaaaaagaaaaauaagugauuucuucuugucuuugugaugaagggaggcaaauagcauuuagugaaagagguacuagaucacauuugcuuuccuagggcaggaauuuuuuccaagcuaggaauuuuaauuagugccuguuauauuauuggaacauuuuuccgugcuuuucauuguagccaugaacuuaguaaaugcaacuauucacguagauaggcuuacuuuuuaaaaauuaaucuaaaaccacuaucaccuaguaugaauguauaaugaaauuuucuaaaggcugcucgcuauuucucuagucuaggggaauagaaauacaguucuucaguaaacaggcuauggaagcgucggcccuuacaggaguugcacucccuucuuguugaauauguuuuguaguuaauccuacuugccuuuuguuguuuguuucuguuagccaacauccauagguugucccugaucucuccauggaccuugaauagcacagagaaaaagcugggccaaaaaccacaauauggauccuccauuugagauggugucauuaucgcaguuguguguuuaaaucuauucagugaagguaaccucauugcuuguauugugaaugugaacagacuguaggaggagccucuugagcaguuccuguuguguguuaacgugccuuagauaaguuugaccuuaaauaacuuggcucacccuacaaaaaggcauuuaauuuuuauugccuuuucuacauucuucuuuaacacgugaauuuuuaacugauagaccuugaagugcuucagagucauuacuuucuuuuggcuaauuuguagaaaggcaccauaugaaaauugaauuuuugaucugauggaguaauuuuugaguucuuaugaaccauuuauaaucuaucaaguaaauccuccucaguucacggauuauugacccaguggaccauauuagcugcuucaaagcuguuauagcccauuauguugauuccgcugacacauacaugaacccagucucugugccuaugaugacauugacauuguucuggaacacucuuuuuccaccaggcuuucuauuuauuucuuaauuuuuaggaguuagcucauaguucaugauaaccaucacacggcucucucaauuugcucaguggugucagaacuuucuuagcagcuggcuguuacgcuaauguuuaaaagacaaaaugaaaacaauuuuuuaaacagucuuaggguacauuuuacucuggacacuuacagauuuuauagauauuuguguaauuuuuuuugcauauuuaaauauguaguccuuugaauuggaaaaggaaaaaaaccaauaagaaggaauaauauugugcuugugguguaugugugguauauaaaugcauugucugagagauuucauuugaacaauuccaaugacuucagcuacuggaagaacggagaugugccuucauugauuuguacaaagcucuaaugaauccagcccaggccuuagcacagacccaggggacucugugaccgaacauuaauaauuugcaaagaugcauuggcuguucaucauauuauuguuaucuguaauaaguguuacuccuguggucauaccuguauuuaagcaaaggagcuuguccucaugggguaacugugaugucgcaguauagacacaauggaagauggccaugcuuguugguacguguguuacuagugggaagucucaagacagggauggauacaaaaugauuuguaauaagccagguguccuuggaaguaucacgucuuacauuuaaaguguuugaaauuucuuaguaucagauuuucucacuuuuucaaauugcuuaaaucuucauguucagccccuuuguccuuuucagcaucugguucacaucugaagaguguuaaauuccuauuggaacuuacugagagugggguagccaugugaauuucuuuuucuuuccuuucaaaaacagaacagcucacuagcuguggccuguucuacuuagagacgucuaacagauucuuuucuacuguuugaaugagaaccuaacuucagggauuuuagugauuaaauaugagaguacauuugcaggguaucaugcaagcuugauggcagugcacaaacacaggcuguuagucucacagagugugccucucuuguccugaguagucgcugccaucugaaaugauaaauuccaaagguggcaacucucuucccugucaauucacuagagugaacuuuuucacaaaccuaggggaaggucaucuaccucgcucucauccuugauaaguggauuccaaugaguacucugguguuuuaaauaauguagccuuucccucugucccuucuuccauucacugcccuucccuuccuuucucccuccuauugcuggggguuaacucagagcuucuuauaaccaggucaaaaucaaaacuuggauccucaaccucacccuggaaauucugggcauuuuucuuuaagagaucugagugugacagcugggaaggaacagcagcuuugcuccucgcucgagaugaugucuuauauuugguauaccagguuucggauuaucccuaaaccuauccaucugguuaccaaaguacaaagucauuguguuaguugcaugcucuccccaggauucgaaggugcuucugaaaaucugggacaugaguuucauacuguccugcuucuuccugaguagagaguagauuuuuguaaaguaguaaaagguuuauaaaucuucuuacaucaccuaacaauuacagaucccuuccugaugaaugucuuuccuaucauauuagugauugguuuuaugaacaaaugucacagagaugcauaaucacaugaccaccuuucaaauugcauuagugcaaaugaaugaaaaguguaucaauggaagacaaaauugcugauucgacauaaagauauaaugaggugauuauuaacauuuggaugguaucaguauucuggcucuuuauguaagguuaugugucauggcagaugcagaguguauuuagggaguagcuguuucaggaguuagugagcucuccucuuacuuucaucuuggugauggcuguguccauuggaagagggcauuccuucuagcuguguugucgcagcugccuagauagucugcagauuucucaaguauacaagccauaaauagaguuucugaauuguuaacuguuagguaagaaacugaaauguuuugcccaaauugaaaugccuuuucauuuucuguuucucuaauauuacuaauuaucuaacaaaauacuuucuguuacuauugaccugauuuaauuggggggagcgccuccacacucagacgcuugcccucuuugaugccguggaugcauacguauuuuccuuauauaauuggcuauaucccgcuguugauuuuuacucugaacucuuaaauuauuuaaauggggucuuccucaugucgauugaugguaggcuaugaucgugagguaaugacuacagaugcucauuggaucugugucugaaaauuuaugugccucugugugucacuuacucccuguuuagguauucacacagacauaggaauauucagagucauguauaaugauacacccguaaguuuaggggcuucucucuuugcuuccucccccacacuuaauuaguuucuagacugaaguaguuuuuuuuccaucauaguaaauugugcagugcuauggaccuaugcaugacagaacacaccacucucauuuauaaguagauucucuucaaaguuuuuagaaucuugaugagcauuauaauugauaccucuccaccacccuaccccccaaauuuuaaaagauguccuggauuuucuagaaaaaugguacuauuuaaauacuaguuuuuaaaauaaauacauuaguuuuuaauauuuugaaaggaagauauuuuuaaaauuaggcaccauggaaauuccuuuguuuaccaucuguguauuagcucauuuaguauuuauuuggcaaaguuguacugggcaaaggcagauacugugcuuuacuaugucuccuguggaagacuaucuaauagaaugaaugauuuagcaccacugaaaauaguaauuggugcgagucauccugugccuguuuaugaaugacuucauugagauauguuucucaccacaugccuuccacccauuuaaauaucugguuuaguguguuucuguauaguaacaauuaugcguggcaaucaguuuuauuuugaagacauuuucaacaccuagaaauguaauuucauguucuagccauugacccacuccaagccuuaggcauccaucaguguacuucuaucuguauaguuuucccacacagacauuccauauauacauggaaucaugugggauuguagugccuucuugcuucuucaacuuagcauaaugcuuuuuauguucacuuagguuuuaaaauguauuacuuuuuauggccaaguaauauuuaauuauaugaauauacuacauuuuuaagucuaccuauugaugggggucaguauauuugaaagagaaacuuaaaagugagaguuugucucuugauuuuuuuuuuaaacaguaguagauguucuaagguugauuuuuaucagugaaccucuuggacaucuuucaguuacuuugaaagcauuuauuaugaaagugauauauuuccuuggcucauaauuuuucuuuuuaaaaguuuaauuaucauugaaucacauagccuuuuguguuucucagauuguuuaguguuugaaccaauggccucuccccuuuuuagugagucuagcagacugcuuucacaucacccagagcauguacaagaugaaugauguguuuucuguuggaaagaccaaaaggauuucugaucguuugccaucuacuaauucuucauaugucaugaaaaacaauuaggcaaauauaaggaacauuuuugaaauguuuucacuuuuaaguuauguuauuaccacauguuauggauauauuuaccuuaauuuuucauuaaguuuuaaaauaguguugcuagcagaauaacuucauuucucaguucuuggcauaacuuguaccugcugaguguagugauguuuauguuauagcugaacaagcuguggacacuuagcauugauaauaagccuuauaaucagcaauaauuacuaauuguaaaccauauuuguugcguauucaaccucagauuuauaucuuuguauaaacacaaagaauauaucuaccuuagucuuacugucaaaaucgucuagagacuuuuagauuggcaaagaaaaggaggcguuucuggguguguucuuuauaacccuauaaggccuuugaggucuaugucugccuaauuguaaaacuugauuguuaaugcccagagcccaaaagauuguauuccuuugcauacaauguggaaggauuuuguuaccaagaaagaguaauugccucaugcagucauauuggcacucuuugucacuaauaaacuuaguaguuguccuucagcuuuuacaugcuacagauuuuugugcagggggcaucaugaacuggcuaguuuagaaacacaggucuucugcaaaccauguuaguuucccaagacccagccagacugaacuucguagaagguuguuucuuuucucuuggccugaugaauuugccauaugaggaaaagaagaaacuguccugaaacuuuuauagggaaauauuuauuaguuuaugauacauauauauauguuuauauguuuaugacauuacaacuaaaagguugacuuuaagaaaaagacguuaugagcugcgacuaguacucagcgguagaguauuuccuuagugugcuggaggccucagguguccucagcucuggagaaggagaacuggaaauagaccaggugaagcuucugccaguggcaaucauuacagccaacuacggucuacucagaaagcacacugccugaguuuauaguacacacuaguagcugcaaugaaugcuaccuucacaauuaaaaucuuccauaauuuaaguuuauugugaguuagguucuucaguauuaaaugcuuaaaaauauugcgagugaaguuccaugaucuaaguuacaaauccuccucacugcccuaagaaaugaacaacaagaaagugaauuuacgcauuuuuaguuacacaugagaguuuggccagauuucaaucacuaagaaagaguguuugaaaagucacagaacccuaugaauccuuuuauuuauuuauuuauuuauuuauuuauuuauuuuuggaggggggcauguggaaaauuaaaacccagagcuaaaaugaguuucgguauagagccccugcucacugugcuugcaucuguacauauauguuguaaguuuguguuugccuccugaccuuauuuugccuguuguuauuuuaugucagauaaaucaagagcuuauuucuacauaaggagcagcuaacagauguuuagccuguguauaauuccuuuguuaguuauauuaaguauuaacagaaacaacaguuuuuuuccugagaaauucuauuuuguaagaucccugauguuugguccuuacauacucacagaguuagugcaagcuaguguaauuaaagagacugagggacuuguuuuagugauagucuaaucaggauuggaauagaucuuuggaauauaacuggaauaccucaaaauacauucuuacuuaauauuagaacucauuaauauuuuguaaacaaacuuugcuuacuuguagguuuuaggugugcugucuuuugagauggguuguucuuauauuguccaggcuacuguuaaacuacugaugucuucccucagcaucccaaguagcugggagugugugugugugugugugugugugugugugugcuccuacauuucugauguccuguugaaucuguacauucuuccccaucuuagguagagguauacagugaguaguaauugauggagcaugccuacuaauauuauaguagagccuuaaaacagaaaaaaauaguuuguccuccucuuagauggauacagacacacaguccaucaguuacucauuaacauuaaauauauguuacacaucuggcaaaauaaugggauaaaauugagugcaaaaggaaucauucuuagacauccagaacauugcuugagaucacaaacaguugucauuuguuccucuuguacuucuccaggcuugauacucugugcuucauguugauuacuuugagaaauuuaccauguaguucauggaagccauuauuaggaauugaaaacaggguauugggguaucuucccccuugcucccuucaauuuuggaggaucucaugcuuaugcugguuucauauuuacuguguagcugagggugaccuugcugccaagccugaggaccugaguuaguucucuggaacacacaugguugaagaagaaaaccuccugacuuccacaucugcacuguaaugcaugcauguauacuugagugagcaguugacacaugcaugcauccaacacacacacaugcacacacagagacaacauaccacaaauagacugagcaauuauaaugaagaaguauagcauggggucuauugucaaaaagaaucugcugcaagggccaagaucacauuaaagcaauugucauacagaaaagugcagaugaagagagggucaagucaacaaggaaaaggggaaugaucaaauuaauuaggagccaguuugaauggucuaggggaaccacaacuggaauucagauauuaacaaugagagugggaggccaggaaaugcaaggacagaugauuuuuggagggagacaucaugaacugauucccuguccuuguaggaacagcacucagccauuggugcagacacaccuguguuugauugagaugcuugagugacuucaggcaaggcauuagucaucaccucaggucccucauguguaaaaggaagauaauagcagugucaaauucauggucuuuucugagaacuuuguguuuuuguaauuuuucuacaaaacugucauguuuucuacacugacuggaaaacauucaauuaaucuagcuauuauuaauuauaaaggacaauaagaagugaccauguuucgauggaagaauagagaggaaucgauggucucuaucacccaguuuaagaacucuuauucuugggcucuacacucuaaauccucuaaucaugaagccugcaaauaccaaguugcuaagccuuguacacaggaacucugccauccacuucuuaccacuuaacacgaugcuuuuugcacaguaguuggagcuguaggagaggauggaauugccaaaugaagagugaagagccugaccaugggcgacuccuauguuuauuuacagugaugagagagaaguugcuaccagaaaagcuagauaguuagucuuacuuucucaggaaugaagaugaguuauaguugcaaguuacaccaaggucuaggaggacaaggagaccaggauaggaaccaaaugugcuccuaguaucgcuucaagagugcagcgucagaaaccuguggccagaauucagaacuaaacuguagauggcaugaggaaguagagacauugguuugggcaugcacagauuucucuuucaagaaacccauagugggggguuaguaggaguaauuacuuuuaauguguugcgaguuaaaauguuugugauugcuguuccuggagcucagggcaagagguacaaggcagguuggaaggguaggguagcuccuucuacuccuugagugccuaggggaugagguacaaguugguaagcggggccuacagaugggucugcauuggccagccugaacauuguucccugcagagguggcaaugacaagucuguaugaagcuucugcagcauucuuccuuucuggcguucagagguugucacucagacaguguaauagugacaguccugugcagagaucccgcagagugggaaacacuccagcacuagcuaauggaagaaagaauggagggugcucccaggacgaagguucuuccaccgcagcucuuccugucugucucccugaaacacauggacauuucugaggcuuaaccagauuugauaguuuaugauaaaccuguuuuguaagugugccugaguuggcaggcgaucauauugguucuguuuuguugugaauaaauaguaugucagaguuuuaugccauuucaaaaacauuauuuaaaacaaaacuuccuuugaagccaugauagucucuuacacaaaauauuuauuuagccauauuguuuaaguaucuguaauucccuuaaggaggaauuguagucugcguaagccucaguuuaaaacagauaggccuucuggaauuuacagaaauacaaaauggcuaguccugugcuuaaguguuuauauacaaaggaguugagguguuccaguguucuguguuuggguauaaaaagaguaggauccaagaaaaagaaaucaucuugaaaagauuuaauucccaaguaaaccagaugagcaguguuaaguagucugagugaaugaaugaaugaguuaaccagcaguaagauguguguguguguguguguguguguguguguguguaguuaaccuacaucucuuaguuuguuuuuaucuugauuauugauaaaagugaagguuuguucuaaauguuguaaaauaaaaauuuuuggcaaaauaauuaacaucaaauuaacgacucaaacuguuugaugucauuuauuguagaguuaaauauucuccuuagaauaucauuucuuuuuauuguccacucuuugauuuugauaaggcagaggauuuuaaaaaauauuuaugaaaguuuguacuuacguacuuaaaauauuuuuaguguugauauagucucuagagcugaauuuauaaccggauacuuagaaaagugccucguuuguaaugaaaacauugugcucuaaacuuuuuuuuggucaggguacaaucaaaucuuuuguucauuaauuaaugaacaauuuauaugaagaagcugcuuauaaauguauucugucaguuugcaugagaauuggaaauugagcuuuuagaagaguacuucuccuuauaaccaucuaguccuguauugcuaaaacauacauacagccaacuucaauaaccuauuuaagguacaauugaaugauaggcauuagaagaaacugaaauaucagguggauugugaauucaaauaucuuuuagugcugaacaaaagagcaaauuaagucuaaaaaggacacagguugaggacuguaacaucuaaaacaggguagguaccuacagagagaucgugaauugaaagagaaaugaaagggaaagucuuuaaaccugcauggccuggucguagggagaagaggccauugaaccuuauuguagauggaccaaagacauuaacaguaucuagauggaacacugugugacucaagggagcuagguuaguucauauuaaaaacccaagugcuuucagaaaguuagcuucuagugcauguauguguagauaucagguaccaauuuacaaugucugauaacuaacccugcuuggaggggccucaaccaugccagucauccuugaucacauguaagucucuuaggagauguuguucagcaguucagauggucagauuagauuguuaauaagugagugaucggguuacaucccuucugucucuagaauuuucaugcaacugaaaaguuauauauacaagauaaauguguuaacugcuaucuaggggcacacguuaggagcacaguuucuaagcauggauuuuacucuuagaaacuuacacuccauuuaugaagcuuucuaagaauucaguuuauaaugugaacuggugagauuuuuuuugagcauuuuuuaaaaacuuuuuauugguucuuuuguccauacuucuuugcuugcaaauguucauuggggagaggcuucuggcuucugcuggucuugucaauacuggaacuucacugggacauccuguuguugcccugugucauggggaucuuguggcuuuggcucuguaggacuggcuccuucaugcgcuccagcugugccuccaugggguggguguugggguacaccaauucagagcccuggguuuggccugagagguaucuggucagcccgccagcuccugcucuccugccccccaggccuguuggagaggugauuuguuaagcgcuuguggggaacugaaaggcauuucauguguguuccaguguucuggaauggaauuguacuuuuccaaguguagaauuuucauguaaacauuuuuacuguuuuaugucugguuucaaaauaaaguuucaauuuacucucuugucaccauugaaauaaaaagauugcuuucauuuuaaaaaagggaagaagcuaaaauuaacaaauuaaaggaaaaagccaagagacugggaaaagauaguuauaaacuuuuaaauaaaagccacccaaagugauuuucuuaauaaucuuuguguugccauauuuuacuuuugcaaauacuucccuuugaacaguguuuggcuggugucuucuuagcaucauugugaacaaguuagguaaaccuaagcagcagcaacagaauugcuuuucuccuuuggugauccaguguccucuggaaaacuuaagucuguacucacacucaccuuguacucccuuugcguuuaaagacuuaacauaccacauuugugaaugugcuuucuuuucucuacccuuuguugugaaauacuuugauauaaaauauauauuucaaaugucuucagaccuuuacuaacaucagaccuugaacaguaggugugggcacuguuuacugaaaagagugagaaauaagauguuuugggauagaugcugaucuugucuccuccucuguuuucaggccauccgcugcacauugguaaacugcacgugugaguguuuccagccugggaagauuaaccugcggacgugugaucaguguaaacauggcuggguggcacauggugaggaaaucgaggcuccucuuucuguucuugcuauguuccugggugugugaaugugugugugugugugugugugugugugcacgugagagagagacagagagagggagagaguuuuuuuuuagaguagucaugucauugaccuggagaagagagcggucaucggugcuacaaguauuccuuaacauucauccugcagcucucaaacagcauauucuccucuccaggaaggaaggcugggcaggcaaaagggccagauguuuauagaauaguugggcaguaagguucauacugagcacagcagcagccagcaggaaccaggucugauggaaacucaaacauaccacaguuggccuuucagggccuggaccucagagggaagcuggcagaucuucuuugcuugagaacuccucagugacugcaugccccuguugugugugcugaguuuauccuuccagauguuaaacuuuguuugguuuaaggagggcgagcaaguggcugguaucugggagaguaaccuguaaauacccccuuucagugugcauggggauuagaggaggcccuugaucuuaaagccuccacgcucuguuggugucacuggagggaggguggcccaagcacugauccuaaggaugcagauuuccugccagguacaaagcgcuguucauggauguggcuuuacugcauauuacgcauaguauugugugugguucauguuuauuguguuuaagaaaaaggagacaugcaaauaagcagacauauucuccuuguagacuguguaauuuuaaaagauagguaauguuuguagaagaaaacccuggcuuguguuuuugacagccucggguauuggcucuuaagugggcauacucuucauucccaagcagugccaaacauccaguggguuguauuuuuucuaaaugucauguuauucuaggaagaucugagguaacaccaccaggccaugucuugaaaugcuuuuaauuuaucauguaccucgcuugcuugggcaugugucuuggagcuguagggacgucucagccauguuuccaugagagagacaguagcaucagggaaagacacuggaaggagugugcuuggugacacaaccguuccuguaaccaguccuucaaggauagaacuuuuccugccuucauuaacaaggugauuugaugucuuaaacaacagcaguuuauguucuuguagcucuggaacauugaugcuagaguuuuauucugagggcuuuuagguauuuagauggcuuuccugaugccaucuuugugucuguaucuucugauauuccugagccaacuccucuuacaaggacacugggcagacuugacuuugagggccacccuaagggucuuaucuugaguuagucacaucuuuuagggucacaugucuaaaugcagucucauucucagauaccaagauguggcucuagucuaugaauuugggggggagggcaguucaguucaugacacuuuacaaacaugccauuuuauuuccuagaggaaauuuuuauguguauguacauggguuaugugggugggugaguguuuguggauguuuguggauguguguuugguuugugcacgugugcaagagucagugcuaugggaaugcacugcuguagcuuacugaaaguucaugugugcuucaguagacuugcaccaccaugcauaccuagaaggauuaauuuugcuagaaaauaacuagauauuuuaugucccuuacccguuacaugaggucauuggaggcagugugguguagacucuucuaaggaaaaaaauggcucucucauuuaaugauguguuauucaacaugacccuguuuucuuacaaauuaugauuacuaaugguacugauuuagugcuggacgacguauagcucaguguuagaguguauauuuaagcauuuguuaggcuccgaguucugucagaagauacuguguaaucuuacagugaaaagguagugauaauaugaaggcuuuaauaaauauucuaugugaaaaauaauguauggacagccguugagcauaaagagggguuaauaauuaaacaaagagcuuuucuuuccuuccagagccuucuuguauuagcaucaucugucuacugugggaaccuuaggagauggauaguugaccgugucacuaggauuuguuuuauauaucugcuuccaugugcauauuacauuaguuagggaguagaacacaaaugcuguuuugauuccuuccugaaaaacauguuuuaguccuggccagggaggguuuuuuugagacuuuuugaaggaugugaguuuuaacucucuugaauaagguguuucuauuacaguaaacuuugcuuucuccauuguauuauuccagguucuuuuucugagauauuaauuuuggccuuucucauaucuaaguaaaauuaauucuaguaguuucccucacuauuaucaucuugaccuuuauucuaccucauaguacggacauacuuguacauagugugaaauauauacaugggguuugcaaagccuacccuucucccuucauuagggcaaguaugacagggagggcuggcucuuggccuuugaguuggcagugggaugagagcacccacucauuuugccccuagcauuuccacuaauugcuucauucccucccccugcacagaaacccugaaaucaugucuccaauuauuucugcucagagguaagacauaccagucuuccuggccaccuuacccauguaguguccuccguaugggacuaggaggaaaugacuuggccuuucuagugugugauuuccuuccaaaaggaugugagacagaaaagacacuaccacacaguacuaucucaugguagcaucaaguacauacuacuugucacuguguaugcacacaugcacaugaguccacacucgcccgugcgcgcgugcgcgcacacacacacacacacacacacucuuucacacacacacacacaagcacacgaauacguguugcuuaugaauaaacauguaccuaauucacaccuucuccuuuaaaaguaaaaaaaaaaaauuagaaaacuuuuggucucuuuugagugucuucuuacaucccuuuuguuuuaaauuucuaaaguguugagucauuauauaauguguauauaccccuguguacaaauacacagacucagcacacauaugugcaugucucuguauguacacaaauuuauagccuuauagauugcuucuuaagcuuacuugaauugaucacaguaguugccuucaagaaaccuuggagagauguuuucaaauacuugaagagguauuaauucauccucuuacaaaaccuggguguugaacuaacucagggggcagcauuauuccuuaugaguugauucccugaaaucuugagcacuacggagcuuggauggggacacacagaacggucauuggauaccagcaggauuuccuacagaggaaaaaguucauaaaugauuuccuuuuuuccccauuuaaagaauguuagcuuuuuuugccaaucaaaugcaaagauuguugaauuuaaauuuguaaaaacaaaacuuguuauuuuggcaugggauagccaccugauguauguaauaaguuaguugaugagcucagggcuuccaguccucucuuguucuguucagagucuuuauaaaagaauuuaguguccuucuacccaauccacuuuccuccugucucccuagcuaguguauucucuguguuuaccuuuccuccauuugccuaagaugaucucagugagguuuggaguuggcuucuccuacaaggccagcccugcuggugcaagaguguagauaagauccaagaagugaccacuaguggggccugucuccugagagacauuuuuguugcuagaaauucaguuuaugguuugauucuuucuucugacacuacauguuuuaauucaacuacuuguagaugugagucuucagucaaagauuuggcauaaucuuaaaaaauagccaguauuaccagaguauuagacuacacagugcugagugaagguggguggcuaggauggggguccauguucaccuguucccucucugaaggcuguccggagaccuguugccaccaggagauguugccuuugugaaagaggcagggcauuuauuuuauuauuauuauuuguaaauuaauuuuuguguccauaguccagaugaagacuugauuuuuaaacuuuuuaaaugagaggguaaaguuaugcaaguaaaaauauaagcuaaauucuaauuuuuuuuaaggaaauauuucauuagaagucaagacuauugagaaaucguuuucuugcagugguauauccaucuguuucauagcuuaugauauguaggccaguguuagaaauguaacuuauuuguuuuucccuuuguggaacuaguaguaauuucauguucugaugaagcuuaguuguuaaaacugucuccauuuuaacuuucccaaagcugaaucaguucuguguuccugagcuugauagauguguuagagggacauuuggauggaacaggagacucgauccguauaacacucagcuuacugaccuucacagcaggacgugggaggacaguuauuuuccuuauagacugcuuuagccuuaaggaaggaaguaccugccaccaagcuagugaaugcuaaaguugucauuggcuuccaggugaucugcaggaagaugagugucauuccuuuggccgaugccacccuguaagaaagacugcuguuacgcuggggcuuugggagcuuuucuucaguauguucuauaagugugauuuccuuuccuugcuugcaguuauuuagggaaauauaaucccacauuguuacuugacuuagugcuucaucaaaccugauuuuuuuuccauacccauguuuuaucuauaccucuuagcucuuucaguguaaaaauaaacagguuugcaucaucuggacuauccaucacuuaauagcauauuaaacauauauacgacauaaagcauuuucccguggacuuuggauccugugacacaugaaaugcaaggacaguagaguuaaguuagagucauuuaccauccuacuuuaugauuuacuaugcugcgagccuuauugcuuauauaggucacuguuuacagcauuucuuguaaagauuuaauuuuaaaagaauaugugugugcauacaucucacacacacacacacacacacacacacacacuauugcaguuggaguggaagacuaugaguuccggugcuuguggaagccaaaacaggacacuggaucuccccaaguuggaauuacaggcaguuaugagccuuccuacgugggagcugggaaugaaacuuggguccucugcaagaguaguguguguaguuaccugcugauccaccucuccagcccuacuucuaaaucuuguauaaucagcagaaagugauuuuuguucucagucucauuaaguuugcauucuccccuuuuacuuaauaggucuucguagacuagaggcccuuacuuaaauggaaaguauaaaauauccaccaaaaaaaaguuguaguuuuuuuuaauguaaguguacaucacauagauguugcuggauuuccuguuuuuauuuacuaaacucauaaaugucaauuaaguuucuauuaagacucaguauguaaaaugaaauuuuaaccuaggauccaaggcauucuauaaucaaaacucuugguuauguuugucuuacauuuugaaucaggcgcucuuggaauucuguuuacaaauuccacaaguuuauuguagacauggugccuuauaaagacuugaacaggacagaucaaagucaauacuuccauaugagaggucaaaugucuuuauuauuugucucagucuguguuaagcuuacaauuuauguaaauaucuaugaaaggaguuugccaucagccccuaccuaucuugugucuccguagcuguggcucaucuuccucagccaguuuucuucuucacauuggaaagucucccauccucagcaauaaaaugucugaagugucugugcucuccuguucauucugagagacuugacagcacugucuggaaucauguauagacuucccaggauacauagcacacugagaagaaaaccggacuuuccuuuguuacaggaagauaauguucucacauauucacccacagcacagcucuggccuuacucuaacugacauggagaaggucugucagcaauuguacuuuggaagaacauuuuuagcagguguuuaggacuuggugaacuguaacagcacacuacuaggcugggugcuucuuagcauagugcagugaugauagucugaccaaagguggaagguuggccauuuaagaaaaugcuucuagauuguuacaguguuccagaaccuggcugugccuagccucagauccuuuccuuagaggaaccagcuuuugcugucccggcauucuguucugcugucuccaugaggaaaguccuugaacauuucuguacuugcuucacuugagugaaaacaaagccauuuccugccuggcacaggagacuguugcuugaccugggggcacagugcccucuccugccucucuccucuccucccugauuggagcugauaagccauaaagggaggacauccugauguaaaggccugugcuugauuaauggcucuggcugcucucucaucgcaucccucagcugcggguucccuugcuuucucagccuacccaccuucugcauguugcuuuaaacuccuucaauuuucuuuuagcaucguucaaacagugccuccuuuucaaaguccugggccaucugccugcuagcuucucagauauguugucacgugaugcaggaugaguguugcaagaucuuguguccuaaguacugucagugcugauuuacuggucaggggcuuccugggugaaacugacguuuucagaacucucuuucucagacugugacaaagcucuacaucaguuaaagggaggaugcuagagagagaguuaaagggacagcuguugaauaaggagcuugcagcuuguucuagcucugacuguuggaaccauuuccagguuauuuaauuaaguuuuucucauuuuuuuuuucugugaagauaucuauaugauuuguacauaguaaaagccuggugaaguguuaguuguuuuaauuacugaaucaaaauaacagauauaucaaaguugacuaguuaaaagauagcuguaggcagacuaauguauuuccuguguucugguucuuuuaugugcaaauucaaauaauaauaggaaugcgccuaaauaucacaguggcuugaaggaagauaaaaugaguggggaguuacccuaauguucuggcauaagcauuuuagcucaaauccuauguagucaaugcgguaauucuaaacaugaacagucaugagacugucuaagaguuuuagcccuugggagguagaggcaggagaaucagccauucauggucauucucagcuucauggugaguuugagcacagccuggaauacuugagaccccaucucagagacaaaaacagagucuuucaaagugcaguguggaagggggugugcuucagaguggaguuuuguaccgguuuaucuuggcugugaggcccagagcucuucaggggcagucuccucguccaagaacucuagggcagcugugugggccucauuugaacagaagcagagacaaaguuacuccagacaacuuuaucccagaccacugugaagucucacuagagcuucccgguuuuugagaaguagagagcagugcauuauguguugaaaaccaaagagauuaaacugaggaagagcugcccuugcuuaucuucacaccucuccuucugcgugugaauacuuugauaggcucacuacuuuaucauuuuauugcauuuuauuacaucauaaauuuuuauaucuugcuaacgauccuacaggaagcuuaauuguuuauaggaacaucuuaauuaacuagaguucaccauguuaagcggaacacaaauugaaggggugauaaaugaaacacccuccguuccucuccuuuuaucggaugcacuauucacauaaacuagcaucuucccccagguuguaaggacugguuccuaagcauucugugcugaugcuccccaccauucucucucuacuggaccauaauggcugacuuccuccaaccucccucuacuccucuauggaacugugaucagagaagaguacucucacagagaauucugaccuguaugcuguaugcugaggguccugaaauacuguuuuugcaucccauucuuuccuaaguacuugccuucuucagaucaucccaaagcagauuacugugugcuagaaagugaauccccgagcagaugauaugauaagcgggggggggggggggggguggguguuguugcugguaagagguccaguagcucucucauggucuccuuuuuggcucucuaguagaaauggaauccccacguugaccuuucggcuuuccugacuuguugaugaugaauuggugacgguaaacauggggucucaaaccugucuaccuuaaaggacaguuuaucuggccuucgauuuaguaggccaacaagugugaaggcaauucuaggccuggcuguugaagaaaaacacuucuuuugagcccuugaaauaaggcaaguucaagcucagaugugcuguaaguguaaaccagauuuuggagagccugucuuaaaaaaaacuagguuguaaaauuaucaguaagaaguauucugucuaguuacauaccagcaucucuguuagaucuaagaaaaauuucuaaaguuguaucauguuugcuuuuuuuacuuuccucagugaaaauugaaaaacuuuuaaaaaguauguugaggccuggggcuguaguucagcugguacuggucuugcuugcccugcacaaaguacuagauuccccaacaccacauaaagcagggcaagucuacaauuccugugcucaggagguagaagcuggaggaucgauuguucaaggucauccuuccucucauaguuaguucaaggccaaacucuagaauccucuuucuauagccaugcugugauaggcuaucugugcauaacauaaacuuagauaacccagucuuagguugaaaauggauuacuagcagagugguuagaacugaucggacaaccagaaagccucaguucaggcucuagucucucuuuggucacugugaagucucccuagagcuucccauuguagcauuuccacaguaugggacuuguguggccuuuccugugguacccuguucaugccugaggagcaauuccccacugagugucuccuacaggaggcaagucucccugugaagccacccuccuacugugccagggagccaggaggggacacuucaucuuuaugaugcucugguaucagaagcccuagcuucuguguguuaugugagacagugguuuauggaaauuuauuuuucuguaagucucugaucucugguugccugcgucuuuagcagaagccccuugcuguggccugcaaggcugcaggguccuuaucugaauucccauuuuuuaauucguuucucuuuugagucuucacucugauuuuucuuuuaauuuuucucugaaucuuuagacaacaaaguaagugagagcgguauagaagguuuuauagcuccacuaccuaggaaguacauuuuaaagacauuaacuuugcucgaucauuaacagauguugguccuuuuguucuauuuagaaguuguagucuagagucaaauaacuauuugaguugguaguucuuucagacuccuuuuccugcaguaauaugagaguaagacauucuugcuucccuccuuggcugaugaugcuuuuuacuaucaguaaaaauuaaaaaacaaaucaaguucuaacauaaaagaaaacaccuguuuggcuuggagaacuuggcuagggagagccuuuuucugacaugccaaacgcgaccaucacagggccccugaaaaggggucuuuuuuuuuuuuucugucucuauuucaugugagcauuggcagaaacucugacaagcaguucuucauauuuuauuacguucuugucugcagaaucucugucaggcaaaaaccuugucagcggaaaaccugucguaggaucagaggagacaaaaacaggugucacacaggcagucaaaacugaaggaaaaaaaagauuaggcuaaagagaaagaggcagacaauuacauuaaugccauugcuuuuaucuuauagauguguguuauuaucucggggugcugagugcgcaauugccucacagaaauguagacaggagacaaggggaaacuugauaguuauuaacugaagaggcagugugucaaagcuggaugggguucaaaguuuuacagaaggaaaaaaaaaaacgcaggcagcaagcaacggcugugugguucugcuuucggcuacguaaacuuaguagcaaucuaacauuuucuacuuggaaaaagaucauagaaaaauuaaugaaagaugugauauggaagcuuuggggguaacauuuauucucuauacuugcgacucagucucagaaccuuuucugucucauaaaaucuuuccacaaugagauacaaugugaggcaugaagacaggcauuugucaguucagcuguguuguuuggauauguuuaaaacaccuauuaucaacacacuuuuaauuaaaaaaagcuauuaagaagcccuuuuacuaagugugaacaucuguacgugcaagcuguaaauuagaagaucacauaugugugccucagucagagacuaaaugaauuuggcaaguguuuucuauuacugggauuuuaaacacagucauaucuaaaggaaauaacaaaugcuacauuucucaauuugcauugauuuuuuuuuauugugucuguugguacugauuaauagaacuuuucuaauuaggaauuagagugguuaucaugaucagauuaguaaacagaacucagaacaacaaccaauagcccuuuugcuucuuuguuacucuuauucuucaaaacuugccuccuaaaaucugaaacccuggugauguaucuugcaguuucacuuugccaguugcuuaaacccugaaagguuuuaagcuuuauugauaacucacccugucaggcagcccacaaauggagggcagggcagcagcagucaguuuuccugcccgguuaguuauauauugguuguuuuaaugaaacaucaaccgagacauuguucuggcuguugggaauuuuuuuggucauguauuuaauacuugguuaguuuagauuuuugcuaagcccuaagacuuccuucuuagcccucuuuaugagcaaaucuuuauauuggggcaaagccauuugauacugauauguucauuacacaaauccagcaauccagaagaaaacaaacguuagugucagaagugucugugggaggagcccagaguuugaaggaauuaaauguaggagaaaacugaaagauuaaggauagcuucagaauaagauuucagaccgacugacugggggaaaauaaaaaacaaaacaaaaacaaacaaugacauaaagcugaugcauauguuuuuaaaaacugaagaaguuagaauaggauaauuucucuuuagguguuugcuacgagacacuggccuacaauaccacugcuuucauucagucuugaaauguuuccuuaauguaucugucaaaguuuuaaagcaugcgcugcguuucaguaucuccuuuguggaaauguauagauacaugcuacuuuaaggaaacuaagucuauaaagcagauagcuugcuuauacaagaauucaauuuuuuaguuuuuaauaagaagauauguagcucacucaagcaacuuuuaaauuuucaugguacauuuuaauggguuauguuuuauagccggcauacauuuaauucauugauacaaaaacugaauggaguaggguguauguagccaacuuuaggcuagucuuggcaacucagcguuggauagaaccacaguaguggaaauaaaccuguaaaccugguuucaguaaggaaauguaauuaccaaaucucuuccuacagcuacugucaagucugcagauuaauuuuucucuucucuuaagcaccccagaggagagcuccuucauagaagcaaaucugugccccuagacuugggccauguggggaacaagggaagcggcauugcgcccgccugccugccugccugccugccugccugccugccugccaggagcaugagcuucugaaccuccacacaaugacagccuacuuuuaugggugcugcagucagacauuaauaauucccaacaucaguucugaagacuuuauuaugcauaaggccacaggggagaaaugccaaucagcuuggaauauuagccgcauggucuccagcgcugcucagagucuccugcagacuaauuguggguguuucuagguauguguucccauauucugagagcugaaugccaaccaaagccgauuaaauacacuggcugguggggcuuauuagaacuacuuugucuaacaucccucccugcaguguagagccauauuuguaucguauuaagggaauauuuauagacuauucuucacccauuaaggggucauugaggugcaguauauaaggugguguguguaauaaggguuuguggagucuugauagagucuuuaaaucuaaaaccaccaacacuaucuguccaagaaaggaaggaaacccguuauaccucugggugaaguugucaucacgggacugggagaucagcucuuucaaagaccuaucgcuuucuuucuucuuuccucucaaauaauuucaacaaguaagccuucucucuccuuugcaucaacucaccuaauuaauucaacuuugacaagaacagagagaaguugugacuuaaguagaacaggaguuauuuuguaccuaauuugcucccaauuacauaauucuuuaaccuaaaagcagugaaugaaauccgcagaucuaaauauuauucaagucauaaggaguuuccucuuaaucacaauuauuucugucuuaugaucuccugauucacuaaaaaguuucuaaugugccaucauugcgccuuauuaauguccucccuuaguggggaagcuuguauuaggaucgggcuugcagucuaugaggagguuaagucuuugcauugagcucugauggucuuuucuaguaaaagaacugagucucauaauggcaaaggauugauguuauaaugauuccaaagggcccuuuuaugaugaaauucuaaauaugugaaaucccauuaaaccuguagaaguucaugggcuagcuccauugaaaugacauaucguuauauuggguauagugugcuuauuauaaagugugacauaauaggaaauuauuggucauauuagcagggaugaagagcaauucacccccauaaauucagaagcuacagccuagacauuugagguagaagcaauaacaauauucuauuuauaaguaaucagaaccuuaaaaucugaccucaaauauuucacuaacaaaauucuguuacuaaaaacuugauuuuagaaguuuaacauucaucauggagaaguucuauauucuuuuaaauucaagcacauguguuaaguauuaaaucuguuaaaaauuagccuaguauacccagcccaaauguucuaaaagcugaccacuuggcauuacuauaauuuggguuccuaguggcaguugagaauagacaugaacuucuccaacuagccuuacaauuuaaagcucacuuggcauucuacuguuuaaagaaugagguuuucuuuauaacuuauaaaauuguuucaaauagacauuuuaaaacauuaaaauauccaaggcaaaacuaaaaugaauggaguaauauuuacauacuguucauauuaauuucuaauuguuugauacugcaaagugggugguuuucaaaaaucacuuuccacuuuucccacuccuuauuucagugaauaaauaaaugcaaugucugugagcuccacacugcugugcuugcccaacuguuagaugggauccacugggcaugugccuauagcuagcauauuccuccacgaaucaccaauguaacuugaauuugacuuuuaaagaaagucauguuuuuaagaagcugugggaaacuaagaguuauaaacugacauugagagccaguugucuaaggucagugaaaagcacuuuucuacuccuacauuaaggaaaaaaaagaauaugaguauguucugauuucgguaaccuucacagaaauuuuggaaguggagucuucagaauuauaaguuuaaaacuauuuuaauuuauuugaagcuucuggaguaauucuuguuacuuaaaauugaaaaugaaauagauacuaucaucaucaucauuauuauuauaauuauuuuuagauaauaccucaccauagauauagucaaaaguauauguuauuauauauuuauuauauauucugugucacuaacuuacauugagaucucauuaacgaucuacaaaaauucuaucuguuaucuuggcuacgauucuguucuucacauccauaaauguuccuucuccauauauaugcucuucuguuuuacugauuaaccauaacuuuuuuccauaucuaaaaaaauguuggaagugauagaaaaggcaguaaguaaucuuggaauuccugucaagauaguacccuacuguagccuuuaaauuguagugaucccacaaucucauuauucuguggagggaugaagaguagggggaggggguugaggaaagggucugggucagaccccaugagaauguugagcccucagacuaucaccaguucagugcaaggcgucuaacuguguuuccuauguuaacuggugauccguucagcaguacguguuacaugucagguauuguuacugcuucacauaaaaguguuaugaccucugagagugcagcauauggcugguauggaagaaagaaaguguucaugagaaagaagaacauaauuuaagggcagcuuugacauuauaaaucugaaaaaugaagccaugcaaauggaaucuugcuuguaccugcagcuucucaggauuugguuucuuucacgccccagcugaggugguuuugcuugauccccacaauuccccuguaaauuauguugggaugauaaauguguguuugcaauuuuauguuuauuuguauguuugauuguuuuguuuguuugggguuugaggggaguuagguucaagaaggauuuucucuguagcccuggcuauccugaaacuuggcuuugaagaucaugguggccuugaacucuaccugccucugccuagugagugugcugggauuaaaggugugaacuaccauccccaacuaucuguuuauuugcauauuuugaagacuuuuucuguccuuuauuaaccagaagucggucugaaucaucucuguuuugucuuaaaaacuuaacaugggccugggaacacccauuuagugacuagauguuaaagcucugggaaaucagcgagaacacacuuugguuaaaacaggagcuucaugucaaagaauuacuaugcuaaagagaaaaacaacuccaaucaaggucauuugacucuauuuaauguauacauaugcaucauguguguguguguguguguguguguguguguguguguguagguguguagggggugugcauggcacauauauacccaugcaugaguguguauugugguaaagcgaugaguuguaugaaaaggcugggagaguaauagaaaccuuucagagacauaucacgucucucgggaaagugacuuggcucuacuguacuagacaagguuaagagaaacaccaaaaccuagucaaaaccauugccgcagugagggcaugagggucuaagcaccuguuuugaagugguaggaguuagguuagaaaggaggaauugauccaagacaaacugcaaugggacuaauaagcgauugauuaugcaagagagcaagaaguaauuagagcugguuuuguauguucuugcgagauaauguuaagagaggaaaacaguuucaacaggacagaaucugguaucugcaauuauuaucucagcuguauaaaaccacccagugaaagaugaggcugacacaaguccuugcuuugcuuagugggaugauagauaauuuuauuguuuuucuuucuuuuuuaauuuacauccuuuaaaagaggagcaucccugagagaaaaauagcacauucaaauaaguuggcuuugaaagaugguggccacauaucccaguccuaucugagccauacaggucagcuauguguuuauauuuuaagaguauugagcgggguguccaggauugugcaagaguagcuggauuccuaggggcagauuaacacaugagaguagcaugaaaggcuacuucccuggaaaccugaugcuuucuuugccucuagguagauuuccccugcagaucagaaugucccagucaucuguacuucugcuucaucuuugcacuaaacaucuuccuacccugcuucucagcuugauccucuuucuguccuuuccacucagaguuaagguagcacucugcucuucaagccgccagagugguauaccugaaaaaacgaugagacccgagagcagucuugacauugccauacgccuugccacuguuaucagugauaacagugauggugauguagcuggucuuucgacucucuccugaauacggaaagcagcggcuacugucuacacucuaaagcacagcuucaaggcaauguucugaacuuuaaucuuugguuccagcugucuuuccccagauagcauuaccauaaaaguucaucgcaagacucuuaucauucaaccuaucauguggguacaguaaaauuaagaacauacaccuauaaauguaaaaucuuauuuuuuaauguuuuagucauuaauguagauaaaaucaaaaugauaugaauauuaauguucaugauuuauuaacuaaagaguggauuaucugucagggaaguagaugaaacuguagguuguuucuucacagauuauccauuaauaaauagugcuuagaagaaaaaaauguuaccugcuguuucugugauguuuucuacuguuaucaauguaacucuuaaaacaccuggcauugguucacuguucuggauauaugauggucacaacuguuaauauguuuauaaugagaggagguguaugcugcuaaaaaaauuaacauuuggguuguuauuauuuuuguuuguucauuuauuuauauuuauuuauuuucaugccauuuacuaauaggcuaaauacagucauuagucucuagucucuaaaagaacauacuguaaacuucauaagauuaaauaagcucugaauaguaaucauugaaaucaaucugggguguguuugugugauguguguguguguauguaugugugcacacgcgcgcgugugaacgccagagguugugaaauagguauuuuaugucauuugauugcauaggcgauaacuaccuuauugagugguaaucacaguuucugaaagaaauuaugugaaaauuaugucuacagauuuuauccaguguguuuugaaaaucauaauuaagcuggauuuagagaguaaacaccacuuauguguuaggggcuuuucuguacuccuaaaggccuguucuaagaauaagcaagccuugaggauaguaagaacuuagccuaauacucagcaagucuggagucacuucucauuacuggacacucuucaguguagacuugugagaaucgccugacauuaguccucagacuuaaccugcuccugugugccucccaaggcugugcgugcagcuccauggcuggccuugucuuaguuccuuuagcuccuguuauucccagaagcuguguaucaugccucccaugcuaaaagcacacaaacaaacagcccugcugcuuuaauuaaacuucuaugcuuucaucauuuuuaauauauaaaaguaaaaauuuccaguuuguagagcauuuaauguuuucuguguccuguuaacagaaacaucgaccacaaaauuuaggaacauuccauagacuuugcuuuuuaggauaaaagcuccuuacaguccucucacuugaccuuuuagaacuaucugcacccuuuugccucugugguuacucaggucucucacacucuuuuggggguggagugggggcuggaguagacuccuggccagcaacaucagcaucuugugaaaacuugauagaaaugcagaguccuggucacacugaauaagagagucuaggagaacuggccccauucucugggcugacaggccccuuacaugguucccgugcacaccaugaccgagaaccucugccuugacuccaucuuccuguguuacucaccugcuagcauccuaagucacuuagacgacccugccucguucuuucuccucugugccacagaacaccaaucaagucccguguagcauuuacagcuccggcauuucucugucuuugaaggcagaggcuacaacauaaauuacuuuucaucuacauagagcaccuucucagggaucuguuaauaagugcugaugagcaugugaaccugugcauggaugaaggacagcauuuuaggaggagucuugaucaauaaggucagcugcaguagagagaucacggagaauaaugaaugaaaaaucuauuggauuucacaguacggcagguguuggugaccuuugaaaugcuugcuucagcagagugaugggcagaaagcccagauugcuggaaguuaggggcguccaacaugauaaggacuuacacacuucuuauugacuguuuaucugaacauuuagaagcagaguuuuccugggugaaguuacugaauggcuccuuuugguugauaaccaaauuccauugagccugugaucuuaggagauaugaucacuguaacaugauguauuucuaauuuuaaaaugaaaugaaaugaucccuagaaugacacaggacauucaguaagugcuuaaauggccguuucccuguuugcuugucuuuccuaugauuauuuuucuuuacuaauauuguugaagacaucacucugugcauuuauaaaaggugaacuucuuuagaacauuucucauuccagacauggcaguaauuaugaauuuuauuuggacuggggggggauauaccuuuaguugaaccaggcaguaaauuugaaauuacaugguaucuaccuggagguguuccccaaaauguaguugaaucagugaccggauuuccaaacaguaauugagauauggauuggaaacagaauuucugaccuuaauuuuaagauucuacuugagagacagagaaauagagauugagagaaaguaaguaauugauugauugaugauugauuauugaacucuugcagccaaaaguuuuaaggaugauacauucguggucucaagcguaucauuaauaccagcaagcggucuuuuacagagucugauauuguccaacucauucaacucauaugauucccauuuauuagcacuuuugccagccacaaauucaaagaaaaagaggauucccacuaguuguaacuaaaacccagaaucugaucuuacaauccaucauuccaccuuguuguggacagggacuaggacagacaggcuuguccuugauggccucccucacgacucugaccauucaggaguuaggccugaauccucccacaguuugacagaucuuggaauucagcagagcccggcucugggucacacauuuuaugucaguuaaaagacaagacaucuuaauuuuuauuucucuaaauguuaucaaaaauuauuaaccuagcuguugugugguuguguaaaacuuuuauaccagaauucaggagucagagacaggcagaucucagagcuggagaccagcuuggccuaacacagaagguuccaaggcggcuagggcuacuuaaacgcugucucugagcaaacucuuugaugacucccuacagacuggaacuguaaaacagacuucccugguagaguguagagccuauaccaggccagucauuaacauaggaugauuaccaucuaucuucgauguugcauucaggcugaaaucauggccucaagccacgcuguuuacguuccacauccucaccuauggcucaucucugacacucuugagagucuuuucuuuguggccuacuuggacuuuguuguuacuacuaacuuacucgcacuuacuaguacaaacauccucugcacuagggucugaagcuggcccuaugcguaucuguguaaauaaaguuuuacuggggcacacacacacacacacacccuuccauacucuaauguauaagugacuaauuguuaaauaaaaguugcagcuuacaaacuaguuacuaaauaucacguccuuguagaauacauugucgagcccuguuguacauaugcuuugucacacuguucuuacuucuuuauauaugacacguuuguauagaaugaucauagacuauugagauaguuacgucgguaaacgugcuugccgccaguccugauaaugaacuuagaccagucuucagggccuuccugguagaagaaaacuccuauuagccauauucugaccacuccaugagcauggugguagaugugcauacucacaaaaaaauaaauguuaaaaaaaaaaaaacuaauuaaauaagcaucaggaaacguccuuguaucuccugucuggguauaaaaggaguuuagagggaaauauuuugaauuagauauuuuacucaggcuuuuccgguuaccccccguccccucccaccuuuugcucacucagguucuuucucuuugaaaccaccagacucuuagcuucucaaugccucggaagaugggauagcacuuccugucggcuaccgagcacaucugaccaugagucugcauucacuuugcaggcaugcagacugccaaaccccaugcauccaauccaggauucgguguccuacuguuucucugugauccuuucagcugcucauuuguuguggucagagcgcuuguuugguggggcuuucagagggcugaggaagugaagaggaggcggagcagguuuccccucuccccaugucuaacucggggcuccagguggaucagcugcucaucucaaggcugcauagucagacugaguuugaagaacaagauaguaacaccccucuccugccuuccgcagccuaaaugcccuguggagugagagcugacuucaaucugcaagcuugugaaacccuuaucuuucccaaacguuaaauuaauuuuuaaagcuauuuauucagaguugacuuaaccaccagaauaggagagaucagacaaaucagcugcaagaaaugaaguauggggaaacccgaacucuuugacaaaguauuccugggaguaaauguguugaaugaagccagcggguaaaugauaagggccuuuacacuguggauguaagaaagcaauuuaucaagaguacaugaacucucugguggcuucaagucaggaagaaaugagaguggaggaggagcccuaaaaaauacauuagaaauacuaaaaaagaaaaaaaaaacccuccaugugcaugcucuuuugaaucucuccauuaguauguagaaguguugguauguuugaauugggguuguucagcuugucuuuaggcuguuggcaauacugcugugggguaaaguguuagggagaaagcauuuuauacaggcugcucaguagcuuagcgucugcaggaaccuuggguauucucagauauggccaugacuucaggcagaacauugucugaaccuauuugccugacuugggaggcuaaaugacuaucucccuggcuuacaguguuugcauuuucucucucuagggcauauguauauaguucugacaguuaauugcaacacccuuuccguccuuuugaggaguucugggagccuuuuuggaaccaucucuuaaauuuugcugaaucuccuaagccugguggcugagacuuauaucaccuucaucgacaguggagaagccugggccucauccuuugugcucuaagcuguuggguucccaguaauucagauauggauggggaauaaaccuuaugaucuuaucuuaaggcuuuuaguguuagaggagugaugcauuuuguagaggugaggagaagacaguucugaaaugugcaaaguauuuacuauaaaauugcccauccauccucggcuuucuccaggagauaauuccauuagcuaaaaucacagaaacucccuguuguagucauuuguuuuuaguuucaucugacacccuuggaagaacucugaacagaaguaacuaaguaacuuccaggcaucaagcuggugaagacaacaacaaucccacaggcaaacaggagagaacuugggagaacuaaaguuucaggaaaaucucccuuugauaauuugagugguaaucuucagcccuccacacaaagcgucaacuuuccucauucuuucugaauaagguuaugauugugguugucuuuguugaugacuuuucuguguagcccaggcugggcuugaauucucuuuaucagucccugagcacuaagauuacaaguacacagucuucaccucuccagguuugaaugaggccuuuuacccuaugauuuaaaagauguucuuccccuucuuucaaccgguuaggaaguccagggguguuagcagagucgaggguuuuucuguuuuaaaggugagucucucuacauagucaaugcuggccuaggacacauuccucuaccaguacugauauuauagguaugugccagcauaccuugcuuacaggguaauguagagccuguuuuuacagugugaauuuggguuucuguguuuguguagaagaauagaaggcacuaugauaacuugagcuagcguuuaauuagcaaaugaauuagucauguuuuuagaaaaagccacaaucacuaagaaaaaaauccuuagugacuuucuuucuauaagucaaauauuuuaucugacauugucugugauuuauaaauccuaagucauuaggaugccaagacaggacgugagagcucuugcuuaaauaucuauggucauaagcugucaaaauggagccuggacaauguccaauaaaguuucuaauuuuuuucuuguccuuucugucuguuuaucccacccuaucccugggacaucggcggaauggccacagccuuggauaaacucagcacacagcaccuguaccaccccacucaaguggagauugugcaguccaacgugguguuugacaucagcagccugaugcucuacgggacgcaggcagugccugugcggcuaaagauacugcuagaccggcucuucaguguccugaagcaagaggaagugcugcacauacuacauggcuugggcuggacccugagggacuauguccgaggauacauccuucagguaggaaaggauuugagcacugcaucugggccaacucuugguggguucaaugagaacuguggcuaccucugguuugcuucuuucucucacacagccagagagugugcucuccucagaucccagagauggaaagggagcgugcugucuguaggcuacugucaggccuuuggagcuuguaguugaagggaaaaguaguugguugaugagugcugcuuuauguacaccuuugaauucaacucuuucccuccaagugagcugucucauuucucucuguaagccuuacuaucuuugagaugaggaaugagcuuugaaaaucugacaugacucuccaucuggguucaugaagguauuucucaugcccaggagacaggguccccuugaaugcugugaacccucgagcuuuauuuuaucuucacccaaaccaagggaagaacuacaugaacucuaucucuguauaucaugggaaagcucaugcugucgcuucagagcuuggagcccuggaaaguguacaugugaauguagguuuggccguucuauauccuggagccccuccuuguaucagugucacugcuaaugugguggggcuucuggaauuaccugggaaauguauagccuccacccuaucaucaacauccugucucucauugccuuuuuggugcuaugccaugucauuuugccuuugauauuauuuuuuuauaucuuaucugucuuccuguaacuuugagagguaacuguugagaacaauauguugagagaccccaggauccaaaaucuggaugaugcaagacuauauugaaggaaaugucaguuggggaagguagaaucuuaagucuuuuuugaagguuccuauggagauauuuccagagcugaccucuuagaaagaaaaauguuuauggcugugccaguccuguggaguaccuuagauauaacugauauuuaugaucugaaccaugcccuguaaaauguaaauccucagcugccgaauacacauauuauacggagacucuacugaguggggaugcuccuguauccccauguuuuaaucugggaugaggacauacaaauccaugccauucuuuuacauggcucuucuacacaccagcggugacagaugguaugcuaccagcaguagcauagugaauaaaaguagaaaaagaagugcaaaggccugucucuuccaugaugggacaauucuuaguguaguacgagccucagccugagaaguaugaaaguuuuuucccucagaacaugaaccgagggugacaauaauuauaugcgucauuuuuaguucauauuacuuucuuuuuuguggcugugggaaaaccccaugaccaaggcagcuuucagaaggcuuuaucuuggcuuauaauaucagaggaugcacaucuugaaaggcagagacagcagguagaacacauggcagaagggaugaauagcugaauggucaagucuuaaacacaaacaugaaacagaaagagaacacaaacagaaauggcaggagucuuuaaacucuugaagccuaccucgaguggacauuccccaacagggccacacuuccaaaacuucccuagacagcacugccaacugcaccccacauguuuaaauggaugaacucguaggagacauucucuuaacaccacaguuuuaaguaguaugcuacaucuucucucacaugccucauguccuacuauuucagugagguaaguggguggaugagucauaagagccagggaauaugaagggaugcgugauccaggaugaagacaaggagggaccacuuuccccaucccugcuuagccuggcucccagaccuuuggaguaccagaucgcucuggagcacuugccacgugacuguuaacaucuuuuuuuuuuuggauuuuuuucccccuacaagaaagaaacaaaauaaaacuaaccaaccaaaaacccucucacaccggucucccuagaguuguuagcuuagcuguuuuccuuuauaccaaaccucucagauagcaucuucacugauuccacugugaugcuugcugcugccaucaauacuguguuucaacaccaugacuuccaacgaguagauaugugcauggcuacacugguuugccaucauaaacacucuguagugauuccugucacauguugauguuaauuaauugucuuaguuaggguuuuacugcugugaacagacaccaugaccaaggcaagucuuaugaaaaaaacaacauuuacuuggggcuggcuuacagguucagagguucaguccauuaucaucaaggugggagcauggcaguauccaggcaggcauggcgcaggaggagcugagaguucuaugucuucauccaaaggcugcuaguggaagacugacuuccaggcaacuagggugaggaucuuaugcccacacccacagugacauacccauuccaaccaggucacaccuauuccaacaaggccacaccuucagauggugccacuuucugguccaaggauauacaaaccaucacagggaccuauucuaaucuuucuggguccuuugggguugcuucagugcgggguguggaugcuuagagcugagcggagagcuuucuaguccuugccuccaccuuauccugagcuuccucccaugagacgaccagaaacuuuggauuaggcacggugccaagauugucaacuguuccuugauauaaagucaugagcuaaagucaggaccaugcuuugucccgagguccauaagacagcagcucaguaggugggcagccuggcagugcuguguaccaaggcccaugacacaccaacucagcaggugggcagccuggcaagauagaggugagaaaucccuuuggacaaagcuaaaugcucaugucacuuauugggguagcucuuugccauucuuucucuuccccuucccuuucccuuucgaagacuuaaaacuuuuuaaauauauaauuuaaaaucaugcacacacacaugugugccuaugugcauuuuaagcuuaggugucauggaagccauggauucuggcaucuggagucacagcugcccacugguccucuguaaaagcagugggugcugcuauugcucagucaucucuccauccccugacaggcuucucaagagucaucucugccugacagugucauccucucuguguccccuugccccgcuugcuccuccaaacuguuaauuuuacuugcugaugucuggcauucgaaauuccuguucacccacuuccucuguacuuuuccuuucuuguuaaaguauaacaaauacccuuaacuuagugacuguauuagucaggguucucuagagucacagaacuuacggauagucucuauauaguaaaauaauuuauugaugacuuacagucggcagcccaauucccaacaaugguucagucgcagcugugaauggaaguccaaggaucuagcaguuacucagucucacacagcaagcaggcgaaggagcaagagcuagacucccuucuucuaauguccuuauauugucuccagcagaagguguagcccagauuaaagcuguguuccaccacaccuuuaauccgagaugaccuugaacucagagauuuaaucuucuggaauccauagccacuauggcucaagaucuccauaccaagauccagaucagaaacuucuaucuccaagccuccagauaagggucacuggugagccuuccaauucuggauuguaguucauuccaaauauagucaaguugacaaccaggaauaaccacuacauuaauagacaacuuuaugacagugcuguuuuauacuguucugauuugaccagagauuucguaaaaauauaaaauaauuauuuagguauuaauuuucccaaaauuuuauuaugucucgacaggauaggaaauauccaucuuucaaauauauuguagauuucacuuuguaugagauaugauugcaagacaagugucuaaguagaagacagcaaaaagccucaaaccaauauauagaaauucucuuauugggaagggaaaugcuacauaaaaaugcuacauuauauugccauuuuaauauaauuauaguuaauuuucauuaauguaaauguggugaaauaucaaauuuuaaauuauuauuucuaggagucuagaauugauauuuucagaaaaauuauagauuuugcauacuagaagaacucucagcuuaguuucugucuucuuuuauugauagaauugauguaguauugauuuucuuuaaauggcacuuucugucguuuaacauuuaucguauacuuguucuguguaaaacaguucuagcguuagaauagaagcaaaagguugcagggcacaaacauuagagaauacuuucugagaaaauauucauuuuguaaaagacaaaagaaguugagcuaugaaaacauccccccuuuuaaagguuguucuugauuacugacuagucuuuagacuuaugugugguaaugauaagguaugcacaaaugacuuugaaaauaauuauauguaacauuuuuuuguacagguagacuauaaacuguucaucugagagccggggaagccuauaaugcaccauuaguguacaagucauuuuaucuggcuaaaacucaauugucuuguagcccucaaggcaucaauuuuagcauuauugcucucaacaacaguauauugaauauuaugucaguuaaaggagaguaauuaucaaggcaaguuaggguggcuguuagucuuaccacauauugacuugguuagcaguuggcuauagauuguguuaccgggcaaauaaagauguacgguaaguugaacuggucaagccaggauauuaaucuaagucccucugggcucaaaccuacauucuuuauguauauccagauacuucuaccuuuagcaagaguuuugaaaguggaagagaauaugucaccuguuuuucaaaacgggaguguaugguugcaggggaagaagaggucauccggaauucaagaaagcuaucauuuguauaugauguucagagaaaaguggacaugacagaaagccacacagucauugaaaagcuucggggaucuguuaaagagccuuucacuaggguggcauauguaagccagccaguugaguguaaaaugaauagcauaaauuggaccauaaccacguaagaaggugggccaucuccuaggcgugaaaaucccaguggucucuggcguaguugcuaaagucuucauucagaaaggaaagccggauugcuuuccagaaaaguaagauggaaauagucacuuaaaugcuaaaauauaaauucaaaggagccuauauuuucugcaaucaaagaauaauaauuauuauuacuucaggacauccucuagagacacauuuauucacaaucaauaaaaacaguggccugcacucuuaugccugcacucuugucccagucucauuuccuuucugucucugacuuaucaucauugaauguagucauuuaaaaauaaaauuuucacauagccucucuuuagcuggaacauguagcuaacaugccugggugcauguuccauccugccuuuggaaaacuccccacuuggaagcgaguccuuccagaauucuaagaaccaguucagucuuucugaguaauuagcagaaugucagcagccagggugucagaggcucagugaugcacacugcaaguaaccugggccacaugguucuagcacuucucaggccaucaucagucugagaagucuagcuuucaaagugggagaaaacacaggcuggaucccucucugagcauuucaagguacacauuagcauaauaaaagcucugaggacuuucugaggauauuaagggagucgacuugaaaacacagguaaguagcuuuccccaguccuugcuaaugccuaaccuuuuuugucaaguucauccaaauaguucaguucuggaacacacuuagcauaggauccucuuaggaaggauuucacugccugcaaaucccuacuguucugccuguguggguaauauuuugucuacaggaauaagaugaaauccaguuuuugccaguacuagcuaaaccaauagagcccuucuuuuucugguguuauuuuuauuucacaacuguucgcuucaggcucauaccacaguuuaaauacagucaguuguuaaaugccuuucuuaccauuauuguaaguacuacacauucacucaaugcauaucaauuacaaagaaacauucuuaaacuuagaccagcaugauauuuuacuacagaacucaugcaguagccagucauugcauuuggucagaggauccuuagcauuucuucugauuuuguaggaauagacaacaacagauacaagugugccuccgcaggucagaagaaggcaaggcucccaggcugccuagccaaaggccuaugcagaagaaacacauucugguauuugugugguaggaaaugucaauaccaaacaaacacauuuauauuaccccaugagaaguagauucacauguuuguuucugaaucccucuccaccccucuuguaguuacuuuuagagaauuaacacuugaugcauccaagucuguaugggcucuauggcuucucugugaucacaagaacuucaaaugggcacaguaguuguauaacaagguuccugaaguucacaaccacaaaucucucguuccccuuucagcacacaugcugaguugccagugcucugugugggaaggcagaucccuggcuuaaugucuuaucaggagugugaaauucagccuuugccuuuauuucacaugagucucucaccuguaaaacagcauaauaauagugccucacaacagcuuuguugugaaaauaaaagcguaugugaagggcuacucaguauagccaacaauaacugcuaauaugaugguggaagaugaugaucaauuauaaccuauugccuaccugcccacuuuaguucauaaaauagccuugaauucuggaacucuuucucuuuuuuuuuuuuuuuuuuuugagacaggguuuucaugucuagcccugacugucauagaaguugcucuguagacccagacuguccucaaacuuagagaucugccugccuuuaccucccaagugcugggauuaaaggcaugcaccaccaccaaccauagaauucugggauucuauauuucacuauuccccuagccauucacacacaaagauagcaacuucucuguuguaaauaaaucacaugcacaugaccacacacacacacacacacacacacacacaugcuuaggcauuugaacauauuugaauauaaaggagagcagaagagaauagugacagacacuggacucugcaguuggacaagcuugguguaaaccuuggugucaccuuugacagcuguuaccuaacacagauguaucauccaaauaucaguuucuucaucuauaaauccuguaauaaaaugaaauuauauuuaaauaucucacaccuuaacuagcccauggcauacuuuauuaauaacuauuauguuguguguguucacaugugugccuuugaaaggaacaauuuauucuguaggacacggcuuuuaccgcuuuuuuguaucccuguuucaucaacucuuccagucccuguggcagaauaagugaaacuuguuagaaaucauuagagcaggcuuuuguaugaaauaaaaguuacaggucagguugcagcucagcgauaaagcacuugccuagcccuugccuagcccuugccuagcauguacaaggccuugagguucgguuuccagcucuagaaaauaaaaugggcagauuuuaaaaugaguauuaacuagccccaccaauguuuuugggaauuccagaagcauaaagaagaaagcaccuaucuguaguucauuuaaguaaccuuuuaaucaguuaauugcuauguagaggccaccagcacaggucuuuccuaaagcccacgaggcagugagcaaggcagcccugaucagaugaugggaaggaaguuauuugaugaaaacuaagagaauugcaaaggacuuaaaggaggaaugauaugaucccagguagagauaggaugaucaccgugguucaugagaaaguuaucuuuguauccugucaccgaugugugaguuucucagagagggggaacacagcuuuagugagcaggagcccucucuuucuagcaagcacagguacaagauaggugauuuggggcaauaccccauguuucaauccuuugucuuuaucacagugccugagccaucuacaaacuuuauccuggcgauccuccuagccucccuauuaaagagauaguuugggagacuauuaucucucguuuuaaaguuagcguggcuaaaggccuuaggcaggcuuggagcuggaaguugaguacggggauuuugaauccccuggcaaagcucugacuauucgaacaguaaugaaaacaaaguccucagacauaacgaugcagcuugguguuuaguacuccgagcuaaaaugaagacgcucuuccucuugccuuuguaucacagagccagguaccucaccagauagcucaccagacucugaggcggaaugcagugaucaggaauagggccuguguguguggaacauagaaagggacuuaagaagcagaguugauccacuuuuccuugacgaguuacauuugauaaggaacaacucagguuuacuugaaggcauauucuuuguugucauugucauuguucauggacaccccguagaccaaacuggacuucaacucucaucucccagccuccgccucccuagugcugguauuacaggugugcacaccaccaccacaacagccugcauugcuuuuagauguuauuaaucaaacuguugucucuggaguaucacuccuauacauucuucauugaauuucaagcagacagcuccugaacugugggguuaaaccucaagccagcccccaauuaguuucuaacuaugccaaaaugaucuguucauaagucucauuuucuugguggcaaccuacuuugaaaaaaguuuuuaggaucaacagauguaguguuauaaauucauagcaaagcucaacaaauguacuuccauaggcaggccagucuuuagucccugacucuagcucuuagguuucgagaaccgcacaucucaugguucuacuuugccauacauuuuauuugugccauucuguccuuuuccuacguuuuccucaguuuggugaaggaauaggugcuuugacucacaggugggaggagguuuuuauaaccaggcucuacuguuuuacuaugccucucaucucuaacacugauuagugaaaugugaagggcugagagagguaggaaugagaggaggauguacagagucuucuagaagcucugacuaagcccauacagacgaggcaaacauagcuauagaugcauuuguuugauuuguguaugguauuggcacacguaaugcuggcagugauuggaagacacagugugugccaauccauuuacuaauagagucagagugaccccugccaagcagaaucagucuguggagaccuguugaaauaggcaauucuuaggaaaaagaaguguacugguacuccauggaaaggauggucugugggcuuggauuuugauaugucugaugcuuccguaucagcccuuccugcuuccucgcuuucuucuuuuccccccuaacuaccucuuucuaagggaugugauucuaauggcucacuaauccagaauuuguuuuuuauuuuuuauacccugggacuuuguaaauaauuaccuuaccacagugguccuguuaucaucuaggaaguguugguggcgauggaguggugugcuuacucuuguccacccgcccgcccucuggcacuuucucuuccuuugcaaagaggagacuuaagcuaguggacuaggaggguaggugacacagugauaaguauacauuacagcaauggaaugucuuguaugaugccaaaauagaaagcagagagcccacaagaggauggccacugcugggggugggggguguucacauccagaauccaucgucuguuuccugugugauucuuagggagagaaagaacccagaacagcauguuuguuugacucggagagccagagcuucuuucuguguuucuucauucuucuguacuuuucucucacgaaaccauaauaacagcgucggcggcagcuuucuaguuacuaugaguaaugugguuuuguauuuucuauuuuuauuuuaauauguuuccccuccuguggauuuuucuuguuuuguguuaaaaauuaguguuaagcaaaugcaguaauuuaaacugugguaugcucuguuuuuuuuucccccucaguacagcucugaaggaggacucuaucaacaauaagcauuucuguguccuuagagugggacauagaccgcuaacguauugcuccugaacauaguaacccauacuuuaaauaacagaauagucuuuguuuccagaguaccaguucauauuagaucuguuuauucauaguuuguugauaagacaugaaauuggcaagucagagaagcaccuuaaauugacucauuuauuugcuuguuuuuaaauauacagccacagucauaaguuuuaaaugaacaauaagauauguucagauuccucuugagaggguaauuaagagcuccuugucucagugcugucaucucugccagacucugaguucaugcugaguauguuccauugagucagccgucacucucucagcagugggauugcugucccacgcauugacaugugagggaaugucuaucucgcaguagccaugggccucugccagauuuggagaucugaagggccaggacugggagcuuuucaguucugaaucaaucacgguuccaauuucuaacagcagagacagggaggccaguugaaucuguggccaacacaaugguauuuuuuuaaauaaauaaauaaauuucucucccuuuccuaccuugggugcuugauuccuuuagaacaugaguaucucuguccauuaauccucuggugacuuucugcuggauucagagugugguuucuuaggugaaaagcguguuauucguucagcugcacagagauggagauuagccaaaagccgaucaggacauguggacggugccaggcccagggcaccugaaggaaguguauuucuuuccugccuagccuucacuuccucagccauagcacgaggaugcccugucugcugggagugggggagggcguucauuggcaguguacuagcugccacaaauccauggccauagggugcgugagagcccuugagagucaggcauaucaccucuguaacaucaccugauuuagugcuuuuccucgggucuucagugucucagggggcccuuuucccuugcagcacugaucuuucaaugaggugcuagugucugucccaggcaauaacaaggaaaaaccaugcagugugaacagcucuuauuaggggguaaaugccauuaacgcuuuuguagccuucucuaccgucugaaugcucuugucaagagcgugacucaccgaagccuuccucuaaaucauagaacagaguuucagaugcugaaguuuuacauuuuaauuaagcaaagccauuaucccccuuggcucccaucuuuuuuucuuuuuuuaaucagcuaugccugcagccuuugaacaguccucuaaaauaaggcuggaagaacuuguuacuggaaguuaucuuaaggccuugagaaacaauuacccuaagucgaauucguguuaggugauucuggugguauggagcacacaccucccucaggucggguguuugagauguucauauaagaugcauguuucuauaugauaggagaaaacgcgagcuugucaaacugaugagucuaaauuaacaaaauauugaaagcaucaaccaucuaaauaacagauuuauuucuguacauacguagaauuguuucuguggucauuuuuuuauguaaauuucuaauguuauuugaagcaaaaagaaaaaaaaaaugugggcaagagcuugcuuuacuccauuccuucuguuagccacgcagucguuggguuacagcuuugaauuguaaaaauucaauaaaaauaguuacgugauagaagacugagagaaauaaaguauuuuuaacucugguauuagauuuuaauaaagaaauuguaaacauuguuaaaacaugggaaguaaacccagaaaaguuaggggcaaauuagaaauaaaguuaaugaucugaugcucauugcuaacuuaaaauauauaacuuaauaugcuuuuuauuuagaguauauuuuuaaaaauuucuucucccucccccccacuuuuaaaaauuaccuuuaugguuuuuuguuuuucuuuucuacuuguccucauuauuuguaaaccugaagaaaauggguucauuuggcagauucuuacuuaaguggugacugucuaaccggguagcauguuccuggcuuagcugucaguggcagaggcucacuuccaccagagaagaagaaucaguagccgcguuuuguaauggcuacauaagccagaucuauagcuaggaaggacauuagccaagaauauguaaauggaguccucggacauauuuccaacuugcuugagagguuaguaucaaaaacagacaaacaaacaacaaagacaaacccuaaaccccgaauuaagccuucuucagaucccuuggucaaacaaacauagcuuucugccacuacuuuuugaauuaugauauuuauuuucuuuugauuuaauuagauuuugcugucugguaugaaaaucuccaccuauuuauuaaauuauacaaguuaacaggcaaggauucauuuccugucucuuauuuagcuuauaagugauuggucaagcuaaccuacuguuauuguaaaguucccuuuucagugagaauucagaggugacccuguugugcucagggaggaccauguguagaaaccucaugugaagucccucacuuagaaaaggugaucucaguggaguugcuuucaccagugccacuugggaguaauugaaccuauuaccuuguguauguuugacauuaaauuaaagucuacauucacaugaaaacauaaacuuuggaaguagucugcauuccguuuguuuccuucgcucaguguguggauuuuaguucaucugaaccuuauuuuggagagaaguuguaugugcguguaaucagaaauguggcagucuagugccuguagguggcuccuaagggaaguauucucacaucugagggacugugagaagacacuuuaaguagcaccaucugccuugcccgcuucuuucucucuguucuaccuuacaccuggauccagacuguuaaaacagaaacuauacuuucuaagguucacauuuugggauaacuuugaugcccagagaaugaaaauuaucagagauguaccgucagacuucaugaaugguuucccaggcaccagguggaggaagcacuaguguacuauauucccauauaaagaguaucugggcucugaaaggagcacacuggagggaacuccucuuaaaagggaggggcuuugucaaagaaugcuauagagugggggugugcauuuaggauguauucgccagaggacaucccuuugaaagucuagacagcguccugaggauaagcuguggucucccagcccuaaggagcaucugauaguuuaaaauuucacaaauguuuaaggcaucccuauaccauggacaaaugucuugucauaaguguggcuuccauuauuuuagucacauuuagguuuuuaauaugauugcuguguuguauuucuuuaugaauuuccaugacucuagaaagucuagauaguagaauuucaugccaguguuacauggugacaaaauacuuuauuucccuccagcauucuuuccuuccuguuauaucuacauggcuuuacucuuaccuucgcuuacuggacuagugaggaagguuugggaggguuguguguuuuuacuucuugagugagcuucagggagauggaacauacauauugguuaacuuugcagcuucguaguaugugucuaauagguagcgcuguaauucaaauaugugguuuagaguggcauuuaucaaacuaaagcauauuuuccuguggaaucaauauaugagugguaugacaaucuucccccaucuaaaguauuugaaaaucuaaggaauaagaucaaacacgaaaucucuaaauguguuuaaagaauuuuuuccauuuagaaaaaaguucuaugacguguaacguggccuuugauuuuauacgacuuaugagugcaauauaaauuaguaaauuugguagaaccuaauauauuaacaauacuauauauguacacaugcuuucuacauuuacauguuuuaguaaagauguauacuaagauguuacacuaaaaguaauuaccucaguuuaguagggcagacauugagaaccagauaauuaaacuuuucauuuucaauucuaauuugguauagagcaggaauuaaaaucugacuuagaaaauguucaccaaauacucuuuauuuacuuaccaaauauaucuuuaaaagagugaaaacacaaagauuuaucugaaaagauuagaguucugaaauuucccuuuauaaacuacgcagaauucugagcagugcuuaugaaaucugaauagagcuuuauguaaugcaacggauacugugggcagagcuuaacugcaagacugaugggagaaguagguuuuuauuuugucuuuaugaagaggaaugaauauagagaaaacaaaugaauacagaaccaaagacuagaaagacacacuaaaauauaguacagccuuacacgcgccagcuuauuagugauuugaggaccgaagacagggauuugcagaacucaguagcaacaaagugcacauaaguuauugauagcuguucguugaauuuuaucacaguuuauacuuuuguauaauguuggaugucaugagaaggucuaugaaauauacagaacggucuguugaaagcuuuaaggaaggguuagaacuguggcuggcaguagggcucccgcuuuagugucauugugguaguuuugcuucagugaagguugaugcuuucacacgaguguguuagccauguguaguucuaugcgaaggauccagaaugaacuggcuucaucaggguaaguugggcaucuacauugaguggacauugacaaggucugguuggucuagggcagcugaaccuacguacuugggugucgaaaugcuaauaggguguugguuagggcaauuuugcgguguuugguuuagccauaguuuguucaaaugugcauuguucuaggguucugcagaacagcaggagagggaaggcuaaaguguggaagccuuuugaagugucuguuuucuuccugguuacugucacccuauuggucaauacaagucaagucacaaagacaagaccagcugaucuuaagauuggucugaagaaacagacauggggaugggaggacaggaaugauuuggggcuaauacuguaaucaguggucauccuaaagccuugggaagcuuacuggugcuuacaaggaaauaaccugugccaagaugucuuguuuggaaguugucgcuguguuugaagcagaaauggugcugacauuaggaggaguagcaggcauacaauugaugaaagagauacaaguugcucacagucagauuccaggguucaaggcugcucucgugggaaucgagacagccugaaagguuguagcuuaauugugguuucaguaaacuucaucugugcaaacuucauaaaagaaccuggcauauuaugcuggaaacagucaaauaagaaagacucuucaagaauacuuuuacuuacuuagaauucaugccuuuauuauagcacccaucccucucuuuuacaaucugcuuucuggcccaggccagccuccaacucagacucuuccugcuuccucagugcugggacugcagaauugccaccacauaguaguauuuucuuuaugacgucagccuuaagaauggugaucagauugcaauaaauguuucagcucaccugcuaguaccacuugggcaauuuaaauacaugaacaaaagaucccagaguuugaauuuccucuuucuaucucucagaacugaugcuucuguaguuauuuuucuuuuuuagcauuuggaagugugucagcuuugaccaaaguugaaaaacaaagucauguuacuucccaaguuuacuggcuagagaauguaacucuuuaauggcuuucuucgacaguugcuuuguuguacauggcucagcaucugcaaguuacguguguuuccagaagaaaccguguacagguuauuauggaaauguauaaaugcuauugaccuacuaugugaguaggaaauuugcuugaucacagcuucuucaugccacuuauucauaaagggagaacacuuuuaauucuuugaccuuaccuacaaaagaaaauagagacacuuggcaaaaacggcuuacucugcguauuugcuucuggaagggaaaccuguaguuuaucauuuaaauaaaugauaggcuacauaaacugcuguguauagcaaaugacacgauaaaauuuuguuucauacuauggugucuugagcaugaaagcauaaaggaagacaugugaaugaggacgaaaaccaucggcaguuauuuaggaaugcccuccucuugguucuuuaugguuaacagugaugggauguuguaagcacagagcgaagucaggcgcagugaucgcagcuccaugauucauuccugcauugcuccugauugauucuccccgccaugguuaguuucagaaacuuagaucaaggaaaccuggugauggcagagaagcugcgucacggggagcagcugagugagcauccuccaggagcacgcauucgaaugcacugaguaaggcugcuuagauaauagcacuuaguccauuggacuuuguuuggaagcacuuagacaguuaucgauucacuugauggucacaaaguaugccuguguuaagcagacuugaaugacugaaaaaacauguuuuagaagucugaccauuuuuuuaauaguuacauugaaaccaccuauauugcuaguaauaagaacuuuguccuaaaaguuaauuuuuagacuguuucucauuaauaaaauucacauccauaaaaauuugccagcugcuaucagaagcccuguaaaacauacaugcuugacucuguaacauucacccugccuuuuuucugcuuguuggcauucauaggauuucugaauggcuaccuaguuaguuucauguauuucuuuuuuuuauauaggugauuuacaaauaacaguguuagaaagcaugauguuuaaguugauaaguagaaauugaaagaaugaaaauguggauauagcauauuaucuauaauacauauauacuauacaauuuguacacacagaugugcacauauacacacauacacauauguaauacauauacucagauguagguuuaagagcaugaccauuccuuuugauugucauuucuagagcugugcuauauguuuaaccaaaagccauuuaccucuacacuucguuuguauugaccugcugcgagcugccuuccccugcuggcuuugguuccgagcucuuucacccuuucauguuuaguuuuccuucuuuucaccauaggucaauguauaacuauuuuuuuaaacaaagauuugagaugguuauaauuuacuaauugguuauaaacagaacaaucuaggcauauacagaaauaaaaaacaaaaacucugugugucugagacuuaaucuugguguuuauuuccaaaggcuuugcagguuauuucuguacaagacgcagaccagguauuucuuuugucauaucuaguguuuuucgaauccagaaaucacacuccacguuauauuugacaagacuuuguaaagguaagugauccaaauagaauauauaguuauuuugaaccuaucauagcaaaauuauucuuucuguucucuaauggggacagaugggauuauaaaagucaaaugauucugcguuuuucaaaugaagccuugaaguccgaaauaagacaaccaucacuuacucagaagaaacauguguugguuaaaugccauugguuaaaugcuaucucagagucuucccaacaagaaggagccugguuugaaaguuacuugcuaauuauuguguagaaguucaguugaucagcccuucgcucgagucucugggaccuuggaaagaaagccucacagagugugaaggcucgccucagucucacuacgcaaccaaggauggccucaaacccgugauccgccucacaccuacugaaugcugaggcuacagguuucacuucccaaccgaggcuuagaaauacuucuuacaaguguugacagcaaaccagaccuaaagagaagucaguaaccucagaagcacagauaauuguaacacaguuaaguaauuagaagugaaaagucuuauguaucuguuacccugguuuuuaaauuauuuuguuuacuaauuaaaaauuuaaugaugucucuggauguucagcguaucgaauuccugaacauaccaugguuauuugucauggcuugaaugagccagcccugguagaucaggcgacaagccauuucucauuaguggcagaaaagggacaaggggcuaugguuagggucuacucuagagaggggcuuuaugucugaguagacauucuauuucacuucaaauuauuaaacaccaccuggcccuauaaauuuugguauuuauuaauauaaggccuucgauaggaauuaaauucagaaucuguuauuaaaagggcagaagaauacuucauauuuuuacauuuuuagauugauguuuauuuauuuauuuauuuauuuauuuauuuuuaugguggggucugacgauaugguucaggccagccuuaaacugagaaucaucucacaucugccuuuacagugcuaggauuacacugcuuggcuuuuaacuauggcuuuuguuucucuaacuuuuggcuauuaugugccauuaaaagcuguuuauuuugaugccuuacuuaauagauuuuagaguuaauauccccaaaugcaacuccaauagcaaggacaagcuaucuagauaguuuuaagaggcuguguuaauaguguacagauaacaaaguaauacauauguuguuacaaaaagaaacccuaauuauuuuaaaauuuguuaguauacacuagcaacugaaaauaaugaaguaucauuaaacuaaaagagugccaugcagcuaacacagcuaacaggaggguuggagguguuugugcgugagugugaguguguugcggggggguggggggggcugcauguacauccguguaagugcagauauagguguucaugggauuauucagaggccaguaaaucaugucaguuguccaguucaaccacucucuaucauauucucuugugacaaggucuuccacugaacuuguagcuagacuggcagccaacgcaccaugccauucuuccugugucuccuucuaacuccagccccaagugcaugguuaagaggcgugugcauugccuggcuuucuacauggugcuggguauuuaagccuucuguuugcacagcacguguucugucccuuucauguccagccaucuucccagagucuugauguauuucucaggaguccuucuucuuuaagaacagaggaaguaaguuucuugcuauauagcuaugauggcuuagucaugacauuaucuacauuugaaaaaaucaugauaauauauuagugcaugugugggacaauguaaaggaucuuagguagguuucuauagcuggauuuaagaaugcugauaugcuugguuagaaagaaaauuggacauauuuugcauauaacccuuugaguauuaauucugaccaguucuuaauguaaauaauguuuacugucauaaaauaaacacagugggguuuacaccauauguuuuauaauuguuuuguagcguuuuuuuauuuguuuguuuucacugaaauggaaccuacagcuaacucucugaaguuaugcuuguauaaaaggcaauuaaauuuguacacuaacaacuuagcuucgcaaaccaaugucucuagacagcuuuuguuuaaaaaaaaauaaugacuuaaagauuaacacuacccccacucccaagacacagucugaaacagaaauucaauucacuccccuggugccaguugacuuuggguaugugaaggaaagaguccuuagaguguacccaaggaaugccuaaccuccacuaacuggggguaggugggugggggaucggggguuggcuuaggcagcugugaguggccuuugaaaaugaggcuacuguggucucuuaguuuguuuuuguuuuuuucccauccggcuugcagguguuugauauugucagaaauaaaggcucccuuuaaaacauuuagguaauuuuaaaaacuguuauuauauucauaaucacuguuucucuugaucucaggggaggcuggguacccuugauuaucuuuaauagagcauaugaaacugauagugccaaugggagcuggguggcaaguuuuguaauaugccuaccuccccccacccccauucccacauugcuaaacacaucucuuggcaaaaugcaacaauguccauaauuaccaggcacugccagcccuuccuccagagcugcuucugcaggacaccugucugacucuugcucccuucuguaccuucucgugcccuggcuugcuggcucgucuaaugucagagcaacaggcugccauuaaugaauucauaucucuugucaaauucacagacacccacguaguuuauaccauaagccaugggugguggcacaacauccacacaguaggcauuuaaaguccccgugugaaugaauaagcaaacugaacacagaugcucgcccgcccugggcuuuccguuccuuuauauggaaugcuucuucugcauuuggcagaucugcuuagcacaauuugguguuugucuggaaaagagacucccaaacauugucucaucgacugacuagauggaagaaacagcaggauccccacuaacuuucaccauguagaguaauuuugcuggauaagaaacuauagagaagagauagugaguucuaccauuuuuuccccaaaauauagcaauaaagaaaagaauuucucacuaauauuuauaguggcagaaaaucugggggugaaacucauacagacuaccaagaagacuuuuguuaaagccagggcgggggugccuggcuuugugaauuaugaaugcccuucagugguacacgagugcugguaaucgaccccagcaauggcccuuuaaaacugugcauuugaggaugagaucaaaggauacgggcuuagggauuuuuaaugaaucaguuguaagagacuugagaaaauuggcguaagaauguacacuuuuguuucuuagaggcuuugagacuucauuuaugaguauuguucucagaaguuaacaccuaaaaaauagaaauuuuuauuuuacaauuauuaauuuguuuuauauuuauacagauuagaguagcccaucuucuuuaauauacaccauaaagaucacaguaugauaaaaccugaguuuauauuaaaguauguaagacuuccuuuaaaguuuguguuuuuauuucuguugacaaaaguaacacaagaugaagauaggaauucaagugauauugugacauauagaaaaagcugucucuagccccuuccuguagagaauuucccaccgguuucauaaauugguauacaguccuccacuuauuuuuaauuauuuauaguacuaauuaguucuuguuaugaauuuuaaugaaugguuucauucuguguguauauacauauacaugcauacuuaagucuauuauccgacauuuucaugauuuaucauaaaguuuguauugcaccccaaaaguaguuccacacccuaaauauucaucccaaauuucuggaaucagugaauauuaccuuguuaggaaagggggccuuugcaaauauaagacuaaggcucucagaauagaguaucuaggauucucuagauggugccuaaacucucuuuuacaucuuauaagaaagauagaagcuagagacagacucaugcauaaggcuugcuuagaggggaagaugguaccaggauuguagguagaggauggagugauguaccucaugccacacguuguccacagccaccaacgggcucauccaagagccuccaaacagaauacaacugugcugacaucuggcauggacaccaagcuuccacagcuguaagcgaauaaacuucuauuguuugaagccacugauguuguaguuauuugauccagcuagaaaguagcuauagcccucauguugguguguagagaucccauuuauuauguguaacuuacagaauuuuacauuauguggauauacuaugcuuuaguuagcuaauccuuuauuuagagauaauuugcuuccaauguuuuaacuuagcaaacauuguuucaggaagagugugcaaguguaacuggcauguuuauguagaguaauugucuagauauaaaaugccacaucuguucuagguacuuaaccauguuuugaguaauacauacauaugcauggauaucucuaccauguaguuguuuggguacuuaucuuauguacagacaccuuuguugauuucuugaauacacuuaccagaauagacuauaauuuuuguugugaauuuuuuuacuuuuuuaugaaaauaggggaaucauauauguaguuugucuuugcaacuccuugccuuuuccccugaacaaugacucauggagaacugggacaaauagguguccuucuguucuacugaggcugucuuguaugauuucuauuuuccuuaacaauauauaauuuuuguuuacuaaaauuagagucauucuuuaaaaucaccuuuugucagaucucccauuauuuaaaaagcuccucuucugaggugauaauaauguacaugguuauggaaaaucuacugauagagguuugaaacauaaauacgugcugagcgucuuuguuuccacuaaguauuuuuaacucaguauagauugaguuuucagacauugaguuaagaacucuuagcucaugguucccugugucuccugaguuucccuauuguucccuaacacaugguucucuuaucccuuacuagguagaguuuacaguucaaaguugucacagauuagcauaccagagugacaggugucaguuuugcccauacauaaaauucgucaaaaaguaucuuaaguaauaaugaauccagaaucguuuaaacccggcucucuaguuuccuuuuucugucuucccauuuugccauucugacacgacaacucuuccaucucccucauucccaaguccaguucacucuugauaaaaaacaagaugcguuuggcaucuguucucuuguuaaagcccucaggaaaaauuacaaagcuguucuugcaaauucaucauuauuacucagaaacguaauucaccauacgguuaucucagccuuccucccccuuauaccugagcucugggaugacauggccuucuuuggugaggccucguuacagcaucucaucucucccaccuuaauuuguagcgaagcauugcauuugggugacaggcaguuguucgugcuugaauaacucaggauuugaauucuacaguuuguggcacccguguaaugcuuagcaguagguacagcuguuaacuauucgcuuauaaauaaucuuucccccuucucaacuugucucccagguaguguaccugucaccauuaauaacucuucugcaguucccuggcgauuugacccaucaguugucacucacagaggaacaguguucuggcuugcuauuggaguuuaugcagguuucuucagcucuucagucacuucggcagccauauacugugggaaguuguauugaugggcuucacacauggugcuaaaugcuuuaucacaugcuuugaggaaugugccauuauguauuuuuuaagucguauaugauaugauuugccauuaggacucagacuacaaauacagggacaagugugguuaagaugacccacaacagauacagccguucuagauuuuugaugcuaugccugcaccuaauuaucaugguguauugucauccccugauguuugcaaacuuugggcgccucuaguugguuuaguuaguggacccauggaguaugacauucugccuguaucuaaagccuuaguugaaaggcuaccgacucauucagaggaccucuaagugauuuagcauccugugguucuccauguguacaugugcuguccuggcuuccacagucucuucuucaggccaauuccuacauguuuguaagucuccauuuagcuauucuuuucaggaaagguuuucuauuuagcaauggaaguguugccuaaagugcccagaugaccaguuuuauuuaucucuuacccucuuugccuuucaccuuucuccucuguuggauuguuaugauaauuaaugugcaagccaugguguuucuguacccacaaucuagucacauguuagagccucaauaaauuuauguuaaaagugagagucuuauuuuuuauauugacauacauaguuauuaucuaugauaaguggaacaguaaauuuugggcacacagugucuaucauaugcugcacugucaucagaggugcagguaggagaaggaccuccaugccuucugcccuuguacccagugaggaauauacauuucuuugauuugucuuaacauuaggauuucuucaaauggcuugggaaaugguggauaauaagauacugugaggcaaaagaaaaagaaaauaaacuaucuggcaaguaauuccaguguuugugaaaguagacgaugcuugaguaauaaacccucaaaggagcugagccagcuacacaugguacuggugugguuuucauuuggaaauggaauuacuguccaaguaaucuuuauauuccaauuuauuguguaaaacaaauuagaaaauuaucagauuucugguaccaagaaagugccaaaauucccaccacacauuucuacauacuuuguguacaaauguauguauuuauuuauaaguaaucugaaaauagaaaauaaugaaauauaaaauuggagaaaguucaguaacaaacaaacccauacugaaguauuggugccauagagcuguaugcugcugugacuguaguuacuagccacuagaauaauggagauacucguauacaaaaaugcauuucaucagaaauucaagaauagguauuuuuuucuguaaaaaaauauuuuaagguuaaaaccauuuuacaaagaaauauaugauuuauuuuaaaagauacauacaggacuccaucugauauaaaucuaauauugguaugcaacugcucuucuguuuguuugguagaaaugauagaguagcauagagugagcauuuuguccucaauaguauauguggcaaacaaauuucuuauuaauagagguaccuuggucuguacuaacauuuccauuacacaaauguagaagaguucauguguucauuccuucauauacugacauagguauaugauauugagucugugauuuucuggaaagggguaaggauaaaugauaauauguugcuuucaugagcaucucucuuuuuuaauuaagaguuaauuaauuuuauuuuuaauauuguaauguaauuacauaauuuucuccuucccuuuucucccuccagauccucccauauaccccuccuugcucuuuuccaacuuuauggccuccuaucccauuaauuguuguuauagacauauauuccuaaauacaaaagugcagcuuggucagucuguguaauaguacuuuucuguaguguuuucagggcugaucauuugguauuggauagccaauuagguaugcucuuuccuagagaagacuauuuucucucuuucagcauuccucugcugccugucauucucuuuauagguugaaaccuccuuggcuuuucccauccaccauggcauaucuguugacguuguuauuguucaucucagguuuaggcagucauguuggugagacuuuauggauguagcuuuacauuccuaggacacacaaacucucugugucucugacucuuccauccccucuugcagugaccccuggagcuuauguacaggaguguuuuguagcuguguccuuugggacugggcuucauagcugcauuugguuguaguuuucuguaauggucuccuguugcagagagaaguuuccuugauguuaauuauacaauuuucuuuuuuuaugaucaucauauucauuuggguuuacauuuucucaaaaugucuuuuugaguuuuuauacauuucuaguuucaauacaaauccuuuuuuauuuuuguuauagaugugucauauuaguaauagucuugcaaauauucuugguuuucuguuugauuuuugacuugauuuaaaauaauuuaagugguuuuuauuaacucaagugacacaugauccuugaaccuggcuuagaaauaucuuuaagagaauuauugguuuaugcuguuucauuuuucuuuguuucuacuguuuagaguccugggcauggaacucgcccuugaguuggccaagccugugcuggaacccuaaaccauaccuccagcccuuuggcugguuuucuauuuuauuuguauucagugagcuuagacucaugcauaaauuuuuuauccagguuucuuauguuucuuaaaguaccuaagcauaucuuauaagacuuauaauuaaauuuucuuauucauccagcuaauuuuagaagcacuggauuauuuuaaauauguaaaacuuuggcaaaaauuauuacacauaaaagaucaaaauuuuaauuaacaaauuauuuaauggcaacauuuaauacauuuuagguagaguagagagugcauauuuagaauaagaagucauuaaggggaaaauucauaaaauuauuggaaucaaagagauuaagugcuuuuucuucauaaauuuccuuaaggaauauaucaacaaugccuggcuuuaccauggaugccccacaaccucccaagacuuccaagggccaagacaaugagggaucaagacuccagcaucaucacucuauggaagagucacuucugaguagcucuucaauacaguguccucagucauuuccaccucaaucauuuccacuguagucaucagucccagaacugacagccuuagggucaccaauaagucguauuccuaccgacuucauuguuuuguugaauguuggggucauugccauaucacaucucuugguauguaugguucucaucugaggauagagaugaaaauagagaccagaaagcaacuccagaacacaaugccacagguaaaaagguaaaaucuuucagguugucagauugcacaguaguggcaagaucuuuauaauauuucuuauauucuuuugaucaaaaguaacuguuucuguccuucaaaaggaguucaguaggguuugucuucaugccuuguguucacgggugaccuuaauccucgcccuuccaucauugcuucccaugcuguccuucuguauggggcucuucucaccaagauagaugcucaagcgaugaaaguccauaccuguguugugguguccuccacauuucuucuuuacuuuccucgguuccacagucaggggaucaauacagugaagaccuaagaguucaguacaaauggccuccuccuugaggggugcacucauuccuguuuuagguuuuauggugacuuuacccauuccugggaagcugagaguuaaaaagaaaaugaugauuuugaguuuuagaauguuucguuuucuccguaggagacgauaaagggcauguggagcagguccaacccgguggauguuaaagagaaaggggagauuagcugaagaacauucuugugugacuuaguuaccuuucuguugaauuaaauggguggaaagggggaauacauguugugcuuuauaguuuuuaacacuaaaauuauuucuuaaaaaaaaaaaaaaaaaccaaagccuuaaaauacauaaaauggccuucaggccuauuggcucccacuguucaguuuaucagcucuccaccacacccuccccccuccccaucccuguaaaaaacccacagugaagugugaaaagcaucagaaagucuccucuaugccaggucagccuuuuagucgccugccagcaccuucaucucuucauauguuucuagcuaaggucuaacauggaacaaaaacccgacagcaauggagaccagaugcugguauuucuucucugucacuuggcugccgagcagauggaauuuauaucaaucgggcaugcuaggaggaagaggccguggcagccaacauguggaacuggggcugagugacauuucugcuaauguuuuguccuuguagaacauuaugcuuccucuuugcuuaugagcugugguuuuccugacucagacgaaguuccagcuccagcuggaauggcugucgcucuuccccucuccccgcaccccaccccuucuuggagauugcugggagcaauggaggaguaguggggccugcacaauggagcucuuuauuaaaauaccugacaucugcaugcaaugcaccgaaagcgucuuugcuuaagcagaggaaugcguugggccuuaccagucacuuuuuguccacagccccgcacuuguuugauuuauauaaugagcaagugccucuggaaaaaagaagacagugaacauguuguuggaagaagagaacuuuuaauuuuuuuccaagaacauugucacagacaagccuaauacucauacaaaaauaugaguauuuacaagcaauuacagucauaauguggaguucuuacuaugauuuuuuuuuuaaaguucuuugcuuuuucccccuucgggauagaguuggaaaauucauaaacccaauauaacauauuaaggaauuuaaguguuguuaauuauugcuagugggaaauaccacuuuaaagaaauuugaaguuacaaagaaugucuagaaggaaaguaugaauucauguuaaagaaaacaugaagacacgugcaaccagaaccagggaaagagcaguuguugguaaguuuguaauugucguccuugccagcagaaaagcacauugucccuucaugcugucggaauacaugcggaugcaccguucuggcuucuucacucaugauguaaaccguucacaucuuaaccugcucguggcaauuaauaaggaaacgcuucugugcugauagaucauuuuguaaaacacuggagugcuccugaaauugccccuuaccuugacaacccucagcucugccccuccccauuucuauccagaccuuuuguuucugguuuugauuggguuacagagagauucaaagaaggaaaguagaaagaaauagcaaggcacuucuguugcuuuucgcuuuccuuuuuuaagaaccgcuucugcagaugccuuucauggucccugacaugcauguauccuggcuggauaugcccugugagccgucuagaaaacucuaaggcagcuuggcuguuucuuaaucuucaggaaucucgaauucccuccuguugcuuccuuuuuugguuguuguuuuuggcaguuguucugcuguaggacuuucuacuggcucccacucacugggacagggaugagcccuacagcuaacuagagguacaaugcucaugugucuagaaaaagucccaacucggucuuuuuuggagaaaauuauuugaaaauaauuauuugaaccuguguuuuuccuugcuauuuuccuggccaugccauauacugaacacuguauugcuugccuguaauacucucuaauaguguacuguaaaaugucccauguauaguuuacauauauacguuaaauccagaaucacugcauaguaucccucacuuuaccuacugagcuuuaaccgucucaugagccacgugccuuccuaagguggcauuuuccaagugacacaacagcaugggaugaccaacuugcucuugacugaaacuccucaugggccuccugaaacccuuacauaugaguacauuucaacagagggggaaagaacagacauuguucuacaaaaguagauuauggaggccaaaagcuguuagaccuucccaagccacauucuaggggauuguuugacuuggccuuugaauuuugguccuugauguauuucaucccagaaaauuguggcaccagccccugccaguuauaaauauugacugucucauggguguggucuuuugucuuauacccaguugagguuccacguggaaggcauccugcucacuguauaauacuggguauauuauuuaaccuauuucucuucuguacaacugagaugauaauaaugauaacaucuaccuuacaagguugcaaaagugacaaaaaggaguggggguguuuaguagagauggguuggggacaguggcagguaaguaagugccugacccauugcagaagcuccacaguuguaguugcuguuguauggcagucauggcuggccuucugauuucuagcaauuccaagucuaacuugaacuggugcuggcucuggagagcagcuguuugcacuaaagcucaguacccauuauucaucucucccagcaggaguguuaccugcuccaauucugagggacaccggcuucuuguccuuggguguuugaguccuaagaggaaguggguuuggaaaguuaucuacuaagaauacuuggagcgaaauucaaaccagcuagaaugagcaaguuccuguucuguaaccucacauugguuguuugucuuugaguggagauguuccucuuucuagcuggagauaaaagucuuucccaaagaaugaaccccaacaucuaucccucuuccucauugguggcagagggcaaugggauuuauuauacaaguauaggugagaccccuaaggacaaggaguauaaggacuacuuucuguuucuccuaacgacuguugagaaaguaggucaauggggaagcauuuauccuaguugaaaaaacuuuggagcaaaguuuuugccagugucucuuaaaaguggucuaauaauucuggcuagcauucccuuucucagcacaaggauauccuaguaauggucuauguuucuacuuuugcuuuuauguucuugcuugccccaccaaauuaugugauaaagcauuuauuuauuuauucauuugguuuuauuaagguaggaauucugcaacuuuauauccaaaaaucucauguaacagagauauuuuauuuuguuuuauuuuauuuuuuuuaggacaaucagaugaaugcuagcaaaaauuuguagccagguuuggaaucaugaaggugaaggucccugggagacccugucuuuaaaaacaaaucaaagacaugcuuucuccuuuaaacuuuuguuuccauuguucuuuaguaaagaugccacacugcccagaugcacaucagauagaaagugaauacgcagugcuguuguuaucccucuaagacuaaacucucaggaagugagucgcugcacucaggccauuguuggcguuccuuccauacuagaaagauuuuuuaaagaaguugauagagagcucaaacugaauuauuugugccaaguguuauuuugucuuggucuacaaauuauauuguuuucugguacauuguucaguuuuugaaauucaaauauaauuucauugcccuccuuuggaaauaaaaacuuuacaugguuuuggcaagucugcuuuuauaaacacccaacguuuacuguccagugaaaaugaaauaaagaaaugacauuuuccuuuucauucuaagcuuugaaagaaaaggaaacaaaugaaugaacuucaugcuauuauaacagugauucuuugacucuugggacaccaagcaugguguguaaaauggaaucuccucccucccuuuucucccucgucacuuucucucccucucccccuuacaugauaaaaauuaauuugucaauguaaauucguguauucagaaauuauucccccuuucccucuccuuucugccagguaaacaauacaauuuaaaacauucuugugguuuaguuacaaaagggcuaacauucuuggcagagcuguucuuaacauaagcuaucaugaaaaccuuaguggagacugguaagguaaauccugcgguaaaugccagcaguuuaguguguauuagccuaucuuugucuuucauuuugcuaagauugacuaacacuuaauugucuuggcuauguauuaaaaaaaaaaaaacauugaaagaacuuacgcucuagggauuugccaacuuuugggguauuucagcugugaacccagccaaguugcccauuuccaaucaaguacuucacuucuugacacagggaacauuauacacaacacuaaauagcccuccacaaauuuggcucuuaucaaaaucuaaagacauggccauuguuauaggagaauguugcucauuugcacagccuccuuccauuuagagcaacagacacagcaguauccugcuccuuggccucaucuggauauuguuaaguaagcaacugcggcugcugccuggagccauuuguagagauuccguacacauuagcugugucacagugcagcugaccaguguggggcuaauuugcuguuuuucuccacagaauugaagaaaauauccaauuaucauuuaccuccuuuagauucacuugauuauuuuauugcauuuggaauauguuuuauaaauggugauacauuuuuuuaccugaaaaauuaagauuuuuaaauuauucaagucauuacgucuucuuauugccuuucuuuuuaaagguaaaguuauaaauuuaguaacuauucucuuacuagcugacaugaagagaauuuaaaauuucuuaauguaaggauuaaaaaaggagaagcagcagugcacagaguuaaaggauuuucuucuguguagcuccuuguguguauuagggaacucuggcuuucucauccugggaaugcagaguguauuguaauuuggguuuuggcaauaaaauauuagaugugguauuuuagauuuuuacauaucuaugauccaugauaaguuuacuauuuuagaagaugggugagugcauuggaauuguuuuuuaagcucuucuauaguuguugggcaucuuagcaucuaaaagcaguucccgguacagacaccagaccuggcaacugaagggcauugccugccccagcugaggcccugauaggauuuucuaaaaucagagagggagaaggagauugagacuccaccaagaaaaacacaaagaaaauauauguuaauguggcugaauauucaugggaacccuguggccuggggcugcaagcacagucaggccuguguucagcaggccaccccaaggcuaggggcagaaggcacucgccagugguccagcacaaguaguguugucuuugaaaaguuuuccuuuucccuugaaucagcuacagucuuucccuuaaggucacugcaguuugcagucuuuggcagaaggcuucuuccuuuuuuggagguggcauucugacuuuucccccuuuggcaguguuuucuccucaaccugccauuaucuucuaagccuguuuuauguuaucauugucagacgccucuucccuuagcgcguuggaauaaaaugugaugagaucuaucucucuauagauggauauauagaugugcacacauauaugaaauuuuuuaaagcacggaacgggaaaggcauaugguuaugauuugagaaugucaagcuugauaauuuuuuuucaaaccuuuuuuuuuuuuuuuuuuuuuaaaucuguaccuuuuucucugggcagugaacucacugcagagacaucaaagagaauguguacuggaucaaggugguggguuuuuuuuuucuuuuuuuuucuuuucuuuuuuugaccacaucauugccagcugugguguuuaugauuagaggcagacgguccagacaccuuagacuccucaccaagcgucagaucuuuaacaggauccaucccaacugagugacacuaaacagacagccagaggggaguugaugggauagaaugaagggauguggggggggggggggcacuuguauaugugaaggugagcuaggcuuuggugucuaugcauucacccaccaagcuguggaacaaacucugcuaacaccaggcugcaggcugcccagaggccccuuagcaugccuuucaacguagcuuuuucuagccgaggggaugacuagagcucagcaaacacaggcauugauccucucuccccgggcacagggauguacagcauucgggucacagccugggcuuugaagcagcuccauugcacacugcugacagccacagacugcccacuuccaggaucugaugugauucccucucggaucgccacacucuuuucucugcagcuaaugacauugaauucccucuggacauugccuccacuugcaauauuaacacuuguauaguguucuguugacauaagaauucugcaaacagccagcagcccccuuaguaguucaugaaaagggaguucacuuucuugccuuguguucccuucugagucaguguaacugccagauagcuguuuguuuguuuguuuguuuguuuaucagcucuaauaacuagaauauacuucaggaauuggugaaacagcauuuggaaugaaaugucuggaaauuacuagaaucaagaacagaggcuaacucaguggggaccauuaguagugaaaagaagcaauucgguuaauaauuacuuauuucucuuucaguguaaaagagcacuuaaaaaaaaaaacuucugugagcaucaagaaauggguugcuugcuuacaguuccuagugacuauagaaacugcgauucuuuagaagaauaauauuauugcaacaauucaaaaagaacagcaaaccacauuagccuuauugaaagagcaggauuugcaugucaacucagaauaucuaagacgaagugguuauauggauuuuaucuuaaagaaggacauaggaaacagauugcuaggacagaaauaauuuuaugaaccucucuuuugauuagaaguacauuuuuuuuuccuuuuaaaaaagagucaucucaacaguuagcuguuagggcggagugaaugucuggaugauaaaagugugugagccuugguuucacucaucauuccuuuccuucugccuugcacacuccccucuucccuguuuguuaaccccacugacuuagcuccucagaccaucggcagcagcguuuuggcagcuaacguuuuuugcuuguuaaaagggccugaaaagcaguuugaaaccuaggacucuagggcuggguggucugaggcaacagagguaaaucaucacuuggaaaccauugaauucuagaguauuuaacugcaccucucuugcuccagaccaggccuuguaaguaggacuugaauaccuccuauuuccauuagcaaccguaauaggcugcuguuuuagaggagaaaauggcagguaccaucuauacauagaggugauuccugccuaccucaccaauaauauucaucauaauggucuuuaaaacaauacuaagguuggacuguugugguggcuggacuuuuuuucuuauuggcauaagcuguagcguaaauaagaccuuaacauuuuggaugccagguuacucuuaggguuuuacccuguagcuguaauuacugaucuucuuucuuccuaccuucuacaaccuacuguccuuugcaacugcuagcuuuuguauaacuuguaauucuagcaucuuuccaagagaauuugaguuucuucuggucccauauagccacccuucaucccauugugcuugagcucucucugguuauuaggaaccuuuucugaagucuaggacuucauuuuucaugaagcucauuuccuuuaaugggagucuaaacuuucgggggguggggguagcagucuccuuguuuauuuggaugaucaccucuucacccagcuuguauauuucagaguuuagcuuauauaaagaaaguuauuucugugucauggcacuuuuaguuuuuacuccaggcagaucuacucaguaauugguggguaagaagaguuuugucuaugauaaaaaaaaauaauucuauguuuucacauauaauauucuuaauaguuuuguuuuaauaggaauccuuagaacaucaagguuuuauaauguacuuaaacuuugcauuuguccauguacuagcauuguaaauaaacgucugacgcaaaacaacaaagucguuuuauuggauguaccuuugucaucauguagcagguugguucacucaguuguuuauguaauuacaucauugcccagguccuauuuuauuguuguuuugaccuuuauuggucuuugugaauacacugugucagcaucaucccacuuuacaaguuaggaaacugaggcaaaaaaaaaaagaucuucuuaguuuuauuacacacauuguuggcuuaaaauuauucaugaugcuuuacugaucaugcggaccacuuuaaaaccuuccuggcauguauggaacaacucuuaaugaaagaaagucaugaauugggaaaagagcacggaaggcucuauuggaggguuuagagggagggaagggaacaggaaaugauguauaauuauaaccucaaaacauuuaagaaaaaaaauguuuuuuaagcuguacaguuucuuuuaccaaacauugaagugucagaguuuuaaacugcuuaguucuguuugagagcauaaagguuauuucaauaaucugguguucaaauaccuugguagaauuucauuuucuucaaggaaggaggaaauguggcuauggagggggaaucugagugucaaaucuucuucaugagaaggugcccauucuugugcacaucacuagauggguguaaacagaagcgggaguaggucccacauuagucucugcuucuauuagcaucaguauccuaaauauccagugugaguuuuguggcgaguacuuuugguggaauuugaauugaacucuguaaugugugauuggcugugugauguggacacaggaacauacaagcuuugugguggaaagcuugugcugauggcagugagguggcauuggaggauacugucagucagagguggcauuuuuugggugcuauggguucagauaccucuugcuuaccuuagcaggagaaggacuugcguuuccugcugaugggguuugguugaaagcaaaucuagcaccuuccauuagcauuuuugaaaaugcuuuuuuguuaagugaagggacugauacuuccuaguguugucuucguuggucuuuuuuuguuuguuuguuuguuuguaguuuuggguuuuauuguuugguuggcugguugguuaaguuuuggugacagauggguaggucuuacauuggaucaucuggaagaaaguaugauaauauuaggcucaugaagaaauauagccauucucccaaauuaaagaaaggcaaagcacagcuugaguggguaagugagguuugcagcucugucacaugagcaucgaaugugaccgauggcaguaagucacccaggauuauauccauuacucagucaaacaaucugauaacauuuguagagcaguuuguuuaccuggaaauuacccuugcacauucuccagucugcagugcaauuucugaccuaggauaaaaagaaauuaauccaguuauaguccuuguauuuagagaucuggugcaaacaucucauucugagcucuacagguacaguguuauccugguuuagcggcugauacacuaaauguuagcauuaguacaagaagaaaggagcaucaaaggauguuagggcccccuagacuucuugccuuuuaucaccuagcuuuaauuuucuaauggugggcuaaauggaccuccuugcucucaucuucaaaaggaaauucuccuucuugguagcagcaccucuaggcaaaggaccaaaaggacagaaaaggaaccaggaugaaggccuagaaggaggccccucuacccaguaaggaaguugcauguuuuucuuauguaaagaugauugaugaucuguggaaaauaagagugggcauuaaggcagcuuuccuuacgacagcuugagugaguguguggccagagcuuucuugauuaacaaaggucuuccugaccuuggcagugacucauagccuugcagggaugaacaguuccugaacaguuccuccggcaucagaagcacaaacaggucuuuucagccauuuguuagagaacaguggagaaaguggucuaaacuucuuaggaccugaaaacagaagagaguauuggaaucaucuccaugcaugcucaguguaguuucagacucugaaauacagggcugaccaguuuaggggagaagcuuaaaacuaggucaccuguuuaucagaaauacauaaaaugguuuuccauauuucugagguugaagguagaugauguuuuacugaguuuuacaacaucuuuuguaaaauaccaaauacuguugcuuucucgggcuagauaacagcauuucuacuuucuuggcuagaaauuugacaguacuuagagccccagagauguugacagccuauagagugaauguuuaccuagacuggugacuuugacuuauucucacuuaaaauuaaagaucaaacucauuuucuauaacuaggggauguacaucccagcagcacacaaagguucugcuggucuuauuuucuuuauaauuauugaagggagggaaggaaggacggagagggagagagagagagaaaccuuucaugguuuaccucagauuuccaggucuuuacucucucagccuggccugagucuacuauguaaaaaguaaguaaaugaauaaaaacaaaaacguuaggaaacauuauaaggugguaugcauuugacauaugucugguaucaguguuauugaaaccuuuuguagagcucuguguguauacacaugugcaguaugguguacuugcuacuuaacauuagagacaguguuaagacccaugccuuuguguucugaagaccaguuucccuggggaaaguggaugcgguauauuugcacagcaaugaguagaaauacagguuacaacuuuagguguaaugcuaaaguugacuuuaguauugaggugauauguaagagaagauacccaggcuaaguaucuuccuuugugagauuuaggcuggaaguagagaugggcagugaugaauacagaucaaguagacauuugagauacaguuuaaauuugcugaacauccagagcagaaguugaagaaaaguauacagugcggauagcuagcucaguauucaguguuugaacaugcacuugggcauaaugaaccaauaaauacugagaguagcacagaaugauagaaugauaaauuugugacuggaauauuuuauguaucaagaaaugagagggauuuccuuccucuauccaggcgucagagaacaaaacagagugggugguguucggaaugucuuacagugaaaaauuaacaaaaaauaagcuuuguuccaaauguucaugacaagagguagacagaccugugcuucuuugugguuuuguacaggugacaugcccuucauccaaaaugauuagggccacaauguuugcaauuuaauuuuuuuuuuuaaauuuuggaauauuugcaucuuugccuuuuccacuuaagcaucccuaauucaaagaucuuaaaucugauuucuuuccagauccccaaauuagcaucaucaaauaguuucagacucuagauuuaacgaagagaggcucagucuauaauaauaaaagacuguucagcuuuguuauaaaauuacugcuuugcuuugcugaguucuuaguuuagccucggauaaguauaagauccucaguuguuuuuaugacucccgucauuguauaagaacagaccauuucuauacccacucuuguuuacugugagccugcuaugaggaauucauugacuagcagacaagugccacugccuucaaguggaggucuaugaccaacugcacugcuggauagacagugacaaguacuuaguagaaagcacugcagacauuagggaagagaugagacuuuuccuuuccaggagaucuggaaagcucuauugagaauuuuuucuuggaucuccucuagcaggaguagguaaaauuucaacuugccagauggcaugggugcagaaaaccugaagacguguaacaaacaagacaguuugccuucaguguagcuuaggaagaguccuaggaaagaagcuaguuauagcuuggacuuugcuugauaaaugaagaucguccuaaaugccguuugaggucucuccagagccuguggguggccugucuauucucauguuaguauuuauguggcuuuucuaaaaaguuugugaaauucagcauaacucuuuaaccuacacuugacuguuuuaaagguaaaaacuuuuccugccauuuucuuccaaguuuuaaugggaaaaguuuaugaucaauuuuuaaaagauuuuguggaccagaaccaugccaguuucuuccacuggguuuccaaacuccauuucuuaccacacaaacaugaagagggccggcagcagccacgggugagcugaaaguguuucuguuguaguccucugaguuucugaaagauguugugaacacaguuacugugauuuccuguaccugggaacguccuacaaaugggccaaaaccaagcuguggccucccagcugaagucucggagccguucugccuggaguguguucauacugcccugcauucuggagugaaauucaaguuagcugauggaaaacguucuuggaugugaauuaaagagguuuuuuuuuuguuucuuucuuucuuucauuguaauguaagugauaaugauuucucuuucagaaaguuuucucugagaauuuaaaacugcuuucuuucagaacagcuuugguguuucaagcuuaaaaaucuguuuuuuaaauccuggcugccuacuccucuccagucccuccaggcaccguugucucuggaugcugcguaggucugaaugccaagaguuaagacagucucccuccuauaaaucaggagacagcuucauuaucaaaguuauguguuuucaccuuaauagauagccagcccuggugcuggugccaggcucgagcuuaucauggaaccaucagcacagagcccuggaauguucuuuguuuggauuauuuacuucuucuauaaacaaagauuagaguaaaaaaugucaguucugggggcccacgcagcaccguuacuagggaaucucagggcacacuacagguucaguuugccacucagcacagagccacccugacucggucucuguaacugacccgaguucuguucugaggguuuuguacaguuuaucucauuuaaucuucucaauagcucuagaagguacuuucuuuuuuucuucuuuugcugaugaaggaaagcaaggcugaaaaugucaacaguauugccccauguggauuucuagucccaaaggaauuugaccuucuagaggucuuuuguauacucacuaaagaauuucuaaagauguagcuuuuaaaaaaauuaguguuauuagacuuucagcugucugucacuaggagaugguuccacccuuucaauuuagauuguuuuaucaauacagaaagacuuucaggagugagacccuguuuucuuaaauaucaggagcucacuaaauuuuaccaaacugaaacuaugcuucaauguuuugaugaucaauauuuuuuuugaaaauuuacauugcagucugaauucaggaaagaaggaaaauugcggacaaucaagccauuuuaagagcaaaaauaccacaaaagcuuaucacauauucagcacaguuuggaauaagugcaguuguagaagaagaagauaguucacuggggcaucugaacuugauuccuauaaucuaaauaaaccaguuauuucuagagcaucuaagaaccuugauucucaguaaauguuugaauuacuucaucuuggaacaugauagcuugccacauacauucauguguaguguuguguuuaguaaagauaaaugaucugucuuuugcagagaucaaacugucagagauggaugaugucaccaaguuaccaucugauagguucaggugauuggugaauccuuauagauucugacuucccuguaaaagcuggcugaguuugcaaagucaguguacacuaauauuuuguguuaaauaaauuuuuuuuucugauucacuacaagguuguuguucuuauugaacuauauuuccuggauggaaucucuucaacuuaguaacuaucacuauaaauauguuuaauggcuuauuggcagaguaaaaauuauauaguguuggcauaugaauagacucacauaauugcuaaauaaagguacuuaaggcauuuauaaaggugucauugauuuauagucuguauagcuguacauauuuacaacauucuguugacgaauaaaacuuugaauaauauugucccuacagaugucagugauaauaaaaaauugccagguauaauuagauaugccuuauguaggaccuuucucccagauuguccuuaaugaggugggcuuguuguuuguuaaauuacagacugcuuaaucucacuuucuuucucuucacuuugucacuuuaucguaggacgaccugguccccauacauaggcagugacacugauucugacugggguaugaucuuguuuucuuuuucuuuacuacaucucuacucuaguauuuuauauuguuaguuuucccaaacuuuuugucuugggaaaaaauagccaaaccucuucugauguggauuguugaaugaugacuuuaaacaggacagggucauccaucacaguggacauguuuauggcacaguguguggaacaggucccugaaaggggagaacuuuguuucaaauuuugaaccucaaauguucucauuucuaacuguacacaaaacuguuugagggcaaagggggcauuuuuaagacuucagauguguguuuauuuauuuauuuauaucccauaugcucuucccccucccagccccucccuuacagagucccucccuccucacccuuuuccccuuggguaucucccuguccuggcauaucaggccucugccugauuaggagaguccugucccccuuaagacagacaagacagccaugaugauugagcugccuguuggcuacauaugugucagggccucuuuccagcccauguaucuucuuugguuguugggucagacucuaagagcucccagagguccagguuuguugauucugguagucuugcuaugggguuccuaucuaauucagggcuuuuaauccuucccccaacucuucuauaagugucccaaccugugucuaauguuuggcuguggguaucuaugucucuuucaguccacugauagauagagccucucagaggacaguucuaggcucuuguuugcaagccuagcaguaguauuguuaagaaugucugggauuggugcuguccuguggcauggguugcaaguuggucugguuauugguuguccuucgguuucugcuucaucccugcauuucuuuuaggcaggauuaauucuggguggaaaguuuuguggguggguugguguucucuucccuccugugaagguccugccuagcugcagaagguggccucuucagguuccaugucuccaauguuaggcaucucgacuaaggucaccugcauugauucuugggagcuuccaaggggcauauuuuauguuauacauuuuaagaaauuauuuauaauucuuuuauacugucuucuauauuuccuagcaaacugugaacagcuagaauuuuuaaugcaaaaguucucuugcugugauagauaauucauuuaaccaucauaugguccuuagcucugcucuugcaaggaagucuucuugguuagguucauugauugcgucucaguuccauaaaugaagaacauguaaggaugugcaucuaucuaccugggcgauuucacgaggccaucugaaaccacccuccuauauuuaugccuuuguuuugcccucugggagauuaacaccaucucguugccaaguggaaccuggagaccaguuccuagccauucuuaucaucagaauauaugugacucuugaugaaaaaucuuaugaaacuggaagagcauuaagcuuuuauuuaaacuaugaauuucuuaacaauucagucaugaacuuugguugaauuuuucuauacaaguugauggcaucuucagaccuauuguggaaaaugauucaaaaaucauaacaaacaauaauauuuauucuucaagucaagguuucacucaaaaagaaacuuacaaggcuuaacaaugugugguuauauauaauguuaaaugcuaggcuuuaaaaggucugaaaauaaaaugaacuuaggaaagcuuuucuuuuauguuaauacaauucuugugugugugucagaguguauucucaugcccucucagaagccaguggugcugcccaccuuuauuguugucuuauuauaaaucuggaguuauauauguaccccuuuguaaagacaugaagggcagagguugauggcauauacaucacuccacuuuuguucaucuugauuuuugagauggggucucucacugaaccuggaacucucuaguucauuagacccuaugaccagaacuccugagaugcuccagucuccacuuccuagugcugggauuagcaacauguacugccacagccaucuuuguauguaguuguaggcuaccugaauguggguccccauacuugcguggcgagcacuuuacccacugagugagcuccuuaauuucuacuuuguuuuugauucagucucucccuaguuccuuaggcuuacuaacuagacuuggcuggcuacucagucacaaaaucugucucuacacucuaaguacugggauuucaagaguauaccaucaugccuggugugugguuuugcauaucaagaucagaugcccaugcuguauggcaagcacugucccgacuaaucuacuccauuagccccuaaacuuacuuuuaauugaaaauuacucauauacacugauuaaaaaauaaauaaaaaaccaauacaauuuuuuuaaagcaaacagaagaauccaauagagaucccagagagaucucuguugguucugguucuggcuuuucuaacauauauuuuaggacauaaaaucaaaaugugccauuuuauaaaaaguaaaaauauuguaaaauaugucucagaucuuuauuucugcacccucucaaucuaccuaguacacaaaagacuauaugcuuuuucauaaguaucagugaccuucccagaggucagagcaauacagacuuagcuuccucuauuuccuuugacuguugauuaccuucaaaucagaggacaaugaagaaagcuaccuagcuauucaucugccccuaaugagaucagcagcugugaaaauacguuucuggggccccuguucaugacccuagaauuuuuauguaccucuagguggugaagucugaagagaccuugcccacuugaugcaauucagauaauuuaagaucucugaaucuaagguuuuauucaccuuuagucgacuaucuguaugcuaaccaucuacacacccaucucaguaaguggucaugagaguaaaaugugugaaaaguguugacaagcuggaaacuaagaguguuauguaaaaggcuggcaucaucauuaucaucggucaagagauguguugaaaacugguuuucaucacugacuccugagguaagauauuuccucuguuccccaagaauucuugaugaaaaaaaugaggcuuacccaucuuuaugcauagcagacucucuucagcacaguuuuuaaaaggcuaaauuaaguuuucugauaaaugaacagugcccacaagaugcauacauaagaugauacacagaugcacauacgagcacaaacacacacacacacacauguguuauagaauuagaguagcaaacuucagaaagcacauacuuuuauaaugcuucaguuguauuugcucauuuuuauccucaugaccucauguagauaauuacuaacuucauuucccaaguaagggaagaguuauauguggcauaucuaguaaaggauggaccugauuuuuuuuuaacucacaauguaggucuguaaucuauacuguuaaccacugacuucuugccuagugaauuguuucagaauacuggcagagucuugauucuauagacaaaaguucaaaauugauuuuaguuauuagauauaaaaccugggacaaucaacagcuguaucagucuguguauagagcacuaguuaauacccaguaucagugugaucauauaucagaagagguugauauauacuacuuugucauuagaagugccuuuuuucaaaucuauauuuaaaauaaucaaaaggcaaucauuuuuccuuuguuugugcugcuguuauuaccaccaauuuuugagaaaugugaucccuugccuagauuugcaaauucauauaaagggcccuuauuugugacuagguaugggaggaugaagcagaagcauguaaaaaguacauauuuaguguuggauacauucuagauuuuuuuuuaaugaucugcuuuggguuugaaccuuuagaaaauuaaaaaaaaaugaacaggguggauuuagaaaguuagaaguguaaauauuaaauaagaaggaaguagcaacgaaucaacugaguugcagacucauuaaacaccuuugguuugggaacaagagcaguuaaugcagacuagagcgggcuuaaugagccacgucacgccugccuggagcuucaguggcugaguaggauuucaaaucaaggugaaaagaaucuucugagaggaagacagaagagaagaggggugauugcccuagaacaaggcuaccaagaugcgacaaggcaaccauguucuucacccgguuggcuggguugaacugucaggcaagccagagcagcugauugacacccuggacuucugaguguguaaauacucagcugagaaauguggucuuugugcuuuuagauacuucugaguuuucugaaggguuuuguuguuguuguuguuguuguugauguuguuuggcuuuuguuuuuguuguugcuuguuuguaugaaugauugguuguuugguuggugcuaaagauugugaccuagggccucacaagcaguguacacaagcuuuaccacuaagccaucuuucgauguuacugaaguuaaacuagaaugacacagaucccugauuucuggcauccuuuaugauaugcacagcggacuauuggagguggaagauccaauaacagaacagccuacccaacuucuaguuaaaccauuuaaagagagguuguauuuauuuuauagcaacacagaagggugaauauaaaugagcuugagauacagcaauguggcgaucaacuuagagugauaguuaaaaugcuaggcuacuguaugauaauaauuagcuaaugauaaguuaguggaaaacagcaaaccaacuuccaccugacuucaaaagguugguugguuuguuuuuacuuuaucuaggcuucuuuauauuaagacauaccuuggaagauuuucauaauaauuaaauguaaaauauuaugggaaugguauaaugcccaacaaaugaccagaguucaauacauuuuaauuauaauuauuaguacccacacuuuauguuuauguguuguaauaauuauuuacacaauuuauguguuguuuuaugaguugcguauugucuaggaucaaacccaguaucuacccagucuucuacuacugagucguaccuucagcucuaucuuuugcauuuguucuuacuuaauguguaccucugcaccucugguggugaguagguaggguaauuguuauuaaugaaugaugucuuacgugugugcagcauuugcagguuguguauuaugcuguauuuuuauauuugauguccagaagcugagggaagaugauuugacacuuacauccuugaguguaauagagaugggaccauaggauuuggaaucagugauaggguggaucuagggccugcucuuguacucaguuaguaacaugugcuuucucagaaccaaggcucguaguucaaaauaauggaaaacagagugacugcuuaagaguccaaccccacuuguagauguaacugcuguuucuuuccagggucugcccuuuguccuacauuuuaggauacgcuugcccaaccucucaaucugaacaacuucuguucaguucucaacacaaguaccacccaacccagagagccucugcauuugucucuucacaguucccauguguuuccaccacgacacuguuacccuuugucauccguuauuuguuugcuguuuguuugcuaucucuuucuucuaccagacuccggguuccaggggaacagaagaccucgauucuguuaggucuguuagguuguacauuuggcuucuagaauaacauacacuauauauacuaagcagucagcaaaugugaaguugaaaacaaagccacgaaauuaagagaauguguacuauuuggacgccugucagcgaguagaaugccugcuuuugcugauggaguuacuggcugacauugaaacucucacuguuacacuuucaucaucuaagucagugguucucaggggucacauaccagcuaucccgaagauaagauauuuacauuauaacccauaaccauagcaaaauuaguuaugcagaagcaaugaaauaauuuuaugguuguggucaccacaaugugaggcacuguauuaaaaguuguguuaauggcaugaugaagguugaguaccacuguucucaggguauagaauaauaauaagcgguccacugaaagguuuccuacgaaaauaagaugcccaguuuugguuuuagauguugguuucccaaugucaaaaauuaggccuggguugaaaacugggcauuuagggaucuccugcuuuggagcuuugaaaugaguagagaaccgcuagccguccgucuccaagguguuauauucaaaaugucuccugggagcuagcuagcaggaacagagucugcacacugcccccacugaagaguagguggaaggagccggaucucuggaucauccuggcuucagaagaggagcaucagguaugucccuugccuguuacugaugguggcaggacuauuaauucagugucgcugaugugaccuggugcucacuuuaagucuuuaagauagaaagguacuggaaacaaaacuccacagauuuuaacaugcuaaacugcagggauguggggguuccgugucagguugaguggcugcuugaaugucguguucuuaucguugucuaggaaucugcagggcucaguaagguuuuccuguuguugaggcagcucccucccccuucguuaaggauguggaucuccuacaucucugauaaacagaagaaaaacaugcaccuggcuguguuguugccauaaauauucagaugaugaaaauucucuuaaauauuuaaagaaacugccgagcauggcuuaaucauuuuauugagagcucugguuuuaaaacuuaaaugucuguucuuaggaaugaagccggcagguuaaacugccuuaaaaauaaaguggcccacaguuggaucguaaaaucucaacugacauuaagguaauugugcuuaagcacaauuuagggcucuuuugaauguuuguuguagacacaauaaugaugcuauuuuuaaucguuccauccuggcucugaagaaauaaaccuaauauucuuugugcauuguguccuaaacagaaucauuuuguggagcagacuaugaguacuuucuaugucuuaguaaaaauaaggaauuauggauucugguaccauuauguuuacaaagaaaauaaaacaaaaccucauuuucuucugaaucugacacuuccuacaagggacucagcauuuuuaagaaaguauuuuuaaagacaggauacugugugacucaaacuagucuucuaccuaguuuauaugauagaagggcuugauccuagagccacauauaugcuaggcaggcauuuaaccaacuaucuacagugacucccuuuugauaaauugaacugacuugauggcugacacccuucagucuucugggcgccaggguucagcuaugcaggccccaucucauaugcccuagguagccugcauuaaaccaugauagaaaugugaaaaacugcacuuacuggauaaauggagucaaaccagaacacuuuggccccugugagccaggccugugcuaaauucagccccacgugcuacuuuggcaugauuuuaaaucucuaggcaagacacauguucuauuaaugggggauccuaggaacccuuuuguuggucagauuaauauucgugucaauaugcuggagguuuugaguacauggucuuauuaagcccacaguagucucccggcuuuccuguccccaauccuaagaguggauggcacaaccucugcaguagggaugcccucccacacacauggagcagaaaaagaaauuuuuccuuaucuuauaagccauauuuggggacccuuagucugauuuucucccagcuaccauguuagaacaggcaaguacaguaggauagcccuccaguuguccugucuuggugucuggcaguacucauggccugucaccaccuuacagggggcagagacacuagugauggucacucacuacucugcucuccagccugcagauuuccuuaccacuccagcugcuuauuuccuccugcuugccucccauucccaaaagcacacacuuacugagaauucagugaccuauuccugaguggagggaugguccugaccccuucuguaugggcugccaaaauuuugccccaaauuggaaaagaucccucugaauaacagcccaaguccccuaaggauuucccuucucauccccuagagaugucuuuccccaucucugaucacacccucuuccuucugccucuuaaacucuuccaacuucagccauacuucuucacugcuauuccaucucccugaaaugcuuucccuggucaccagauugugacuccgaaguccucuugggacugaguacauuucuggcuacucuuaucugaugguuccagccucucuuucccucugacauuucaaauccgucaccucauucuccacaugcacaccacagcaguccauguuauauguaguguggguuggguugguuuguuuuguucaggguuuccaguaggaccucucuuccucagggaaggggcugcuuuguuuuguuuuguuuuguuuuguuuuguuuuguuuuuucuguuucauucacuauuguauccccagugaccagaacaaaacacaaagcauauggucaauuaauacuaguugaauggagagcugaaugaaguuggcuccugacugcccguucacucuuauggcucaucaaacuucuucauauacuacaugcuccugucuaaucaaucuaucuccugacucuaaacacaccacaguuccucacauccucugugccuuuuacuuugccucugugcugccgagaagagcauugucacaugcuucuccucacucgggucagcugagcagagcagucuugugagcaucuucuacagagagcaccagugccguuugcuggcauuguaccaauggcagugucuugggucuaucuauugcccagaacauuaaaacagagaagcugggggggggggggauccuggcuuuguuuuuucaguuccauuucuaaugaaggaguccccuaugugguuauuagcugaagaagggagggaaggauauuaguucagagcuguaguucaggauuccauuucaacuguguauguguagggagugguuaggaaaguuguaaaugaccaagccauuucuuccuuuuuauacauacucauguauaauuagaaauuuuauuuuauucauuugcaaaguagauacauucuuacuauguaguccuaaaugacaugaaaaccucuguagaacaaguagaacaagcuggcuuuagcucuccucucaagugcuaagauuaaaugugugacccaccauacccagcucauuuucuucuaaacauuuaaacacauuuaaucuuacaauuuaaagagguauucuaaguuuauggccucuaacuucaaguguugaacagaucugaacuuagucuaacuccaaaauccauggggauggccuguucaggaguggggugugccagucccuggucugugaaucuucuuuaagagucagacuagaggcuucaugagugcuuucucugugacacuccagaguucuuuccaaagaggacuuagaauagaaaccaaacugacauauucacucacucacaauuucuguuacaaucuuuuuaagggaaguaaaauuauacaaagucaaggagcuguaaaucugucucagcaccacaguauagaugaucaccaguguccauguuuguaauagcacgguaauguucugaauguuauuuauacucacaauaaagguugucuucuaagucaugccuccagaaaaaaaacagugcucccauauucaguugacuguucacucacuguugcagguuagccguggagacuuaaccacaguuugcuaagaaugauuuguaacuaugcuuucuguccaucauuaauugaggagacauuccagacagagagagaaaauugaaugcauuuuuuccacuucccaaagggugggaguucugcuaguuaguuacuggauaugugauauguauuccuaaacgauaagacuaugcauugcaugccuucccaguggccuacacaucucagcaggagucccuuuccuacuuuccaggucguuaaaguaacucucagaaugagcuucuguuguuuggagaacaccauuuaggcugggaaaucaccaaaacaaacaucucacacauuuuaagcauuuuauauuuaaaauauauaaaccuguaggcuggcaagauggcuugccugguaaaauacuuguugcuaagucuggucacuugaguuuaaucucugggacccacauauuggaaggagagaacugacuaacacaaguuguuuguuacccuccacacacagccauauauauauauauauauauauauauauauauauauauauauauauauacacacacacacacacacauauauguauauauguguguguguauacacacacauauguauauacauacauauacacacauguauguauauacacauacauauauguguguguguguauauauauauacacauacauacauauauauauauauacacacacacaauguguauguauguaauaaaaauauaaaagugugcaguuguucuccagauguuugagauuagccaccaacgcuaaguaagagaugguuguucucaguguaguucugagcugacuucuacauaaaucacaaccaugguguauugagaggcuuuugccuuugaguacuauaauguaaauucagaacuuagacauuauaacugguuguuagcguugggaccugucuugagguguuucuuuguaucuuccuaggguagaauagggcacuuuuaagucuagcauaaccuugcugagaugaggagcuaugaaaugguuaggccauguuuccugaccucuggauguuuacacuaauggaaaagggagaugcguauaaccucccuccucacucuuucccuucaaaucugauguaaacuugauacaagucuguauuauuaaagagcuguaguauacuuaguugaaacuuugaaugaaagugagauucugcuuucuuaagaaugaagggcuucuugcuuggagagguuuuauuugaguuagacacuaaguuagauaugguuugguuuguuauuggaagaaaugauauacaugcuguuucuuuugcaaaacauuguuuuccuucagacaaaugagaaacaguaguguuguguucauaauguaggcauuaaagaaacagaaacuucagcagcauucacaggagugaauucacaccagugagucaucuguggagggaccugagaguucugagcaucucugccucuucaaccacuguaucugagugcucagauuagaaaaauccuuuuaaaaaauagauuauuuacauccaaaaugcugcucccucccccaucccuaccucacagagucccucccccauccucuuccccuucacugagaaggugggacuccccugaguauccccugacccuggcacauccugucccacugaggaaggacaaggcagccuucugcuacauaugugcagggugcccuccagccagccaguaucugcuuuuugacugguggcucaauuucugagagcuccuagggguccaggcuaguugacacuguuggucuuccugugggguuccuauccuuucaauccuucccccaccucuuccauaagugucccccacaccugacaguuguuuggcuaugggucucugcaucuguuuuggccagcugcugggaagagccacuuagaggacagcuaugcuaagcuccugucugcaaguauaauugaguauccuucucaacacucagagcuugcaagaaugaguccuuuuacagguuucucaggcccaccuccgugaguuugucuuugaggaagaaagugggaaacaaaauaacagccuucaaggauaaaugauaggguuuaucuuuagcaugcuauguuauggcauguauguauacacucuguguguguguguguguguguguguguaacaugcauguauaaggaaaaugaaaacugucaggauugguguaaaacauagauuggauuugcguagacaccaguacaauauggugcuccuguccucaguggcugauuuccagaaugcuaaaguuuugcuguaucuuaaaacuauugucuuuucaaaguagauuaguauuauuaaaagaggccuguuuguguaacacagugaucacuagcuacagguuuacuuaagcuuaaauuaggcuacacacugauuuccuuagcggcagaaccacauaucagauauucuguaaugaggagagcagugcaguaaaggaagagauuuaaaagacuuacaguagaaaaaccaucccaugguaagaaaaugcuguaucaucuaaaacauugguaacacuacuaggguacaucuaacacuacuguuuuugcuaaaugaaccaugucaauaaaauuaaaucuaacuguaucucuaccuuuguuacuguuguuccuugaaaacuuaauuaauucugugaaccauguauuugugauuuccaaugcuggcuuaaaaggcucugugauaaucuugaaauuuauaauuuuaauguaaaguuuuauaccaaauggccuuuuuuaaguuacugcagaaaaccaaguuaauaguaauguguaaucaugauuaguuuauuuuguaauuucugaauuauucuacuuaugauucugauagaaaauaaaauaaauaauauuuuauuuucuugcuauaagaagaccuuaacccuguuuauaccauuaccuuuaauuguuuuuguuggcuuugggggaagggauagauguuuuguuuugcuuugucuuuaagauuuugauuuugaucuaguuuaucuucauucuuugauuggcuagugauugaguguggcugaaugacaaauauuaggauucaguuauuaugcagacacuuugcauugagcauuucuauuuuacggaagcauacacuccacacaggauggaaaauguucuuucaguugcuuauuagaagacagauugcccccacaaagcauuugggucaguagcugcuauguagacaaagugugauuuccuuaguuucugccuuauucauguaggcucacacaaguuucugcauaguuuuucaguugguuuuaaauguucugcccauguucucucaugguaccucagggugccucguguuaccucauguuaccucaugguaccucauguuaucucaugguaccucauguuaccucaugguaccucauguuaucucauguuaccucauguuaccucaugguaccucauguuaucucaugguaucucauguuaucucauguuaccucauguuaccucaggguaccucuugguaccucauggugccucauguaaucucguguuaucuccuggugcuaguccugcuuucaguacuguugccauugguuugauuauuuaaagagagauauuuaaaguagagaacaggcuaccuaaugcauguuuauuuuuucauauuuuugaugacauuaagauauguuagguugguaagaaaagucucuuuugaguuugaccaaaauuagaaauaaccauugcagugauuuuugagcuauccuuaucaaaaggauauaccuuuaaucuaaguaaaggcaagauggugauuuucugucagauaccgcuuggauaggugguuuguagcacaaaggaaaaauaaacagauccaaagggaagguaguaaguagggguacaguaguuuugccuaguugaccuguugaauauuuuggcauugaacccuuuauuuuaaaugcaaauucuguccuguuucuccauuggucauggcaggcgcauggcaggaaguggauucuucaugcuucagagcugauuuguauuaggaaggcgaaauacgcacgaaacagaaagguaucuuauggcguaaucugcucuguuaagggaugaggccaauguaugguuuuuggagauccaccuucacuucaggaaaucggcuucuagucucaugcagccacagagaugccaucagaaccuuccgauugaucaaaguuacaguuucugaagacagcuucucacuuucuccuccugggaauuguugcgguucagggcucucuuuggucuuauuugagugguauuuuaccagucagacaaaauaauauucaacuauuaauaucguucugcuaaaacaguuuagaauaaagauuuaauguucucuuuucaaugaagagccgugcccaccgugcaggacuguaauaaaagagaaacaaaugaggcagcucaaaguuauagcucuccauggcuuuuaguacucucauacauuuuuauaaaacauauaucagaauucugagaguaaauggguuauuuuuaaugcaauuguauucagauguagaccggagaguagcacuguccuccugugagauuuugcucuaccccagcaaauagggcuacuacugcacuugcauguccugcucuuuggcuggggaaggacaagugacaccuggugagcuuccggugaucuucaguaaaucugguucagccccaggcacagcuucuugcccuuaggcaggggaacagagcacugcuuuccuuucuagucuucaaaacaggacguaggagaugucacuucaggaucccuccccuggacuuaacaggacguaggagaugucacuucagggucccuccccuggacuuaccaggcuaaaugagauuaaggaugucauguggacuucccacacugguaguuggcaccucccccaccccauagaaacuucggagaacuuaaaauaaauguuuauagggaugagcugugccaaagaguugaucauuuggaucagauuggaugggugucauuucaaaaugauuuuacaaaggugucuuuccauagcugugagguguugauguagggagguucauauaaaaguauagguuggaaacauucucccuucgcaagccugagcguuuagcccagcuucgagugaaaaauaggaacacgggugccucuggagcaggaauggcccugugguuucuaccuccagaaguguaauugccaucccaccacaaagaaaugacuggaauuuaacagcaaggucuuccuccuggcuucuucccugcuugccaaaugagaguggaagagaccaggaagaccugagcuagauggaucacugugguagauugauuugacggcccuggcuuccuuacauuagagaagccgucccuaaaagacauuagccucccagcagagagcagguaugcaccaugcaggaagguugccaaggucuucagggaaucuugagugcuuuagggaaauuuauuuucagaaggcucgaacaagauaagaccaggagaagaggggaacauggaggaaggugggaaagcaaagaagcgggugccucucccugccgguacagcacguccucagcaaacccagaagcaaaugguuuccuuuuuguguaucuugggaauggugugauaggugaggagagacuucuugguacaugguuuuuauuuuggcucgguuugauuaggguuuuguuguuauuguaaacgcccaucagcauguaguaagcccgaugguaaaagauuuaucuaagcaaggggaaggcuuaagugaguuggagagucauugacuucucauggucccagcuauggguaagccucuuuuucuacuuuagaacaauuuuauuccguauuauuaggaacagcaacuuaguccaaagaaggacuuccugagauucucucagagccaacugaauugucaccuagguucacacacaaugggaaucagagacacugccuugcacuggcagguguguaugugugugugugugugugcgcgcgcgcgcgcgcgcgagcacgcgcgagcacgggugaauuaaggcacagcauuugaaaaugucuuaggaagcacagggauagugaguucuuuuuuguuaggggacauuaugaaagcuuggcaggccuccuccccccucgccccugauauuguggcuauaauuauaaccucggggauauuguguucucaaacaaacauucaagcucccagauaccagguugccugaagccaggcaucgcauauggauguguauaacagugccucuuaguaaucacccuccucacuugucauuggccugcccucgcugacaguggaaaugucuucauaggcugugucugcacguugcuuuuguucauuguagguauugucgcgucuguuuuaaacaaugaagguccuugaacaauucgcuugagcgccugaaaccaagcucaugagaagcugcacacucauggcacuguguacucuccuucagaaauuucuucaugcugaugcugugugccauuggaaucuggaaucauuacaaaaaggaaaauuagauccacuugcauaccagccaacucuguuuuuaacacaugauuauuuuauugggguauacauuaauuaauccugaaauagaauccugugugacacucaaaguuguguugaguagcucagaguuuaaauauuuuaguuuuacaacucuguuauguuggcagccaacaauggugucucagugaagccagcauaugagcccugcuugcgaugacaucuggaaagcuuguuuuaucuauaagcacaguuguagacaaaugaaagcagacagauguaaggcugggguggcaucuuugccucgagcacucucuggcuguacauuuuccagugugucaaaaacagggagcuuuuugucagggguggaauaaaaacauucugucacauccguguaccagcuacugugcugaauuuccuaugguguaaaauugcauaguugauucaaaaauuaacaggaggaacaguuaguuaauaagacaugccuacguguaacgggaacuucucaccaaggcagagaaagaauuuguuauuuuaugaagacaaucaacaaccacuuucuccugggagagccaggcaaaauauaagaauuuggcuagaagguagcuaggaguaccagcuaagauuuuuuuuuuauguauucuuuauuggacaagauuuauuaagcaucaacucuguacagaguggcauauguagcaguuugugcuucuguguaggaugacgcucaaagaugugcacugaauucugggagccaguggcaucucuugcgggcuguccucaagucuuggcucaggggccauucuuacaaaaauuuauacaaggccaucuugccuuucuuccuacuuuguuuaguuuaucguagaaauaauuauccccugaaauaagaugcacaugcaggcuuauauacuuacuggcugggauuuggguuaaaacagauucuguuugacauucuugaucuuguaauagcaaugggauuaguuauaccugcuacagggugugaaaugaguauuuucaucuccagggauuuauagcucccuguuccauggcauauacugcauacaccaugcaaccauugcuaauuguuaugaaauauguuucacuaaaaguuuaggaagccuggauggaguccugcuuagcaucuguuuaaggacuggguuggcugcucacagccaaaaccacauagcuuuauaguacuggagucuuguaucugcggaaaccaugcagauacauauaauuagagagcagugaaguggagggauuggagggaggggaagagaauauagggaaaugaaauacagucagcugcaugugucagggcauacgucucucucgguucuaaccgcacaguguaauugucaguagcccaaggucuuugagaauuuucauucucauauucauucauucauucauucauucauucucucucucucuccuccuccuccucuuccuccuccuucucaucuuccuccuccucccucucuuucuccuuucuuuaacaauaaaguugcauugugcuguuaagggguugaacauaguucuccauuuccugccccauccccacauaccauuaucagaccuuucagagugcauugugccgugacccacugagcccugguaagugccuuugcauguucaaaacgaugcuuuuuuguuuuacaugcgguuaggcaugguggagaaaauauauguguaaucgaaaauguacagcaaauugccauuuguaccugcaaagacugaaaggcccagucagauggacccacugguguuagugacaccugaguggacugauguucuggcuaagcagagcuccuggaccuucgccugacuuuucacuauagcugucugaagagaucagugauucucucgcuguucucugaaggacucgucugaccugagcgucccagacccugaagguuucaacacugagcagggugauugcucugaguuuagucacugaaauuugaaacauagcaggagucuucccaugaucucaguucugugagauagcauuggagcugcagucaacugaucucauaaauuaucugcagccauagaguucagcagccaggacgauuucacgucucaucauccuucuugcuggucuuaaugaaugacucuuuagugaagagucuuggagucaguuuuugcagucuguuucaucagcaccaacuuaaaauuuaaauuguuaaaauacagacccuaaucccuucuugugucacucuccguagaggaagugauuuggauuuuuuuauuuuuuucuacuuuuuaguucgaguuucuagugcugagucuuuuagacaauuuaaaaauguuugccaacacuguggaggacacagugggauauaacagcaaggacugugcugauaccaauuugguuuauuuauaaguuaaaugauucugcuaaaucugccacuguauuauuuagucaucuugauuuaacaagaaauaucccuuaugaugcaaucucuuagaagacuaucuuuggacuagaggaaaaucauucucuuaggaacauuaaaaugaaauuauggaucuguaaugcucccauggugucaggaaauacuaauuugucaccgacauauauuaauguuauauuauuguugacuauuacuagagauaauuuucagugucuaguauguaccacauauagugcuaagugucuuaccuguauuuguaucuaauauuuauuaaguguuccauauagaaguguagaucauuguuaaugauucucacaguggucccauggagcaacccugguguuccacugucaccuacucucaucaguuaggacagagaugucugcccuugcauauacuccuugcauguggacuauauuuguuuaggagaggaaaauaauuuccuuuucaguguugacauuuacagccuauucaaaauacauuucuaaauauaauacauuugguauauuuuugcacucaacuuuuuacuaguugguaaauuaacagcagaucagcaguggcagugacccucauccuagauuuugcucaggcacagagaugaagaaagacaagucagucugugugcuuuggaguuccuggagcuggaaccccacauuguuccuugugagcccuucacuuugcucugucuguaaaaugaaggugauacuauuaaugagaccuauuugaugaaaauauuacauaccuugaaagagcuaaacuauguauaaaaaugguaccugccacuucguaaacauuguaugaauauuagcugcuauaauuaucuuucugguaauaagaccagaaagaugugggacuccgcuuacaaucuccagagguuagaaaacauucagugaaugucagcgguaacuacuauuccaaagguuaaacuagcacagcuuacuucuguaggcuaaacuguuauaaacagcuaaauaaccugacagauuguuaacccuaggugcauaaaggauuuaaaccucaaaauucaagccgugcuguauuagccuaaacuuaacacuuggaauauugguaucugugcuuuuaaaaaugacugcuggucuagcgauacaagaaauuguuccucugaaauugucaguuauacagcuguugucugauacuuaccaauggaaacagaaacuucuaagauaauacaguaacuuggauaauuguagaauuuagauguuauauaucagagugcuuagcauauauuucuuucaacuuuuccauauauuuguaaguuuuaauaacucuuagaaauacuugacacucauaaccccucauauuggcucagggaguagagcaauacucucugagcuagaagccuuuucugagacccauacucucuguccugacccaugccaaacacaugcccucacucucccaaguaccauuuuagccacauuuggaacaauguuuccagccacuagcucugucuauugaggaagccauuguuuuuuaugacuaggauuugcauuugugugcuggucaucuguuuaucauugauaccagcucuucuucuuaaucaaagaugccaaaucuugaagaaaacugucagugcaagggccacaagacaguuacuucacuuaauggcacuuuucacggugacauggcuucugugacuuccaggcaucugccagcagccaugcaguuaauguagagccuauauuuucugcagauaauaugcagcuguguauuugauggucuauacucacuacaucugucacuuuuuugaucuuauaauugggguuaaaagauguuuuuaagcugaaaacucccuuaugcuaacacuguucauugaagaauaaaaucagaaauuggguuauagaugacaucuaaggaaaaggcagugucuuguaacugugaggcauaaguaucaaguugaaaacauuuguguucucugucauuuaugucaugugccuuuuaaggaaaaagcucauugcgguaacauuagaaaguguuccucucuucucacuccaggcccugaaucuuguauugaauugugggucugcugcugucagcugauuuaguggugaggucuacagacaagccagucagugaccaaugucaguacuuggucucuuugcaucuccuucagacauuuaagggcuucacacaaauugggaagcagaccaauccuuuuuaugccuccaaggagucaaggacagggagacagaguuuaagucagcaaggaaagacuagagcccaggaagagccgagccguggguaacgagaggaauggagagcagagccgcucggaggcagggcagguucugcuauuguccagucauuuguuuguagggaggcuaaggaggcagggguucaucugggucuuugaggugauaguugcucaguaccuauaacauucagauaagguccaggaacuucccagaguagagaagagagcuuguucuaggaauuaaugaaagaguaccaauuagucuugccaugucuacucuccagaaacauagggaugauccaccuucugggaauagcauaagggaacucaccuucgggauuggcguacgaacagaauuaaaauugcuuucauuuaagcuuggucucacuaugcauucauuccuuuucuguugccauguuaaagauaccauaaccaaaagcaguuuguggaaggaagaguugguguugguucagaguucccuugugguaagcaugacaccaagccacaggcaugguagcaggagcaggaagaugagcacucacauugucaagaguacauagcacagcccggcuccugaaacccauuucuucuagccuggacaucucuccuaaaccuucucaagcaguaccaccaacuagggccuauggggcccauucacacucacacccaccgcuacaugcuguuuagcucuggcuagccuagaacucucucuggagacuaagguggccuugcacuuguggugguccucucacaucugcugcagaaugauggccuacugucguaugccacuauaccuuccuuagaguuuugauuaaaauggaaaguuaguuaugaugaggcugauauuaaaaggguauauguacuuauguuaacaucauuuuuauaggguuaugaggugauaauuuagauccauaaaauguuuccgagaagagcucaggguuuucagcauuuuuuggaacuacaagaaaauaaugcagaauuuuuguuguucauugcuuguuuugggaagguaagcacaauaaacuaaccuuuaaaacaagcuuauauaacagaucaagaaaauacugcaaaaucacucccuccuuuugguaaacucucugauggucuugauaagacuagccuuacucuuucuuguacaguguaagucuggcuuacuauaaauauuagguaaagguuuucucauaucuuuagcaaggaauauuuuucuugaauugcuauucugcccagcacuugggaggcagaagaagcaaggcaaucuaucugugaguuuaagaccagccagugcuauauagugugacccuauuucaaaaaagaggagaaggcaaaagauagaaggaaagagauagaaaccaaauacuagucauggaaggugcuagaaaagguuuaagacucaggagcugaaauacuuuacuuugcacauuuuagaacuuuuagaaaaauacagaggacaggauuucaagacuaaaauuguacuuauaaauagcaacauagacuugcaggaauaugacauguuuaguacgaauauuggguucuccucugcuaaacucucucauuuaauaccuacuguguggaggacagagcuuauagguuacaaaugacaguuuauuaugaugaguaagaaagaccugugccuccugcccucagaaagcucagagauuaaugggagauggugacaaaucaaacuucaacaguuucuugaaaagagaauuuacaaagcaguaaauugcuuccucaaugaaguggucugugagcagagaucugaaggaggaguugccauuaauuagggaaauaguaguaacagaagacuagaaccccagugcugcauuccaggugugcagggggagacucaucaggccuguguuuggguauguguuugccuuuugugcucugcucugguuuucauaguccuuccagaacuugccuaggauaaccacccacaggagaggaugugcaguuuccauuguaaugaaucauaauccucuguuauuuuaugugaugaaaacuaccauuggcagucgacauaguagaguaucccagcucugguggcagagcuuuaggaggaagcucugcccuuugugaaugguggaugaagcaaaccuguugcuccucagauuccuuuucaggcuguccugaguggggaguugauaggagaucucuuggacaugggaguugccucacuguugacagagagacauggcacauuugauuaaauuaaauuaggagcauguguguguuugaaaaagcaagcuaaugaaggaaaaugcaucaaaaggauuuauggugaauugauuaaaauauuuucuccacagaaaacccuuccagcuuagcgcuuagaauguuaaggcuaucugugcagcuaggcccuccagguucucacuugcguuuagugugcaucugggggaccuaacuucccuuugagcauccgcuccuucuguagcauacucuguugcaggcaaaaguauucccaaccugcaaacugaauugcauagagggaagaggauaaaagacacuauuugauuuauuaauuucuaguggauuagaacuacaaauguuugcuauguuuuuaauuugagaaguagagagaaucacagcagcuuuuaauuaugcauuuuguguaaugcagcucugaauagagcagaacaaaauuaaaauuguggaucaaaugcuaagucugaguggaugcuaaagugagcuguaguguaaugcuaauggcuuugcgucuuccuggcaugaugucaauacuggcucuaaucacauuaagcacggagcccauuagcuuuuucuuugcagcagcgugcauacacaaagcaacaaacugcgaguucuaaaguaacugacuuuuaaaaaauucccauguucaggcuaagaggcaggucuauaaccugugcacugugagaguaggugggucuccaaugguguuuguacacaauauauucuuuaucaguguaggcagauuaacugcaccuacuauuaucccuggaauaugcaaccuaaugcucuuaucuucauaaacuuaauaaacccaugcuacuuucacgggaacaaaguuuuucuggacuucacuauggcauaaaaucagaucuugucuaguaugguaucuagggagaugaaagggcuuuuuaauauuuccuuggcucuuaaguggcaugguaucuucauucuuacuuuauguaguuccguuucuauguggaagccggaauggaaaaaucugauugaaguucuuuggcuucaaaucuauucaggcuccauuuagguagcacauucccaaaaugagcauaccacaugguguucaucccgggguuucccagggucugggagaggcaggaugaguuguuucacacaggaauauggucccuaucuuuaaacugucuaccaauucagccuuuuuuuaaguguaacucaaaugcauugcccuuuucugacguagucaccccagcaagauacauaagaguggauuuucagcagcugugauauagaaaaguuuuauugccaaucuguguaggauuggacucauuuuucuucgcaagccuucacucuuugguacauacccagagaacacucagucuacagccuugcgaacuggagcucaguguucuccaucgugucugcacuaacugaucacaaaggaaaggagugcuuuagcguuccuucagucuccucaauagucguugaaucuguccccucuucuuuguauaaucucauucucuccugugauucaugucuaacuucccuagauauucccuuuuuucuguugcauuaugaauuuuuaaaaagugauaaaaauuauuccuauguagauuuaaucucuuuuccccaaguauuuauuuguuaggauaauugcugcuaaguucuguuuaauugcaaagguacacugacuugcuuacuuuuuacaguugauguuguguauguuguuggugcagguugcaagcuacaguuaucuuagaacuugaaaguaaaugcuacuucaaaguuggcuaucuucucuguuuaucuuugguaucaaagaugaagagaauuuggagggacaucacacaaguuuuuaaaugauucagauaagcuauaauaucacacaauugcucagcaagugguaggacacucuucaguaagucugaaaccuuuugaguccuucaucaucaucauaucuuaaugagacacuuaggaaugaaauugaaaucucuuuugaguugggcacagaguggugaaguaauugcccaaguguucucuugacagacguugaacuaggacugauuccagaaagagguucucuuucauuuuuaccuuuuuaaaauuacuuaguuccuuaaagggauucuaaguguaccuuucuauagucaugcugugacauaaacuucucagaauauuucaaguauucuuguagcuguuguguaggaucccuucugaggaucaaaggucugaaacggaaucuucuuuugacuuggggucucugguauccuacagcaaauguccuuaaaaugauauguaucacaugcugggaccacuucaugggaaagcagacguaguugcucagcuggcuccagaauagcccccugaagguguggauuccaccaguguuucuucuggguccagaucugccuuagcagucugcucuagcugcauuggcugcucucugcagaggacuccuguuggaguccacacuuccagugucugugacauauccacauuuucacauagccaucaacacuugaugucuggaagcguucucugcaaaucuauaucagcagggcuaucaccagauacuggacucuucgacuacuuugcuaaggaguugcuucucauaacuacccccucccacuaaccauucauuuaauaugcauuagcaccuucaaagacagaauucuguggcauguccucugucuggucuacauucaauaaaauccaauaaaauugguacuaaaaaauguuuuuuuuuaaaaggaagggacauaaguuaaggcuaaaacuuguauuuaaaacuuguuuacggagggauugauuuuaguuccuuaaagggauucuaaguguaccuuucuauagucaugcugugacauaaacuucucagaauauuuaaaguauucuuguagcuguugucagagucccaugaugagaaaagguaggaucccuucugaggaucaaagaacuugaaaguaaauguauuuaaaacuuguuuacacgugaaggcuagaaacuggugcaggacuguggguaaagggaaggcagccugaaagagauaagugacuuuuuuuuuuaccuuugaggcucacauggucucaaaagaaugcauacaaccaacagcccacaugaagacaaagcucucagcaccccaguagcaaaaaggcuaaguagcaaauaauuaauuaaacaauguauuuuaacuagguuucuauuuagucagcagcuugucagcugccuaugugcugggcguuauaaacaggaaagguuacuauuucugcugccacacagcucaguuucagagcugaucuuuguguugcuggagauaaggacaaacagaagcuaaagagugcacuucccauucagaccugaggcugaaacacggcuguuaaacucuccaaaccuuagcuugcacacacuaauaccuacuucuaggaaguuguugggaaaacuacucaaaaugccauauauaaaauauauagugagauaaaucauaggaagaaaauauaccaaaaaaaaauguuggcugguguuaauacaugaguaagaggagggggucuucucagaguagcugggccaucagagagagcaucccugaggagcuaagagacguuugauguacuaucuaaaggcagaagugugaguuccuuaggacaagaugcccugcacacgcuaacagaaaggcagucaauagcuuagaaacagaaauggaaguguguuccagaaccuuguggacagaugcuccuggaacauaagaagguaaacagggagaaaacacaguacauggguagucucugcuggagggacuuguuaccuguaaagaggugucuugaguuuguacucugugauagucaucugagugccuggauuuuaaauagcccauugagcugaaaauuauagguaauauuaaaucucugguuucuccuugucuuauuucaaucuuguuugauauuguaagauuguauauauuacuucaguguaauauuauacacacacacacacacacacacacacacaauuugaacaugauauucagccagucacccaaguauauacagcuacaguuauuccuauggcuacuguauauucugauugacuucuguuuaaauugacuacugcuuggccugucccauaauuuaaagccuuuacuaucacgucuguaaauaaagacacccuaacaguguugaguuaguguguugucaugacuggucagucuuugggauaugcaaaguccuuagagaacuuuggggaagggguaagauaauuaaaauucuguuagaauuucccuugaaucaccaugagggcuuggugggcauuaaagaagaugucaccuccuagucuauguaaaucuacuugugcaguucaugauuuagaaacacuaccacuggcuuugauggaagacuugggaaaaggagcaagcaugauauuuuaacguuuuaaagaucacugaacagaaaggauccuuugaauuuuuaaagagacaucaauuggaacauacuacagaaaaauacugaagcacaaaguaaagauucuucuuuguucaaaauauucagagaaaguacaucugcaaugaugccucggugauuaggagcauuggcuauccuugcagaugacccugguuugggucauagcacccacauggcaguucacaacugucuuuaaguccaaugccagaggaucugacucccucuucuggccuccaagagcagcaaucgcacacuuauauacaugcugagaaaacauacacauaaaaaaauaaauaaauaaaccuucaaaauauucugaggaggaaaguggguauguucgguaaacuagaaguacucacacaugucgaaguacuuaacacuaagaacccagcuggcagauggcaucugcagugcuugauuuaagcagacccaagacacuggcccagaccccugacagucuagucuggagcauugcgcuucgcccugggcacaugcauaacuguuaccuaucuguguuuauugguuuguugaucuuacaggguuacuagcuguuaccagacucuacugccucaccucuucucgucuuucuccacuuagcuuuguguucuugaguuaagaauucuauucucagagagguguuagaaaauaauaugacauugauaugugucccuuguuuguggggaaaaaaaauggagggauuucaugguaauuuuugagugcacuggagcaccacgguggaggcacuuuccguuuugauagcccaaucaagggauuuagauguucuguuauucucaacaguggaaaaugucgcgugcagucauucucuuucccuuccaaaaccacaucacacaccuuccacucacccucacugcgucuccugaacauuuucccugagauuaucgguguugccuguuauguauggguagucucuuuucuauaagucuggcggcaccguguccacuagccucucaacuaaagcuaaugagugaacaaaaauguuuucauggagagccacaaugggaaaaucgaggccaguggaacaauguaagcaaagaaagacacaauggacucgggauuggugaaguaaaucaacaaaguuguugguuuaaaaaaaaagaaaaaacgaaaauugaacaguagaagaauagcaacuucaugugggcggggucucaagaauggaagggagaacuugaaauaacugagcgucuuggacaaaagugaauagcaaguugaguaagguguguguguguguguguguguguguguguguguguguauguuguguguguguguguuguguauaugugccugcaugacugugugggugugcaugugugugacugugucuuugugaaucugugucuguguguguuguguauauguugccugcaugucuguguggguguacauguguguggcugugucucugugaaugugugucucugugugugugucucugaaugugugucucucuguacauauauguguguuuuguguauaugugucuguguggaugcguauauuuauggcuaagugugugucucuguguguaccuguguggguaucuaugucugucuaugcguguguccaugcucugugucuguuugucagugucucuguguauaucuguguauauguaucaauguguguguguguauguaucugucugcauaggugugugucuguguauuucuucuuggaggaagagugcagagaaccagaacaggaaguaccaaagcaccuugcaaauuguggcucucagcucccgcauuuccauugugaaacaagcagauacauacacagcuggaagacagcuugauucuuaacaguucuuccaucaaagcccacuuuccauuacauggagauguuuucccuguuguaauauggguuuuuaccucccccccccccccaccacacacaccuagucuuuugacucauaagccccuguuuacauuaguuacccaaaggcaaaagaaguuuaauucagacuuuaacuaaguacaaggggguaugggcaaguguaguuaucuccaucucaauauaaaaacucagguagaaaccucaggagguugcaccucagcucuuauuaaugugggccacuguauucuuauuauaaagccaaauugaauuauuguuggcauguuguguuccagcaggcuagugaauagaagucguuuugaguuaguuuuuuuguuguuguuguuguuuuuuuuuuuuuuuuaaagcaagaaagaaugugagugaagaaaucuuggguuagcucggagacagcagggggaugucugugagagggggaguggaaagcaauccguagacuugccgauggacacucauuaaauguuaauaggagcugcgugugaugaaaggcaggaggcucugaguuugucucguuaacugugugucuaugacuggagguaugugaaugaaaucaagcacaggcauuaaagaaauuauuuguugcaaagcagaagcaagauucucuuuacgugugugccugggagaagaacauugccagaauuuucgaucugcaugcacagaagaggugggugagcugggcuccgaggcagguggcacgugaugauguaaaggaaagcucacgucugaaugaacucucaggaaggugagcgccacuaguaacauagguguguaaagccauggacacccuggcuucuugcauuucuguaucgucaguuacuggagagagcagagccuuccuauguccagacacagaaugccuauacugaaaccuccuaucuuaaccaagccguccugggucauugguaugcgggcuguggcuugaaccauuugugcauagcagauugugaaucuaaggaucugugaggccucacuuaggaggcucuuacaggauuaauaaaauauuuacaaaauuaccuguaugguggcuucaguuuugagauauuuggcccuaaucacaacauaaauccucauucaaguggcuuuucuguucucugaaggauguucccacaugucugccagaggagcagcagcagauuccuggcauaccuguauuaauaacacaagagugccugguuccugugcacauguguguucuuguccuuccagguauacaugcaucaacaggucgaucaauagaaggcgaaguguucaguuuuuaagagauuuaucauucacucaagagaguggaauuuacauauaaaauauucauaaauguauauuacucauggugaggaaucucugcgugcaugcuuuacauguauucaaggcaaccuugagcugaucaucaugugcacgguuucuaggugcaggaucaagaguuugcuuaauccuugggcuaagcuaaggccacagcucuugaaaugaacaaacagauacccaguguccaccaugcaccuaacauucugugagacccugguuagcauauaccauuuaacucaguccuaacaauaagcccaaagugugugugugugggggggggggggggcuucuacauuuucuucacagcugggagacugaagcucauagugaccggucagcuaguagaugaaagaauugguguugaagccagcaggagccuccauaccccacagguuuguuuuguuuggaagagguuucccacacagguugccucuccucucagugcuccacaagggagaccuggggguuguuagaagcaaaaccuauucccucucccaugcucaccucuucucugcugaaaccuccucugcagcugcugguuagcuguggcuuucugugacaugcccuggaguuggcuuuuugaugcauuaccaauaucgguaaaguauuuauuacauaauuuaaaauuugauaaaaaucuguuuuaaaauguuccagaagacaaacaguaauacuuaccuggcaacagaugagauuauauauccauauaucucuuaaguaugaauuauaauuaaguaugaaguauaauuguuuguauauagguguucauuaugccauuucuuuuuauuuucuuuuucaaagacauaucccaaagccauagaaggggaaagguguaacugggcuagcaucuauaaccauaggaaauuagugcaaucuguggucuauaugugggggaaauaaagcaaaaacaacacguaugcaucuuccuuggguuuugucucacuugcugauacagugcauaagccauaguuuugcacuugacugacuugugauuaaucgggaugucuuugcuguccacaguacaagucgugaauacuaaccuauccucccugugugugucagcacagcugcuguuugcaugcuguuuucuuguugcuacuauguggaugccccaggcccagguuccagguccccauucuccugcugugcuuugccuguguuucugcagagaauuguaaugcucucagaaaagggacuuuuacaaagagguguucugucuccucagcuugggguggcaagaaugaaagaucaccauguuuuauauugccaggagcuuucacauccagccuccuacugucagaaaaaacccuuugcagaaugcuuuacccuaaagacaccaaaaacaaaggcaacaccuggguccuggaaacuccuacaacauuguuuauagaguaugucuuaagaauugugagcauuacugucuccuguuucucuucuagcugugugggaacaugaggcccuuggagacaggaacagggauucuccauuuaccucuaauuuacuuuuauuguaaauaaggguugcuuucuugauuacuggcauuauucaugggagacucaagaguuuuugugccuacugcagccacauggcagggaagagacccuguucuccaagucuuccccagcaggugcuguucuuacuaaacccaggacccuaaauugaaggacuaugccuggaucugcucauggcucuccucucccugcagacugaugcagaaauacaguuuguaaccaucauacugcgcuugagugauggcauaauuaaacaagcuagugcaugugaaguguccuuucccauggugacuggcugugagcggauacucauaaacacuggcugcuacuuuccaaguucucuuuuucuccuuccugcuaauuuaugauaaccccuuagugaggucugaggguuuacuucugccugccuuaugauuuuagaaaauguugacuugaacugagauuucuaucuuauauaguuuacauguaguuggcagacuggcuuuuaauacagaaugcuuuguugcuuacuuuauccuaaaucauccucugauuccagcaguuuugccauaaauaaauggcacuguacugcuuguagggcaagacuuggcagacuagucucaaacagcuauaaagauucucuacccuauguaaauacaaaucaaaaccaagagauuugugaacauaccauuauugguuuuuguuauuacaaguaaauauuggaaggaaccacaaaagcuacuuuugaagaaugacuaguugcauggucuaacaaauaacauuugauauauuaaauacucguugaguggaugcucucugaaggaaauuaaccuagccauggcuucuaggcaucuaagaguguuaaucugguggaucuauuauuguauaguuuauacugauaguauuuguuuccucuaagguauggacuaaucuuuauuuuauuggauccuaacaugaccacucagaaaaaagucauaaaucccaaugcugaaaacggauauuuccucaucugucuccugcucguccuuuucugaaucuagcaguaagguuaacuuugggccuucuagagugaucauaacagaaugugguuuugugcugugggauuuuggacguguagagcuaaaacacuagugaggaugugaaagaaaacaggucaguguggugaagagcauugccagagcagcuaaagacugucauccuuacaaagacgugcucuccauaucauggcuugacgaagccugccaguaacguggacuugggugugcuuauauuucccaacuaaugccccuaaacuguaaacaaaguaguccuuccugagcacauccauuccuucugggaaucaagacuuuuagcuuacacuagguuuacuugacucaagggacuuauugaccaaugaaaaccauggucucugaguuacuauugaacaccuuucauaggcuguaccccaaacauacggucacaguugaaugucagaggacucugugucuaguacaacugcucugagaugacugccacugugugucugcuuuccccugaacuuugccacauugauagauucccuucacugauuugucuuuauacuguacugagucuuagcucugaguaugccuguacgccgaguuuuacgagccuuauaaauauuagggugggucuuggggauucuauuccaacauuagcugaaauccaaguugaaagauucaguuccguaacauagucaaaaggucugaagguaugucugaagacucuucuuacaggcaccccccccccacacacacacacauucuuuccucucucuccuaagaacguuuuuaguguuggauuucauugguaaauauguuuaaaacauaauaaaauuagguggguacugaacaguuugugauaucacugugaaucaguuuauucugcucugugcccauuauaacugagagaaacuuaggaaauaggaucuaucucccucuccaccucuuacgucucucccugccccacauaugaauacauuccuuccuguugccuacuauagcuaauaaucagaagucaguacuaacuagaagucucuacucauggaucagaguguuaauagacucacuuuguaauccugagucuuccgauuaaaauaauaaagauuacuugaaauuaaaguuagaauaguuuauuguuuaaaccuuauuucauucaugguauguuuacauagagugugccuauccuuaguauacuuaaagaacuugcuaaggcauauucuauuccccuccaauugaagugaaaagaaacaaacaaggaagcaugccugaaaaauagcuuccaagggagcauuugggcagaaaggaaagagcagaaauuagauuccgcaguggccauuguugacugugcucaacugcaucugcuucuucagacccagcacuaaucauuucucuauagaaguucaccucacauauacuuggcuuuugcauucuggaagugugacuuacaugucuugaacaagaaccaucaauagcaugugaguauuaggugcugucuaguuuacauuccauuaaaacagacaaaaagagaagacagguuggaugauaaaaaugucaucccccuaccuuaauaggcaauucuuuaauagguaaaaacaaaggaucuacauuuuuuuaacugaaauuuugaccacuguuucauauuaaauuuuagagaugggcauuauggcacauacuugaaauuccagcacuugggaggcugaaguagauaaauuaacagacaccaaauuaaucugggagggggcccaagaaaacugauguucaagguuacucuuuuaaugcauaauaagucuggcuagguugggcuagagugagacucuuucaaaaaaauuaaaggaagcauaauuuguuacuguggaauauaauguuuuaguucuccaugaaaaagaaugaaauacauucuuuuacauaaaaaugaaugaaauaaaugcaacugaaggucauuauguuaaguaaaauaagacagauucauaaugacaaacauguauaccuucucauucauauaauauauauguauauguuauauauguaaaauauauacauacaauucauauauuauuuauauacuauauacaauuauuucuuauuuuacauauauuuacauguauaacuacauagaauauauguacauauauguguguauauguacauauauacauauauacuacaugaaugagaacaccacaauguagaggggagguugagggggauggagacuagcuacuguggggagaaagguagaauggguaaauauggucaaaaucuugaacaauacagcuuaaggaaaucagcuuugagagcuaagaucuuuucgcccuauucuguaucuuaucuuucuggacgacaaccagcguuucauauuaacugcugaauggaugcagucacaauuaaauacuuacuuacauguuuguuuucucuuucccacuuuauuucuuaucaaauauuccauaaaagagaauuaucugccacuucucuguccuccccauugcugaaauuaauauaucucaaauucuauccagaaguuaaugacuuaagguuuuaauuaagaaucuugauguucuaauauucaguuuggccauucaguaauucacuguuggcuaucauguuugucaugauaucguuugucaugauaucauguuugucauggcuucuaguuugucaguuuuucaaauucauauucaaauucuuaacauuugcauuugguaccccuuaauguaugcuggauuuuccuaaauuuucaucuagcauauucuucuguggugaacauccuuuuucaccuuuuuuuaaaauuauuauuucaauaguuuagaaaauugugaugauugggucuaaacuuacagguccugugacaaaaugaauugaggaacauaaaauuagccaagaucuuaaaagcauuucuggaaaaaaugaauuccugcugugucugaaagcuuauuuguuguuucaggaguguguggcgugaaauguuugagcaucugcauuugcaaaugugacugagcagacaguagaaaaccugccucugagcacagacaguggcugcuuucuguuuguuucuguaagcgucucuaaagagaacagcuggguuuacagacauaacuaguuguuaguguacaacagaugaauuacauuuaagaaaagcagugcauuucaaaaguucaugagaugacacuugcgguaccucauguagaaagaugaguguuagagaauucugauacucagggggcugcuuaaacaguaaagagucuucccagauuacauguagcauauagguacaagacagcucccccagaaggauggaguuuguaagaacaucacagcguuuaagacagcacuugagagguggacuuugaacagucaugaguucgcacaugagacaucauugcagguagaaggaaugguagaaguagaaagugguuguugagacaugcacaaugcucugugaaagucauguugcccaggacuggguggcagugugcauaugaaguaagacuugaaagguagccugaaacagccccugaauggcaacauugaauucuuugugcugaaaucuuacagcaaacaagaucuguggaaguuuacuuugggagcauuguggcaugaacagaaguauaggaaaagcaacuuuguaucauguaagugggugagaauaguuuauuagaaauuguuaaaaccaccuacuuagaaaguuaaaugggccauuaguaaacuuguaagaaaaguguaaaagauagaugaaagaaacagacauaugaauagccacuggguuacccauuaaguaaacuaaagucuggguccuggcauucagagagggaugggaaaggaagcaagcaggugaggcucuaaugacaggucaggugggguguggagauggaagcgucuccauugcaacauaguuucuguguguuccacacucaggcugacuggacuagcucuagacacuauugugucugugaccuuaaguaaguugcuccgccucuuagcuuucaggugagucacaggaucucaggcugauaaaaauaaacacaaaacacaugugccagguagguuuuccuggcucguugucagagugcaacaacauuagguagugauuuucaauuuuuuucauaguuccaguaguaacuaauuuuucaaaucucacuucauauauuaaaaaaaaaaaucuaagucagaggcucuauuuuauuuaaaaaaaaaaaaaaaacccuuuauccuaaaaguaaggagcuaacaaaaacuaagcuguguauguuuuagguuggagacuguuugagacacuagcucuuuugaacuguuuauauuguaauugaguggaagggagggugcugaguacaaagccccaaaccucacccuucuaagcaagccuaccacugcugaucuacaccugagcccaaagguaguaauguugaucuaccggccaaaccucgaaaggaacccucagaauuguaguuuucuucauaaaauaguugaguggauauaggccauaaaugagaaauugcagaagcaacaggaagacaaaaggggauuuaggaacugauaaacucuuacugucagaacauaaggaggaaaggaaaucuuauacucacauuuguccuugcagaguuuuguuauuuuuauauguaauaauuaacugcugaugauguacaucuguccacgccauagucacuuacagacaccagccacaguuugcuugcugguuguuuguacagugggauuuacuuuccauugaagaaaauguccaaccugaauguagcauccuuugcaaaagaacuucuuaaaaacagacaacuuucugguacuuacaagacgaaaaggugaggauaguuuuaacucuacuugauuugcugaaacuaccagucccagcauuuccuagaggcugccucccucucccagcagacccagggaaaagggccucauguuucugcuggagcccuucugcauggucaggagagcucuguccaugggggaaugucuuugcaguagcucacaugugagguuggauagcgucacgcccauuagaguguacuuaacccugggcguggcagugggaugcaguacauucugccucaccugaguggacaagcaccggacuaggagaaaagaucauagcguggaggaaacacccgagcaggucccaagucauccagucaccccuaggccugcugaucuucagcaagaaaagcugcguuucugaaacacgucgugcacuccgugauguuugucugccucccagcccuacgcacgguacuaacaaauucaagcagcaucgauucgucucggcaguggggauauaaagagacacaaagccugugugguacagaggcacaugacaugaauauucaaggcaaucacugagggcagguaacuguuucugggaguggcaacaaguuagcaucagagacaugauauaggucuguuucccuugagccuagauggaagaggguggcgauggaaggcagggaagccaagaugguuuggcacuuuucacacucuuggaguuucagaggucucaccaagauuugaugugugaaaaguaggucuggucuauaugaagaggccuucaaaugccaaauaaugggaauuuauuauuuacucuauaaguacaauaaagagccucuaaggcagcggcucucaaccuuccuaaugcugugacucuuuaauacaguuccucauguggucaccccaaccauaagauuauuuuuguugcuacuccauaacuguaauuuugcuacucucugaacuguaauguaaauaucuggguuucgaagucaucuuuugaggguugcaacucacagguugggaguuggcugcucuaaagguuuguuagaaaagcagaaauuuuccuagucuggagguuuggaaaugugacaacaguuugcgcggugacaaacguguagcgagcuggucagagugaggaaggaaaugcuaaguguuucuucuguggcuguucuucacaugucaguuuacacccaaguaucuuucagaagucauguuuauuguugccuaaauagcacugauuucacaaacucauuaaaauaucaucugucugaugaugucuuauaugcacuaaucacacagguaagcagucgcauauaccauuaaagucacuuucccaagcuauauuauccauaaauagccuuagucaguaguuuuuaaacaaggaaagguuuuguaauucucacuagugacauagggaugacaauccuaaccaggagcucauuucuucuaacuuaaaaaagacuuaaaaagcagaagcugugcaugguguuuccacuuuggccugcagcagcugcuuggcugaagccccauugccuaaacaccauacagacaagcucagucugugggauuggagcccuagggguuguacuuagaauccagcagccccugagcuagaccugucaagccuggcuuucauguuuuccuuugccuuugcugcagccuuuucuuccaaccaguucagggagggcaccaagaggaaguguguuugugagcccauacugccaccagacagcuuuaucaucaguaccgggagccccucccuccaaaccacggcugucacaaggcaauuacaugcaagauuucuacacgcccagcuaauugagaguugaaagcuagccuucagauuacaguggcccuauuucuuaugcuugccagcuaucagccacccuggugucauuaaaugguaacguuuuugcagacauuuaucuaccugacagucugcaaaaucuuaaauuucagauaaaaaccaaauucuuuguacauuauuugcaaauaauacauugcaccuuucuuuuuuucuuaacagucuuaugugguccuuacugucucuaaauuuuaccagagcagauguggucacugcagugcaacagaggacuaaacuaauuugccugauguaaacauuguuaaacaauuucaaauguaaguuuggaaacaguguuucugaaccuguuuaauaauguuuaaaaaugcaucaaugaaauuggcuuagccuguggccuuuauuacauuaucuguucucaauuacauagauucuguguuuugugucuggagcaguuauaaguaacagaaaaaaaugauccuagcugaggaguguggcuuaucccuaaccgauuuaauuugauuuaaaauugauaaaccuuggaaaauacuuccagaaugccauaucaacuauuaaaauaauaggaaaugcauccaggaggucaggccagcgccuuuauuucacucgccgacuccucccacccucuucuuuaaucccguugcuccucaccuuccauucaccccaggcucauuguugugacuccacacuaaauuuuaagcucucggucuugaaauguaacauaaaacauuaaauauguuuuuacuaauuaugaucugcuaaacuccgagcucugugccgaagcuuuuuuauuguaauuucagaaguaguauuuaagugaugacaugcaguaauuugcucauucugucaguauaauuuacaaggcaguggcagauaaacauaguaauacaagauucauuuacagugacacaauggcagauacacagagcagaacccuggcuaugagauaaaguggacugagugacuuaugcaguaauuaggggauaauugucauuaaccucacaaacaguaguuuacccauauuguuuaaaaggcuccaggaugcguaaugacaagguaaucugucaaagcgcuagggggaaauauuaauaagauuugugcaagccuggauagaaaauaugcagaaagcggccacauuaagcuaauugguggaugaauauacacuuguaaaagugcuucuaauggcacguuugcugcucuccaaaugacuaccguuaauguggagaagugggcugcucagaaagucaggacugcugggacuagaggguauuaagccaugcagacacaguauuaccuuggacucaguaaugcgugcuuccuccucuuagcccuuauuuugaauuucggaauuuucuauuauaauaauauauauugaucauuucuuuuuccuuuccuuuuuuuuuugccaaaauuuguucagucaaccaccagccucaagucaccucucuuguggccagauaugauagcuaaugucucuauugauaucuugugucuagauauacagaagcacuaacuauuaauggacguuuggauuuauaauuaugcacacauguaugugugggugccuuuuauaggaaugcauuuagucugaacaaucaaaggagaguguauccaucaacagccuuguguauguuacaaguaauaauguguucccugaugaaugcugcaguaggaaauuaaucuuuguguucugcugcuauucuuaugcccagagaacaaaaguuaaaucucucaauacaucuucuuguucaaucacacacuugguccuggguccugcucccucacguucuaaugaauauguuaaaguuccuuuggguuguucagucggcuucugcuguaaagaacaauuccagguguacugcaugaaugggaaucaucuauucaagcuuggaacgcucucuaucggggucaaggauguacaggcagagcagagaucaaagcuuguaacuuugaacugugcugagguuuccaacuuuaucuacuacauagguaacucucacagagaaacacucuuggguccauuuuuguuccucaucaagcauuaugaaaaaacacaggauccccaacaugacuucauagaaagaugaagcccagcggcagccugcugacauguagagucugccuggaaauuaagggacagaauuuuguggaaagcguagaaaacuagaaauacacaccucaacuugagaaugucagaagagccccggcaaguuugguuuacggcagagccagcagauuuauagcuaucccaggacaucagcuucaucuuuacguccaagaggagacgaaaacaaggucauuagugggaaaccccucucuuuccuccuguuucuggcguuugcucuguggaguucaaaccacccccuugcuauccugaacauaaaugauuuacucacaggacucucacuggguuccaugugaaugcccagugucuaaagaguuuggggagagagucuuguauacauuacugccacucuuuucagaaccauauagucuguuggagacuauauggauuuauguggauaauuauauauauggauuuauuaacaccucacaaaaaaaggaugcaauucaaucuucaaguugcagaauuuucauaagcccuucaaaguuuuauuggacagugguguggacagguauaugaaggcccuauaggaacuaaucaggacaauugcccaauuuuuaagcaaaguugugacuaaacuggauauuuaguugaccaggaaucaaaauuaucccagaggacccagcaccuuuaauugcauccuaaguaaacaguucaggcauaaucaucaagguaggcgguaggggggagauaggauccagaauuccagaagaucuaagacucucggagaguaagggaugccuucaguuacaaauacucaaauucuggaaaacaauuuaaaaguaaaaaugcuggaguuuaaaacauuuuaauucaaaugaauuauguuuagagugauggagcaguggaguucugaaccuaauaucagugggauguuugcuuacacgcggggauaaaaauuaaagcuggauguuggugaugcgguagugacagcugggcauccacaaaaccaagacugucauuuuuauguguccuucagucauguucuuuauuauuuaauguucucugcauucaaaugcuucuguuauauuaagaagaauuaaaaugggcauuaucagaugcagaaucuauuuuagccuguagacaaguucagaaguagguauucuaugcugcaauucuaugcuuguauguaauuuuauagcaggggguuaauacacuagaaauacuaacuuauaacaugggauuucucuggauuaaacauuagcucaguggucaggagaggcacugaagucaauucuuggucucagaauuuaaaauuuggggaguauuuuuuuuuaauuuuggaacucauuuuucuucuuauuaaacaugaaaacauacugugucuuucaguuuuucucagguuugauuuaccauagauauagguaauuugaaaaauacuuuugaaucuuugaaauguaauuuuugacuuuauuagaauuuacuccucugaauuuuauauguaagacaccugcuuuauuucuuugcaaacaaaugcaagacaugcauauggcugguucuaauuuggacagucugaaaugccagaguacauuaacaaaguccuguugggccccagagcuucugugauuuacugugcuguaacaccagggugaucuaucauaaucauaguuuuaaaaguuaaaaacaauguacagguuguuacugagagaaaaggaaguaguauucugcaaaguacauauucuugccagcuguguguguguguguguguguguguguguguguguguuuuccuguuaguauucuccaacaaacccagagucuucauaaauacuagugcuauacaacugaacuaaacacccugcuuauaugauuguuuaaaauccaaaauaaaacaauauauuuuaacaauuggacuuagcccuuuagagcgaguuucucuggcauucugauaguacuacuuuguauggaaaguuaaucauuuuuggagggcaaauuguuuagccuaaugacucuucacuuuucaaaaauaacuccucacuguggaaaauauuuucagauaggaaucaucaaaacacguuauagcuaacuauauguuagaaauaaauuaccuagauauaacguaaaguuacccauguugcugcuuccuuauccuaagagauacauucaagggucguguuccuuaaacguccagucucauccaaguagaagcaauucuugauuuuuguacuuugugcagcuuuucaagaaugugauaugccucacaccauuauauccauccuauaaggugaaaccucaugaaugcugaagacucauuuccagugagguucacauacagcuggaacagggagagcggcaucuucuguguucacauguauguggacaugcaugcacaugagugggaugcugaaaaugucagcucuguguacagaaaauauagagaacagguuucaacguaagcacaucgucuaacaaggacuaauaagcucaucuugacagaagauucuucagugcaugucuucugagagcuuuaacauucuaaccaauugugugucuuccuguaacuuuucuuugaggguggguguuggaaaggaauaggaagacauuuugaguccaguuuuucauauagagauguauugacuuuaauaacagauucugcaauuauaggaaauuuugauauugacaagcaucuuucaugaccaagagugacuugcucggaugaggaaaaacaugucaauuuccaaaagauaaucacgugagcaaaugcaaguaaaauccucuugugagguuugguuugguuugguuugguguuugguuugguuuuguggaugucugucuuuuuguucaugcuacuccuugauuauuuuguuuucuuaagggauauauuuuuuuacagaccagcaacaagaaaauaagaagguuauuggucaacauuguauuuugaaggugaaauagacucuggagaaauucugcaaaaauacaaauuuacaagucauagaaacuggguaggguuuucagucccuaaaacaaauguugauucuuuaaaaguaaagucuaauuugaaccauuuggugcagucacgguaugaaugaggagguuucauucugccuacagauauuacaguuguuacagcuggccuccuggaaaccuuagcuucaaaagcuaggcaagcagucccauaaaagggcucugugugaccagagaguaguauaagcuuuguuuacuuacacaaccaaacugcucugauguauguuguauauacgagggguacaucucucguaggcaguacccagaagaaauagguuuaaauguaaaauuuacuaaaacaaaugagcaugccaagauucuuucccacaugacuucaaguguuucucagaaauuaucacaacacugcuuaaaaacuuucccuaaggaguucccagaaucuauucaaacagaauuuuuuuguguuagcauuuuaucuucccguuuuguuugcaugcauacauacauacacuuagacacacauauacagacauauauacacacaaacauugguccauggccacuuacagaugccaagucaaauaaauuugugagauaaacauaacuuuuuuaaaagggagguggauugguucugaaguaucagaguccccggaauagcuaagguuugaggcuaaaauaagaaccuaaaaaguuggcuuggcauuggagugauaguuugacaugaaguauuuucuucuaacauguacgugcauccuuaguuuuaaugaccuauggugagucucaggagaauggaagaguacugaaaguuugugacuauuuaagcuguuuuuucaaagcuguuuguggugcucaaaggcauguguuccucaaacugcaucucaauugagaaaaugucccuacaagauccaacugcaaggcaucaucuuaauuagugauugaugaaagaggguucagcccauuguggguggugucaucccagggaugaggaaacuaagaaagcagguugagcaagucauggggagcaagccaguaaguagcacuccucuauggccucugcaucaggaccugccuccagguuccuguccucuuccuucagauaaggauguguaagccuuuuccuccccaacuuuuuucucuuuuuucguuuuucccuccaagacaccaaccuuacuucauguauaaaguuggaggcauguccccauuuguuugauuccagauaauagucugaacucacuguauucaccucuugugaaauuccuggguuguguucugacacauuuaaagaugaggccagcuugaaaacaagugaaaagaguaucucagugugucagugugagguaugugugcauaauccaugccuaacacacucugguauuagcucuguugaccagaagucuccaauguucaugaguauauugccauugauaaaaauacauagagaguguuuacccugacacaaauagaacuuucuaaauuccuguuugaaagucaguggaaugguucaguggggcaaaguucuugcugccaagcuuugaagacaugcccucccuccccaaaauucaucuggugagagaaccagcugccuaaguuuuccucugaccuacaaaugugugcuguggcuuacacauacccagacauaagcauccaucuacaacauaaguaagucuagaaauuagugcuauaucacuguaaguucaugacuagaagauuaacaaaggaugucuuuguugguaaauacuuauauagaaauuuucguauuuaguccucauaucacagauugcuuuacacaguuuacuaauagagacuaggaauauguauguuuguauagucaugggauaauuuaggagacagaaauuuguauaugugcgauguuacaaaauuuacauaauuuaacuauaggaaauucaccaaguauaugugaauauaagguuuagcuaaauauacaaugugggcagucacuaaaacacacacuucuuucagaacauuaucaucaccucagaguuacauaaugcuguguucaaucaguuccuuuccacaucuucagucacugauaaccauaaucacaagucuguuuuuguaauccuucucuucuaaauuuucauucauugcauuaggauaauaugcauccauccgggaucugaugaacaauacuuugcaaaguuaucuguguuguagaaugugcugaaaaguuauuacuuuguauuucucuguagcaucauauuguacagcuuguuuccauuuacagcuuaaaccucuagaagaugugacacaguauauaaugcaaguuguauguggcauucuaucucauuaguuuuaacuuaggaaaaacuguuacauuuuaccugguaggguguacuuaagcggccuugaaaugccaucauuucuuuaccuucugucugaggucuaccucuugccuugauacuuguauuaaccugaaagaacaugaacauuuuaucgccauucgaagcaggucaggaauacuaauugccaguauaguugcgaugaacucuucuaauaaagcaugccaugcaaaucuagacaugaagucaaaacacauuucccaaaguucccauuuuguugugaggaauaagcaucccuuagagguuugugucauuuacgagucuaaacauacagaaaaggacaaccuauuuucaguuuuuaguaaccauuagaggauuuucuuuuaugacuuacauuugacuugaaauuucuacuuuuuuccuauucuguuaauacaaagaaugacucauucuauuuauaugcucacauuaaaaauguuuuauuaacuauuugagaaacuuacgugauguaucuugaucauguucauuacuacuuuauccacccuguaacgucucccuaaucuccucucaucccagauucaugucuauuugauuaaguucaauagccuaucagcuuccguuuguguuacacauccacuccuugguguggagccauccacucaaguauggacagucuacaagaagccacagcauuaaagaaaguugacucucuuuccgagggaagcccuuaauuguccagugccccucaguugcagggacucaagagucagucucucucucucucucuuucucucucucucucucucucucucucucuccccccccccaacccccaugcuccaguguugacuugcuugauguguaggucuugugaagugaaccacaacugcugugaguucaugagugcagugguccugucaugaccugaagacaguguuuuucuucaacucuuucugauuuuuaccuuccacagacucuccaucuccucuuccacaauaggccuugaacuucuggaaagcguaugauacagauuuccaguuugggcuguguauucuacagucacuuauuuucuguauuugaccaguuguaaauuucuguguuacgcacauaugcgcgcgcacacacacaccaaucaacuagacaaagaaaguucucugaugagcucuugagaacugcacuaaucuaagaguagagagauaggaauuuauuggccaaauuuacagagccaagcauguuuuucuuucucugaagcaaacuuuuaaccaaaucaggaagugauugguuaccucuguaaugguuaugccacuaaugcacccauaagccugucuuuccuagcuagucauuauggcaguucacaggguuaacaugggguaauggugauaauauugauaacauuucaaccccagcagccuacagaacaccuuucaguacuguaagagcuagcaagcaagaagcuucaugaucaguaacaacuuuuacuuuuccauguccuaugacaugaaaagcucucauagaacugaaagguguuccauaggcugcuggaguugaaacauuaucaauaacaucaccuuuauccucguguaaacccugugaacucccaaaaugacuagccaugauacaggcugauacagaagccauggaggaaacuaagauccacauaugaaugagaacaugagacauuugucuuucuggguauaaaauuuacauccuacacaucucauaaugucaucuuuccagaugaauaaaauuuagucacauguagccaccacauuuucauuauccauuuaucaguugauggaugucuaggcuguuuucuugcccuaacuauugugaauagagcuaugaauaugaaugagcaugugucuccauagaauggaauagauauucuuggguuuaucuaagagugguauauuugagucauauggaagcucuauuucuaauuuucagagaaaacagcacauugauuucuauaauaguugcacuaauuugcauuccuacaaacaguauacaaagguucccuauucccuacacccuuggcagcauuuauugucuuuuguuuacaugauccuaggcauuuugguugugguaagaugagaucucaaaguacugguuuuaauuucacugauugcuaaagauggcagucuuuccuacugcugcucucuaguguaacuugacaucaggaguugugauagccucagcaguauuucuagugcuuggaaaugcuuugguuauccauguccuuuguaauuccauaugaacuuuaagauuguuuuucaauuucuuuuaagaaugccauugaaauucuaauggagauuucaaugacuauauauagauugcuguugguuggauagucauuuuaacauauuaauuguaccagucuuugaacauggaaggucuuuccaucucucauaucuucuucaaugucuuuggugucauaauauuugcauucuauaaguauuucacuucuugguuagauuuuuuucaauuauauuuucuuuaggcuauagugaauuugauugcugcccagauuccuuucucaguacugcuugccucuuaacaauguaugcaaugccgagugaguaugcuuuccauaugcacugcauuugguguggcccauagccuuccaugaacaggaagagaacagucaguggucugcggugaacgaaugugaguucauucuuauucugaucuuuagaucaugugguaguccaucccaacaccacuuagcuggucucucuucugacuuacuacagccuuaccaucucuguuguccaucuccccaaaugacauuaaccagccaaccuaccauuguaccugaaaacaaaucuuguaagaggcuguguggagagugugaacgugaacccuuggcaucaugacagcuaaaaccaaaauguuuaaaaaucauucuuuuaggcagggcauggacuucagauacagagcacuucuuacuuuacucaauaccuuggguuuagucccuguaauaaaaacaaacaacaccaagaaacacucugcagaucuauuuuagaacagauggaauaucuaaggaauaugacauuuuccaugaaaauaauaggaugucuuuucauggaacaggguuaaauguuaauauuuuauuaacuuuagacuuuuccugagccugauaaaacagguuuuuaaugcuugacuaaugguuucucaacuguuuaaauuaguagucuagccaguuauuuacagaaauccaguacuuauaaucauaccuuacauuuaacuaacagugcaaaucauauuaucaucuuuuuuguaaauaucauuucccagucuaaugaauuggaagucagugaauucugguuacaaauagaaauaaaggaauugauucaccaacuagaggggaagucaggaguucaguuuuauacuuagaccuuaaugaauccauguauaagacuggugucauguugcguguuugugaguguggcaguaaucuuccuaugucuaccuccgacugaauuuugcuuuucuagcacucaucccacuguaguaucucauuuuuuaugacucuguucacuugagaaaguuuauuugaucgucuuuacuucucaaacaugaaagcagucuaguuuuuccucccagucagucuugaaucaauauuuaaauacaauaaaaguaaaguacuaauaaaaacucaugccuguaguuacugugauagaauuaaguugcccuaaaaguuuucaaaugguuaauagcuguuuuaaauuaccugcaguucauuuuucaguguuuauuuuuguuguugcuguuguuuguuucuuuguuuguuuauaaagccuucagguugacauguaaaucagugguucucaaacuauggguugugaugccuucagggguugcauauaagauaauccugcauaucagauauuuauauuauaguucacuacaguagcaaaauuacaguugugaaguagcagugauaugauuuuaugguuggggacaccacaacaugaagaacuguguuaaagggucacagcauuaggaagguugaggaccauuauagauuauuauaaaauauucuggccuuagccauguaggagagucaccacacuagacaagguauacuucugucccauagaguuucucuaaaugguuugcucauuaccagugauggcuuuuucuucuucccuuaagccagcuuauccaugaauauacuaaaacaaggagcguauagacucccuauacauaccuuuccucccagauucuauauuugcaaauaugauaguuacuagguaauaugaucaaauaugaaugaaaacuucuugggaaauaucuaauguaggccuuuauauugcugggauccagaggauacauugaccuccaggaauuugugguguucuucacucuauuuauuaguagacauuaucuuguauuuaacuuuacaguuaaaaguuacuuuuugugucucaggcucauagcaacauagcuuuaaugauauagccucaauuuuggcagagguagcuacucagaacuaacagaauucugaaagguaguugguuuagaaaaagcagcaggcacuguagcagccaggaauaaaaauaagccauguagaauggcuauguaccauggggagaguugggaagaugggagaaauaaggugaugguagugguuuuuugaugaugguucauguggguugcuaugauuucuguggcucauuuaauuccaugggcuguggucugugaauguauguugaccuguaguuuuagguucaggaugccuggacagaacuuggagaagacaugauuauacacugcucaggcugggguuccaccuaacagaaaagagcagucacaagaggcgaaugauagcaagaaucagugguauaagaagucagugcagaguucuagauagccuuguucuacagucuacccacuguccugacuagguagugugucacagagugguguucacugaguacugcagagacagacagugaacugaaacaucagaauuuuggcuucaagucuuggauuccaaguucuuggaaccuuacaagaggucuuacuauucacuugugauuucuuaucuguuucacguuccucauacucuggauaugaucaugauggcaugaaggugaguggugcugucaaugaaacaguacauuuaaaaaucacaguuuccuuguuuaccuuccuucagcaccaucauuuccuucuguuccccacaucucaaaaacggaggcucugaguaauaucagugguuauuagugccauugucuaguagcuauugcagcccguggcacuauaugcuuacuuuaaacggagaguauguuagaacauaucaucuuauaggcaaucauuucuauguauuuaggaagagacagacguuuggacaguuuucauaggaaaggauuucuauaugugcugacuauauaaauugauacgaagagugguauacaacuaccauagcugcuuucauaaagcaacucagauaaauauagauagccacucauucacacuagcuaugauuccaaauaugacgguguccagagggaaguuuauauccaaaggcugaggauagacuuuucuguugcaaaaggggugaagguuccuuuaccucaugcugccucccuagagugacauuacauggaaucaugacauaguuguugaaaugagggaaucaagguugauauacuacuguuaucacauauagagucuuucugcauguuuugcuacuuuuuccucuaauguguuuuuuucuagucaaauaucccuaggaccacacaauuaugucuuaaccccuccugccuauaacuguuguuuccaaagaaaaaaauuacaaaccauucauaucauacuuugaagaguuuuaucuaguaucuuauagacuaccucucaacuuuggguuuucugauccuuucucaugauuguguugaaaaagaaauguuuauaagaccacccuuggcaaucaccauaugccaccaggaguacaagaugcugcuaugucuuccuccauugauguuaacuuugaucagauucucgaggcagugccuauuacauucuuagugucaaguuaugauauuugucuuuguaauuaauaacuguauugucauuuuaaaguuuguuuuggugcugaaccuaagaccucacacacacuaaccaguuuccuacagcuggaccacaucuccagcuccugcaacaccauuuuguuuuucuaaaagguuuugugcuuucuuaagcugauggucagaguuggagcaagugucaugcacagagggcugcaaagaucccugauccuggugggucuaagaaacgaggccuuaaaaaauccacauagucauuauuuaacuguuugaauagauuucucucagcccaugcuaaaauggauugccugacauuaugcugcaggauuuuuaagaccuaccuccaggcagaucucauaguuacuagcaaaaaugaaagugugaaaugcuuuuuaauguauauuuaacaacacauagucugauggugcugauguguagucucuauggacuuccuuugcuaucagaggaggaugcugccagacaacuuuaaauguuuauucuaucuaaagccaucacaugcuuuucaaauaucuauuccuguccuuuacaccaacauccuaaaaugucauauacuggcagaguaucucacauguuaaauggcugguuuaaggggaaaggugccauuuacaagucguauuuccuuuccuccaccucaugaaaaccuacccucagccaggauuaaagcgcagccaucuuuagaagacaaugugcuuuggagugcugcuguuaugacagagaaacgcuauuuuacuguuuuuuuuuuuuaauuccaagauucacauaacuccuacuuaauggaauaucugucauugcaucuggugacaugccugcuugaauugaagaaguacauuucaugaacuugauucuuucauaugugucguuauuuaaugaagauuaggguacaauuuuuuuuguugcauuuuuccuaggcuacgcagcaagaguucacaucuuauacuaauauaugcuaaauaguugcaugguauauagaucauuguuguuaaaauggcaguacugaaggcauuuuagaucacaaagccccaguggucugcauucuguuugcucugacauuauuaaacucaaucuguuucuauaacugugacuguaauugcuacauuugcauggcaggaaaguuugcuucgugcauuaacuuuucuaacgcugcuuacauguugcuuucuguucuugcucuccgcguuucauaaacuggcagagcaccuucaguugcauugaguaauuaugcacaaucaauaaguuucuguauuugucuuuguuguuucuuugauguggccuguaggacgcugcuggcaagguacuggaccgcugggccaucaugucucgggaagaagaaaucaucacccuucagcaguuucugcgguuuggggaaaccaaauccaucguggagcugauggcaauucaggagaaagaagggcaagccguggcuguaccaucuucaaagacagacucggauauaaggacuuucauugagagcaauaaucgcaccaggaguccuagccuccuugcucacuuagagaacagcaauccuuccagcauccaucauuuugaaaacauaccaaacagccuugcauuucugcuuccauuccaguauauaaaccccgugucugccccacuguuaggguugccgcccaacgggcugcuuuuggagcagccggggcugaggcugagggaaccgagcauuucaacucagaaugaguacaaugagagcagugaaucugaaguaucgccuacaccauauaagagugaucagacgcccaauagaaaugcccugacuagcaucacuaauguggaacccaaaaccgagccagcaugugucucccccauucagaauucugccccagucagugaccuaagcaaaacugaacacccaaaaagcucauuccggauucaccguaugagaaggauggggucagccuccaggaaaggaaggguauucuguaaugcuugugggaagacguucuaugacaaagggacucucaaaauucacuauaaugcuguucaccugaagauuaaacaccgauguaccauugaagguugcaacauggucuuuaguucccuucgaagccggaaucgccacagugcaaaccccaacccccgccuucauaugccuaugcuaaggaauaaccgagacaaagauuuaauccgggcuacaucaggagcugccacuccagucauagcaaguacaaaaucaaaucucacacucacgaguccuggccggcccccgauggguuuuaccaccccuccacuagaccccgucuuacagaacccucucccaagccagcugguauuuucugggcuaaagacuguacagccaguuccuccuuuuuauagaaguuuacuuacuccaggggaaauggugaguccuccaaccucccucccaaccagucccaucauuccgaccaguggcaccauagaacagcacccuccuccacccucugagccaauagugccggcagugaugaugggcacucaugagcccagcgcugaccuggcaccuaagaaaaagccuaggaagucaagcaugccuguaaaaauugagaaggaaaucaucgacacugccgacgaguuugacgaugaagacgacgauccuaaugacggcgggaccguggucaaugacaugagccaugacaaucacugucauucccaagaugagaugagcccaggcauguccgugaaggacuucucuaagcauaacaggacccggugcauuucaagaacugaaauaagaagggcugacaguaugacgucugaggaccaggagcccgagcgggacuaugagaacgaguccgaauccucagagccuaagcucggugaggaauccauggagggggaugaacaccuucacagugaggugagcgagaagguccugaugaacagcgagaggcccgacgagaaccacagcgagccgucccaccaggacgucaucaagguaaaggaagaauuuacagaccccacuuacgacauguucuacaugagccaguacggacuauacaacgguggcggggccagcauggcugcccugcaugaaaguuuuacaucgucucugaauuauggaagcccucaaaaguucuccccugaaggugaccuguguucuaguccagaccccaaaaucuguuaugugugcaagaagagcuucaaaagcuccuacagugugaagcuucacuacaggaacguucacuuaaaagagaugcacgucugcacgguggcugggugcaaugccgccuuccccucucgucgaagcagagacaggucaguaaaucuccauuggcuccuccugcugaggguggggguacaguucagacaagguuagauguuugugaugcacuguaaggaccgccauauugaccaugugaucacuagacugccaugcucauuggaggauuuguguuuucagugcuuguuaugauuaagcaugcagaaucgugccaucugguaaugcaugccaucuuucucuguguauguguauauguauguuuccaugcaucuaggugugaauacguuaacaguacacaguuccuuagaagccacagcuucugucauucauauaugcuuugccuuguggcuuuuaaauuaaaccaauauauuaucuucacacacacauauuuauccaauauagaaacagaaauuuacggauggaaagaaccauagguccaggacaucgagacagccugcauugccguagguauaaccagaaauguuaccauuccuuacaugaguauuuaguguguucuucaguucuuuaagaaucaugaaacuaucagaagaugaggcugucuggugguguggauuucuuuauuucaacuccauaguaucuuuggguacaucucucaaauguagucugccaugggacuucaccagagaaguggggacaugccuagguagaugcuuuaggaucaguuagaauauauuauguacagcccucagaugaccucacucucaaguuauguaaccauaagcagaagcggcugguccuaaaccuaccauguucgucauuaacuccguuagaguauaaauggaaugucagggggcagucauuggugggcagcgaggugauccuucacuuacggaggaugagccuuggagcaagucuuugauaucgugccccaggccaacucagauccgacaucucccaauccuuccugcuucgagggauguauuauuuacacuaacuuuuuaauauuuucagauagagucguauuuaauaguaguauuuuauauacagaaaaaaaacaaacaaaguaaaauugaugacuuuuccaaagaccuaccuaccauccuauucuugaguuucuuuguuggucuuugaugaagcauaaaguaacgaaagucccacugggacugauguggcaguacauccuguaaucacagcacuuggaggagcugggacagacagguagaccccaguguggacuagcuucuaaaacacuguccugacuuuaaguuauauauaacacugcaaggcaguguuaccugucuuugaaacauuuuuauauggaagauuuauuaaugaauauacacauuuuuuucuuuuuacugacacagaaggggccaaauucuauucuuuuaaugauuuccuaccucuacuauucuggcucuauuuuuaaaaggguguguguguguuauguuauuuucaauuccaagcucucacugagaguuucaaggaaguccagauaguauaccuauacuucaguacucucaccacacauuccagaauuguaauaguauucuuucagauuucaagcaguauguuaguaaugauaagguuaacgcauugaaaauuuuucauugaaaaauuuaaacaaauauaaaagacuucugagaacuugcauaaaauauuuauaaaaauggaguguuugaagagaagccaacauuuaagcuuauuugcaugaauuccuuucccauuuuaguuugcuaaaaacaucacaguucauaacacugaacuaaauagcuaaggauaagauagggauccaagccuggugcuuuuacuaaugaagagucacuagaaagcacagguucuccugugucugggucccgacacaaaaggaagugcugugcagagaauuuguuugucugaaggaaaauacuugcugacagaaaaaggauauuuuaguugccacuuuuauuguaaggacuugggagauuagccagugccagccacacagaagcuagagauguggucuucuaaguacaagaggaguacaggugcggcuguuucacgagacagccgacacauugaugagggacaguaugcuuacuauaccuaaaccuuuucacuucagauuuuuaucacaugauaagugacaaaauuccaauugaaaagauauuauaaagugagaacuuuuuauucuugauuuuaauuugacuuucuaauuaauaaacagaucuuuugaucccagguuaaauuaaaaaaaaauuucaguuugucuuuuuuuuuuuuuuuuucuuuuuuuggucaaagaaaagcauucauccuguugagaugauggcuuacauuagcauagugccgugaggguaacugccaccaaaaaucacaagaaacagugucgccauugagucuuccugacucugggcagagugggccuugaaacauaauuagauuccucuuucagacuuuaaccaucuuccaucaaugaugccagccagccgcuguguccacuugugcagaggcucucuggucuugucucugauccaccuucaguuuaccuuucugagucuucucuuuaaccguuaugcaaauuucagagagccugucuucccauccucuucuucagucaacuucgacggauuaaaaccaugaggacuuucuuaccuuucucuuuagccaacaggccuuuccaagaaacucuccuuugucguuagaccuccuucuccaaacuauuucuuauuacucugaagaggccuagcuucauccauucuugaccucacagugucuuccuuguauaaauaaagcaccagagaggacacuccuugugggcacuaucccuaggacagcaguaauaaaacuucacaagguuuccuccuuuccucaguguaccaaugccuuauccuucaggcugaaauaccuuacaggaguuggaaucacaagggguugcguugucgucuucuucggcaugugaauaaaauggagacaggaagauuuuagguaauaugguuuggguuugacagugagagaaagacaugcauguaagguuugucagacugacaguagaccaguuuuaucagagguggccuucuguguauacuugucaauaaugguauauuuaaucaaucaaaaguccacauuaaugacaaagaacaggcuaauauguacaacccauucaccuaaucacuaacuagcugggaaagugaccuuuuuuucugagugaaugagugaaauguaaaucauuuucucucugaggggccuggugcuugaagaggauuaccacauuucuuccuuauuuuuccccaugguuuuuuguuuuuugguuuuuuuuuuuuguuuguguguguguguguguguguguguguguguguguguggcugaguugugguucugucagggaacagcaggcuggguuguagaaguaucgauaugccccaugaagaaguucugaccaaguggccuggagcuguaguguucauaaaagcaugauagucacacuuggcagaacuuaguuuaccugggcugucaucucauccucugacuuaaucuuucuuugauccuuaggaugacugggcacucacccauuuauaagaaaaacccauauauuugcuucuuauuuggagugagggguggcagaccaacagcuaaaucaaauucuauuuguuuuccucaguuugcucuucauuuugcuuuggugauuagagauuuuaaaaccccgucgguugagaugaauggucuguauagaaagacauugucauccuugcgaccuuugucuguuccuuuguuagcaucucacagucaguuugucauacauuuuaccaggaagguaaaugccuccucuuggucuuuaagguauguggggguugguucagccagaugaauaaauuuuaaaacaaaauaauaucugccuagggugauuuauaaauaaauaugaggcaaccauugauuccaagugugagccuucuucuugauugcuaguuaaaucaguccgaauuuaaacauguaaacuucuugauuuauauggagguaagacaucuguauuugguuuguuaaaaccugcugaugucuccagaacuaaauuuguucauguauaggccucuggguagccauagcuaaacacagagauguauagguucugcucaccuuauuaccugacuuccagcccuguacaggugugcaggaauaaauuagcaucagccccuccgacgagccacugcauauauuaacaacagaggugaagaugugagagcaugcuaccugccuccuguuaucaccuucucagcagcgcagcauccauuuuuccaucauucucuacguuuggaaacuuauagagaacuuuuauagagagagcuuuucaauaaagaccaggcgacaccuccaagacaugagccacuuagcaccaauucaagggaacuauuaguauaugugcucuaauguaauuagcugucaaauaguguguuaauccucagaggagagccucuuaauagauaacugcuucacugccuacauugugcccaaucagaucucacuucccuguuuucaaaauucguuauaaaguggaguuguguagguccucuggccuuaagagauguuuccccaccggcuccucuguuagguuucacaauagagccagaagaucaauaggccuuuuguacugaucuccauuacuuuccaucaaaagcaaacaaacaaaguaaaucccccuccugaguaauugcugguugugcccuccucaagcaaaacuuugguaguaagauaaacuucagugucauucuugucccugggguucuuuuuauacacugggagaagagcaaugagcaaaacggucuccuuguaucauggggagagacucugucaagccuaaagugagccuuggaucuuccuaaugaccuccugcuggccuggcuggaugcaagacaagcucauuuaaaccucugcugaccuuucacuccuccaaaagaacugcugccuucacugccaccaucuucagagcugugugccacagaggcagcacuggggccagcaaaccauuucccuugcacgugcaaagagguauuuuaucaaugcuguggaccgaaggcccuauuaaaucuccugugacugugcagcucuuacgacaaaaagaacgcuuccaaacagccuuaauacuugcccuucccuagaaaggaucaggccauuguuuuuuuaucagcaucgucuggaaaauucuggcaaaauaccaaagaaggcauaucuuuaguauccaggcaguaugguucaugacauacugacauggcagccaagggguuguuccugcuuccuguuucugggccaccaaaacuaguaggcuauuuuuuuuuccuguuccucuuucuuuugugaaaugucauuuggcauacuuguuuuugcaaauuccuuauuguaggaaagugguguggggcuacacauacacauuaauauuuucucagguaacccugguaggaucccuuccuucuagucaccuguguaacccugguaaaaagcuucuaaccagcuaccuuuaaguaucguuugcuccuuguuuccaaagacaaggagagacguuguugcugaaucucacuccaaguuuguccuuauuguuuucuaagacuacucagaaauaauaugauguuuuccccuuaagacucucaggaccuucaaagugacgaauauggcagucuguaaaagaaguuugcacuugccaagaaauuauaguguuaaaaauuuaaaaggagaucuagugaccuugauucucuagugccaagacuugagaagccaggcaugccaaguugccaagucaguggaagagagaacacauuucaggaaaggacaguuuuuucuucagucauuucacauaaggcuacacuuuagaaaaauaccugcauuuuauguccuaaugcaaacugcuugaauuaaaacgagaguuguaaauuccugguaaaaagcugucaggcugauguguuagugaucuuaacucuaguauuuuauggaguuuauuacuucuuuuauuaacuaagggggaaaauguuacccauuccaauuuaauucuuuuucuugcuugcucuaauuuuuacuuuacccugggagagggagagagacagaaacagacagacagaccaagugauuuuaccugaaggcaugugggugauggcugucucaccugugcauagauacaucuguaccauaccuggcuacugcgagucauacucaacagucccauguaggagcaccauguguguuuauauauggaaacacacuuaaacagaaacacccagauccaucuuagaaaaugauagaugaaguuacucccaucacagugggacacaggaagcuuuucuaaguaaaacugcagagauggagcuaagaacagacccugggaaggaagccucugaaggcugaugguuggaugagcgagcugcuguaacucugucacucaggggcacugcugggucacucugcucacuaguaauuguguuuuacagacuucuaaagcaauuggcucagucagucccaauucaauaaaaguagagggagggagggagggagggagggagggagagagagagagagagagagagagagagagagagagagagagagcgcgcgcgcacacuuuuguucuauuuuuuacuugaaauuauuucauucagcagucugucuuuuuuauuaccaggacuugacauuagcacuccaagcuauauuagcauccauuucagcaguucaguaaugguauuaaaaaaacacuuaacuucaacggugaauggcuguaugacagaaccauaaaaaauccacauuaaaaaaaaucuuauguauuugucccagcaaauuauuuuucacuuguuuaaccacuucaaaacuauguucucacgacgagugcuccaaagaaccaccuucuuucucagagugguggacugcgcagcucugugggcuugggggccagugggguugggggaaagaagggaacccccuggugagaggaagguagggcuguuguuuaccuguagcuagauuaccuuccauucaucagcagagauggaauuggcaaccucagagcacccaaggugaaauucuuggaucuuggagccugacugggauuugauuuugaacgaaacacucuccaaacuugggagcggagccuaaguacucuggcacuguggugugcucauaaaugacuacauuagguucuaaauuuugauuaaaccuucaguaauuaaucaaugcuagacaugaagcaguuggcaagguccagagcugcaaaauguuuaagacauaaaacauuacgaaguaauuagaauaugcuccuucaagagaaggguugccuucacuaaagagguaaaugauagcauccuguuuauuguggauguaggcagccagagcaauaugauaaacugcuggagauacacauaucaguaaucauccacauuauuaguaccauuaaucauaauuccaaaaauaugacagcagcagccaacuuuuugaccaauuuugcuucugccuguuggccauuauaacuucacuaauagaccgcagagcuccuuugcguggcaguuugcauugagaauggaagguuaauuauauuugagcugcugauuucuucucuccuuggaaaaggcuuagcacuuugacaaucccaggagcucgagguuguuaaaccaguaaaaguacuuuauugaaauuuucuuuguuggugaggaaugagauguuucaaaugagauauaagcgccaggcugggacagcacuaauguuucuugcuccaaagugauccuuggacagcaagaacuugugguucuuuggaccacuuuaccuuguuguuucuagucugccccucgguaaagaagaaguucagcaguauacaguagaauaccaggaagcucuaccagauuagcgguagugucaaccauauaugucagaauagcauguuacacuaauaguuacauuaaaagcauauacacuaguagaauagugauauuaggagcaagaagcaacucuguuaaaauacuguguguaugaccacaaggaaaaauucacaaacaucuuuuggaugcuucugcaaguuaaaauguuuagcagcagguauaugcuaccagugggcuaauucaaauaucccaugucucaucgggcaggcuggacagcacaugagcaaauaugaagaugagauuaugcuugccugcguuuucaaauucaugacuuugauuuucuacacacgguucuacauaaggccaaggcuaagugauagggauagcccuacaggauacagucucucugcaugggggagcuuagaaaacccugaugccaccucuuaagaucacaaacuguuugaaugauacaaaacauuuaaaaacauuuucucucagaaauuauuuucuuuuaaaaugaucucagaaagaaaucaauaccccauauuuuacacaggaaaaagaaagaaaacuuaaaauggaagacagauuugaaugugaaaaagcaguuuauuccuguuauugggggaaaaucuucuaaauuauuuaaauuagacaauagaauauggaacagaagaugcgaagguuguuccuuuuuuccagccuccguagauauaaaacuuaaaauuacagcuccgauuaucuucccaggaggcuuuucucucucuuaucugacaauaacucaguaacugagcaccggaugagcugccugauacagaaauuucccaaacugugaaggcauagcuuguucacaguguaacacuccccuuacauuguagcacaacagguacgacagaacaaacagcacccuucaaaagccuucuugugugagauacaacugggccuuaaaacaguuagggagcaggcugucguuggauaucaauucuguacuuaaccugagcaugcaacauacacacucucugucuacccaucugcccucccacaugccaucacuguguuaacauuuuuaugcauuccauagccaugacaaauuguuuucuaacuguagugccaaauuuaguaugcaaaagacauguuugccucugccaacaaaccaauaauucucacuaacaucuucagaguuacagcauuuauaaaguugcaaaguggaguaaacaaaccaucuguuuggcuuuuccauagaugucaugcuuucuuauuagcauauuacgauucauuuaguaaacaaauuuggugauuucguucaugucaaaguuagaucggaagccugaagaugauuaacauuccugggacaagcacauuaauacauugcuuccucugcaaaguuaaauggcuucucaagagaaucgccccuuguugacaagaugagacugucaauuuuguuugccugccacguuaggggccauaaggggauggcaggcucugagagaggggagucguguaggcagcauaauucacugugaauugagaaaagaagucuaauucugauaaauggucgaccccaauacauccuaccuguuauuacaacagacgugccguaucugugcaguaaauuaguuaauccccuaaaggguuuggugggagcuuaucuucaagugaaugauuugaauguagagggaacugccugcgugaccaguaugggugauuuguuuuauauugaaagggguugaaauaacugaauuucauaguuuguuaauuugcaagaacuuucuuaguucuuauuucuugcauuaaguaugccuuucuuuugggggguuugagaauuacccacuagaauuuuacauuggaucucuuccucugcuaggggaggguauucagacugucuggagagaguguuuagugaaaauucuggaacaacuacaguuuuguuuugaauuguuuuuagggaggggguagugcuaaaaugucauuuaacucauuuagguguaagcaugcgauuaauuaauaaauagugauacacuuugcaaugaauucaauagucaguauuguagcagcucagcugagaagcaacugagaaguagggccuguaaucuucuauuucugaggauuugaagaguggguauacauuucuguauggaaauauuuuccuaaccaauacugcauucacaucaggcacauauacuuucuuagauuugauaaaaaucccuuuuacugccuucuccccuuuccucaugcacauagacagcugacacuucauguccagcaguucuguacacguggauucaaccaaccacagacaaagaauguuaaaugcacccaacagcauccaacacauagaaacauucuuuauugucacuauuuccuauaugauguaguacaacuauuuguauaucauuuaugucacaugggaaucauauguaaugacuuaauauaccauguaggauuguguaguacccuuggaaauacugucagcaguuuauauaagggacuuuuaagaaucugugaauuuugguuggggguuuaugcugaccuaauccuucaaugauaccaagggaugacugcuaacacacacacacacacacacacacacacacacacacacacacaucaucaucaucaucaauucaucauuaucuccuccuccuccuguagacuaugaucauuuuagacaguauugagaauauuuggcauacauuugugguagauuacaaaguggagcaagaaaguaaaugcaaaauguaaucaacagugaagccuuacuuccauuuuaaccaaagaauuguguaauaauaauucacuaaacucagaauggcaaaaaaauaauuuaaaaguaaguauuggacauuuuauauaauauauuagcuugauucaugaauuugugaaaucaguuucugaccagcugucuuaauuacuuucuacugcugugauaaaauacaugaagggucaaagacccuuaaugaaacaugguuuuauuuacuuuagaguucaaggaauagucaacucugguaggaaagucgguauagcaaaaaccugaagcagcugcuugcaucauauccagucaggaagcagagacaguagaugccuauguucagcuuauugucucguuuuuaugcaguguagccuagggaauggcaccacccagugcaggugaaucuucccacuucaauuaaccuaauuaagguaauccccacacacaugcucagaggcccaucucucaggugagccuggaucucucuagauuucagguugacaagugagaguaaccaucacaugaaaaugaacaacuagcaauaaaaccaccuguucuuccccuguauuucaaaaccaaacucaaacucuguuuuuuuuguuuccauuuuugcuugucagacauuacauuaguucacgucgagcauuugagcgagagggggaaaugagagcacagccuagagugcuuguuuucuuucccuggcucugggcauuugcugcaucuucugugcucugugauugauuguaccacuaagguuuccuccaagaaacagaaagguacacagcaugacucuuuaguccagaagcuuagguguuagcacccugccccaaucuaaaaccuuacuacauuuugacuuuucuggguguaaguuuuggcagauuugauguugaaggcagaaacucagagaacauuuguaacucuguguguagcccaggguagaugaguauuuugagccuacguucuguggugugccuugaacuuuacuagaguguccacuuuugcucugucacuaucgucauuacacaaacacgggaaaaaugcuucugucucaugacucucuucugcgcuggguuggggaaaccucgugccagacuuguaugucuuacugauuggaugcgaccuguuuuucaaggcuuccacuuguucuccuguucucugaugggcugacuuacaacguaucuguauuuuugaaaguaugggcuaaaucuuaggccaguguaugaagcccuuuguacccaugauuuuuuuaaaucucauuccuuuuuuuuuuuguaugugcggauaaucuucuucauagcuguaucuaucaccugcuuacucaaggcaggcagaggcagcuucuuauauucuucaugcucuuagucuaaauguugacaaaauuuaagucuucucuuaagguaaauguuuggaacacuggauuccuuucuuuucaaaaccaagcauuauccuuggauaauggauccuugugcugggcucuuccuauuugcagcaagcugugcccucccuccugucuuugggcuucuuuucucucagcaucugauugucaguagugaguucuuucugucuuccuucuuuuuaccucuucaguuuugcugauccaauuaaacuuguaauauucuucaaauggcuauuaaccccgggucuuugaaucucacgaggacgguauuuuuuaugacagucagugguuugaacugaccgauuagagggucugacaauaggucuuuguuaaagccaagcgguccauuugguagagugagaacgcuaaccugaggaacaggaccaguuccugcuaggaaccuuggucagcccacuuuccugcucuucuuccaaccccagcaauagcauggcaaagacucccaaguccaaggcauggggcuaaaccagcaggcuucccccagcccauucuccucaccccauccauguguuuugcauauggcauuugggaagauuauuaaacaaaaaugaaauagauuaagaagugaacauaaaagaaucaauucucuugaacugugguugcauaauggaaaucgacugcugugaaugaacccaugcacugaaguuaugaacagcaaaguuaaugcacugccaugaguucaucuuuauuauuacauuacaccugaaucaauugauaaaguagcuuuuuuuuuguaagcgagagauggcacuuaauugaauaaaagucaauguaauuauauuagcagaggccaacaguacugcugacagcggaaaagggacacuguugcaccgagugccagagcuggucuccacauuucugcacaucguuugguugacagauauugagggcugguacaucaucuaauuagauuacaguccucuugugcugcaugugagaaaugaagagaaaaaucucuuccugguaacauaucaguggagauguguaaauucacaagucaucuuauggcagaggugucccucugggugaucagcauacccucuugucaauguuaauuuauucuuuccuauucagucugucuugaugcaacuuuugugugucuggcugcuguuuucucagcagcgaaccuaggaagugcagugacugcggaugugugagcaacagcacagaggucuagacugcagucagaugugugcuuaugaaacucggaaaggguggguguuaaaaguaaugagugacgauaggguuucaugagcugcuuacaguuggcagacuguuuuaucaauagaggagcgauacacauuuuaacuaucuccacguuccuucuuguuaagcccuggugguaugugucucccccgcaugacauucuaagaacuucaugguaggcacuuucugcacucugcuuagcaguguacacuugagucaccugacaccagggacaaguggcagggggguguuaggggaagagagggugaaugucagaacaggacuguggugacaacaucuguuuaucuacauucauacauccgcacacugcaugcaucuguuuggaacucauuuauggaugaugcugaugcuguaaauucgguuuuagcucauuugauuuaugguuuuuggaauauucaggugaucugaaaaucaagacaacauacagaugaucacuuaugacagaaaauaauuuugagaucagacaauuuaaaucccuauuuuauuguuuaaguuuuuuaaaaccggaugccuagaaugugaauuuguuuucucucucucuuucucccucucucucucucucuuucucucucucucucucugucucucauucuugcuuucuuuugugaucgauuuagcaaaagauuagaaagcugaucuuauugucacaagguaagcucagccuucccaagugcagcguggagagggcugccccccucugcccccuccacccagagugcugauugucucauguggaaaggugggacaccucucccuccuuucugguccuggaggcacauaccucucacacaucucuaggaaauguuagcuauacuuggugccaauugaaguggcuuuucauuauaaguaggaggucucaugaaguuaaugcuggccguuuaggucauuucuacuaucacaauuaacuucucuaagaugccagcuucugacgcuggcaaguuuuauuuccuguuucuauaucacuuuauuuuuuggaggguagcuuucaauuuagggacuuggcaaauaucugagcauuugcagguggagagagguauaugcccaagggcgcuuuaaaagucaacgggggauguaaauacaaggcaauguuuucagauaaacagugacauggacuuuucaagugagaucccuauagaugcucugggaaugaaucucacccuuuuaaacacaagcaaagcuuucggugagguuuugcuugucaaagcaaggguucuauuugucaaauaaagggaauauaugucauuguguuugaauuuuuuuaauuuacugugcauuaauuuuauccuuuuggauuuuuuauggggggagguaggggccggauauuuuagaaaauagcagcuuaugcuuuaaagaauuaaaccuugaaauagcauuauuuuaugaagacaguucaauacuauaaaauguaguaacuuuugaaaaaauaaauguauuuuacuauuagauuugacuggaauuccagauagguucaagaaaggaucucuuaacuauuugaagucacuaauuugcuaagacuuuuuuuuuuaacuauaaacaugaaauacaggagagugaggaggaaaauuuuuuuuuaaaguuaaaccuaaauuacguacaccauuuacguuuugaaaaugcucaucuuuuuacacaguauuugcugcaccaggaacaguuuauuugcuguucuuuuccgauuuuaaguacauuuagacuguuccauugagacgaggagagaauuuccauucuuuuacccuguuucauguuuauucuccugcucuuauuuaauguauaagcugucugcugcgagguccucuguggcugacacacuaacaggaacagccauugagaaaagagugccgggguuugccuucauccugcgcucucucucgaagaacuuauucauaaaaauuacuacguuaauggaaagucccccuuucgcuccucccaccugcacucacucccagauccugaggauggaggggaaugcuugcuuuucugaugguguaauuaggaaugaaugugcuuauuuggugcuuaaugaaaguugaaucaauuuuaaaaugcccuccuuuuucuccccccuccccacucccugugcgccuccccccuccccucuuguuuuccuagacacagugccaauauaaaccugcaucguaaacuguugaccaaagaacuggaugacaugagccuggacucaucgcagcccucccuuagcaaggaccuccgggaugaauuuuugaugaagaucuauggugcccagcacccucuggggcucgauggcagggaagaugccuccucucccgcagggacugaagacucccaccugaauggguacgggagaggcauggcagaggacuacaugguccuugaccugaguaccaccuccagccuccaguccagcagcaguguccauuccuccagagaguccgaugcaggcagcgaugaggggauucuucucgacgacaucgauggcgcgagugacaguggggaauccacucacaaggccgaggcccccacccuccccggcagccucggggcugaaguuucaggaucucuuauguucagcaguuugucugggagcaauggugggaucaugugcaacauuugccacaaaauguacagcaacaaggggacccugcggguccacuacaaaacugugcauuugcgagagaugcauaagugcaaaguccccggcuguaacaugauguucuccucugugcgaagccgaaacaggcacagccagaaccccaaucuucacaaaaacauucccuucacuucaauagauuagucccagaacggacacuccaaaugccagcucucaccagauggccuacauguuugaacugccauagccagugugugcuuccgcaguggggcacauauguguguguacauaugugugccucugugucuacacuugugcacacacauacuuucuuuucuuuagauaaaaaugauaaauacuaggugcuuuugaaauuuuuuucuuuuuccuuuauaguuuugggagaggguggaucuuuuacuugggguaaaaacaagagugcccuuuucagcacacacacacacacacacacacacacacaaacacaacauaacacacaaagugugcaacuaaccccaauuuugauaggauaauucuuggucuucuccaaagagacauuuuguuguaccuaugacuguugccugcaaaaacaauaaauaaauaaaaggggaaaaaagagaaaagaaacaaaaaggaacuucuuacaguugucuuuugugaacuuuaggguuuugagagagucuuuaguuaaagcauggcagauucaccuguaaauauuuagccuugagaggccaaugauguaaagcaauuguauugaugguucuuuaacucuccuuuaauuuuggcaguuacauccagcuguuagauaugcaggaaauaaauaguuugcuggcuaguucuauucauuuuuguuagcauuaaugcacauuuucuuuaaaaaaaaaaacaacaaaaaaacaaaaaacaaaacauggucuuguuuuuccuaaccuguuagauguagugguaaagcugugcuggcaugcuucacagcacaggucugauuucuuaaaaauguccuguaccaguacguaaaucccaucaugcacuuuguucguacgcuaaaggggauguguaauacccaggcuuccuuuuacccagaaacuaccgccauacuucaaggagc

SEQ ID NO: 1969 - RNA, 1700 nt, Mus musculus
cuauugagaaaucguuuucuugcagugguauauccaucuguuucauagcuuaugauauguaggccaguguuagaaauguaacuuauuuguuuuucccuuuguggaacuaguaguaauuucauguucugaugaagcuuaguuguuaaaacugucuccauuuuaacuuucccaaagcugaaucaguucuguguuccugagcuugauagauguguuagagggacauuuggauggaacaggagacucgauccguauaacacucagcuuacugaccuucacagcaggacgugggaggacaguuauuuuccuuauagacugcuuuagccuuaaggaaggaaguaccugccaccaagcuagugaaugcuaaaguugucauuggcuuccaggugaucugcaggaagaugagugucauuccuuuggccgaugccacccuguaagaaagacugcuguuacgcuggggcuuugggagcuuuucuucaguauguucuauaagugugauuuccuuuccuugcuugcaguuauuuagggaaauauaaucccacauuguuacuugacuuagugcuucaucaaaccugauuuuuuuuccauacccauguuuuaucuauaccucuuagcucuuucaguguaaaaauaaacagguuugcaucaucuggacuauccaucacuuaauagcauauuaaacauauauacgacauaaagcauuuucccguggacuuuggauccugugacacaugaaaugcaaggacaguagaguuaaguuagagucauuuaccauccuacuuuaugauuuacuaugcugcgagccuuauugcuuauauaggucacuguuuacagcauuucuuguaaagauuuaauuuuaaaagaauaugugugugcauacaucucacacacacacacacacacacacacacacacuauugcaguuggaguggaagacuaugaguuccggugcuuguggaagccaaaacaggacacuggaucuccccaaguuggaauuacaggcaguuaugagccuuccuacgugggagcugggaaugaaacuuggguccucugcaagaguaguguguguaguuaccugcugauccaccucuccagcccuacuucuaaaucuuguauaaucagcagaaagugauuuuuguucucagucucauuaaguuugcauucuccccuuuuacuuaauaggucuucguagacuagaggcccuuacuuaaauggaaaguauaaaauauccaccaaaaaaaaguuguaguuuuuuuuaauguaaguguacaucacauagauguugcuggauuuccuguuuuuauuuacuaaacucauaaaugucaauuaaguuucuauuaagacucaguauguaaaaugaaauuuuaaccuaggauccaaggcauucuauaaucaaaacucuugguuauguuugucuuacauuuugaaucaggcgcucuuggaauucuguuuacaaauuccacaaguuuauuguagacauggugccuuauaaagacuugaacaggacagaucaaagucaauacuuccauaugagaggucaaaugucuuuauuauuugucucagucuguguuaagcuuacaauuuauguaaauaucuaugaaaggaguuugccaucagccccuaccuaucuugugucuccguagcuguggcucaucuuccucagccaguuuucuucuucacauuggaaagucucccauccucag

SEQ ID NO: 1970 - RNA, 1693 nt, Mus musculus
cgacgacaccgaugagucccacuguguugagguaagaugacaggcagagccauucacuaaggugucuggagaaguucuuaccacacuguuggcuucaguucccuuaugaauccucucagaguauauucauaucagcccaagcugguggcacagacaugaagaaccaguuacuugggaugauaaggcagggcgauagcagguucaaggcgagccuggacuuaccuucaaauaaaaauuagagaggggcuggugaaauggcuacccaguuaaaggcaccugggacccacagcuagaaggagagaaccaacucccucagggucuccuuugaccucugccuaagugcacacaguaaagguaguuuaaauauuauuuuuaagaaugaggagaggggucuggagagguggcucagugguuaagagcacugacggcucuuccacagguccugaguucaauucccagcaaccgcaugguggcucucaaccuucuguaauggggucuggugcccucuucugguaugucugaugacagcuacaguguauucauauacauaaaauaaauaaaucuuaaaaaaaaaugaggagagggcuggggauauagcucgguggugcauaguaccugccuucaaaugggugagucugguggcuucugguggaagauaucaggacacaguugaggacgcacgguuaguaaacuagggcaagagccaacaggggcuaguguucuagaacuagcucaguguaaucauacagaaugguccucucugcguccacaggggcagugagccucugaaaucagcgcgagcugcucauacuguagcuuccuguuugaccgagaguguagguucugacugucugcucugcccugcuugcuauucaguuuaagaggaugaccuuuacagucaggaguucaaaucuccuacucagcuacuuugcagcugguaauugggcagauuaaacucugagcguauguuccuagcugugaaauacgauuagugcugcuucauacagcauuguuaauaaaaagucaaagcauugguugcaggguuagcucaaugccagagcauuccucccugggaaaaacaagcaagcacucaggagucagaagauaucuguauggauacauagccaacauacugacuguaacugggcucaaucauacacagcgccuucggauccaccucuaauucuugaguuuguuuuauuuuuagcacaucgagucacguacucuggcuaucgcccgcaaccugacccagcagcuccagacuacaugccagacuguccuggucaacgcccaaggguuaccacagaacauucaagaucaggccaaacacuugggggugauggcaggcgacaucuacuccguauuccgcaaugcugccuccuuuaaggaaguguccgauggcguccucacaucuagcaaggggcagcugcagaaaaugaaggaauccuuagaugaaguuauggauuacuuuguuaacaacacgccucucaacuggcugguaggucccuuuuauccucagucuaccgaggugaacaaggccagccugaagguccagcagucugaggucaaagcucaguaaaccccuccuugucaccagagcaugauguugcuggccagaugaccccuuuugcuguauugaaauuaacuugguagauggcuuuagcuuagaaaagcagcuucuuagaaccaaggg

SEQ ID NO: 1971 - RNA, 9559 nt, Mus musculus
aagaggugacagcaucuccaaugcuuuaaaguuacggcucuuacaagagucagcacuuaggggcucauuaguuggcuuuauuugaguuuagucacuccagagcugaauggagccuuccuauaaguuauccccaacaaagcagcccuaaacaucagccacgguccggcagaggaggaaaugcccuggauucaccugcggcaccugccugcaccccgguaccuccaccuccgcagcguccacggauccuuacgcuccaccccagcugccaccgcucagcaccccgccggccgggccagggccggagagccugguucccgccucaccccggcggcagaggccaggcccggucccugcaccgagucgauccucucgaggcccuccggccgcagccucuccgaacggcagcccgcgggcuccggggaccucccgcccacucacucagcgacuaggccagccggccgcuccccuccucccgcgcggucccgcacgcuaccugagcggccuggcggagcgggaggaaucgggcagggcagcggugcggacucaccugcgccggcccagucggcgacuguccgacaccggagcuuccuggggugagaaagcgccggcuacgcggccugggcacccuccgcuggcagggccgggacuccggggccccucugcgccugcgccuccgcgcggccgggucuccaggggacagccugcagcgagggcaacugccgaccgaagggcucgcgggccgcgggcgcugcgggaggaccgacgucuaggcacugcccggggcgagacuguccggaccacagaccgccauguuucuguucccuauucuuuuuugccuucccuuccuuccgcucuuuuccacagaacaccacuuucccucccuccgucccucucccuuuccuucugcgggggcgguagaaaggacgcggggggugggguccgaggucggacccgccccgcuagagccacgccccugugguugggcuccacccagagguugacccacgcccccagacuccuaccaagccucaggcucaggccacgccucugcgcuugugccccgccccgcgagcgcccuccuccuggcagaauucuggcggaccucggggcgcuccuuagaaucccgacgccgaagcgagaguccuccagcucuccuggcgcuaguuguaaccuuucuguuuguucugcgguguuuuguuuuguuuuguuuuguuuuguuuuguuuuguuuuguuuuguuuuguuuuguuuuguuuuguugcgguugccuguggcaggugacuaccgccucuccaggcucagguuuucagagaaugagaaagugacuuagaauagcucaaggucaaugaaagaaaaaaaaaagccuagagagacuugcaguuucucuuuaguagaggcuggaaguuccacccauaauugugugaccccaaagucugagugacacuggagggcugcccuucucuaagccauccaaagaccucugagagaccuuagcugcguugucuuucucuacuucuauccagauuuugauaacgccaaacgaguaacucuuuaguuuagauaaucguaauuugcugccucucaaagguaaccuagaucucgagguaaacauucugaagcugaugguugugagccucaggacagagugcugaggauuugacucugguccuaaagagagcagcaaguacucugaaauaauaaucucuuuagcacccaauuuucaguucugcagguacugaaggacggaauuggagagucuucacuguaaugaaauuuugacaaaauauuuuaauuuguuuuguuuguuuggcagaagguaaggugguguguagggucucacuauuuagcccuggcauuuccugcaagucuuauuuguaaaucaggcuggccuuaaacacucacccuccauugcuggaauuaaagacuugugcuaccacuuggugacaauuuuuuuaggguaucaauuuuucaaggaacaaauagcuuaaaauaaguuacaacuuuuuuccucuuggcaaaagacagauuaggcggcagggguggcuggggggggggggaguagaacaaaagugacugauguuuuugagcaugucuuagugaaacccuuuucuuuguaugcuguuaaaaauuucauuaagccgagcagugguggcgcauuccuuuaaucucagcacuugggaggcagaggcaggcauuuucugaguucgaggccagccuggucuacagagugaguuccaagacagccagggcuaucuauacagaaaaaaaaaaaccuugucucgaaaaacaaaaaguucauuaaauuauuuuaaauaugugugcguagcgggugaacucccguguucauaguggucacuuugcugagaguuucucuuucauuugcucacgguuuuugcuaacaaguguaauaauguuaagucugguugauaugugccugguugucuauuucugaaguuaacugcagguuugaaaaguuuuggcuuuugacuucuauagcagacaccauuuuccuaaccacauucgcagucagaauugauucaagaagaaacagugauauaaauaugguuccauuaacaauaguuaggaguugaucuagggcccuggaagcauccuaacaguccagccagcagaaacguuaagggacacauucauauuugaaaaccuagcuuguggacuucuuuuuuuguuuguuuguuuguuugguugguugguuugguuuuuuucgagacaggguuucucuauauagcccuggcugucuugaaacucacucuguagaccaggcuggccucgaacucagaaacccaccugccucugccucccaagcgcugggauuaaaggugugcgccaccacuguccaaccaacuuguggacuucuucuacuuccucaccaaggcuuccaaaauguuuaaucggagcuauggguuuaacuuaauaggagagaacuuauucggcuagagugagacccuagguuggaucugucccucugauggcugcauaucacuagcccucaggcacugaaagggccuccccuucuccccaucccccauucucugggacuuguaaaucagaaggucagaugcuagagagaugacuuaccugugguacuuugaaaaugcuugccccagggaguggcacuauuuggaggguuggccuuguuagaggaaguguggauguggcuuuaagacccuccuccuaaccacaugggagccagucuucucuuaucagccuucagaugaagauguagaacucucagcuccuccuguaccauaccugccuggauguugccaugcuccugccuugaugauaauggacugacccucugaaccuguaagccagccccaauuaaauguuguccuugugagaguugccuuggucaccgugucugcuaacagcaguaaaacucugacuaagacacagccuuuucaggccuccaguguuacccauacauacauguacauauucacccacaggcauaccaccauucauauaaauaaaaauuaaaacuaugagacccuuuaaaagcaguaaagucagugugcuggcuuuucucaacugaggcucccucuucuacaaugacucuagcuugugucaaguugacauaaaacuagccaggacacagguugagcaaacccuggggagcaagccauuccuuaaggcuucuacaucagcuccugccuccagcuucuagaccuucuugaguuccucuucugacuucuuccaacaaugcacagugguguggacguguaagccaaauaaacccucuccuuuccgaauugcuuuuggccacuuacagugacccuaacuaagacagaaaugccaaaaccuuuuccuacuuauaagagaaagaagaaagaaggaaggaaagacagaaagagagagagacaaagaaagaaagagagaaagaaaggaaauucaaagaaguuauuuuuuuccacaugauggauuacaagauuugagaaaaucuguaauuuuuuaaauuuuuucuuacuguuuucaucauccuaaaguuuuaccauaauuuuuucaucucuguuuccuucccaauaucuccuagaguaaacuugcaaguuuaacuuuucaucugagccagccauccuuuauuuugcauguccuugaucacucuugcacaugcacauccaggauaaguaaauucacuuugacguuuaauauagaaugguuuggcuauccuuccugaggaacuauuugcaguuaauaguugcucgggagaaaagaguccuuuuuuggagaccuagccacuugccagaguccagugccagaguccacuuccaguggauugucccucacccauggccaugugggcagcacuaacuggaccuaauagaauaaacauauguuugggugggaauacauaggaucauuucucauuguguacaugaaugaaauucuaaagaauaaagacaaaauuuaauguucaauuaaaaaaaauaaauaggugaugaacacacgggcccaagauuaagaauacuuauucuuacagagaaccugagacuccaguucugggagacacaaugcccucuucuggccucugcaaucaucugcacaaacacgguguacauacaaaugaucagaaacacacauauauaauauaaaaugaauaaauccuuaccaaaaaaaaaaaaaaaacaaguuauuuuucuaaaaagcuggaagagaacuggagagcccaaucaacauauagcuguuauaaucauuagagcauuagaguuuuauuuaacuuauagauacgagcauacguacaggccaggcaugguggcacaugcauuuaaucccggcauucaggaggcagaggcacauaaaucccugugaguuccaagccucccaggcuaccuagugaaacccugucgcuaaauaaauaaaaacauacauaagggaugagggcguagcuccguugcagcccucuugccuagcauguacgaggucccaggcugacccggcuucacaaaaagaggaggguacacaggaguauucuggccaacccucugaaaaaggaagugucauucuagcucccggccugcugagugagugcuuaagaucacuggagaguguggauuugcaaggcuaaagcacuaaauaggcaggaggauucggauucgguggcccucuucacggcuacaucuuacaggugucauuuuccucauucucccuguucccuucaaaaucuccuaaacauugcccuguggggacaaggucgcaugugagcucguggggacaaggucgcaugugagcucguggggccuuuucuuucuaggugcacagaaccgaucauagaaaagcaugaagaguagucucagaaauuaacgaagguggaugaaagaugagggugugguucagagguagagaggaauuguuuagcacuggguccacuucucagugccauaaauaaaacaaaaacaaagaagugaggauagagggugaagaggaaaaaagaaacaaaaaaugaugaacaguuuacacagauaggccugugcuucagucgcuuucuuucucuccgucugggggcugcucacuuaacuuuuccucuuccauugaguagaaggauuuuucccaaugaaaauacuuuacuaauucgcaauguugucuuaggauuucuuuugcugugaugaaacaccaugacccaaaagcaaguugggaggaaaagguuuauacuucuacauuguacucaucacuggaggaagccagaacaagaauucaaacagcgcaggaaccuggaggcaggagcugaugcagacagagacuauggaccuguuggguaaacaguauggaggugauaagcaggcuuuccuuccuacaagaggaccugccuccuagguaguuccuucccuccggguauaggguagaaauguuggcuggcuucauuuuucuuuuaaaaaggcacgcucaggauggggguaccuauaccuccagagguaaaagcagaaggaucaaaaauucaaggucagccuuggcugcagaucuaguucuaggccagccucugauucaugugacccugucucagaaaagaggaugaagagguguaucuuuaauuuuuuucaaaucuuauuuuuaaugaugauucauaagcaauuuaaccucccuccuagccuaccacccaccagagguagugggaaagauaggauacaggggaaguggaccuguuuagaaagguucuuuggagcaacucccaucuguguugucugggaaucagcaguucaggucacagcucagcaggcaauggcagcuggauccacucgaaaacaccucauggauacaccagcaguccaguucgguagagcuggguuagcgagaguggugacaugaccuagcagagacaaccaggccucagccuuggcuccagucagccaaggaaccagcaggaacaucagaaguucucagcugugccugucucagggaaacgaagaucagugaagacaagagacccaagcugugcacagcuggcuguaccagcaaaccaagcucugucccugucacuccauggaguccuacuuauacccuccaaacuucacguguccucuacaugccuugccucugcacacgucuugccucagcauguacagccaaucagcccgaguccaaggaaucccaauaaaugcagcucaacuaugcaauguaaggcgaaccaauacguguguguuguuagcaaagaauccuucaucacguguccuuucacaugcuugcuuuagcagaacauccucucuucugugucugccucagcuaaacauuucuucacgagucugccuuagucuucaaccuguguccacuucagcuaaauguuucuucacauauuugucccagcaaaacaccauccaacacaaucgaauuuccaaaggacccuuaaguuuccacuucaaggaggggagaggaagugggggaaaggaaggagaccgaaaggagaggaggggaggggaggggaggggagaggaaguagagccuaaugcugugaacuggugcaguauccccuguggcuaugcuuggagucuuggaagcuugauuaguuugacaaccccacaaggggaacuugagagcaaguuugagcaggggagcaaaauuacucuguacaccuuugauagaagaacagagcucaacaauccagcaaggucaaggguguggcuucaggacgcauacuuaugagucuguaagagaagagcaaaaucuguuccucaccagccaaauccguacuagggaucaaugggacuucuugugccgcagccauaccucuguugguagauggguuuguuuguuaguuuucuuuuuuguuguuuggauuugggggauuuuguuguaguuuuuaacauuuauuuauuuuaacaucuauuuugugggaggcaggguuagaggucagagaacagccuuccauaguugguucucucuuuuuacuuuguagauuccagggauugaacacaaaugugauggcaaauacuguuacccacugagccauccugccaucuagauuagguuucuuuggggguuuucuugaaacaggguuuuguguagccaaggcuauccuccaacuugcucuguaguuaaggauagccuugccuugaacugaucuuucugccucugcuucccaaguacuaagacugagcugccaugccccaacuccuccuuuuaaaaaaaaaaaaaaaauccuugacagagucuuguguagucuugacuagccuggaacugauuguagagcucaggcugagcccacguugcagcacuccugcuguuuaccucugagcccuggaucaccacaucuggcuuugacagguuagguaguguguauguguaacuguagcacuccagaagcagaggcaggaggcuuaaggaaaauuugagggcagccuggucugcauggcaaguuuggaacaagcuuugugggguuucaggaaggacgaggucgagaagacuuaaggcugugaagucaugaaaacagcuugcucuuugggugugucucucuguguuacauggcuuaaauagcagaggucaguguugagaacuugcccccuggcuagagguaauauuugcagcuauccugaaaaucugacuaagggcauagcucaguggaggaacacuugcauagacacggcccuggguucaaucacaagucgcguuaauuaauucacuaauuaauuaauugacuuaagccugguaugguggaacaugcuuauaaccccaagcagacaggaagcagagggaagaggauugccaaaagguuugagggcagccaaagaaagaaagaaagaaacaaacaaacaaacaaagaaacaaagaaacaaagaaacaaaagaaagaaagaaagaaagagagaaaggaaagaaagaaaaaaaaauaaaugaaaugaaaaaaauaaaaagaagaaagaaaacucagacagcucacacucaacuuuuggaauuguugcuugcccuugagaagaaaaccaccugccacaugaacacaucccccugcaucuucuccauagcuccugagcaugaaccccagcccacuccuuuauuccagaagguuuuagucacagaaacuauaagauaacaaauauuucuuuuuuuuuuuuccuagccacaaaauuugggaggaaucugucuugcagcaauaccugacuaagccacuucaguaugcauagaagggagaagagcucacuagugguagcacuuuuuacauugacuauuauccugacuucugcaggcaccuacacacaugcgcacacauauacacauuuuuuuuaaaaaaaguguugaagacaaaggcagacagaucucugugacuucaaggcaaguugguuuacacagaguuccaggacagccaggguuccuaugugaaaagacaaacagacagacagacagacaaaaaacaaagggaaaacgugucgaagugguuugauuggcacuugggaauucccuauagaacucuuuuuaaagaagcaauccauaauggaaaaggcauguuuucaucauuucaugaagccuucaguuggaugcccaagggaauguuuagagaguacuucuucuaacaaacugauuuggaauuggaggaaguuggauuccuaaggugggggucucacucucuuucauuugucuguuuaaaacagggucccauauugugaugccuacuccugguugucaacuugacuauaccuggaaugaccuucaauccacaaauggagggaauaccugagacccagaucuugaggcugaaaaacacaagcuuuugauauagacuuugcgguggaagaacacacacuuuugaugugggucuuuacacacauucaguccagaucuugaagcacccuuuaaucuaggccauaccuucugcuggaggccuauauaagcacaauggaagaaggaaggauuucuuuaccugcuuguacuuacuugccagcacaucuauuggagccuacuccuucaggauuccagcuuauacaacagaccagcugaaacacccagacucauggggcugagcagcuaccagacugcuuggacuucccauucacagcugcccauuguuggguuaguuggacugcagccuguaagucaguccaauaaauucauauauguauguau

SEQ ID NO: 1972 - RNA, 1259 nt, Mus musculus
caccagaccuuguuguuuuuuuuuuuuaauauuguuacucuaguuuaauacaaaaauaucauucuuugagcauuucuucaggcuucacccuugugaagacuccuaggcacaugugaaauuaacaaaacuuuuauguuuuucucuugucaaccaaucaguuuuguauugauuggaauccuaaaucuagccagagacccuacauaagaaccaagaagauaaaagagcuuauucucucugacagugaaggacuuugauuuaaaaccugaauuguuucugacaauaugugcuccaguagagugcuggagagaugacucagugguuaaaagcacuggcugcucuuccaaaggauuuagguucaauucccagcacccacauggcaguucauaaccaucuauaacuccagcuccagggucccaaugcccucuucuggucucuauggcuacugcacacauguagugaacaggcaaacauguaggcaaacaaaacacccauacacauaaaaauaaacaaaaaauuaaaaauauugaggacacuaggggcuggaaagagaugaaucagugguaaagaguugcugccaggcaauugggaagagcagaauucagaucccagaacucauguaagacacugcuacauguacagucaugcaucggugcauggcuguaacccagcuccaaggagaacugaagcaggaucagucccgggguucacuggcugccagccuaguugaggaaaugcagacucaaaguucaggaagaauccuugucuaaaagguaaaggcagagagugagagaggcuauaccuggcagcugcuuuuagacucucucugcaugaauagacuuguauagcauucucuaugaguaccgcgcacacucauacagacaccuuuccacaggacucagucuuuuuaaaaaguacugaggacccugaauacccuuuauuuauaugggucuaucaucaacauuuuuacaauacuaggaauuuaaacuggcauaucuaaugccuaugaauguguaaauucuauuaggugucauauaucacacugcagccuuuggaaugcuacaauacacacugaugagagagagggagagggagagggagagggagagggagagggagagggagagggagagggagagggagagggagagggagagggagagagagagacagagagagagagagagaaccuggaugugaugguaugugccuauaaauucuaacacuuugggggccagccuggcuugcaugaaacccuguuu

SEQ ID NO: 1973 - RNA, 1259 nt, Mus musculus
aaacaggguuucaugcaagccaggcuggcccccaaaguguuagaauuuauaggcacauaccaucacauccagguucucucucucucucucugucucucucucucccucucccucucccucucccucucccucucccucucccucucccucucccucucccucucccucucccucucccucucucucaucaguguguauuguagcauuccaaaggcugcagugugauauaugacaccuaauagaauuuacacauucauaggcauuagauaugccaguuuaaauuccuaguauuguaaaaauguugaugauagacccauauaaauaaaggguauucaggguccucaguacuuuuuaaaaagacugaguccuguggaaaggugucuguaugagugugcgcgguacucauagagaaugcuauacaagucuauucaugcagagagagucuaaaagcagcugccagguauagccucucucacucucugccuuuaccuuuuagacaaggauucuuccugaacuuugagucugcauuuccucaacuaggcuggcagccagugaaccccgggacugauccugcuucaguucuccuuggagcuggguuacagccaugcaccgaugcaugacuguacauguagcagugucuuacaugaguucugggaucugaauucugcucuucccaauugccuggcagcaacucuuuaccacugauucaucucuuuccagccccuaguguccucaauauuuuuaauuuuuuguuuauuuuuauguguauggguguuuuguuugccuacauguuugccuguucacuacaugugugcaguagccauagagaccagaagagggcauugggacccuggagcuggaguuauagaugguuaugaacugccaugugggugcugggaauugaaccuaaauccuuuggaagagcagccagugcuuuuaaccacugagucaucucuccagcacucuacuggagcacauauugucagaaacaauucagguuuuaaaucaaaguccuucacugucagagagaauaagcucuuuuaucuucuugguucuuauguagggucucuggcuagauuuaggauuccaaucaauacaaaacugauugguugacaagagaaaaacauaaaaguuuuguuaauuucacaugugccuaggagucuucacaagggugaagccugaagaaaugcucaaagaaugauauuuuuguauuaaacuagaguaacaauauuaaaaaaaaaaaacaacaaggucuggug

SEQ ID NO: 1974 - RNA, 2396 nt, Mus musculus
aguuauguuguugagugccaagguacuuuauaaaacugaaggauuucuugccuguguauggauggcuccagcaagaaauucuaaauaaacugaguguucauacacaaaagaaugcaugaagguagggguggggauuguuaagaagagccuucuagcaggauggggaggaggcaugaaaugcucaaaagucauuaagaaauguaugaaacuauaaacaguauuguuuuaauuuaagaaauaggaaaaaauggaaggguaaaaacacuauccugacuaugggaagaauuucucaacucaauaaguuucaaucucaaaauuauuauuuuuaccaaaauuauaacuauuuuacauauuacuaacauuuaaaaaagcacaaaacaugcauuugugugugcauguaugcauguuugaaugugacgagauauauguacauacgugugaacauauguguggagccagaaguugaucuccagggucguuuucuguuccugucuaccuuguucuugaagccaggucuuuuuguggaacccagaucgcacggauucauugagaccagcuggucaguacaauccagggcuccucuuuucuccaccugcccagcacugggucuagagguggaugcuuuacuguaaauguuaauuaacuguggcgcagagggguauggagugaggcgugaguguauggugugaguguguggugugaauacauaaugcacgugugcgggucagagacaaugcucgggaguuagcuuucucucuccaccugggucccuggggauugaacucaguuugccagauuuguggggcgagcacuuuccucacugagcaaucucucuggcuguuauuuaccucagaacauccaggagguucuuguguuaaugucuacuuuguaaggaacagaccauugucuggaugucaguuuuggaguggcuaccaacauaacaaaaaugagaagaucugaguguuuagaucauaauaauccgagucauacuuccagaguuugauuccagaucuguaggaaguauuguucaugggacauuuuucugcugagauaaugaacacucucaguggauuuuuaaaagccauccugcauuuguaagaucacacuauaaagaucauagcuuuguaccuguucacugaagaucuccauagaucagaaugacaagaccugaagacccuaacuuccccuucuagugagcuguaugugcucaaugccacagcagcuuugucccuaguaauaaaagcccguucugaacccaaggaacacagggagaaaaaucugugaauaguucaaagaugacuuaguuuagcaaagucagcugcuucgaagccuggagaaagcagucuggaaaccacuguccucucacaagagacuuggacacucuccuuugagaugccuuccuugccuucaacacaaacaggagacagagcuggugacguugguuaauacaacaguguucugggcacuugacuaccaugaguggaaccuaugcuggcaugaucauuuagaggaaaucauuuguaguguuuugacuuacagauuuuuuuuuuaaguugcauaagcauguuuaagauuggacgggcaucugccgcaguauucauggugguugguggaggggcagggauauggcuuggaaccaccuguagcuguagucagcugaucuauauuccccugagaguuaccuacaagguaaaccugucaagcgcugugggacaaagguugaucugggcuuguuuuccccugucuuuaaguuuuaucaaggaaagcuucugaggcuucugcaagacugaagacucaacacaggcuucaaaucaacccucggguguggcuguguccccauucuacgguggucagguuguuugguuuuggcuuucuuuaaugaaaucuaucaaaaucaacuaguccccauuaacuucuuuuuuaaaaacugauguaaugaaaugugcaaaucugauuggaaggaaaaggcuggaaagaaaacccuuagcuuucauuuguauugucauuuuuuucacuuuuuuuuaauuagauauuuucuucauuuacauuucaaaugcuaucccgaaaguucccuguacccucccccaacccugcuccccuaccaacccacucccacuucugggcccuggcguuccucuguacuacaaaauugucauuuuuaacaugcugcuuuugugucuuuugaagcuuccccgcuuggaacuaagaaagcaaagcucuauguuauauuucuauguauaauuuaaguguuaagcucuauguuauguuucugcauauaauuuagaugauaugugauuauuguaagcaacggcagucuauaaacaguuuuuguguuaauaguuuuggauuuuccucauaaguaauuuaaaaauaaaauauagauguccguuaaauaa

SEQ ID NO: 1975 - RNA, 916 nt, Mus musculus
agagaugccuggggucgugauugcuaggguggaucuucgguuugcucagaagccgcuguggucgagaaugagcggaacccugggaaaggugcugggcguguggaccaauacuguuucuaagcaaggcuuuucccuccuaagauucagaaguuugggagagaaucccauuuuuucugcaggugguauucuguggaccagucggcacuacaagacaaagcccacucauggcaucggaagauacagacacuuggugaaagugcaggagcccaaaaagaagaaagcaaaaguagaacugagagccauuaauguggggacagauuaugaauaugggguuuuaaacauccaccugacagcauaugacaugagucuggcagaaaguuaugcccaguauguccaccgccucugcaaccggcuguccaucaaagucgaggaaaguuaugcaaugccuaccaaaaccauagaagugaugcaacuaccagaccaaggcaacaaaaugguccuagacuccguccuuagcacccaugagcgaguggugcagaucagcggucugagugcuacauuugcagagauuuucuuggaaguacuccaaagcaaucuuccagaaggagucagauuguccgugagggagcacaccgaagaagacuucaagggaagguucaaagcucggcccgaacuggaagaguuguuggccaaguugaacuaaaaauacugcaagcccuucaugugauuguuggucuccgagaagcugcuccugcgagaucaggguuaaggaggagcgugaacacucgugcugggaaugccuccuugcaucugugccccgggcuugccaguuaccacuucccauaacaaaaccuaggaccuucuccaccuaauaaaugucugcuguugccaguguaaaaaaaaaaaaaaagagaga

SEQ ID NO: 1976 - RNA, 43971 nt, Mus musculus
ccaccggggcagccaagucgccgcagaacuggcaguaaugcgcuaccucaccauguucuugugaaacaguuaaaagacaaagugacaagcacauccuaaguggcuuuucuaucuugaucauagacucgccaucaggcugcacaguaacaacagaagccccgagaagccgaaaacucugcaagagggacgggaggcgggaaccugauuugaggaggaggguggaggagaacagccaaucccgcgcuccccgggaggaagaggaggagccagagcccguggguccccgcacugcucacucccgcgccacgccggccccgcagucuccucccggucccacgcugcggcccgcuguggacuucccuggugcagacauggccucgggcuccgccugcacggcggugaaggugagaucacccuacaagcugugaaugggccagcccugcaggguuccuucucgagccuccaggcuguguccccagccggagcgccccccacccaccgcucagcagggaggggacagggcgcgcggcacccagcgccaccccgauguccccagccuuugaacucaucugcauuccgggcccgagcggugguaaccggggcucugauggggagugggguaauagaagggggagcgggaugauggaggggacugcgccccgcugccacccucuuuuaguaccacucccccccaggcgggagcuggcgcguggcucagcuccugcggcugcugcgucggucccucuagucuuacgggacuuaagcuuccgcuacuuugacuaggcccacgugggagagcuggcacuugcucuuuugcaugcuucggcuucauuucccccuccaaacuuagauuuccuuuugcuuuguuuuaccucggcagcgcagagcugagggagcucugagacuuuuuaaauacugaaacagagcgcggaccgcucucagacuggaggccucugucuuauaaaccgcuuuccaaccuugaaaguuagaguuauuuucuuaggccuuagguccccagagaucuggacacaagggacucuugugcgccgggaacagcuggccagaugagagcaugaguucugagaguuggagugagccucccuuggggaguuuuaaacacauccugauugauggguagagaguggaauaacggagcccaggaaacacugguguuuaaguccuuucuaggcuguuuauuauuagccaagaacgcaguuaauuugauucaguuuaggaauuucugacccaugcuacaggaagugcacaguuuucuucaggcauccuuuugauugccugcagugccguuugaugcccuugcaagaggcccaucucugcauuuagccuucagcgugccagggcauuguauacuggggcccugcagggcuucaugaaccacucagggugagguugcugcauucggucauaggggccaacuuuuucuuuucuccauuuugaaaaggauuauuuacauuuauagaaagccaugguuccagucagcaggaacggggcagaaagggucuucaugugcaagguacaguagguacuuauuuauaaaguggagauuuuaacauauugugggcuggaaauuucacugagguagaggccugugauuugaagauagaucuauuugucaucucugucccacaaugugaguaaaaccaaauagcuagaacuucacacuuaaucaguccagucaggauaauacuaucugugcaaggaccagcauaucucaacagaaagaauuugcuuuaaucugguuagccuucugcccaacacacaguuucccugcaaaaugaaugugguccacuuaagagcagaaagagcuauguaaauauugaaugauauguauuuuuuuuaucuuggcaagcuuuugaaauaaaacuuagagauauaaauggugcucggaauaccugcugaguucucuucuugagauugcaacaggugagaacauugcuaauaaaaaaucaugaugccaacaccauauuccacaaacugcuaaggcagcaccccacauagaaaacaggaagggucccuauccagagcaaaauaaccuauaaaaacgauaucuuagcgcgagagugaaguggcuccgucucuggagugcuugcugcccaagugugagaacaugaauuuggacccucagcacccuugcuggggagcugguggcagacaccagcauccauaguccugccaauagagaggcagacacagggaaacucgggguuaacacuagccagccgagaaugccuuucucacacacacacacacacacacacacacacacacacacacacacacuguauuuuaucuggacaucagguagcauggauggauuguucauuugagaucauaagaacauaacgauucuuucuuacagaugugaagcugacagaucagcuaacgugucucguacagguuccuagauaaugacagacuuacagccuggcacucccagcaaguagaugugagauauuucuugguccuuaaacaauaguuucauuugcuuuccucugaguggggaggaaauagagagcuggggcugcgugcauacgcaggccgccucugcggaaaaccacuguauaggaggcacguuuguguccagcagguggcuuuuggcaugcaccauuccauccguuucugagaagcaacuguuuuauuguguaccucagugagaauauucccacacuggacccgagaggccuggacucucuuagggaccucugcuaggaggccagugcugaucacuccuacuuugagcuguuguuagcuuuaugucacacgcccagcucagugcuugcucuguuaaugcuaacucugguaccuuccuuuguaaauggaaauauuaccagggguucgaguuuaaauucaauaccguuugguuuaagagauaggauagaccauucagaugaaaagcaucccguuuuguagggacaguauaaugcucaugaucucgauguaaucugucuaccggcagaauccuacccaaaaaauacuuauuggaaaccugccaggcucugagaaugcacaguugagugaaacagcaucccuguuuucuuuaaguuugucuuguauuggggcuggaagacuaaguaauaugagggagcugucaggguccugggaguggcagaaaagaccuuuagguguugguuguuagaggagaaugggacuggcuggaggugauuaagucaugguuauuagagcuuccuugauggcaauaagcaccuuuguaaaaggcaucaggcccuaagagccacaugguucugccauuuaagggaccaucuauaaaccaaagagcuagcucucccugauacugaauuggccaaaaucuugaguucuccaagggccugcagauugugagaaaugcguuuguaagucugauuuuauuauagccacuuacuuaggcacaucgaggacaagcuaguaguugaaaugaugauaaggaaccuggaauuacguggacagcuaagccugaggaaaggcuggggaagaucugagcacagcggccuugaaauagaaaccgucuguacuugugaucgugagaauuaguuggguauaguaggccuucaggauauaaaccacaguagagaauuuacuaguacccugaggcagagggaggcagaauuuuagcuagccuuaaacuauguagaacacaccgugagucaacuguguacauacaguaagacccuaucuaaauaaguagauaaauaaacagacaaacaaauaaaugaagccaacaaauuuuggauuugauucuaaaugcuuuggaagccauuuaaggauugugaacagagagguagugucugauuuauguuuuuaagugauuccuuggcugcucuguacagaauugccuauacugggcaaaggacaacaucuggccagaagccauggcgcuugugccagucugggcuggcagccauagaaguagugagguucugcaggcggaguagagauagcgugugggaggguagcaagagggaaagggugcuuccugugucuggcuuccaccccuggaggugcugagcaguccuuuccaaauagaaguaaggaggcugaguucaggauuccuuccacuaacgcauuuccaagugggcgcuaaagcaggggggaugagggggggucucucuuacagcagcagaagagcugcagaguauguccagggucaaaggguagaagauaaauggagacagcaggaggcagaggccaugaauucauaggagcacguugcccaagaggacuugagagaaacauuguccagguuuagccaugggcuggcagugugcuugaucaugcagaaggcaaagcaaaccuuuggcauccagagagggagggagguuuggagaacugcuucagugauccgaguuaugccccuggcuaguuucuccaccgagggauaggaagauaauguuaaucauguuuaguuggauagggcgggaauauggucccucuguaggucaguaguagacuucauagucagaggguccugguuuggaagauggcuuuuaaaccucucuucuggacugccuugagcaugguugccacugcucugucagauugcgcugagcuuugcagcacacaguuuacccuuagccucuccccuacaaagugccaacagcaccuccucucuccugugccagacgacaugguacauacauacucucaggugccccgagaaagugaccucauauuugguuaaagaccccuaggccauugccugagagacuggcuaguuaggagagguaggaaccgcugauuugugucucugucuacagaggagauaagggccugaguugccgugaggaagucacuuuuccuucuuggucuguuguuaggagugguaggguauggaccggaaacugauaccacgacguccauuugauuuccaugcucguucggcaugcuaauuaaaagucugagccacauagggaaagaaaaugaggaaacaaacagauaagauaaauauuuguauaugauggucccgagauccuuaacugggaagaacucauuggcuugacuccguugcuucuagagacauucgcaguugucucccugcuccacgguuauacccuccaucaacacgugcccuucucccucuuaacuuccuguucucagaaccccuaagguuccauggagggcccauccagauagucucccaucucaucuuaauuuauuuacacugaauaauauuuguagguucugagguuggggugucaacaucuuuuuggaggagccucuugcauauccccugagaacccgaaugcuaacgguuacagcuguuaggaaguggggagauggaacagauaggaagucagcuuugcucuggaaguuaagucccaugaggcaugcggcuagccuggguaucgggacuacagauguagccguaucagaacuacagauguagccucauuuugcuaccuugccgcugugauuugagcagcuuuccucuccuccgcaccucgauauucugccucaccauaggguccaagugaccacagaguaaaacuuugagccaaaccuuuccuccuuaggguugauuuucucacauauuuugugucccagugacagaaugccaggugacuagcauaggaaggggucguuaugcggccugauauauuccucuagcucauauuguacaaauuuguguuuuaagcagagcaacacacuggaaccaaccaacaagcuucggauaaaacgcaugcuuuggauaaaauccaguuaucagauccucugcaguuuggggucugacauuuggcagagagggacugcugauauccaucagcugaguagcaaggaacuuaggccacauccugcccuuauuccacaagcaaaggagacuugaaaggagugcagugaguuuugaagaagaggccccggagaaaccaaauaguccauuucagcugugaaaugugccagcuucggggugcccgggggcuguuuggaucuuccagccuuuccuaauuccucugacuucuaugacuguguuagguugcugggauggccuuagcagagcucagugggcaguaucucacaguacuggaggcuccuugucccagauaaccagaggguugccaagagaguugguuucuucugugguaacccuccuugagguuuggauuugggguagccaugguuuccauauauuuugaccaaaaaaaaaaaaaauccucaaagagaauaaucaguauguugcaucccaggaacauggauacaaguggccccaaagaaaauguucuaucagugguuucaugaaguuuauuuuguuacaggauaaaauucaaauacacuggugggagcugagauuagacagcauacagcagagcaggaagucucucagauuccaucugaugaacgccuuagcuuccaguugcuacaacuuggugguuugcuaaaccagaagauuuugccuccuggaaacuaggauguuagauagguugugggugggcaagagaaccagggguguggccuaagauuugacucuggaucagccccaauccagaaguucuaaucaguccaucagcccuguagaaucuuuaagcuggggguggccucuucucugggagcuucaaugugcaggcuccuugugcucuuccuucuggguguaucuguguccguuagguucaacccugacuccaaauccacucaaguagugagcaucacaacaucuguauauagguuuggacuggggcacagucuggcccauaggcguucccuguggagaaagcuuauguuaggguuuuacugcugugagcagacaccaagaccaaagcaacucuuuuuuuuuuaaagauuuauuuauuauuuauuauaucuuaaguacacuguagcugacuucagacacaccaggagagggcaucagaucucauuacaggugguugugagccaccaugugguugcugggauuugaacucaggaccuucggaagagcagucagugcucuuaaccacugagccaucucuccagccccccaaagcaacucuuauaaggacaacauuuaauuggggcuggcuuacaaguucaaagguucaguccacuaucaucaaggcaggaacaugguagcacccagccaggcauggcgcaggaggagcuaagaguucuacauccucauuugaaggcugccagcagaauacucacuuccaggcagcuaggacuaggguauuaaauaaagcacacgcccacagugacacaccuacuguaacacggccacaccucucaauacugcugcucccagggccaagcauaauacagaccaucacauuuacuuuggggaugugcugucuaguucguauugcagguuuuguacagaccucucgggcgcaagcauuuggucucuugauccccguaagucaggaccauaaaugggguccuauaaaaccauacacauagucccuccauauuuguuggugguaacuggagcugaaggacugaaaucccagagagggauugggcuagaucccacccuagcugucuuuccucaccuugaacuugacaugcucaaaagccacccauuucguuacauggguucaucucagcuguucuaucuuugguguuugugaguaccucugggaggcagggcauacagggcucaaaaggaugguuccugagaccaggcaagguaggugaaguccugguuuugaggcaccaggggaaguacauaggguauguaucugguuuuagggaauguagcuguaagguccaaagucgcaggcauucuuuuugaggugacuggugggaaaucuaacaguuaaacaugucccucuuucagaaaccuuguuuuguguagugaagacuuucuggauguacagaguugauccaucuguucugucucagcccuuuaacccauuuuuaggcauucuagagucaccuggauuugggaucugauaagguauugcugccuccugagagugguugauggguuucucagugguguccuugaucacgguucucaaccugugggucaccaccccuuuggggauugcauaguagauaguuacauuaagauuuauuacaguagcaaaacuacgguuaugaaguaacaucauuuuaugguugggggucacaagucaggggcuguauuaaagggucacagcauuuggacaguugagaaccacugccguagaugcucgcccagcuacccagagccucucuacaguguguuccgucaccuugagcaaaagcuugccccgaccaaggguuagucucuguaucaugggcagugacccuuucuaguagacuuugagcuccuggaaguccccagaggauguuaggaguuggcacacggugcucaagcuggaaaacggcguugcugcucuuuuuguaaagcaggaauaaugccauaggaccuguguaagaagagagcaucugugaaaaucagauacgguucagcgcuaaccuggggugaagugcuugggagcuucauccagcuguacuuugcuugugcugccagcagguggugcugugggccacauguugacacugcaggccuccaucaagguucuguuuguucccugguguggcaguacaguauucaguugccagucugguuuccuguagcagguguagguuuagguguggguacagguuuccauuaacagugagagccagcuggaugaccgggugggcuuuguagacugcuguggucuucuuggucagucugcuuuccugccaaguacuacccacuccucgcuaagggcugaggucccuagugcaggcccgucgugucgcugggaggguuuggacugaagcagagcuggcagaugagggaggacgaguuucaggagcuagccuguuccgauugcugcuuccauuccuacugugcuagcuugcugcauucugagaguacuuccaaaacaaaaugagaucuguuucguauucaagccugaaaggucaguguugucaguguugacucagaaucugagaugggguagccuaggggacuucuugaaaugauuaagcaaagcggucauaaguaaaaaguuugaagguuuuuuuuguuuguuugcuuuuuguuugauuuuggcuuuuguuucauauuuuguagcucaagcuggccacaggcucccuauauaucaaaagacagucuggaacuucugauccuccugccucuaagccuaguagcuaaauucccaaugagucaacugauaguuguuucuucuguugcuuucuuuugcccagugugaggacaugggcuggacagucuguuagcccagagaugugaaagauacaacggagaagccacgccagcagaagugcugggcuuuuguaaaauagaaugauuuuauagauugguugaccuuaagcauauuaaacaaauaacuguuguugauuugaaaucaccaauauguugacuggucagucuuuccccuuuaguugauauaaaauacaucugcuguaauuucaauaauguaccacaagguggcaucagugucaacuguuuuagccaccaggaaauguaaaucugccauccuacagcaaaaucucauaaauucuuuaguuuggaacuuuacccuguugagccagaaacuucuauuuuccuuuguaagaauauuauucagugacaauucguuuacacccuuucauuguaaaaagugcuggggucuuuuucuaugagcuuucucccaaagucccauguuguagccugcuguugaccuguuuaaguccuguguucuuuagggagucaacauaaaguuucauaaugauaauguuacuuaguuuuuuaauguuaagacuuuaauguuuaucuuuguaauuguucugguuuguuucuuaggcuuuguuagaucaacucaauuuuuuuuuaaagauucauuuauuuuuauuuuaugugcauugguguuuugucugcaugugucuggcaaccauauaugcacauugccuucagcagccaaaagaaggugucggaccuccuagagcugggguacagaugguugugagacacugugguugcuggaaaugcucauaacuguugagccaucccuccaacuccagaucaacucacaggaucagguuucuuucuccacuuuuuauaagaacauggauuuccaggaagucuuaggaaacugaaaaaaaaaaugcuuaaacauaaaaaauuaaaacuacuagcggggagggggguggggggguggcgcacaccuuugcagccagccuggucuacaaagugaguuccaggacagccagggcuauacagagaaacccugucucaaaaacaaaacaaaaacaaaauuaaaauuacuuugaauaaauauuugaauuauacaauguaugaaauacugucugcuguauauguauacauaugaacagccuuugacuuaguauauauauauauauauauauauauauauuaguaugggcuugucaugucacucaucuuuaaccugcauucccuuccaggugguuauaguggcaugcaaagaaaauuucuuauaaaauaucaugguauaguaaaaagaaagcauuaucaaagaaauaggccuaaguuuuuauaucaagcuuucuuuacuccauaguaaaugugguagagaagcaaccuugaucagaaagaucuuucuacaacuuuugggcucgauuucuaaccugaaagucacguucuguuuauuugugauuuaauugggaguaaauguggugcagucagaaacagcggccuauguuuuggcuaugucaagaauggaaggggcuggagagauggcucagcaguuaagagcaccaccuguucuuccagagguccugaguucaauucccaguagccacaugguggcucacagccaucuguaauggggucuggugcccucuucuggugugucugaagagagcaauggugguguacucauaugcauggaauaaacaaauaaaucuuaaaaaaaaaauagaaaagaccaucggguuuuauuguuuuguuuggggguuuuugcuuugauucuuuuuaauuaaagggcuuguucuucaggaaucuucagagucauugcccuuuggggauuggcaggaaugagaaugggccuguaaauacgguuagguaucuuugcuuaaagugaacuaugaccagcugugagcgucuucuuucuucuccuuucuccccuagauuggaauaauugguggaacaggcuuggaugaucccgaaauuuuagaaggaagaacugagaaauauguggauacuccauucggcaagguuaguguccggcugacggagugcgggcuuggccggugcuuaugccuggcuggcuuuguuuuuacuaaguuauuuauucacuuuacaucuguaucaauucuucuuccuccuccucugguccagucccucccuccuacuccucccccaccccaccccccuuccacucuuccucuccuccacagagaagagggggcguuccaagcucaucagccaaucccagcacgucaagcaaggcuaggugcauccucucccaccgaggcuggacaaggcagcccagcuaggggaaagggauccaaaggcaggcagugucgucacagacagcccccgcucccacguuagggucccacaugaagacaaagcugcuacuuaugugcagagggccuaaguccaucccgguccuguacucugguuggcaggucuguuuuuaugagcucccaugagcccagguuagacucuaggucuagcccagguuagacucuagguuuucuugugguguccuugaccucucuggcucccugaauccuucuucccccggggucucuacaucagcuuccaacuguugcugcauuaagcuaagccccuccgacaacauuuuugcuagauuccugucugcgaauagagcagaauauaaauaauacugucaggagugggcucccucucauggcauggcucucaagcugggccagucauugguugccccuucccucaaguucugcuucagcccucaccccugcauauccuguaggcaggacaaauugugggucuaagguuuugugacugguuuggugucccagucccccauaggaagucuuaccugauuccaggagauggacaguucaggcuccauaucucccguugccggggaaucuuagcuagggucguccucacagauuccuggggguuuccauuguccucgguuucuaguucaucccagagauguccccaccccaauccauuugucuuucccaguacucucuccuccauucucccuccacauggucccuccuauucacaccccucucuccuccccuacacaguccacuccuucuguaccucccaccaugccuaaucaauuuccccccuuucagcaagauucaagugugaucuccuugggcuguccuuguugcuugccuuuugugguucugugauucauagcaugguuauccuguacuuuaugacuaauauccacuuauaauaagugaauacauaccaucuuuaucuuucugaaucuggauuaccucacucaggaugacauucucaaguuccauccauuugccugcaaauugcuugaugucuuuuuuuuuuuacuagcugaguaguauuccauuguguagcuguaccacauuuucuguauccauucuucaguugagggacauguuuccaguuccuggcuauuuauaaguaaaguugcuaugaacauagcugagcgagcguccuugugguaugguggagcauuucuuuuggguguaugcccaagggugguauagcugggucuugagguaaacaucuuuccaguuuucugagaaaccaccaaauugauuuccaaagugguuguacagguuugcacucccaccaggauggaggcuaggacauccuugauccgcauccuugccagcugucaccucaguguuugaucuuugcuauucugguaggcgugagggggaaucucggaguccuuuugguuuauauuucccugaugacgaaggacacugaacaugucuuuaagugcuucuuugccauuagagaguccucuguugagaauucugauuagcaguguauccaauuuuuuaauuggguuauuugguuuguugauaucuaguuucuugaguucuguauauuuuagguaucaauccucugccaaaugugagguuggugaagaucuuuucccauucuguaggcugccauuuuguccuuuugacuguucuuugaaauaaaagacuuaaugaugguuuggauuuccuuggcgucuguuguuaugccccccccccuuuuucuuucuuguuuuguuaauuuggauauuuucucucugccuuaguuuggcuaaggguuugucaucaugcugauuuuucucaaagaaccaacucuuaguuucauugauucuuuguuucuauuuuauugauuucagcccugagucugaucuuuuccugcagucuacuccucuuggguguguuugccucuuuuguuccagagcuuugugugugcugugcuguuuguuacugcuagcgugaugaggcacucagugcugugaccuuuccccugagcacugcuuucgucuguuuggguaucuugugcauuuguuuucacuggauucuagaagguuuuuaauuccuuuauuucuuugacccaugcucacugaguagagaguuguuccaguuccaugaggguguaggcuuucugucguuaaguccagcuuuaauccauguuggucugugagauacagcgguuauuucacuuuucuuguaucuguugagacaugauuugugaccaaguauauaaccaguauuggagaauggucccugaggugcuaagaagaagguauauucuuugguauuugggugaaguauucuaggcaggggauuggggacaggggguugucaccugguuguuggugcugcuggcaggccucugggaaucuaccggcuugauuuuuuuuuuuaagauuuauuuauuauuauaagacacuguagcugucuucagaugcaucagaagagggcaucagaucuuauuauggaugguugugagccaccaugugguugcugggauuugaacucaggaccucuggaagagcagucagugcucuuaaccacugagccaucucuccagcccuugguuuuuuuaaauuaagaguaccaguuggucuuguguggacagagguccuagcacugaauuuccucagcugagguguccauuaaacuacaggagacugaugccguccguggcuauugaacacacacgugacuucuugguuuacacuucuagaagucaagauguucauuuuccauucaaaucuguuucuaauuuagaguccaggucgcaugcaccacaggcuggcgacugacuggaugagucaguaugaaagugacaucuucugacccagaugagccagauaauauuaucccaccgagguugugugagcagggcauccaccuuccuaauuccacauugccuccuccagucacgggcauucuucugacaagaagcccucugaaaagagcuugcaucccagccaugcccucauuuucagcuaaguucuucaccugaccuggguucuuccaaguucuuucucaucuugcucuuagccucgggcuuucuuacggacauugguucucccgucuuucccugugacacuucaagcggccaucuuaggccuggacaucacaagcaugcgguucugucacugagcuccugguaaccccacaguuuucuuaaauccucagccuugccuuucacaccaugucuugaaccauccaaaugccaucaacacauauaaggucuccuggggcacuugcugccgucagagccuguggaguccaugcuagccaagagcucagucaauauuuauugacgauaaugucgaucauuagaaaucuaaacuccuuucccugagcuguagcuucaaacgccaaguuccuaccagucuguuguguuguuuaaugauucuaacuuuuaagaacucucuguguguuuuaaaauuacuaagcuguagcuguuuauuuuuuuccauugcaugcagccauccgaugccuuaauuuuggggaagauaaagaacguugauuguguacuucuugcaagguaaaguauuuaaagguuuuuuuuuuuguuuuuuuuuuuuuuuuuuuuuugguuuuguuuuauuuuuaaacauuacuacuucgggagaguuuaaauuuaacuuaaagucagggaacagguaauaauguaggugugaguuguaugucuguagagucaggacucuguuuacgacacgaggcccuaagauaaguucagauuucaaauauuuaggaagucagagaucuugacucccacaucagucuguaaaauaguugguuugcccuccucugaagcuuccgcuucuguucuaacggaaaagcuauuuccuuucaugauauccuuucuuccaucgaucagauaauaagaugcuuuguccaugacagauccugauccuuguguaggcggaguuguuuuucuguggaggggagguuuggcgucccuggacuaauguggguuacucgcuccccgaacagagcuagugggguacaccacugcacagaaagaaagcaccgucaugaggggcuccccugcucacgcguggccgcaggcugacucucaagcaugucauuaggugguaccuucuagaaggauugcauggucuagugguggggaacaagucucaggccagcccacacuuacauguguugauuuuaguauguaagacauggaaaggggacuuuucaaagcuuuguccggaacagugaaguagaagacccuuggaagccagcaaaacuaaaauggaguuguuaauugucccucccuauggauuucagacaggucuccuuccuuggucuguggucauugcuagagagcugccuauuuuuuucucaagcucagggaagaaacgauuguuuaaauuacacugauguuucacuuguucuggaaaaaccuccugagagcucuggaggugagcccuaggaaaaugugugcaucucuggguaaugaugggucccuccuuaaaugucaucuaugagcucagaguggaaacuuggggugcuguguugguucacaguuuguuagcuaucaagagaagacagaaaauuuucucucucuuuuuaauuuauuuauuuauuuuauguaugugaguauacuauagauggguugugagccuucaugugauuguugggaauugaauuuuuaggaccucuguucacucuggucaaccccgcccacuccagcccaaagauuuauuauuguaacuuucagacauaccagaagagggcgucagaucucauuaugggugguuauaagccaccauguaguugcugggauuuaaacuugggaccuucaaaaaagcagucagugcucuuacccacugagccaucucaccagccccagaaaauucucuuucaauaagaacaggaugauagugaggcauauuuaacagcucugucaagcacauagcuauuucauuauggguuuuacugaugcggagggggagcgcggggggggggggggggcgauccugucuucaagugggcugggugacuuuugggaggccagaaggaaagucaaugagagagcuuugaaccaaaaaugguugccuccuaccaaagcccaaaguucuuacuccaaugcuuggauauauuuccacacuucuaaaugugacuacuugaauaaauaauaguaugcauguaggugcauguucaaauaugcauauaaaauagauuuuaaguggacuuuccaauacugaauaaauacauaagcuauaaacaaaccuuucaaacacugaacaacggcaggcuguguguuacuugcuuccaguguauuucugucuuaucgcaggaaaagaaaugaaaacucuugauaaaacuacuucaguaggacaucauuuguguuuguuucucaagaggccuagauagucugggcaucuuuauaaaauauugcucauaagaacauaaaaaugccauguaaccaaugugaguuuuaaaauuaauuucaauuaauuuuauuuauacacauuaguaucuugccugcaugugugccuguaugaggauguuugaucugaaauagguauuacagacaguuggaguugccauguggugcuuggaauuaaacuuggguccucuggaagagcagccaguccucuuaaccacugagccaucaaucucuccagcccccuaaaaugaauuuuaaauauugagcaguuuacagcuguuggcuugaguuuccuaaaugaauguggauucucagguucauggguuuuaggugcucggauaauuuuaaccaaaugcauauguuuguccgacagagugauauuuacaugacagaugcuacggaagaagacaagggcagugcccuuggcagauuguaguuguagaggugggcaccaaggagacauagaggagacauuaguguuguagcuguaugcgguguagaugcggauacuucuugaucuuggugcugagaucuaaagagggucagggccugagcaaaaauuaagaauggaagcaagaaguccagugagucuggauuacaaaggagaaaauaacaugaagugguuccucaaaguuucgguagccagaacucggaggucaaggaauugguucuccuggggguugcgggucacuauuuuuaguaacauuuccauuucuuuuguuuguuuggcuugguuuuggucuuuuuguuugguuuggguucuuugagacagaauuucuccuuguuacccuggcuaugcuagaacucuuucuguaaaacaaguuggcuucaaacucaaagauccaccugccuuugccucccgaguacuggcguuaagagugugagcugccgcugcaaccacuaccacaguaguaauaauucuuuauggggcuugucauaggugugauaugcauaccauccuaaugaaguggcauuuaaccuggaaacccuuugaaaggguaaugcccacuugauuuguagcuauuaaaaaaagaugucaggucauuauauuuacuaaugcacuaaccuuaaggaaauuggaaacugagacggcuagucuuuugguuuuugguuuuugguuuuuucgagacaggguuucucuguauuacccuggcuguccuggaacucacucuguagaccaggcuggccucagaaauccaccugccucugccucccaagugcugggaaaaaggcgugcaacaccacggccuggcaagauggcuagucuugacagaagaaaugcuuuauguuacacuaucggucuggauccagguuuaauugaggaacaauuuuauauauauauauaaacauauuuuuuauauauauauauacauauauauauauauauauauauaaaaacauauauauauauauaacauauuuuauaauaugucuguauaagcacuuugggguaagcauugaauuuuuaucugcagaaagauuuuuuuuuaauuuuaacuaaaauauugguuccuuuucuauaauuuuuaaaaaccuuuuuguucacuguuauuaccauauacacagugcuaccuuugguguccaugucuuguucuccauuucucaguucuguuaccaacuaagaaaugccauuuuuaaaauagaagcugugggccuugcgggccuguggcuucaguuacuacacucuuagaaaguugugcuuucucuuucucgcuguuuacaacuucuuaagcaaaguaguggcucucuagagcauugucaaguuucaguacaaaaacaaauuuuugccauuaaaaauuggcauuauaaagucuggagagaucacucagugguuaagagcacugccugcucuuccaaagguccugaguucaaaucccagcaacuacacgguggcucaaaaccaucuguaacgagaucugaugcccucuucugaugugccuguaaacagcuacaauguacucacauauauaaaauaagcagaaaaaggaaauuggcauuauauugaacaauguauugagaaaugaaucaaaauaaguuuuucuuuccaaaaaaaaaaaaaaaaaaaaggacccugucuccaagaauagucacagcccuaugguccaggucaagguuagaucuacaguucagggaugggcagugguagugcacaccuuuaaucccaaugcuugggaggcaggggcagguggacgucuaaguuucagggcagcuggggcuacacagaaaauccugucuucuggauggauggauagauagauagauagauagauagauagauagauagauagauagauagauagauagaauaaaagcuuugauucaguuaagcccggaacaguagucaugaaagagcuggucugucguccagaagagcaggacaucaaugaacagcuucauaguugacuuggugaggcagaaggguuuggaggccuccaccaggaacuugguuuugccuuuucuuuguaauuguuacaguucccugcucugacggcggaugucauacuuccaucuccuuucuuagacacggcagacaacacaccaucaugccuucaaaagucaacuaccaggcaaacaucugggccuugaaggaagagggcuguacacaugucaucgugaccacagcuugcggguccuugagagaggagauccagccuggugacauggucaucauugaccaauucauugacagguaagugcugaguggcucugagagaugaugugugggaaacacggggagaggggagaggggagagaaucacuuuaagcuucucauuguagguuguuuuuuuuuguuuuuagcuaaacuggcagauacuauauauugaugaauguaauugcuauauguggacauuacauggugauugauaaaguguucaccuaucacuucacauacacaccucgcaaauuagcuuggaugcaaacauugauuuucacuguacaauagaugcaccacaucaccacaccaggcaggagauuucaaaaacguacucuuucugcucaacuaaaacuuaauguccuuuggccaauuaucucccaggcuucagguaagugccgucgucuccucaucugaguguuuuagaucgcaugugaguuugugcguucucuuccagugccuggcuuacuucaccucaccagauuccuccggguuuguucgucuugcugucaaugacuguugucuuuauuaugguugacugauuucuacugucagugugccacauuuucuguaccugugacuaggcaucgagguugagucuauagucgggauaaagcuggcuaugcagaggggccuccggaguaggcugacuuagauacuucggaugagugccccugggugggguagauccugagguuuucaccuucguugaggaaccccaaggcugauuuucauaguggcuggccuaauguacauccccaccaacaauuuguaagggcuuauugacuucuguaucucuaccaaccuuuguugccuguuuuccauucugaagaccgaaucucacuauagauaugguugacgguucccugguggcuaaggauauugacuauuuuucuuuauauauuuugguuuuuaauuccuugcugaaugaauagcuggcaaagaugcucucccaguucgugugcacuuccuaggagugcgaugcaucgcguguguaccuuuucagcuugguucuuccguuugccccgugcuguuguuuccgagcugcugggguccugaggaaggaaguucuugcccugcccaggccucuagcucagugugccuuuucuccggcaccgucaggguugcaggucugcugcuggauucacuugaugugugugcaggaugagagagggcaaucucaucccguuucaguccucugccugucuacaucugaauaucucccuuccccugcacggguuauuagcacuugucuuucucaucaugguuugggcccucacagggaauccaauggcugugguuucucucaucuuugucacugucuacugcugccuuccucuuucugcucgccucauuugucuuagaaauagguguucaguuagguuauuugagagcuuucuaaacuuuuaauacaggcguucaugacuacgcccccuuuuggaacucaaaugagugggcugugaacuuuaguacacucaauacuugaugcauauguauucacagucauuauauuuucaucauagauuguuuccauuaugagugucauguaaauuccuuuuuacccucugcuucaggguguucauuucggaucguacgugugaguaguuccugcugcugucuuucuguuucucacuucuuuaauucacuucaagaaaucccuccagguucaucuugucacacaugacuguugucuuucuggguuuuuuuuguuuuugguuuuguuuuuguuuuuucgaaacaggguuucuauguauagcccuggcuguccuggaacucacucuuguagaccaggcuggccucgaacucagaaauccuccugccucugccucccgagugcugggauuaaaggugugcgccaccaccacccagcugacuguucucuuucuuauuuaguguuuguugucugcuaggaagggcauguccucuuguuagugacaguucuccgugaguuggcuucugugcagugcucagcauccacuuugauucaauggagagaaagcaaaaauaacacugccaggcggugauggcacucaccuuuuaaucccagcauucugaagcagagacagguggaucugugaauucaaaggccagccuggucuacagagcaagugccuggacagccagggcuacacagagaaacccagucacuagaaacaaaaccacagauagauauaucuguagugaaaggaagaacuauagggcauacuaggaagguaaaauuuaguaagaugaaaguauaagggaaagagagaagugggguaccccuuuaauaccagcaguugggaagcuaggcaggguaacuagaaacuugagacuaaccagagcgacauagugagacccugucucaacaaaagguagcaguuuggggaagguugagcacacaauaaaagagauugaagggaaaagucauauauuccuccuugcugaagauggggugggugggggucagggggaaguggauacuuuuuagauccaguccagcaggucaguuugggcuggggguuuggaggcugagccuguucuaccuugccuaccagcgugagcuaagaaguggcugaguuacagccgcuaaggaagcagagcucuagucaugccagugaccuugguauguggccccuaggagguagacuacaguccuucuggcuugucgcaagugugggcugcucagaugguugcccgucacuuucaagauacucugucaucaguguuccuguguguaugacaaaccagugccuguaaacaucccugagcuuccgcgugugaggaugaugaucaaaccaaggcauccugcagugagcaggcaagacgucccaggcaugaagugcuuugccagcccuggccacaguagacucugccugcguccacccauaagucuuuacacaguucaucucaugcuucagagauccaacacuguuuuuaaaaagaaacuuuuuuacuuccccauguaaugcagaugagcacaucaggcuaagaaaggaauaacaguguuaggaggggugauagauccagauuaccauggggaaauuggauuaccucuucacaauggugguaagcaagauuaugucuggaguguaggagaucccuuagggcgucucuuaauacuaccauguccugugauuaaagucaaugggaaacuacaacagccuaauccaagcaggaugacaaaggacgcagacccaucaggaaugaagguaugggucaauccuccaggaaaagagccaagaccugcugaggugcuggcugaaggugaaggaaauacagaauggguaguagaggaagguaguuauaaauaccaauuaaggccacguaaccaguugcagaaacgaggauuauaaaguaauaugaaugcuucuguccuauuuugcuaagaauacauuugucuuucuuccaauuucuuuaacaucaauugguauguaaguugagaaacuaaaaggauguucccaagggacauugccccauugugaauuuacuguacaggaauaguuauaucauguuaggcuuacucaggacaggaccuuguuauuguuucauguggacaugaaauauuauuugugucaaguugacaaggggugaauuguaguggcuguuccuaguugucaacuugacuauaucuggaaugaacuacaauccagagcuggaaggcucgccugugacccuaaucuggaggcugggagauacuaguuucucaccuggaucuuggcauggagaucuugaggcauaguggcuaugaaccccagaagauuaagacagggagaucucugaguucaaggucaucugggauuaaaggccugguggcaacuuuucuuuauuuuuuuuuuaacuugcccaagcauuuaacuguauccaguucccuccaagccaucaaagauauuugauuauauuggccuuccuuacagcauggagucauguuuuuccacuaaugaccucccaugguuucuguuguaauuuugcuugccagaccccuucuuguguggccauccuggcgcugguagucuuguguuuaacgucugauucugagcccacccagcuucucgucuguguucuguucgauucggaauuuugagggagucgaucaagaacaccagaggcuuuguguacaauauugguagccugucuuguggagugucacauccagccagugccaccaggccaguggucgucuucagcauacccaccauuuuuccuagugcucauuaacagucccuuugaaaggauaaggaaguggacauuuccuugggccaagagaaucuuguuaggcauuucuauuuucgaaggaccuuauagggcauccaagauuuauaauuugaggucugucucccauacuacaugucuucaugugucgcacugugcccugcccgggcaccacugucacacugcuugaggaaggcagaaugaagucuggaacuggggucugcugccugcgucuuccuucaccagaccagaaggggaaacagcagagucugggacaaauucuauaguucuuugucuccucucuggguuccacugagagucaggaacgggggccagcacucuaccuuucuccucugggucucuugagagccaagcagagaggggagacagagcucuggaugaguggaccuguccgaugaggagcgagagccaaguggaccagaaggacuggaggggagauagccuuccucaggggucuuuuaguuguaggccuuccccacaaugauccuuagugaagcagcucucugagauggaccuugcuuguucuugcugauuuauuugaugguagauguaagugaauacacuuuauuugggcugagucagggguucucuaucuuuuguggaaaaggaguacccaggaagggaagacaacauuauuggcugaagacucggggcuaucuggauuccucacuagcauggagaacuccagauguuaugcccaagguccucaguuagguguccugguuaccuguucuagaacaaggagcagcuguacccuacuggucucaggucucugagguccuccagaucugagcucaaucaaccuugccuuuuuuuuuuuuuuuuuuggggggggggggggguguugguuuggguuuuuuuuuuuuuuuuuuuuuuuuuuuuuuuaucugcauuuauuuuauguugaauuuauucccaugccaugagauuuuguuucuucaguuuuuucugggauaucucuuucuucuauacaaccuccucuucgggcuuuggaacgaucuguuccuucacaaugaggaucaucucaguguggcuagggagcucauguauggguuaaucgagccaugagcucugcucuauagguucgucggugugucuuaaguuccuuguucaccuggauauguugaauaacuagacaaucuacaucgaaaccggaaguucagcauuacuuuaugcauuuuaaagcaugugcagcaaaaauuuagcacucuuuccagaauggcacacauugcuucuuuaaagugacauccuucagccucuugguggcuuugccgcuaugaggcuaugcauacccuugcuguccugggcaauuucucagauguucuuaaacugaaugaagguuugaaacucuagauuugcaugauuuugucggauguucugcggcaagagaguagcaaaccaucuucacaggucacgccuggccgcuuacaggaaaaggccuugccaguuccuuauaacugguagcacgguccuauguacuguacauuccuguggguagggacauuucucuuucauccugccaccugugggggugggcagcugacacagaggagucgauguaacuucccuccugacucuggcuuugcuauguggauaaagagagcuuagcuguucucagggcuccaguuggacuuuuagauggugaauuuuuuacaugcuuugaucccagcaucuucugaucuucagugucacuuugccacuuauagauaaagcagcaaguguauggacccccagcugcuugcuaaggggucuacaguuacuuccucaccaaaugcuaacaguucuuuuuacaaauaucuuugauuaugcaguggccucucaaccgcacaggaucuaugaugaggugccucaugaagucagagacgagagauagaugccuccucccugcugugguuuggcacgggccuuguguaaacaggccagauucuaagaagagccuuggccgaguuuagaagcauaguuguuuggauugcuuagccuuucucuuguuacuuaucagcuuuguagcuuauacuuacuucuuaaagguucguuguagaguguugcauagggggccuucuccugggggacucugcuggcuucuccccaauguugacacacucuauugucucuuccugaauuucugggcacaccuggucccuccauuuaacaccaugaccaaaaggcagguuguggaggaaaagguuuauuuagauuacacauuuagauaauaauucaucuuuggaggagauugggacaagaauucaagcagggcuggaacuuggaggcagaagcugaugcagggucacggaggggcgcugcuuacuuccuugcucuucauggcuugcucagccugcuuucuuuuagaacccaggaucaccaccagcccaccuaccguggacugggccuuccccacgauuagugaggggaaaaauugagaaauugcuuugcagcuggaccucauggaugcauuuucucaacugaggcacugaugaaucuaacuugggucaaguugacacacaaaacccaccaguacagauacuauuuuagauccuguuguuuggguagaggaaauguaauacagccaucccauucgagaggcugaggucccaggggcagggacuuccggcaaugucuucauguauccuuucuuccugugccaucaauaucugcugcaucacugaagucauugauuggacaggaaggaaggauauauguagaaauugugggugugagucuuuauuuuaaacuuaaaacaaaauucauagagacagaguaacuucugugacucaaaauaccaggucaagcaaugccugcccuucaguauccuuaccuguuaauguaagaguucugcggguauuggguucugauauguuccuucucaagcuuuuugguugguugguuguuuuuuuuuuuuuuuucccagcuuguccucuugcaggaagaauaggagaggccuggguuugcucucgcucugacucaucaggaaagucccgcacuaaauacaugggcugauaugauagaugaugccuauguauuucacccuccuccuccuagagacacagcccuaccuugggcuuccccggugaugucaucguugaaggcugaggucuuguaggggugugcucugguguccacacaggucuucuuucaucuugaguguguccacuagagucuaacgguuagaaacggacuccugagcgagaugacuugcaccugggaccucaccccugaggagugcacaguagggccauuguuugaggguaguucuggauacccagauuacauaaugacagcacccugucuaaaacaggaagggaaggcacggagacccaugaugcagaguuucccaggggccuuugcuccgucccaccccucugagaggcaaguguggacaggacaggaccauccuguuucucuggcuucuuguguguguccucacucugcugagaaagucaucuucaauguuauaaagaagcagauacuacugggcauacacucacugcaugccucugcccucccuuccaucuauaacuuguguccgaguuuuccuuuuguaucuagcaaagucaacaacccccaagaaguaguuuguccuuggagucugcucuggaaucuaguuucguuagagcucuucacagucucaccacauuccuguuguaacaacugagcuguggagcugagugccauggucaguuaauggcaggcacuccgugaucauccucugauugaugcuugagaagaccuagggacagagaugcugcuacauacuagcaaguggacccaaacucaggugauucgagccuguccccucagcucccgcucucccgccccagugagauggcucagauuuuguaacugucuucuggcacuuacucguuuguaacacugccacacccucagugagccuggcuggagccaccugucccucuucugucucugagucuccaucacaacaucuuguuccgugugcaugcucaagccuaccuucucucccugcaagcauucuggacaguucucccccuuuccaccugacagccccuuuagcugcuuucuauagcuuccuguaaauaagacaugaacuggccacaagugaugucuagggggcuguccucugggcuuuggaaagcagaaguuaaacuggcagaaaugauguucugauuagcuauucucauagacugacucagcccuuccuauaacuugguguaaauuguuccaacuuguggauacgugcuuuguuaacucuugccacuuuucuaggaaugguuucuguuuugagguuuuuuuggggagguugguuuuuuuugagacaggguuucucuguguagcccgcuggccuugaacucagaaauccaccugccucugccuccugagugcugggauuaaaggcgugcaccaccacgcccagcucuaggaaugguuucucacauaaguucauauuuagaaagccccgaaacuuugcuuguuucucuuuuuccaagugaaugugagugauuaugaugcaauagacaggaagacaaguuagcugugaauaauucaggagugaaagaaaaugucacauuccacucuuaggaacuggcaauuucuuaaauauaacuauugcuguucaaaguggacauuuuuaaaaaggucaucugacccacuaguggaauuuaaaaugcuaaagcuuuucuagccaacuuuuuuccauuuacaguuuacaauccuaagcauaaaagcacacagugguacuuuuuccugcauauaguauaucuauguguggcuauuguuuccccgguaaacagauaaaaccacuuacaucaaccuggaacaaguuggaacacuugggaaccaauaacagcauuaguaaauguuacugucccuuuuuacacacagacagacugagauucuaggacugucucuuucagagucuugagcaaaggcuucauugaugcaguguugaaauccuaacccuuaagggaacgaggucagauuuguuccugcaacucccaucagaguuaagauuucugugauugucauuuuuguauuguuuuuuuuuuucuuuuuugaagauuuuuuuuaaaagaaucauuuauuguauuuuauggauaugaacuuugccuguguguaugugugugcacugcaucugugcggucagaaaaauguguuaaaucucuuggaacuagaguuguagaugguuaugagcuaccaugugaugcuaggaaccaaacucaggucuucuguaaccaacaaguacuuuaaacacucccaagaaucauguuuguucuuauguugccuaguguacuguuagcaagaucucauuagcagacuauaaggaggaauaacgaagccucuucauugaacagucucaucacugagguuuaaacauccauuagguucguucauuuguucguucguucguuuguucuuuuuuucuguguuguuguuguuguuguuacaguuguuaaacaauugggaauacuccugagauugaaaugauccuaaugaauggaagaaucuuccccagaaaccauccuugugagcaaagccaugucaccuugcaggcacuuaugccagggcuugcuagagacagaggccgcauuuggaaccuaccucagaaguugugaugguuuuguuucuuggaaaagaaguguguuucugucugaugcauuuuuagcuucacauuucuucaugggaaagcguugacuuaacacuuucaagcuaauucaaaggugucuacuuaagaaacaaccuaccaggggcuggccagauggcucaguggguaagagcauugacugcucuuccaaagguccugaguucaaaucccagcaaccagauggugacucacaaccaucuauaaugagaucugaauuccucuucuggugugucugaagacagcuacagaguacuuaugaauaauaauaauaauaaauaaaucuuuggacuggagcaagcagagguccuaaaacaaaaauuucaauucccagcaaccacaugaagacucaaaaccaucuguacagcuacaguguacuugcauacauaaaauaaauaaaucuuaaagagagagagagagagaacgaacgaacgaaccuaccaauugguuuuucugcugugcugugucugaacuaccuugaacucauuucucuuggcaguaccaguguauauguguccuucacucuuuuaaagacacacuuugugcauuuuaucuuaguaccugagcuggucaguuuuaacugccaccuuaacacgauuuagaaucaucuagaaagagagucucagugaggaauuauuaaggccagguaggcguguggauaugucuguggcuaguuauuaaguaauaucaggagagcuagucaauugugggcggcacucauucccuaggcagggguccugagugacaggagaggagucucugcuguauuauguggacaugauaugaccaccuuucucaagcuucucucacuauaacuuccccauagagauagacucucgccuggaauugugagcuaaaacccuuucucuccuaaguugcuuguuggcagaguauuuugucccagcagcagaaaggaagcuaggagagcaucuaccccugcuugacaaccucgggcaguuuuagagguuugcaugaugugugacccaucaaaacgccaaacugccauguugguagaagagaguacagaagcggauguuccgugugcagcgauggccagugccagccccuuguauuauauuaucucauccacccuugcuuagcccaugggguaagugguuccugcccccacuuuuagauauaggaagaucugaggcagaggcgcagaggucugagugacuuucccagaagcaagcagccagugaguaguaaacaucagucaaguuuacagcaagucaguccccuaaaauccaugcucaguuagggggcagaguuaaucucuuuacuuuagaauaagaagcagaccuucagcaggaguucuuuauugcuauagaagccaugacuggguugauuauauaucaaacuacagaaacaagugcauccaugcccuguugauaguauaacaaauuauuuacaaacuuaggggcuaaccaaaauuuugucaucuugguauuauuugguuaguaguuuagcaugggucucacugggccuuuuuuaagcuguuagcaagacuauauuacucugggaguggugcuuaagauggagcccauuuccugauccuuugugcccuauccauccacagccagcacuaaaggaugaaguucuuaucauucuggcaucuacacaccuucuacccucuagcacauuuaaggauucuuguaaggaugacguuccugcauaauuaauccagaagucucuuucuguuuugaagucagcuucauacuaagccaucugcuacccuugcuuuucucugccagguuagguaaaguaaccguggguucuggggauacaccugugggguaggccuaacccaaauguaacaaugagaugcaauuguaccugaguguauugaggggcagccacuguaaguuuccauuuuuaaucaagggugcaaguggguauuuuauucuguuucagcugcuauaacaaaauaguguagacucuaaacaacagaaauuucucagaaggcuaagaaggcccagaaaagguguuaauggaccuggugucugagaagagcuagccuucuugaccuggucuuaguuuccagauguuaugaccuuaagggguaggguuucaauauagaagucuaaaaguuggacaagccuuagauguugcugugagguuuuuuguuuuuuuguuuuuuuuuuuaauguauauggaguuugggguauuaaggacuuuguacaagacacauuugacugguuggcugguugguuuuauuuuaauugaaacaaaaggaugaaaaacaucucuggcccguaucacucaacaacaaugaacuacacaguugaacuauaauugugaauucagacagguugguuugguuggaauugggaggugaccuuuccagcuuuguuagcagccucuccuccaaggcuucauuugcaagaugguucuaggcuuuguccugagguccagaagaugcaguuucugugacaggcucagagggagucacaggugacucacauuugcuuuaggauuuccuuugggguugccuuggcauuucucagcuguggcucugucccaacucauuuagcguagaccguuccucaguuuacaguccauguguggguauauucuauugauagcgauuuagcuuuugaucauuucacugagcacagugacacuugaauuaguggugcagaugccacgaguaggcgugucuucacgggggaggaaagcuuugauuuuaaugcuccuuuuccuuucguuuccuggggccucagccugcagcugacucucaggugucucuucuauguuaccggggcaccuugaugauuaacugacuucucuuacugcuucuauaaacgaagggaugagcacuguggauuauuuuuauaugcuuuuugagguagauucucacuauguagcucuggcaguccuggaacuuacuauguagaccaggccguccugaacucacagagauccuccugccucugucuucugaguaccagaaucaaagucauauggcuccaggcccagugaguacuauguuuuauuagaaaaugggagaaugaaaaauauacaggacuugcuauaacuauguaacuuguaauugaauaccuucauuuaguaagaaagauguaagcgggcugugguggcacaccccuuaacucccagcucuugaguucaaggccaaccuggucuauagagugaguuccaggacagccaaggauacacagagaaacccuguccugaagaacaaaaagaaagaaaaauguaaacuguuucauuugaaggaaggaauuaagaccagucaauaaguaucaaguaacacagcaagaugugguauguuugccacaggcagagauauagggagacagagaagucguggauauguuguuaggguagguguuccuucauggacgccuguugccauagcuacuggaaguuucaguguccuugcuuuaugauccuagaguugcaaguggggacauugcuacaacuugacucaucaucaaaacuaaaaccgggcacaucuggaagugauaacaaggcauccuuuaguuggucauucuuccagggaaaacccuguugguguaggcuagagcugucauaugacccauucuucaaccucagcuggaugccaaggaguaaacucugacuucuugaggaaugugaaaaagagucaagacucguagagcuugcuuuccuccacagcagugggacuucuucaucucaaauagagaugacuuugaugccaaguagacucggucacuagguaugacccagcccaaagaauaaguuaauuuggaacaguaccaaauuaugccagcugugugaauggaaccagcaaaaagaauuuuccauccugccccacucccaacuccuggaaaaagacaccagauuuucugcuuucaguuuuccugugucccauccuugccucaucuccauucagcaggaaaaggugggcuuugggguuuucucugaguuacucaguaguuagaaaaaucaaugcauacaaaaaaguaguugguagucuuuucugaaaguuuugaaggagaaguugagcgaacugguagugaguucauuuuagccugucuuuuauggauucccaaaacagaauuuagaaaaacagaaaacaaaacaacuugaacuagaaaacaugagaacgagucaaaggagguagaaacaagcugaacaaggggcagauuaccaguggagcagggcaaucuggcuggugugcagaaugaccuagcaaaacgugacuaggauugaggccgcaguuaucuuuacuuuaaauguggguaaggacuuucuauggaccugaaacaaaguaauuguuuaaaaaguuggguuuggguuuguuugguguuuguuuguuuguuuguuuuauagauuuuagggagaccuggguauagucugauucaauuaugaaaaagcuaacaaauaaagaguauaguacaguuugggggaacuuagugugagucugggaaauagcacacugagccaacucuucuguguacgucaugauaaaauguuuuagauugacuuugacuuggucauuacugcccucccugagguccugauuuaacagucuccaugcguacacauucguucuugguuaggaguguauuacagccggcccagagcuagaaggguccaguucaaaccugaagaugcucugugacagucaccugcauguauccacagcuauuggauaagaagugaccagaggacagagacagagcuuuaacagugguaaacaccucaccccuuuaucuuccuaggacaucccuaaggccucagaccuucuaugaugggagucauugcagugccagaggagugugccacauccccauggcugaaccguuuugccccaaaacaagagagguuaguggucucccuuacagguauaucaggagagcuuggcgcgcaaucugcagguuugucaguuggcugaguagguaauccccuuuuuauucccucaguguugguuuugaaaaucagugguuuguggguggguuggggagcagggcagggggaggguauaggggacuuuugggauagcauuugaaauguaaaugaaggaaauaucuauuuaaaaaaauauauaaugugaagaaagaaaaaaagaagaagaaaagcagugguuucauggugagccauuucccauggccaagaauaucugcauuauuaguuauuuuaagcaaaauuguuucaccugcugagccaccucuccagucccagaacuguuucugauacaacugauauuucuaaaaagccuugaaguaaggaagcccagauaaguugauuucuggacagaaaaaaaaaaaaucaggaaagccauucuuauuucaccguaugucuuuggagggacagcaagcuuuauaacaaacaaacaaaaaaagcagagcagugacuggaggacagcugcacucugggaaacgccacugggccagaccuucaaucugugugugacaagugauaccuuagcugagcgagugagaucagccaagaccugaggccucaguccagauugcagcccccgggauagccucccuaaguucuagacagugaauggaauucaaguauauaaauuaccagagccuggugugguuuuacuaaaagcuacgagcuaugccugcaguggaccugaaugugugauuguaggguaugauggccuccuucagugcucuagguucucuaaggauaugacagcaaagucuacucuagguaauuaguuugcuaaaauagaaagauaaaaucuuggacuguccaugucauuugugcucuuccuuuuccagguccucauagaaacugcuaagaagcuaggacuucggugccauucaaaggggacaauagucacaauugaggggccccguuucagcucccgggcagaaagccuuauauuccguacuuggggcgcagauguugucaacaugaccacuguuccagaggugguacuugcuaaggaggcuggaauuugcuaugcaagcauugccauggcaaccgacuaugauuguuggaaggagcaugaagaagcaguaagugggaaucccuccugaucccgugaggugugggcgacagccaccgagagaaugucucauggguuuccuuugcauuugucucggggccuuuguacaucgcuuuuagguguucaguaggcuuuguuagaucuuuucuguaguuccuguuggcauauaagaucuaccacagagggucagggagugcuuaucugagcaucaacaguguaggcacuacaucauaggcacggagauguacugagaaccauugagcccugggucugccuuuaaagagaaaguuggacuuugugugugguuuccuuaugcuguugcuacuuauguuuguuuucauggagaaggaaaaccuaguaagcaagccccaagucccuacccugcucaucacacuguggccacugccccagugccugcuucgccauccagugaaacagaacacagaaucgccuaaucaugucaccugucuacccacauguauuuugcugggcaacacaaacgaauccugguccuuugguuuucauaaacgcuuuauugcuuucucacuacagcugguaguuuuuacuuaugggagaguuuccaggcugacugugucuggccuggcagcucaagagcuccucccagcuucaugaucuacagaagcuguuugcaauuaaugggaaacacacauuuguuccugucacuuccuggcagcacauggcuuccugucagauuuucuacucagucucaggcuaggcagcuagaugccuccucuacagagggagcggugacucuuacgccacaugggugcuggaaagcacauggcucgguucugucagugggaaggcauguaaugucacaugccacaagaaagacacgcauaaacauggaauccacucaaacggccauuugugucauugugcuuuaaacaaguuacggcccgacgugacaugguucuagaguggccuaagcucaccucgguuuccuuuugacacucaacagauuauuuaguuuguuuucucugaaauaaagccaggacauggagcagaggagugacucucugcuuugugcgcgugcgugugucagugccauuguaaccaaacacaaacagauugugggaaagccaccagacagcuccugugucacacccaggaggcaaggagagcuagauugaacaagaauggggcaguaaccuuccaaggccauugucccagucacugcaacagccaucaagcccagccuccuaguacagguucucaucuguggguuacaaccccuuuggggguucaaaugacccuuucacagagguugccuaagacuguugaaaacacagauauuugcauuaaaauucauaguguuagcaaauuacaguuaggaaguagcaaugaaguuaauuuuaugguuggcgucuccacaauacaaggaacuguguacugaagugucaacagcauuaggaagguugagaaccacugcccuaaagguuacacuggcugaggaacaagcacucaaacaugagccuguugugugcaucgcagcuccaagucaugaaggggaggugggacugcucacacugcaggaguaggugucagguaagggccagaacuccaggccugcguguaaccuuccaaaguucaccccagcuggccuacuuuggucagcuacagccugccucugaaaaagaaucaguggucucccaaaaugucacugccuaguggggaagaaguguucaaaucaugagccuguggggggucaggcaagagucagaccacagcaagugguuuggagagugccgacuaccaggcucacucucaucuguaacuccaucgaguggcugugcaaaggagcgaaccuuggaaguuuaagcucgaccuggaagugaggguuggguugcugcucugagucauggggucaauaggaagggcauuuugaguggaacccaacaacaggaacaagguuaguucagagucaagggggaaagaauauggacaugaguaaaaauaaauaaggugagucucuggcugcuggaaucgccugcgugugaucccucggcuuaaaucacaucuuuguaugcaagccgcacagaagccgagcuuccaccccuguggagguccuacuuccuuagcuugucuugguguuuguggaagccaucuagaugaagagacacaaagauguguccuuggaucuuagcugucuucuaagcaggauaaaggaaggcaaggaucugggccugauggucagcuuucccccaggaaccaguucauucauacacaaagguagauaagaguccaucugagcugacuccaugcccagucauguuucaucuguaccuccguaauuuuaauccagaagcauugcaggaaguagccaaguaauuaggucauaauuauguuauaauuacuuaauaugcucaagcaaauuucuaguuccuaguuaaauauuauaaauaacauacauguuauaagugauucucuugcgggcgcucgacuggccaggaagaacgacgcugcaacaggauccuucugcacacguuuauugggagagcuugauuguagaggcgaaaagaccccgagcccagaacuggugcugcuuuuauaggccuaggagaggcgugucuuacacccggauugguuaugcacuaagccucauuugcauguuccucaucugauuggcuacucucucucaguaccucacagaaccucauuaucauaccucauuugcaugucucacaucugauugguuauacucucaguaccuuacagaaccucauuaucauguccgggccaggcagugucuuugcaaaaaacuuuacugcauauguacacauugguuguuuguccagacuuaugcaugguggccagcaguagucagugccacucugcaacggcacauguggcuucccacaugacuccugugugcaugcacacacaugugcacguacacacacacacucauacacaaauacauacaccaguuucugaagauccaguuuagcauccaguuuaugcuggguaagcauacuggcacugagcuauauccccaguccuagaaguaauuuuuuugucuuguacaggagcuuaagaugccaaguacaguuggcacacacucagacagcaagcaguaccuggccggggggggggggggggacagaagcaagagaauugugaguuugaaagcaacuugugcuaugcagcuugugcuacagagugagggacggcuucgcauaaaggaaggacagggaaaggggacaaacguguugagucuccuacacucuagguuccuaccagcuucaucuuaccguguguccuucugucuucuguauuggaugcuggaucuagauacagaaggaaaauuaaacaucauaauggugauuugugacgaacacagagugaguuggaauuuuuguuuucaggugguuugacuugguuuguucauuucuuuaggcucuuggguguagcuuaugguguuaaccaccaguccguuuacuaugagucauaaaaauaacacuucuacuuuuuuuuuuccuuaaaagaugcuuuuagaauauuuagcuccuguuuaguuauccagaguagcaaauuaaacuggaauucacuuuuuuauagaccaggaagggugguggugauagcgguggcggcggcagucacugcugguugacaucugugggcuuuucagaaauaacauuggguugcuuuaaggccuuuccucuaagaugaagagcaguguuugggcucaggggauuaaauuuggaguaaacagacuuacaacacagguuuguuuucaucuguucaggcagcuaugagaaaaaucccauuagaaguagcuucuagaccaaaaagaaggccuuguuuuuacauuucaagggguugaaaacucuaagaucaagacugacuggcuauaugucuggugagaaccuauuuuaguccuaucuucaccaaaccucacaugacauauaauucauguuuuaguuacuuuuaaauuguugugauaagaaccaugaccaagacaccuuauagaagaaggaguuuauuagagacucacaguucagagggcagggcggauaggagcaggcagguaggcauggcgcuggagcaguauggcacaccuccuccagcaagauuacauuuccuaauccuucccaaacaguuccaccaacuagggaccaaacauucaaacagauaagccuaugggaccauucucauucaaaccacaacaaugagggagcuugcuguaauaccagaccccauuccuaacagcagugccagccugaccuaauuaaucaacuucugauaccccagcuuccagacacccucaguccaagagaacgaaauuccuuaagaugaauuuggaagggagacaaacaucucacaccaguacaagacagggacauggguaaguguucugugaaaagcaguuuaugccaguaaaauucuguguucuucucucuccaggugucaguggaugggguuuuaaagaccaugaaagaaaaugccaauaaagccaaaaguuuacuccucacuacuauaccucagauagggucgauggaauggucagaaacgcuccguaaccuaaagguaggugcccucacgucugugagcagacuuguuuuauggcuuuuaacuauagucugucugucuuucugucuuucacuuucaauuuggucccucuccuugugcauuuuaugcaggccgacgcuucuuuuuuuccaacaagcuuuuuuguuaucuugugccccagauucuuuccaucguccuggaguuguccucacgucuuggcucagaaggcugaugaguuuccugugugcuucucuugugcucagcuguuuucucuuugguagauuggugcaggcuguaggcaggccuuuauagccaggacaucaauacaucagugacaaaguggagggaaauaucuccuuuaggccaauauuacuaaaauuaagaccauuauuagugauggguaaaugacaaguugcagauugguagaaucucaacucgagugucuguucuaaggauacaguuuaaauugcaagguuagagagcgccacuuuuaaugaccauuuugugacuugauuaacuggggugaguacggagccucacucucauuccacuuuaccuuuucuuguaccuaaagagaaauuuccuccagguguccuagagcuuuucugugcuccuggauccuuugacagucacugagaggguggcacagguugauagaagcuaccccuaccuggauuaguaccucccacaggagugagccacaaguuuagguagugaagccauuguaaaguaguaaaugauuaauaguguuuucuaucuugcacggaaugccacagcagagcccaauguagagccacccaaaggucgagagucgcuccagugagcugugcagcacaccacugugaccaugggucucagccuguaggacugggaaggccaggaauguuguaauauaaugucuucccugagaggagacaccccacugguuucagcaccggauaccuaggagauaaauguuuacuuaaugagugcauaauuuuccucccgugaaggguucugcuaaagugcaaaaggaccuugugauuauuuuaguucuggggggaauuggggguugggggugggggagagacaggagauaaaaauccaccaauuacaaaacagugguuugaacaaagcaauuucaaacauaugugcucagaccacucagaaguuuguuugcuggaaccaugacucacuguggccucuucaaaucaguuucagacucacaagcugugaugaucuaaccuuauguuuaccacaguuucacguuccaagucaguuccuuaaaagacaugcugagaugguacaaaucuguggucccuuugaagcugauguaguguggucauggaaauacucacuuuaaaguggauuauuuaguguagcauucaucagguuucaaaugaagugaagaauugaagguugaagaauugucuuuuuaaagacaaacuugaguaccaugaucuccgcucuggaauaauaaggaacaugggaguaaucauuuuuauucugaaucaucuaggcacgaaaaugcauauaaugaaauacguauauguucacucacgaguucauuccacaaacaccaaucaacccacugugucaagcucugaguuagaacaguacccagcuaugagguguggcaguucaugcuuuuuaugccagcaguugagagacagaggaagguagaucucugugaguucagggucagccuggucuacagagugaauuucaggucagcuggggugacaucuugucuccagaaacaaaauguaggacaauacucaaagcccucucccccaguggagaagaucccauuguguugcugauggagacacauuaaaacuucaaugacuuuacagagauacaagauaagggguagaggucacaugggcgacaauuaagcugggagacugggggaacaugugugauucucacaacaguccccugagaugaacacagccaaccacaguugucacagaagggaaggacacacaagaaaucagaguugcuccuaagguuccacauaugguuagugguuuuccuuagcuucauuuuuaauuucucgucuguguguguguguguguguauguguguguguguuuaugguuauugguuuuccuuagcuucauuuuuaauuucucguguguguguguguguguguguguguguguguuugauauauaugccauggugagugugugaaaguuaagagggcaguuuguaggauuugauucucuuuccaccauuugggucccaguaauugagcccaggugucaggcuugguggcaaguaccuuuacccgaugagccauuucgccugcccuaauuaguguuuuuuuuuguuuuuguuuuuugguuuuuuaaauuuugauuaaugugggaaguaucugaaaagcuuuaaaacuauguguccccuugaguccuuccuauaauccucaguguuucaaggauucuauuguucuguuuuugcuuuuuaugucuguuauuguugcuucugcugcuguuguugcuuuucauagaagugcuggggucguuaugcuguccgcugcuuguagccccugucaucucugcuuacuuucuuucagaacauggcccaguuuuccguuuuaccaccaagacauuaaaacagcauggcugacacaagaagacguucuacuucuagucuuugggggauuuugcuuaaacaaaaaugggaaagauccgcagccuucaugccuuugccuagaaagaaagacacuguuagcgacucaaccaagaucccaacuccuccgggacccagaaggaaagcagacagccugccaaacagagccggagagcacaucugucucacuuucccuauuaaacugacaacaaggauuacuagugaaaacauccacuacccuacagcgcuaaggagccaauacgagcucgagaugggacugugugauuguaaacuggcgccauguuuccgacacuugguauucuaagaguuucucuugaagaaguuaugagauauuccuucaaagaaucauguguaaagaagaauauuaccugccauaguaaaauaaucaaaacuaucugaauaucaaaaaaaauuagcugugccguguuuccguuauacuuagguuauggagcaaucaaguggaaaucauguuuccucacgaagaaaugauuaaucuuuuucucuacuuuuaaauauaaucaaauaauaaagcuguaaaaauuaaaauggacuuagagaacuuugaaacuccuuugguggugaagugaagacaacaacaauaauauaacugcgcuguguaugugaaucaagauauauaagccaaauaacccccuuucccaaauaaagaaauaaaggaaaaugcugugugaggagcuuacuaaaccuuugcuaagaaagauccugggucaccacacagcuaagaugauguaacugagaaagccaaggccgguguuuaaugcaagccagugugacucaucacaguguaucgagaguugacacauaaucaguuggcaauuuuuuucuuuuguuuaaaagaagaaaguagaagccuaacuuuuuauuuuucaaauuacuguuguuacaggugcccuacagcgcccguaaagggucuguaaagugagugugccugugucugaaauugacuucaagauaauaagcuguugauuguaagcaauaaaugaauuauuugcuccaguguuaaugucgagcgaggcccuggauaagugcaauuguuacuuccgcccauguugcagugcucccaucucuggcuguaagcaguccguggagacuccgugaggccugaucagggcuuuagguuguuuuuacucacugcagugucaacacuucuuuccccuuagccacugcggggugggcauccguuuuguugccuuuagaaaaugcugcucucuucaacauggagaaugacuuucuucaguggccuuucuagcaucaugugcaggcuucuuccccuuuuccuuaauccuucaucaugaugaaacaugcauauaaucacugggucuggcucaacaugaugcuguccguucuguccaucuuccuacggguaucguaauuccauucuuuuucugacaagaugaaaucuccuuguguauccuuuccgcauccuuauccaugcauguguugauggacgugugggcugcucccauaauguaccuguucugaguaguguuucaauaaacaucaguuugcagacuucucagaugaucaga

SEQ ID NO: 1977 - RNA, 4753 nt, Mus musculus
cguggucugagggggcggggccggcggcggugcagaacgcugcagcucagugccugcgggcucccuacccggcgugagucgucugugccggcggugcgguucccaggcgcuagcgcucgagcguucccaggacgcucaccgaagcuacugggucuccagaggggaggagccgcucagagaccaggcuguagcaaucucacggccggcgaaggaccauuucugccacagaccggggacaagggcauguugggcggcagcagugacgcgggccuggccaccgccgcggcgcgggggcaaguggagacggugcggcagcuccuggaagccggcgcagaucccaacgcccugaaccgcuucgggaggcgcccaauccagguagcgaggguccccaggccuuaccggcagagggcgcacgagcgcggugcccuccgcggcugugaguuguaacugggcaccaccugggcagcccucuggugcuggcugugugcgggcccgacgggaggcagguuuugcaagagcaaaaauccugaaaaacaaaaacgaucgaaacaucccucggcacuagauugguuuuuuuuuucuuccuuuugcgacgcugggucugguuccguacaagcugggcaagugcgcuaucugggagcaaugucuccagcccccgaaucuuugcugcaaagguggaaaaauauaccaguauuuauucugccaucuuacagucauagaaagaagccaacacucagagagcaaauuguaaaagggagggucagauagagagaaggacacgauaacgaugagauuaccgguuacauggccuagauuggggaaucccacagaauuggagugcguggggcgagggaguucacugugaacuugugaacaacgguaugaauccuuuuuuuuuucucguuccucauaaacuuaaggauuucuccaacccagcacuuaauuccuuguaugcgggcaguaacaauguguaguuuuucacuguuuaacaggcacagcccucccaacagaacacuuggguccuuucuuucgggacgacaaagagguucccuaaacauucauuuagggacaaauugagauacauuuguucaguguuuacuaaugcuuuugugcucuccugaugauuaauauagucgccguuuucacucaccucacuguccaucucugggacuaugaaaaucagcacuccuguuaauaguaugguuuaggaaagguaccauuucucuucaguuuuuaugaaaaagggguguuuaacaaaagaauuuuuuaaaaguuaaaaaaaaauuguaaagugaguauaaagaccguauaaaaaauuuuauuuauggcuuuuacuaaaaacuuuuaaaucuuuuugccgcuguaaaaacagcccuuaccucgccaaaagaaagaaaaagguuauuguguuccuugaaggaaggaauauuucuaauguuaauauaauuuaaaacugucacaugaucauugccacuguguaaauuucaaagcacauagguccaccagaaccagugacuguuuaagacagauaccaaaaccuguuuuauuacuaacuuaaaauguagaagcaaauguuugcacaguguacaacauacacaaauagcugcaauggggagugcaucuucaaaacguuguugguuuuucuuaauuaugcauuuuuugauuuuagguaagagucaaacuuuuuauacagaaacaaaaucaccauuaaaauuuuuguacaauauaaaugaauguuaauuucauguuacaguguauguucacuguauaucauacuagguuaaaauguucuaagaggcuuuguuuccauaauguuauauaagcuuaggaugugacagcuuucuccugaucuccuaugcacaaaugaucagacuacauacagugugugagcacagacauucaugacauugaaggagcaaaaccuuuuuaaaaacugccuuguuuguuuucucaaaacaaacaaacaaauaaacaacccauuaugugguguccucauuugcuuucuguugcugugaggaacaccaggagcaaauggagcuuagagagaaaggguuuugacuggcuuacauuuaauugcuacagugcauuucugaugaagucaaggcuggaaccaaagcagagaucauggagaaacacugcuuacuggcuugcucaaggcucaaagucaaccaucuuucuuccaggacaugugggacauacacccagaguggacuggaacccccacacauacacauuugucauuaaccaagaaaaugucccacagaccaaucugguggaggcuuuuuucagcugagguuccucuucccaaauuagugugucaaacuaaccagugaguaugguuggccagaccuggaggguuagagggaaacaauaugaaacuuuauauauaaagccugguuucugguguucugccugcaagacaaggcaagguuggcacaaacuaugagaguaaccaaccaauaaugccugacuuaaggcccacuccacaagauggagcugacauugcuugagugaucaagguccagagacuauagcucagcaaacuaggguaaaaccaaauaguauuguuccaaaaaaggaaaaaaaaaaaaguaccaauaaaaugacauucugcuguacuuagacauguccggucuugcucagccauccucagagaagcuuccuucuacagcagacaugaacagauacagaacccacagccagacaauaugagagaccuuggaacacucaggcuuaagugggugucuccaucaccucccucccccacagggcuaagggaacccugcagaagagaagguagaaauaguguaagagccagaggggaugggggauaccaaggaaacaagauccucugaaugaucaaagcucuuaacucaagagacuaaggcggucugcaucugcaccuacaccucuaaccugcacuggauccuuuguguguuauauuauggcucccaguuuaauguuuuuauagaacucccgagugugugaaagagugggucucuugaguccgguaccuucucuugugcuuuuuuccccucuguuuuguucaauuccaauguauuaguuuuugucuugucuuauauuguaugcuaucacuuagaagccagauuguuuuguuuuggauuuugguuuuuguuuuuuucgagacaggguuucucuguguagcccuggcuguccuggaacucacuuuguagaccaggcuggucucaaacucagaaauccaccugccucugccucccaagugcugggauuaaaggugugagccaccacgggccggccagauuguuuucuaacaagggaaccgauccaauccgaugagaagggagauggggaggagcugggaauguaaggaggggauaucguaagcagaauuuaugugaggggaaaggucgauuuucaggaaaaggguaaaauaaaguauuuuuuauaaaguucagacuaagcuaauaaaucacuuaacgaaauaagucucuguuguccaacguuucauauaagaaauaagccauuucuccgcccuuucuuauugcuucaccuguggagaauaaaauggaaucuaugcugaguucagccuaggcuaugauggguggggaauggauugaguaagcaaaagagaaaucagacaccugaagcuugcaagcacccuugcugccucccacccccaccccacuagaaacgucaguaucaguuuuguaaugucugaggcucuuuaucuucuuuuccccucaggucaugaugaugggcagcgcccagguggcagagcugcugcugcuccacggagcagaacccaacugcgccgacccugccacccuuaccagaccugugcacgacgcagcucgggaaggcuuccuggacacgcuugucgugcugcaccgggcaggggcgcggcuggaugugugugacgccuggggccgccugccgguagacuuggcugaagagcagggccaccgugacauugcgagguaucugcacgcugccacuggagauugacugcggguucccuccgccuuccgcaaggacuucuuucuccccagccccaucuaggaagacugcaagcacgaagagggccaccagcgcccagccugcaggccuuccaaaacuugaacccuacccaguaagacaaagccaaucagaaauaacuuccuacgcauuuucugcagcuggaucugguccuugagccucaccuugaagccaaggggaucaccaaggagauuuaguauuguaugaaguucccgggcccucuaccuuucaggacgcgguguaaaauagcaagggaaauucuuggaucuccacaagcugcugcugcaggggaacuggagacagcuugacauuuguuugacauuugggugggugcagucaguaccuuccccugugaacugaaaaugcagaugauccacaggcuaaaugggaaaccuggagaguagaugagaggcacugaagugguuuuauguacugucauguguggggauucaccugcaaaauggcauuuauagaaacugagaagucaccuccagcucgacaaggaaauagugaaauugaagacaauaaauuuccacuaaacugugacccacaguugccuugaugccuggauucugacagacucaacguccacaaagcccagugaugaauuguagugguagcagguuacucuaugcaaaauaguuuaauaaccacuuuagaaauuuccuacauuugaguugcucuuuaauaacaguguauuuaaagaaaaaaaaauuuaaagaaacagugaaguuca

SEQ ID NO: 1978 - RNA, 458 nt, Mus musculus
ccaucuuagcgaggcugcugugguccacaugacucucugagcuucgccaugccacccaaagaugacaagaagaaagaugcuggaaaguuggccaaaaaggauaaagacccaguaaauaaaucugguggcaaggccaagaagaagaagugguccaaaggcaaaguucgggacaagcugaacaaucuuguccuguucgacaaagcaacauacgacaagcucuguaaggagguuccgaacuauaagcuuauuacuccagccguggucucugagagacugaagauucaugguuccuuggccagggcagcccuucaggagcuccuuaguaaaggacuuaucaagcuggguuaaaagcacaagcccacauaauuuacaccagaaacacaaaggguggagaagcuacggcugcuggugaggauucaugaacagguucaaucagcugugcauuugggaaaauaaaa

SEQ ID NO: 1979 - RNA, 18386 nt, Mus musculus
uaaaaaaaccucgugguuuucccaaaguuagcuccuuauaacaggaaauucauaagaggagaaguggcaggguugagcugaucaguagaacagguguaagcacuuuccuuacuugcuuagggaaaaaaaaaagaaggugguuguacggaaaagcacauuucauagccagucacagcccauggguuuaaaaacuaggugaacagaauccuggccuaggcauauguagcccaaaggucuuuuagagccggauuuuucccagagauggaaccauuccagggaaagaagaguucccaggacuggguuucuugauuugcuggcagguuucagauaacugugccuggccucguuuggggacucugaggucuaggcaggcaagugcuuguaagcagugcugacagguuauuuuaucuucaauuaaguuguagcaaguugcaccaagaucagauuguucuaccuaaauuaaagguguucuuucucauauugcagucugugaagcaggggagagaggcucaagccagaguggaacugcacagcaagaagccaggcagcuucacacgcugagccaccaagcaagucagugaauccugcccuacuuucacuucgcuuccugcacuguguggaagucugagccucuccucacaggcauagaaaggaagcaauccccucugcacaucuccuaagacggccuuuaguuauaaagaagaauuaauuuuuacacaggaaauggacauuaagcugguaagcucccagauaccauucuuccaaguaaagaugcuucucauuaaacuugauuccuguguccccaacacugauccuccauuauuaccuaggcuuguucuaaaguuuauuccugugucccccaacacuaaucuuucauuauuaccugggaucguugaccuagaauaagcuaccaaauuaaugagacaucaguggagauaaucagauuaaccuggaaaacccuuaagcauccacuaugcuccuaggaacuagaguuacccaauuuguagaucggccuugcuggggaacagcccuuucuguguguuauaggagaugcugacuaaccuguuaauccaaaugacccaugacaacgcaguuaaguaggaggauguuguuuucugagaguauggucccugcuucucuaagcccagagagcacgaacagcaggaacaggccaaagcacuucucaggcaucaucugcuugcugcaaaugucaucuucuaauaaagugaacagaagcgagaagguagagaugucaacugggauauucuaucccacaucauuuguuagcagaauguguuguaaaaggcagugccuuagugcuugaguucaggcauugcacacuuguguguagccuaccagagcucuccuaguugagggaaauaggcagaaauaaguaaauacucaaaauaguucuagaucuacccaguguuuuaaagguggacaaauauaagaagcuggaauaaagaacugcugguagagagugggaggaggccacuuuuaaaggaagggcauuaagauggaagaaauaagcugauggcuguugagaagauaaacuugugacacaagaagcagugaaguucuaauacagagagagcaucccggguuggacgagugugaguauucacagcuaugcaaaucaggguucucuugagaaauggaaccagucaagugcauauaugagagugugcagaagaagagagcucccagaaggagcccauguauacauuuagggaggugagcacgcuucuaaacugaagaugugucaacagucccgagagccaaucacggagcacaaacugcgcccaaguguuugagagacacaggagguccucauaguuccuggccaguggcuggcaggcauagcacacagaaugagcugauguuucaguuugagaccaaaggcaggagaaauccugguucagaggaguuaggugggaagaggagagacuguuccuacucacuggagggugagcuuucauguucuguaagggacucugacugaaugagacaugggaaugcuggcuagggagggugugguguucaguuguauguguaaacuugacuggccauaaaucugcuuagauauuugguucaauuuugucaccaagugugucuauguggguuuuuaaaauaauggacuaagaaaccaaauccuugaccaauggcuggaaugaaagagaagaacacauuuccaccuuaccaucccucugccugccuaccugagcuaaagucucuuucugcuuugcacugggucuuaaacacuaaccucuuugguuggugcuuaggccuucacuuucauacuguaaugccaccaacuuuccuagaucgccugguuuauggacaguagcaaucacaugagccauuuccuuagaauaagucucaguguagacauuguuucuccacaacauugguccauuuuucuugguaauuguaacuaaugcagaagaugaucuuuuacucagucuccuauucaacuguuaaucuccucugaagcaucccuuguagauggaccuagaauaaccuucguucaggaaucugggcaucccuuagcccaguuggguugccacguaaacucaucauguaugggcaauauaaaggaaaagaacacauaaaauugagcagaggcagagccuugcaguguacagggauuuggaguuuauuuaaagucucuugggugaggacuuugaaggaucuuaaaugaaaagcaacucaaucccaucaauuuuaaaauucauagcucuuggggcccagugagaugguugaguggauaaacaacuuguuacuaagccugaugacuugaguuuaauccuugagaccuacaugguagaaugaagaaauugaguccugugaguuguauacauacaaacacacacacacaccccuaguuuaaaaccaauuacucuuugaagauggaagauauagaagcaacuguuauaaggcagcaacuguuaaguggugauggauggaaacagagacaagggagguggaaucaagggaacuuugaggaauauuuuagaaguuugaguuuugaguuaguguaaaucaaguaugaccaaguuuuguagaaaggcuuuucucuuugcaucugugugauaggaugcuaaaucagacaguugucucagccagcagucagcaauucuguccucccuguuguagccugugaucuaaaaucucuccuccccgcccccuuccaauaguuggaagaacauuuuaaaaagaacaccucaugacccaaaaaccuaaaguauugauuaucugaccuauacagaagaauuccagaucgccuaacucauaguccacauuggcagcaauacuauggaguaucaguuucucuuuucucuauguggaccaaaauuagccaccaauaaaggaagauuugauucaucagcaguggaaccucagccuguucuaacagcuaagcacuuucugaaaccagugagaucuuggaggugaccucgagaugagcaaagccauuuguuuugcuggggguuuugcauguuuucucugaugucagaggggccaguugggccgugcugaaggagaaauaagacuggguagccuuagcuccaagcaaguaggcuagcacacugggggacaguugugaggauagcucagaccuaacuccuuguuuuuuaaaaacagacaaacaagccuauguccucuagaggcuaucuccuggauugaaucaguuauccuggcccugaaaugucauacacagguggcuuagacagcaagcuuugggugucuaugcaggucuagagaucauuuuucuugauucuuucuuggcauaggcaaguuuuuguacagacagaaacccauuagccagggguaagaacaaagcaaagcccagccugcuucucagaggcaaacaagcauuucagaaucuucagaggcauucugcaagugguugugguaaauauucuccaauaaacaugaauuucacaccuggaucaauuuuucauuggaggaaacaccugaauguuuuugauugggucauaauuuucugaagcugacauuuucuuggaaccuauauugcuagguuugaagaccucaugaucuaaauuauaaaacccuauaacaaguuuugaguugggaauuuacaucagguuccaggaccccuguaacacugaguccuaguugguaaggaaguggaaugcaaagaagaaagccccugucaaggaccccagacuccugugugaguuuuacuguuucucgcuauucgguuguguuggagggaugguuuagagccuccaugcaccuccagcucuuuugguucaccuugagugacaggaaagcaagaauccagugccaccagaaugauagaugauagacggugugguagacgcgaagauggcugagcugguguaaagggggcccaggauggagcaucccagggcagcacucaacauuagcacauauggauucucucucaggcucagugggcuuucuaaagcaguagcauauugccagugaaaagcauucaguguuccuuucucaucucuguuuaguuaguuuccaccuuucugaccuaauguuuccuuucaugacuguuuuuuuuuuuuuaaaccuccuggaaaaaaucugaaaagaauccugagcaggaaguguucuuuaaccagaaagaaaaaaaaaucugcugcuccagcauuauuuuuucauacuaugcuaaucauuuuugaauacauuguacagaugguagguuguauuuuuauggagggcuuuuuuuuuucaagccaaguucauagacaugaucuugaauuuguaaugcuguauucugaagugucuuuuuuggcugucaaaauaguaccagcuuuaaaaaguacauagacacucugggcaaggcugauuauuucugcuugcuuucuuuauacaaaauaaguauuuucccuuauugagaaaaacuaccauauucguuguagaagacuagcaaaugagagggggaaaggaagaacaauccauugguuuaagcacuagcccauaaaaccacuccuuaucuucacccuccuugccucuugggccguagaauaagcagcaucauugagauccauuguucugccuccugucuacgugucagaugugcagggacaaacagcuggcgugaaggacacauuaauggagguugugccugugugaaguuugcaugauaaaaugggagaucuuggggugggaggcauggaguccuggguuuugguugcagaaaugguugaguuguguauucccaggaagucccuugccuggguuguaacuguaaauuaagagaguucuuagggagauucacuuagagccucaaguuccugugagggcaaauggcagucauggugcuuaccuucugagcauccguguaucgacugugugcuuccauaagaaaccauguggccacaugguucauaguuuagguuuugcagaaugaggcaaaaucaaaggugagauagcuagcacauaacccuuuaacaugugagcauuuaagguggaaagaggagaccaucaccuaaaauaaucaacagacuagauuuuccuagcuccuguauuauaauccucacuauccugugugaugucacucuucugaugaaugauggacauguccaacugaguggccaaagcccugagcccacucccaccucuaaccuccaggucaugugauuucagucucgccuagguuagucuuaauuguauguaaacugagcuauccuuuguguacuguccucucucuccccuuuaccauggcccaggccauuuugaucccugucuguuucuccucuuuccuaccacucuguuccuguacuggaacccacuaagcucuguuccuccucaggaucaugucugucugcauggugcugauucuucucugcuugcuuggccaacuucuuauccuucacaucuaaguacaaggcgcaccucauuugaagagucuuccccaaaauacuugucccuaugcccugaguguucuaacacaucauucauuuucugacaucuuuaucccucccuccccauuccgcuucuuccccuucucuuucuccuuucccuuccccuuccucuuugagcauucauuaguugaguugucucugugugugugugucugugugucucucugugugugugugugugugugugugugugugugugugugugugugugcuucugcucuguagcaaacaagcucccugggaaggagggaagaggagggaauccuucuguuucuaaaggcauucccauugcgcuguggcuauaaggccuccuguugaugagcucaacaucuaaggaagagacuccuugccuaugguguggaaggacaagggacacaacgugagcuucaggaacccacagcggcuggguacauaaggcugcauaaggcugaagcuagucugcaguacaagaagagauggcaugaaacaugccuggcagagauauagccucacagugguuguuucgggcagugcucucccuaguuuaaaagguacccaggaucuuguguggcuuggauuuaaaugccagaguagggucauccuugugaaucucuggccuacuuuuaggagcuguuuaaagcuguuggucauuagaccacuguauuaauaacgcagguaggaccaggauuccuaaacguuagauguguauugucuguauaggauguauaggauguauauuauucaccauggucuaugguugcuguagccuuucuaaaguguugagcaccaucccguccccggccuuuacuccuagaugccucuagcauugcuaaaguaagacgguuggaucugucuucagaugccaccugccauuuucugagguucucaaaucaucuccauccauggcccuuaggguacucuucagcccuuuggaaucucugagccagagucguccuuucgccuaagcuaucuuuguugcauauuuaugucuuguaauuaaacccugcagcuuacauucauguucuucuuuauuugugugcuuuuguacauucugucuuugugcucugccgagcuccauagaaguaucuucugagugucuucauuuuaaugcuguguuuuaauacuuagcagguagucucaucugugggagguaguugauaaaugccgucugaaugaaauucuacaaggaaugugguuaaaugcuuuccuuucacuuuugagcaaaugauccuuuuuuaaaaagaaguuuuguugaaguauaauauauauaguuccagaaaagugcacugagucuguggcucagugaauuuucacacuuugcgcauugccuuauucaggcuaacaucaagcacacagcaugaccagcaucuccaaagcucccccaugucccacuucuacuuuauaaucuuuucaauuuuuccugcuuuucaauaaugaaaaggaauccauguucacuguuaaaaaauuuaaaaguagagaaaagcaaaagggaaaaacauacuccuuuuuaaugcaugcguuuuaacauuucacauucuuucaguguucucaaugccuauacaugcacauaaauauauuuuuaaaacugaagcaagaugguaagauacauaguuucugugucuagcuuuucaacuuucucugugaguacauguauguauuaacaugaaucccuguaaauacauguauguguauauauacacaacaugcacacagauaacacacauaccuaauuuguuacauuaaugacaaugugcauaagucauuccuuuuguucggaaacuuggcauuuagguagauucuauuuuuucuuugauaaacaaccuuucaauacuuaaucauuuuaugauuuuuuuuuacuauuauaguugcuaagucaaaugaaaaugaacccuaauaaacuuauaauuuacauauauuugguucucuuauaauuuuacauauauuugguuccuacaaccaucuucuaauuaacaaguuuaaaaauugauauacaggaaucaugaaacagagaaauugaguuuaagauucacucugaauaaaauaaucaauguagacagaauagagugaaaacaagcuuuucuucaaaucuucagguaccuaccucagaauaggugucauuaacguuuucaccuuucacaauucuuauguagggacaauagucgauagucagggucuuugaaauaaaggugguuaugguccuuuaaaacuuggcuuuccucagaacaacaaaagcacuugcuggaugaccagcauugaggccagcaaacauugucuuguaaaaugaagcagaucgaugcuucagccuuuagaaacugcauggucuccacugcagcccuucagcucugugcuagugcuaaaggugacauagcuaacauguggccuguguugcaaggaaaauguguuuaccacagcggcuggaacuggacagcacauucuagugagaggucuacucaguuguuaaccagucuacaucugaugucuuaaaaugcaaauauugaauaugaaugcuaacuuuguacuucugagaguagaacauaauacaagcuuuaaagucaauaguuugaagacaaguugauuaaaaaguaguuagaggguuagagguuaggguuaagguuaggguuacgguaugaaggcaaacauggcuuuguauauuugucaaaauacacagcauaagcaauucagauuaaacucugauacaaaccauggaguucaucaguauuagcaauaauauauucaugguguccauuaaucuaauaaauauaucacacugauauaagauuaauaauacgagugauucuguacaugcaggcagcugcuuagagagcucugcauguucuauacagucuuaauauuucuguguacucucuacgucucuaaaagaaagucugcuaacuuagaaaaaguuucauaugcuaccuuuucugugucgcuuuacuucaauacaacuugaacugcagagauaauauuuugagagucuucccugcuggaaaugggcuucccuaccaugccucaccgucaucagugggacaucucucuuggcuucucaugggccuuuuuacauuuugauggcucucauggguaugauugcuugacagccaagcucugaggagauguucuguuacuguguguuuauucucuagccucucucuuuucuucuuucuccucccucugccucugucuuccccuccucucuccuccucuucuucugcccuccucucuuucuacuaaccugauauuagacagauuuuggaaauucccuauaaauauauaauacaaauaaaauguaaaaggcuguuagauuuuaggagugauuugucucaguaaauacaccuuuuagaaaaaaacugucuuugauauguuuuuagaaagcagauuaaaaaucagguacagaacccuugauuuguaaugcaagggcucagauugcuugcaaaucuaccaguugcugcccaguccuuggcuuccuugccuccuccaaaaguuugcccucuucuuaauguggggaugcuuucccaguucauaguuuaacucccugugugauuucaaaaccaucaguggcuucccauuaccuucaaguugaagcacggccuccuuagggaugauaccaguaauaccagacagugaauacuaaugugaagaucauugcugcgcauacagagcccgugguggccaucccccugccuauacacaaagccucagcaugugcuaugggccccaugccagcccaaaggggccuacaguuucuggcaucuggcagcauuuguaugcauuuuuggaaucuguauuuggaaccucuccugcugccccugugccucagugaccaacuuaggugucauguuccauaaugguucuugggaucacuguuuccaaagaaucuuccagaacucugcacacauuucaccuguaggauauaggaccauauauuacuugaucuuuguuacuugauuugcuuuuuagauuugggcagccuucuaggacuucauguguuuccuuauuuucugguccaugcuugagucccugaugcauuauugcuuuaacugacugaacauaaguaacugagucaagcagagccacugagugaguaaagcucaugucagcugcuucaauaaggaaaugucaauagauuuuguuccuucgggugcuuucccuuuuguagcuuugccagccuucuguugcaugaagcuuccauggcugguguuggacauguaaaagucaugaagacuauuuccuuaagaaucaugggacuuauggaaagcaguauacaucacuguauguucaacucuaacucuagaugacgcucagacagcuguagcccaucuauacauccacggagaaaauacaacaguuuauacagucgcuaucaaguuuucugcuacugaaccacucugcacuccuauuuggaguuugcaucacuuuccauggagauuugaagcuacuuucaggcagagagugcuauagaaagcagugauugaaaggaaaaauagcucuuggaaagcgagucauauagaaucugucuucuaguacuuacauaugauuccuuccauguuaaucuaucugugcgucccaauguuacaaaggcagacuuuacagaagucuaccuuccaccccaguguuaggccugauggucccuguccuuacccugccauaugacagcuacaugccuuuaccucaugcaauuacccuaagccugcauccuugcuuagagaauuacggcaucccuacauguguaacaugugccucaguguucuaauguuuaaacggaaugcauuauuggaauuuagcauaguaagagaauuagaauucaagucagugugauaaaucaccaaacaagccacugaaaggccuaaauuuaaauuaaaccuuuaaaagcaauaaccucuuuucaauucugguauuaccaggagauaauggagcuguuaaguggaauggauuugauuuacaaguucugcaauucuuuccucaguugucuauguuuuccacaguguauguucuguccuuuaagagugugaucaauaacuaagguaagugaucugucucauucucccuuccauccuauuuaaaaugcccuccgauauauacagaucugacauagaucuguguguauacaaucaagcccagugcauaguaaaauaaaagccuggccaacgaggguuuuuugguuuguuuuuuuguuuuguuuuguuuuguuuuuuuuuacauaagcuaacgaucagaaaauuaguucuuaguaguaagugggcauuauucuggaucauuuucauauguucccgcuccccugcagagcccucaacagugcagcuccgagguucugcaucugauagccauagucaauaacaugggucaugauacccacucucagaacuuagaaaauuguguuacuuuuccuucccuucacaaaucgccaaugaagaguguacuauccgaauugugaaagacagacaguucagaauuagugucacugugcuaaaaucaaaguacccacagagcugucauccacucuggaauugcaaagggagaauucagauccuaucucuuucauaucuccagggcucucaucuguccuuggagugugaccaccucucucuaguuucugacucuguggccaaaacccaucuuuccugcugccuguuuucacacauccuucugccucuuacuuauaauuauguaggauugcauuuagggugcaccugaguaaccaaaaauaaucuuuccuuuucaagauccuugaauuaaucacaucugcaaaaucucuuuguaccaaguaaacuaaauuucauggacuccauagauuagaaucucccccccacccauauccccucucucugugucugugucucugucucugucuuugugugugugucucucugucucucucugugucucuaugucucucucuguguguguguguguguuuguguguguguuuugauuagaucaggcuggccuugaacuccuagagaugcaccuuccuaugccugcugggugcugggauuagaggucucugccaccacagccagcuccaccuuauuucuagaaacaacaugguaucuccuacugaaccuagagguuucugacuuauguagacuaguugguaagcaagcucugggaauucuccugugucugccuccccaacacugggguuauagguacacuccaugaccauaaaaaugugggagaacugaacccagguccagaugcuugaguagugagcauuuuacagucacuccagccccaaaguuagcuucaucacagucaucgucuucaucaucaucauaaucaccaucaaauuuccaaaauauuuuuuaauucuuuggaaauucaugcuguuuccuaccucuaucuccuccuacaugucaacaaguccccucccaaggucauguccuucuucuuuauaauuuacugagacuacuuaauguugccuguguacacacagcaaaugagugggcccagggcaugaacaacccuaccaguagcaacaacccccacccccacccccaccccccaaagggacugucccucucccagcagccuucagcugcugacagcucuucagcuaggggugaagccuugcgaacgcuccccuguuccugcucuuuagcugaagaguagcucaaagaccaugaagagagagaacaaaugcagucagcgacugucggucaguuuuguguguuaguuugacuuugugaccuaggcuuucuguuucuguauucugaccuguaugaagaugaaaacaaucuuguauguuuacaugagaaaaguuccccuuaggaaaaagguacaccagaccaccuuuuaaagacauuucuuuguauuuugucauuaaaaaaaaauccucuuuuaaagaaauuuaaaauaccuggaccagccugaaggaaaaaaacccucucagauguuuagccauauagaaaugaguacuguuucugauuggcucuuuuaaucaugucauauuagcauccucccuagaauguaaaagaguuguuuaugucauccauccaauggacuugaaacauggcugcuauaauggaguacacagcacacugaacauucagagcuaucauuaaggcuuagauguuguuuucaucuucaguuaagguuugaccuccaugaacugaguuggauuagguauaaaacgagcuuaguacauauuagcauugacuuagaaggaggcccaucaacugugagcaucugcucugacucuggcaggaugucuguaagccacuuucuagcauguuuaguaaacacagaacuucggcuauuucccagggaaauacuauucauguacaguaaaguuucagacuuaaggacuacuuaaugcuaauucucuccugugcaugagugcuugugugugugugugugugugugugugugugugugugugugugugugugugugugcaucugugcuuaauugucaagugucaacuuucaagaaucauuuuuuuuucuuaguaguuucuaggguuagaacucaggccaucuggcuugcaaggcaagcauuguuacccuguggguuuuaaaggucacgguggaaaguaucacuuuaaagugucaaaucugcugcuaaacuagggaguuuguuaaacccagaauuucuuuuucaccuaaggcuuauuacaagaaacuuuguaguuuguaauuuguagaacacaguagucauaaauaggggucauggguuuccaaauguuuggaguauuugaggacuuuccuugcucuagaagacauaugggugucuuccacagcucagggcuguggucaccugcccaagucuguagcugaaaagcaguagaugugaugcuggcaucagaaaaggccucauuccagguaucucacauccucauagacucaguggcuuuccucucccuggagggaacugcgaauugaaaucaaauaauaguaucaagcggagugaaaguucaagagaagagugaaagagauuuguggcuuuuuagaauguagcgugaaacccuccccaccucucccaccaagugucauuuuggccugaagcugaauuaguucucaucugauuaaaucagaaccaaauucagcuauuuccuaacugcugugaaaugcagauuugaaagaugugucaaaaaagcaagagcauaauccuaguaggaaauggcucuuuuaaaagagaauaauuagcauuucauuuauaucaucaucuuacgucugaacguacaaaaguauucaucauauuacuguaacgugauuauuaaaugccuggccagaauaugcaaauuaacuuuaaaauuuaguauucuaaaugaaucccaccaagauuuccaugaaggaaucuuagggguggauaacacacuaugcuaaugugcuugagugucuaacgacuuugaggacgggggggaccucagggucaacucgaggaauagaaacacuggauacuuaauggguaccagaagaguuuaggaaacauggaggaguggcuuaccuagaaacugccuguuugaauuuaggcagcagacacaggugugcauuuuuauauauucucucuacacaguauuuauccaugcaauacuaagaugccaaaaaaagaaagaaaagauuuaucaaauugauugaagcuuaaaaggcagcugggucuaauggcccaagcuuguaaucccaauacuagggcugaaacaagagaauugcaaacuuaaagccuguuuagacuauauauagggaguugcugucucagaauacacacacacacacacacacacacacacacacacacagagugacagacagacagagagauagacagacagagcaagagaguacacugaaagccauuuguuacuaggugauuauauuucuuuagcuaacuuguuugugaagcccuuuaagacagugucucuuagaggacugugagaacuucagcacuauccugcauugugauuuagguaucauuuuugcugggcuaugacccucaaccuuuacauaauggcugguuuaaauguuacuauggcgguagucugugaaacagaucauugcccauaagcugaggccucguuucuucagcugaaggccucaacagaccaagcucuccagaagagguggggaggagggcucuguucugggccaccucagcaacaccgacugcugccaaauuucuagcuugcuggccugccucucacacuugagaguuagcagaccucuccuggaagcaagugccuaaagagucaaaugaaguuuaaucucaugcacucagcucugcucucucuaugcuccuuugguucuguuuucaguagaauccuuuauuaucagcauuuguuagaaaggcagggucagggcucccucuuagaccuauugagugaaugcaugucuccaggucgugacaaaucugcuggaacagccccuaccuccauuugaugugaugaacgaccaggcuccagagcuaccgcaggugacuagagaagcccccaccugaagcugaagagauaaacguuucacuaggugguuacuaaugugaucuggauucauucuuguugcuuucaaguagaugaaguaguaguccugagugucuugaugacuuuuggacagauuaucccaauuucuuaagaaaaaaaaaaaauccuggaacaauuguaggcauuuguaugugguucaaaaucuucguaggagcagucaucucgucuguuauauuauccaagaaaagaucacuuugaguaauuuaaaauuaauagcuauuuugccauaacuguagcucagagcucuggcuuaucucgacacugucaguuuuucuaugguaaggugacacaucgaagucaaaagcagagacacuugauguuuuaaucagccuauaaaaaaugcacaggccccuugaggcauuuugaauauugaaaauagucuuuccuuauuugauuauaguuuuucaaagcaucucagagaccccuuguuguaugucuuugcacugaaagaaaauuucauauauagaugccaguuaaauuacuaggacauaguagugugacauauaccagcuauaucucaggaaaacguaaugcacaaaaaccacaucccuauuucaguuaccacaguggaucuucugcuguagauggugccucucguguggaggagauuggaguuccaggaucugagcuggagaauccccauugcugaacugugacugacaaagcuucugugagagggacaguccauggagguuugcagugagcaggcuuguaagucagccgcaagagcaccccuagaguagaggaugcuauacugucacucacugugccuaggaacaagaucugaauuuggugaagagccugcucucucugccaccuggagcucaaaugagaguuugugcuucuuccugugauucacuuauggucugaugcaaagcaugcuggguauuggggguggaaauagauacuguagugauugaugccaucugacucuggaacagggucacagaaauaauuuucccagcccuugacaccuucaagagggaucucccacugccccucaauuaucuuguccuuaugucccaaaggcuagcaagcuaaccagauggugucugccaucuuuguccucacucugaugccuaccucuauucccagggcuuaaaaguucacugucugcuuggucaccuaagggaauccuggugcugcugcuguagcaggaauccugccccucaguuuccccuaaagagcuagaggauaauguucucacuacucagggcaguagcaggaagcccugcuaucucuuaccugcugcuguggaagaaauuauuccauaaaacugcacuuugcccuucuucagucguugucaguuugacucaucugcccaauuguucuccccuauacuacuaacugugguuacuccaguggcuaauggagcuagggccauuagucagcacagauuaguccuaaaaagcuacccacccucccacuuguggcccuuuauccuucuguagauuuucuuggacuucuuaagcucuuccaaguuucaccuggcuauuccucucuacaaguccuaaagccagcccaggugggagcuguguaugcagaggggaagaaguguuaguggcuggagcuggaacuuacugacauguguuuucacuuugucgccugugucuuacagcugugucgccuguccugcagucuacccaagucaacacuuaauccaccuucaccucaucaccagaguaaccucccucugggaagguggaagguacacagacgauguaaugcaugaggaagucuggcaggagaaugaauuugaagaauuaggcaacacucugaaacuaaagagccagcaagccuugaaccaguggugauaagugggaguuguauaugagcaagaugaaacuuacuaugggucacaaagagaacugacuggugaccacagugaauaagaacucaauggauacuugagguuuacuggaagaguaauggagggugugugguagaaauauauucauguaugaagagguaauaaucugcuaguaaaguacaaauggaaucaguauagagcuaagacuuggauucgggcuuuuuuguuuuuuuguuugucucaagauuuuucuguauucaaaugugaaucuuuuuauuacugaguaguauucuacaguacagaucuaccacaguuuguauagccacucaccuauucuggauuaauucuaguuuuguuuucuuuguuauuucaaauaaagcucuuauuaauaaaaguacuuaauaguaggguuuuuuuaaagauuaauuuuguguacauguguaccugugucagaguuugugcuugugaagacaguugcccaaggagcccagaugcauugcauuuccccuagagguagaccuacaggugguuguaagccaugagcacuggggacuaaacucugguccucuggaaaagcaauaugcaguaugcacucuuaaacaaugaacugucauuccugacccaagaguagguuuuacaugauuucaacagacaaaaaugacgaauuuauugcuucaugccuacaauguauguuuagcacauugaaacaucacaugacaccccguaucaucacaugcucggauuauuugucaaauauaaauuuagaagguugaagguaguguccuuguccauggauacuagaggcuggcuugcagugagcuagccuggaguacagagaaggagggcuauggggccuguaagggacaaaggcagagggauaguaagcuagaaucggcuucauguccuugccauguugcugccuaggguggagaagcagcucuuuguagaaaacgccucucaggggagaaaauaugagacuuugugaaagcacaggauuagcugucaaucuuaugagagucacacaugucccuucuguccacaauuuguuuuuaucaaucagagcauggcucauaguuuaacacugguaucuaucaggacaagaacaauacccuucccauaaaaggagacuacuaggaauagacagcagauaauuuuagaauaaauaauacaaucagccacauuugcauuuuucucuuuuuauuauaca

SEQ ID NO: 1980 - RNA, 150242 nt, Mus musculus
uauggacuggguccuugggaccauuuacaaaacugaacagaaaagaaaucuuagccgggauguuuuccacguggcgggggcagauggggggcuccagaccgcccugccggcgcguccucaccuggccacagugccugcagcacaccugcgggccagggcggugccccaggacgcacuccccagcaggcugcguggguuccgccagggagaucagcgagcgagaugcacugcagaagcaccuucuguaccccaccuccuccgaaccucuccaggaggcccagggcaccugaguaccgcggcgcgcagccagcgcgggccggcgccucccggaguugcgcggaguggaccgagcgccgcgaggacaggugcaaagauugucaggcuaacuccggcugucucauccagcagugcccauaccucuacccccagaccaaccuccuuucaauuuuaggcucuucuuaguguuugaauggggucucucuugguuguguugcgcugaaaagacacgguggguuuuguggguuuuuuuuuuuuuuuuuuuuuuuuuuuuuuuuuuuuuuuuggaaccuaacugcagaaaaugcaguauagggacuuggguuaauagggcggacaguagaagacagacagacggacagacagacagacacacacacacccagagagagagagagagagagagagagagagagagagagagagagagagagagcgcagggggcuucuaucuccaggacagacagaaugauacauacugucauuaacaguuuugacccacccagaccccacccuucgguugcauccaucacagucauuacaaaggggccgcucugucucgcagcuugccuguuccuggggcucucggacuggcuuaaugaggugcacccagccggggcuauugugcagcgcgaccgagacaggagcgagacugcaaggaucuuagcagcugcuagcagcagccugggcugcagcagcuacuaagcccagaccucaaguggauggaugacucuggaaguguuuuucugaaggaacccgccagacuuuggaagacgguagcagggcuagagaacuuagauggggcuuuccuguugugcacuugaacuggcuggaggcaagugccugucgcucggguaaucgcagggugcugggggcgggggugguggugcuggcgguuuaaagccagucuuuggucaaaaagcggcuaggaucaauuuccccuccaaccacucaacucucccucuuaccuuuuguuagcuuggcucucccaccucccaccccccuccuccacccugguguggucugaacccugcaucuugcucagggguuugauugugcauuuaaauguaagucuaauuggugaaugcucucuccuuuuuguugugauuacuagagauaccuuaguccugccuucccaguucugcgcccagccaaagcaguuuugaaaaauuaagugcaaaaaagcaugacaaagcaauaugagguugcugugguaagugaacuuuuaaaccaaaaauuaucauucuucugguaugcucugucugugggugguguaaagagauccacacacaaaagguugggggcugggaagaggggggugacuaaaccgacagacauaaccacuauuucugauuuguuuauuuuuuuuuucucauuuccuaucuuugcaauugucaacaaacaaguucugugcuguuuugauacuauuaggcuugcaauggccuugauucauuuaaagugggugagaguuaacagucaguaggggaggggacccagggaacuaggauauugucuuuuuuuaaaagacucuugaaacuuauuagaguaucccgaugauucuaaaagagaaaagaacaauggggucuucaacagccccugaagcuaccucagcccccucccuggagugcacccuccuuucuuccccagguagcaccauuagaggccaccauccuuagauuuuaaaugagaaccaaauacggcauauaggaaguugggaaccucagagguaagaggaaggcuuuuuuuuuuuuuuuuuacuuuccuugccauaguagcuuucccguuccacucccauuaauggggaaaaaaaaauacagaucccuucuacauacuagguugcuuuaucuguuuuaaaaguggaaguguauuccgggaaacaguuccucagcucuacguuuugaucucacucauuuucugauaauggcuagccaaaacaguguuugugguauggcaaaguuaacaauucuaaguucggugaaggguucaacuuuuguuuuggaggaauauaaacucuggcuagaucuucucguaugggaaaaaauauagcucucaguagucuugacuauuauuaauguuguuguuguuauuuuguggagcuaguugaguuuguuuauuuguuuuuuaacuuaucuagggcuuuugccauaggaauuccuauauuggaauggaccuacacacuguuugagaagggaaagccauauauaugaguuuucaaaucugaaugauaccauagaaacaaagaugccccuugaaagcaauuuguacuuguuuuguugagucucuuaacuuugauuucuguguguacugauaugauuauuucuaugauucucaagauccauucaaaaguagguuuuuuucauuaauuagaaacaaaaaauacuuuuagaguauauugugguuucgaugaaugaauuuuuugcauaggucuuuaauagcuauuuuuuagcaaaugacauuuucacuauuuuacacaaaguugcaguuacuuggcaauaacucucacagcaaagaguuuccuucuaaagucagcuuuccaagugucaaugcuacuguuuucaguucgagcuuucaaacucauugccaaugaaacuacuuccugugucaauaaaaaacucaguucaguaaauuaugugggggaaaacaucucagaaguuuagaauucaguaucguauguuugaaguagcaggaccucaauggggaaguuugcuuuucuguggagcugguauuguaccauagauagccaacuaguacuguucuuaagagcacagucagcuagugguguucuacagacauaauucauuuuagcccuuacuacuccauuuccuuagcuauuuaacuauaugauuaaucucaaacaguaucagcauuaucuggggaguuuaaauaaauauauugaacuguauguacacaauauuaaaguaagaaucuauuauuuucuacuguauaguuaauuguaauuaaauaugucuccuguacauagauaaaaauagauuccuuugagacuuuaauuuagaaaaauacccuuaauuaaaaguccuuuuaaccacauuccauuucaaaucaguuuccagcuuuacuguggcuuuccaucuguacauugaaauuaauguuucaguuaaagacacaaaaaaauacuauuuuaaaaauuuagguaaauuaaauaauuucugauauuuucccucauuaauucuguaguucccugccaauguuaaggcugcuaaauauacaaggaaauuucuucauagcagaguguaauauugugacuuuuuucuaaaacacuaaaauaguuaaauuacauacaaaauauauacauauauuuuaauaaaauauaauguucuuuuaggcauuauuagcauaauaucuacuuagagaucauacucugauauuuuucuucaaccuuagucuaugcaaauacauuuuaaaguagcagaaacaucucuaauaagcagaaaaaaaugcucauaaguaaaaaaaauccuuuuuuuagauuuguuuuauauauauauauacacacacacacacacacacacacacacacacacacacacacacacauauauauauauauauauauauauauauauauauauauguuuucccugcaugcacggguauaugcuacauuuguaacuugugaccacagaggucagaagaggguguuggaucuccugcaacuagacguauaaaugaucuaaaucauucugugggugcuaggaacugaaccucaguccucugcaagagccacaagcgcucuucacugcugagccaccucuuuagcugcaagaagaaaacucuuaaaagucugacaaauagucauugcuuuuuaaaauaugguuauuuacaugauuguuuauauacuaagaaguagcuaagauguaagaaauaguuauggggcaagcaagacagacuaccucauggucugucaaguacauagaagauuugacuucuuuauuauauugagggcaugaaauguaccaauaaucaaggaaccacaauagaacugauauagguaaugcuuucaguguuacagugccagguauugaaccuaagaguucaugcaugcuaggcaagaguucuaccacugagcuguucuuccagcaacacuaacauuuuucaaacauuuacguuuuucaacuuauuuacuuguguguguauguguauaggcacauucaggagaaagacaccguguacauguggauggugaaaggauagcauguaucagucaguucuuuccuuuaccaugugggcucugggcucgaacucagguagacaggcuuggcuugcaagcaccuuuauccacugagccauaucuuagacauuuauauuuuuuuaaaguauaaaaguaauccuuauuauuuuuucuuuuuuucuuagaugcuuucuuuauuuacauuucaaauguuauccccuuucuuaguuuccccuccaaaaauccccuauccgcucuccccucccccggcuccccaaccaacccacucccacuuccuggcccuggcauuccccuauacuggggcaaagaaccuucacaggaccaagggccucuacuccuauuccuuauuauuuuauuaccauuaaauucaacauuuaucuuacauauuaacuauguaguuuagcugugaggguuuaguuguaugggugagugcuauguauauaugaucucaguuaaauguacaauacucuggguagcagguuuauguggccucgacacuugcauauauaaugucagacaggucauuaaagauaugagaagauuuuaauuaaaagcucuuauacucuaaguuuagguccaaaaugaaacaaacugugacucaaacagaaaaauaugaaauagucuacuagacuuaaaaaauucuuaaauaaaaauggcauaaucuccaauaacuuuuguaguuuauaugagaagaauauuuuuugcaaaaaauauuuuucaacaacauucuucaguuggcuuuagaugcagaaacuugguuuuauugguggguucuucucugggauauuaauuauggagaacuuguuguauccucuguccaccaucaaaacaagucaaaccaaaccaaaccaaagcaugagaauauuagcucaucuauaauagcaaaauauuuuuaaauaaauucccaaaauuucuauuuaaauaaaaggaaaauauaacugaaaacuuaauuuuccuuaaacugaaaacuaaauauuuuguuuugcuagcaacuuaaacaggauguaauuuuuauuuuaagacuugaaaauuaaauuaugauccuauaugauuuuauaaauaguagaucaaugacuaucuuuccucugccagacuuccuaaacuaagcauucaccuugacauuguuggucucuaccucagcuauucagugacucagcaucccccguuuuauaaacugucauuauuuggugaacuaagagaaucaucaaagcagaaaauugcauaaaauguuaaaauuuuucaaaugaaacccuaguuaauaguuucuuuuuaaacaguaaaagaugauaaauuuuaucccaacaugcuggauuucaaaccagccugagcuacaacugugcauguuugacucugccucagugcaccccaggguccucugugaugaacagaggcuugacuauguauaauauuuaggauucaguucuauuggcccuggaacauguaucuugaaagacuggucaaauuuuagcccccaaaauuaaauuugauuguuugugaauagauaacaaacaaacaaacaaaaacagugaaacaacaaaaacaaaaaccccacaaaggcaaaacaacaagaaaauaaaaacaaagcccucaauacauuuuuuuucuguuuuaaaucuuaaaauguauucaugauuuuucuauuauauccauaauuuggaaauuuguauuauguacuaaaauaaaaacucugugacuaggcauauuuuuugucuaucauauucaucaaaauuaaaaaaaauaaucugucccuauaaauaauaaauaccuauagcugugcauauaaaaggcugugguuauagaaauauauuauaaaagagaaaaauugaguuauuaaagcuuuuuucaacuuuaaacauaagggaaaauagguaucaugaaaauuaguuuuauuaaauaauaagaccauuuauuguacuuaguacuaacgaaagacugagacuguuuuagagcaagucuaugggacaucuucuucuuaaccucuccucuacugcauucucauaacuucauccaaaguuauaaugcccugaaaucaagagugggaaaaauauucaaugucuuuaaaguuaggagaagaaaagccaggagcaccuuacuuaaaguucccccuuagguccuucaguucugcacuuaagcuaucgcuauaacuuuuuugaagaggaagccauuacacauugucuuaggugaguuacauguuguggauuuucaauaccucugagacuaugaaugugcuaccaggaacucaugaaauaaugcaaacuagauaccaccacucuugaaggccacugugaaggcuaauaaaggaagcagcaguggugugcaugccuugagauagagauuauaaaguuaauacgacuggagaucauuuccauuaagaaggaagaaucuagcuuuuuuaauguuuccagaaaaagucauuuaaaggacugauuaauauuauaaauguuuaauaaaaucuuaaaaauuaacguuauccuuugguaaagauaaugagagcuaagauugcuguagacauuuaggcuugcauuacgaacaccucagggcuuaaucuaucagcacugaaccugauuuuguggcauugauuuuuuuauauauauauauauauguugaggcuacauuggaggccacuguaucugagaauacaaaugaaugaaagacuuagcucuacaaaaaucaaggcauguuguuuaguuaugggcaaugcuacagccuccaugggaaugucccauuggaaaauggggcaauuuugucaagcagugggcauuccaucucuaagguagauauguggccuaauguuuauaugcaaugaggcuaacaucaucagaaguuagguaccaauuuccuuucgggagguagaggguggucccacgaauauaccuauacuugguauuaccuaggcauuucuggaggcaucucaguuuugcaccauggacuuuguguuuucuuuccacuaaaaaaaguagacuaauggauuuucaaaugauguucagaaagacaguaguauacauuucucuugucguuacauaguuaugcacauaugagggagagcaagcuuccugcaucggauguugacuguuccaagauucauuaguguaauuccucagacacacugccuuugacaaaugugcacagccaggaaagccuuuaauauauugauuauguuaguguuuuguugcugguggcauaauggauucagcaaagcuccauuuuuauucuucuaugcucaagcaaaaaaaaaaauagaucuugcaaacuguacacgagacucacaagcgaaaguaauuaaauaacggaagugcugagggagauugucugugaacagggcucuguaacaggggauguaauaaagaggguaugugagagcgauugaucuaaagaaaugcuuuaaaccaguuucgguuucuuuguauuauugcauaucuaccugaugaaaaggaggugaugcuaaugugaaaguuaccuuccuugggauuaauuuucacuguuggucaaguucaaacuauccugcuucuuucugaagcucgcagauguguguagcuuuauacuguggaaacuuggacuuuaugcguauaacaucucacaguugcucucugagccucuccuaacacauuguagcccuuccuucuggcauucucuccuggcaaccauuuuuuuuuaaauguauuuccccguguuccuuuuuaggaaaccccucucaucauuguuacauguauuauuuuauaggaaggaaguauguaaaauauucuugccucucaucauuguuacauguauuauuuuauaggaaggaaguauggaaaaauacucucaaacucauuuuacuugugagcuugaauagcauucagaguaggaccgauuuccccagaauuuuguaggcuugcccaauccagcuguauauuuuauaugcuaauguaaauucuauuuuuguuccccuuggggguuuaagugauuauaauuguugcucuucaaaagccaaacagaugaugauugcugcuucaggaguguacccaaagaaacuggcuuucauuaaaccugcucauccacuucauaauuaucuccauuuuaucuagcuaagacgcaggaaaaagauggcaaguacaguucauugaagccaguucaguuauuuaaacauggcuuuauugaacuagcaggagguguuaaaaguagggggaauguuuucguucuaacguugauauguagccaguggcucaacucaagaguuaguuaagcaccaaaugccagaggccacagagagugagaggaguccucuaguggauacaugaaagaguacugcaaccacagcuuuucugaaauaaucuuucacuugcucaucuccgaauauguucaaaaugaaguuaucuaucuacuacccaguaaaaaagggcccuaaaagucauucuaagaaauaggaaaauauccuauaugauguguaaaaaaaaaaaaaaaacaaaaaaacaaauugacagauucuaagaggaugacaaguccugagccugacaucaagaaucuugcacagaauucuuaugauuccagaucugauaauagguuagaaaaggcugucauccagggagggcaguccucucaguagggaggcacaguggcuauaaguuaucugcucuccagaccuaggguggccuagggguuggguugcacuggauaacguuucuaaccacacuuggcugguguacauagagcuguucaaagcauccaucugugagaaaauaacucauugcugguaacacagaaacuauuucauuucauauguaggaacuggaauaugggccuaucagccccucucaucuacagcuuaaucagcaucuccuugaucuacaauggcuugucaaugcaugaugcuaaauuauuucuagacugcagagucauucuuaaagccugaagguagauugcccucagggaaugaauauuuucacagugagcuccuaggcaaucuaugcaauuugaauucuuaaauccagggauaguauaucaauggcuuguucccugcaaauuuugaauuaaaaacuguuugggagugugacugccauggaauuuuccugaauuccuacguguaggucugcuuuaaaaggcuugaauccgagagugcuccagcuguacccaaaccagcccugacaacaauggaaggacuucucacuuccuuucugccuugccauuaaccuuuagggucugaguauccuuuguuaccuuuaggcuguuuccaccuuuguuaacauuguuaaagcucaaaaucuacuagggaaauauuuccauuucuucuaaggugacaggcaaguugcuaauacauuuuaaacuacgaaaaaaguguuaaggauagucuugcuguguuuaauaaaaagucacuguaagucaaaaguuacugauagaaaauucaugucaggcuagcauacucucugucucucucucucucucucucucucucucucucucucucucucucuguguguguguguguguguguguguguguguguguguguguguguguauuucuucauugguugcuuuucuuaacuaaaaggcaccuuuacucugcauccagaagaccacuuacuuaucuugagguaaaacagugcuaaaugaacuaaauaaacuaacugaacagaaaaauaugacucugaaaaaaaauaauuugguaguguugacucaucugcuuauguuuauuaaauuaaaguaaagcuacaaacauagcugacacuaaaauauaucuuuuucaggaaugguucaguaauuuccugggguuaucucucauaucuguucacuuuacuagcaggaaauaguaugacugcuuauuucaugcagucauaugauauaaauaagaccuuaguauauaccaauuaaauaucuuccagcauuguuaauagugucauagagugagcagagccaaaauuguucaagcaacaguuuacaaucuccguaauaagggaccaaggaguugaaaucuguauugauuuuuuaaaauucugugguuuuuccccucugaaccaauguuaaaucagauuuuuaugaaguuuuuuucccucuccccuccucuccucucuccucuccucuccucuuugaucuucuccucuucugucuucuccucuccucccaucuccuaucuccucuccuguucucuccccuccccaccucucccuuccccuccccucucauuucauaucucucccugucucuuccuuccuuccuuccuuccuuccuuccuuccuuccuuccuuccuuccuuccuuccuuccuuccuuccuuccuucuuucuuucucuuuaaauaagcaggcgugcuuagaacucaccucacaauuacucaguggagucuccuagcaucaagaucaggaccaagaaaaaacccuccucagguagcaagaggcauagaugcacagaccugggagaugccuuguuaggcacauucauacaauuuuuuuccccuucccuucucuuccccucucuccucccucccccucccuccccuccccuccccucccccucccuccccaccccuccccuccccuccccuccccccccuucccuucccuccuuccuuuauuuauugagacagaguuucuccauguagcccuggcuauccuggaacuugcuccaucgaccagucugucccccaacucagagaucuacuuaccucugccucccaagugcugggauuaaaggcaugugccaccauaucuggcaagggaacaaggacuuuuuucauuugguauguucacuccaugucuaaaacggugacucuuauuuucaguacccauuuuacuaaugaacuaagcugaggcuuagaacguuuagguaccuugggucauaaagcaagaacuugggaaaugcaggaccaggauucaggucugcuugagcacuuaaucgccacaacccugaacuugaaaaguccguuuaauauacagauggaaaaugcauccuucuguuuuauagcugcaauuucacacccaggagcuucaauuuuggugcuuugauuauccuaaaacuauccagauccuauaggauugccuuguuuuauagccuuagaagaaagccacuguauucaugugaaagauggccaggucuaauagguaaaaguugccuuaaaauuauacucaaaguguuuugcuuucuuuguauaaaggucacuucuuaucucagcucuuaauucacaaauucgagaaccugcuguaauuucacuguagacuuuacucagauaggaggcaaggcuggaagugggugagcuuucuuccaggucaauuccucauuaaaauaguaacaauucucuaacaaucauugcgaugcaguuuccagaguggccugcacaacaucaggaucuuccuacuuuauuuucugauuuugggaugacaccaguauuuuaaagagugaugacucaugucuaggacugaaauuuguuuuucaugaguuuauacauuuuuuuccccuugaauugcaccaaaaaugguuuuuuaauuggcuuuaacucaugcccaauaaauuggaugagaauugauugcugcaguccuguuugguugaaaauuauucaagucugugcuuuacgaaaugaguguaugaaugaaggccaggccagggcacuucccauccucuguuaugacaaacaccauuuaaaaaagacuuauaauuuauauuuuaaaaucaauauagauguaguuuauaaaacaguacgguaaccuuagaauacaucauauuacaaaaauuguuuuugcuaauuaggaauuguuucuugauauuauuuuccccaggcugaacaauauuaguugaccuuccuuaaagaugcuuuuguggcuuuuguucagaacccugccaugguuuuagaauacuucuaaauagugcaaugaaauaagagauaaagcagagauugugucagagauacugcgucaucccacagagacaggcugugagccacuuuuucuuucuuugaagagugauuuuaaagacaaaaaaaauuuaaacaguaugaaaauugaauuaacuuaggugacuguuuaagggcauugaaauagcaauucacuaaaugguaccugucagcaagccagucucuguucaaucucauaauuauuuaggguaauaagauuuucauuuacuuauacgcuauagaaaaauaagcaagucauucuauagauuuuuuucuggucaguaaagguuuguuuuauaauauuauuuaccuaugguaggagaguguauaauggauagaagaaaugauuaauuaaugaggaaagauauuucccuuggucauaauuuagauagacaguaagugaaggaaaucuguuuucuuucuccaguuagugccgguaaauucuaacuggccaggauaauuauacaugauguagucugcagaaaacuaggagaacacuuucauauacugugguuauauuucucugucauauuugcuucucaucugcauuagagugaaacauuguuuuugucaauaaauguuauuuuaagucuaaagcucagagcugcaggucugaugucucucagaaucaaaguccuaaaggacuuuacuguuccugaccacuccauauauagcagcugcccccaccugguggccaugagggcaggagcuugagaaguugccuuuuucauuuuuuuccugucaaaaccccaagcuaucuguuugucugcucuguagaagauaaugccuacuuagaauuuuucccagcacgacaauucagaaaauauaaugaaaaaauuaaccguaaauccaguaccgcuuguucaaauuagcucuuuuuuaaaaaauauuauacuguauaaaauguaauaagguuaguauuucaagaaaauccucacauauaauuaagcaauagauauauaccauccuuucaauggcuuuauaaguuagggagaagacucuuuaaaauuaaaacaaacaaaaacaaacaaaacccccaagcauuccuuagauuucaaaacaauaucaccuaagguccagaacaucucaggacagcuuauaguuuuaaaaauucuaguaauuucucugacucacuuuuaaaaagcaguuaucaauuuuguuucuuuccauuugucagcaaucaacaaauugucaugaaucuaagacauaugaguauaauuacuuuugguauaaaauagcuuuugucuguucauguuaauuuaauauuacccacuccuuuuauaauuugcucucuuucaaguguuaugucaccuguaauuugugcuaucguuaaagauguugaauuucauguaaauguaaaguagggguauuguauuuaacagcacaaaaggacuuagguucuagagacagaguuucuguuucuacuuguguaucuuugacaaacugcucaacuuccucaaugucuucagcugcagccaccuagcacucacacauagcucauguuaucauugccacucacuauugcuaaguuaguaugggaaucaugggguuuaaauggaaggccuugcugaagggaaaaggauaguaggaaaaacaaugcuaauacuccgguuuccuuuuuccaaguccaggaguuuuugguaaacaccauaaucuguguuuuuauagccgaguuuuuaaugaccuccacgggcacauagguuucuuaaggauauccaaaguggagcuugucgccagccacacaggcugcagcucuguuucucuuucauacagcuaccuuuggcuccuucuugcaaacacguucuugauucagaguccugucacuuucccgguaggcuuaucgugaccaucagaacacagguucuuaggagugcuaugcacccgucuuccauaccugucagucuuuacuugcucucuguccuucucucauccugccucuucauuccaaggaguucugaauuucagaugacccuuaauguaggccgugggugggucuccuuccuucccuuccuauucugcacuucccaaaguugcuguacucauggcaucuaacuugucuggguccuuuuguaucuguauucccccaggugaauuucauagcgagcauuuaauguaggcauauuauaacaacccgacagcugugccuuccagcccuuugcaaacacuguagguaguagccuggucuucaccacagugcuuucauuguuaccucggaaacaucuuccaguuguccugagcgacacuccccauccccugcacauauaugguagauuuguauaaagauucuucaaauuaaaccaugaacacuugugaugucuaugaaugcuguccucuuuauauagaccuuauaaagagacucaaacuuucaugaauccuuuugauaugauuaaaacagagacaugccucuguuaguauuccuucugcaucuagaaaauauuaguauuccagaaaacaccagugcucuaugaguuaaauaaugagcucugacauaaaagaaaggcuuuucuuuuuuauugucuguacaaggaauccagaaauaucagcaagagaaaaaaaaaaacucaugguaaauuaugucaaaauaauucaaggaaacaucuauuuguuacucagaaaccuuaaacagucuguacaucauacauuuauguuauaauuuccaaccuauguuuauaaaauuugacauucuaaacaaccauguucucuaaauucugaugucaggaugacaguaaccaaaggaaugagacuugacuuuuauugcgacaguauccucggccccaaaauguugcuuguucaaaaaaagcagauuuuugaucuaaucagagccacgugaaucuuuaagaagaauugguacgaaagagcaguaagcaagagcauugguuacucuguguauauaugcauaaacguuucuuccuugugcuaacuacaccacugggaagucaggcaguugcaugacuaggcuuggccuugagugggucagucuuaacaaguuagacugaagcagauacccaccaaaggggaaaguucaagugcugccucugcucuccacugugaccgagagugaaguaagaccugcagacagacauuuacaucuauucuuauuaucaggcugcaaaauuuugcugccuucuaauuaaugacucaaaguccacaucuguagcuguaucuuuaucaauccauagcaacguacgcuggaagggaucugagaagccgugaacccuaagccaguuuuauuguccuucugacagucugguuuacgguaucaacuugauauuaacucuucacuuuguuuuauucaaaacaaacaaacaaaaccuuauuauuaaaagcuccuuauacagucugccuuuauauuccuuuggauauuuauuugauauauuuuaaaagcacaggcaaccuaagaaaucguauacaagaguaaaaguccuauuagucccuguaaauggaaaaaauauaacagcauauaaaaauacacguggaaugagagagagucuagagacaggcuaggacaagggcauuggauccaauuucuuuccaugccauaaauaacuauuaacuuuuaaaaucauguuuugaaauuaacaaaauauaaacuaagcauagaucauauaagcauauauauauguguauauaauugaauaaucaaguguuuccacauuaaaucaaaauauuuuaauuuggcuaaacuucagugguguauauuugauuaaaugugauuccaucaaguaauuaacugaauuauaagcuauacugaaugccaaacacuaacaugugagccuaacuaaaguaacaauggccauaauuaaugccaaagagagaacaaacugcagaaagaucagcauucgggaaaccugaaaucuguuucuauuaaccuuagaaauguuaccuaaauuucucaugccucugcagugcuccugaaaaugagacauaauuuauuucccucucaccuccagggguuaucaugauaaauauguaaaagugcauugagcuuuuuuuuuuuuuuuaauaaaagauacuauaaaaaucuaagguguuuuuauuauuauaucagucaaaugggaucucagacucaguuccuuuuugaagauccacaacuuuuuaugggugaaucaugaaauuguauugggaaauauauuggagucaccuaacagggcagacagaagauuuuuaugucuucuggagccuuuaaaacuugguuacaauuagaaauaugagaagauauuuaucauaaaauauaucagguaagacacuaaugaccacauggaagguagggauucuaauucuggcuuuaugaaaauaaaugugccaugguuguaguuacuauguauugacgacuucgcccaugcaggaauuuugauuguucuaugcuuaugauuauauuuaaccucacagugcuagacauugauccuugcuaucauugcuuuagagaucaggaaaccaagacuuaaaggugauacguggauguaagacuccauaguggcagagucaaguauaaauuggcaugugcugaagccauggcucaagcgcuuaacaguuuguaaaacuaucuccuaaaaggguucuguuagugaggagauagguucuccuaucucaaggagaaaauguggacaaucguauaauaaaaaguuagagugcacaaacauuucaagacuuaauagcacuagcaacgcccaagcaggcauccuguaacuauguuuuauauaacacauuuacugagcucguuagauuuucaaauuuucucuuuuccuaggguuuccuaaaagcuuaaucugauuuccauuagacacugagagucugcaacccuguucuguuacucuggcacaugauagccacucaaaagaugcuugaauccaauugaaaugagccuuuuguuaaagaggacagauaaauaguuaggaacaggauagauuuugauuuaguuggcacuuacgguaugauaaaugguauagccagaaagcuguaacagcuccaucugauauuuuugguaacagauucgugauuaguuauuauaaacuaaaguauuacaacuuuuggguauuuuaaaagcuucagggaguucugcuucuggaggugaagaaagacucucagccauaguggugcauuauuuucuacaaagaauugauucuagaaaauccuuaaaaaaacaaauuucauacccuuggcuauuuugauacuuuucaucacugauaacgaauugcuagcucuucagaaacaacagcagcaacaacacagacacacacacacacuauuauuauuaaccagugggaaaaugagaaagggaugguucucauacuaauuucaauacuaaaacauuuuucuauucaaugaaaacagauaaaguuaucuuuuaguucuaagauguauaauaauuuaaguuccuggaaugucucaccucacaaacuugcagugcaucuuuuagcuuugaugcaaauucuuaucucuaaaauguuuuacuuauaucaauaaacaauaguuaaaaccucugcuguguguacauuuucaauuugcguaagaaaaacaacaagacuaacaguagcuuaaauguucacuaaaucuggucauucaaaauugucuuuuugugacaaauaagacacuaucuuguucauaugaauauugaaguuaauaccauagugcagaaaugcaggaauuuaugaaaauaauuuuucuuagcauguguauacauugccauuauguaaacuucuauaaguuuauauaaaaacauaauaugaaaaagaauugucuacauaacuauaaauuucaaaucuuuuaacuaaucaugcacagacuuggcuuuuaaaaaaauccaaaugucuuuuuuuguguuacaugauauaaaggaauuauguacauagucauucaauagaagugucuaugagaucccaagacugcuaacguauuuguuugcuucugacucaggaaucauaucaccucaaaguuaagaagaacucuuuuucauauaacaaaagaguuuaauaauuaccaaaacauauaauaaaaucuuaagauuuuuuccuaacacauuuaccuguuuuucuccaccucaaaagugauuaaaacauacuuuauauuuuuagugaucuguauucuggcauugauauaaaucugaggguuuuacaaaauaaaagcagauugacuuuuucugaaucuggaauuagcuauguguuguagcuugaagggacuuuacauaaugugucuaugacagaauauaaauacugugggaaaugugcccucuuguagacaucguaauuggacaccuacgaugggcuuacaguuaagacacuuaaaacacaaagcacaauguccagugccaggcuguuauugaaucaagacaauacauuaggguuuuuauguuggucuuuaugcauauuaaauugugggguagcauuuauucaaauaaguuucaaaccucauaagcaggcagaggaguguagaaauaaagugugcccucugaaaagcuggaaucuguugcauauaccuggaauggaguucccccaacuauccuauuguaaugagcuguguaaaggggaaggggugcaaauacaacuguuuuuauuuccacagauaacuaaguggauucuuuacuguaguugaugacuucucaagcuauucuaaaagcgaggcagguuuucucuggagcagggaggaggcccuuucacguugagaccaaaggccaaguuaccagcuggcuuuagaaagcccuguaucuagguugauguguuuugcucacuguggaagaaaaacuugggagucuauuuugguagccagucccucugcucucuguuccccgcggugagcuagaguccccuuucauaucagguuggcuucaauuguuacuuaagcucuuccucaccaacuucaugccuguacaccgaguccccuuuccauuauccaccgcauccuuucucagaugauuuuaaaaccuguugggcuuuuccuucccaucgcccccuacacgguauaaagaaaaaagaaaaaaaaaaaaaagcaagccacaauaucccacucuaggcgcccccucucugccugccgaaagcauuuuaaugucaguuugccuucggagucuaccagcagccggcugccucugccaccugaauuucaauuucuuaauucacagcccagaugaaacagaauggagcaggauccgggcugcccucuacauugggcugggcuuaucaagcgugaaguuuggcgcuuugcaaaccuauucaagcgauuaucuguugaggaccucuccagccaucuccaucucugcagcaggcugauaagacagcuguuucacuagccuuggucucuccgggccucagucuucagauacaacccccgccuuugucacugugccccggugcugucgcuugcucuguggggcaaggguugaucugaacacacguggggggaaaaugugagugugugugagagagaaggagaggaaagaaaaaaaggagggagugggaagaggguggggguuggagaccugagggagcuggggggcagggcccucgccgggcacaguugauggcugugauugacugguuggucagcccggcuuuauuauuucaaauuagauguggaucgcacacaaguggaaacauaaaucuucaauauaagaaagagccucugagcaucggaggcagagcaaccguuucuucccagguccggguaaaggggcgggugaaaagacugauugcuaccaucugagacagaugguuuccuuuaacuuuggaaacugcuauuuuuaauuacuuguauuaauuuugcaugagcuguaucggcugcaggaggaagcuuagggaaggcuguuagcaucacugaaagaaacggacaccaggcucugauuugcccuguaucaccucuaguuucucucucucucucucucucucucucucucucucucucucucucucucucucucucucucucucucuuuuacccucgccuguuuacguggauguuccccuucccgcuaccagagacgcgaguuuaucuuccuaaaaguuccaacagagugaacgacggaagaaaaucugaggauuuucgugggagcguuuccguaaaugaucuuugaucgcaggcugaaacacagaggggcacgugcgacagaucuuggucugaaacccgcagcaaggggcuuaaaggagaaugugacucauacaagaauuuuuccuggcagagggagacaaguuggggggggggugucacaauguagagucaucucccaagauuuacuggaaaaaauaugaaauaauucacaauucacauaucucuucagguaaaucagaaacccgaggaguuccccuugaguauauuguauuuugcagccuuucccuuuguagaugaauuuuaaguugagaaaaggcuguggucuugcuuucugcuucacuaaacacuguuccugcuccagcguuugcaauauaaaggguccuuugcaacacagucuugggguaguacucaagggcgaaagacauugccagggagagaaaacaucccagaaaagaacuaagguagucaaggaugaguucuugcuucuauucccacuggaaaauuucaagaugaaaaacucugagguaggcuugccagacuuuuccaagauuacugggauuugcauuuauuuugcaagaacaccuugaugaaaggguugcuccuccaggcagugggggaagggaguggaguagaggaagaggacacacauccaggcucaaacucuggggcuugucacaauggccgggcuauaacaaaaggaagcuuaauuccaaacaaaccuguuucgauggaggacagagucugccucaaauccgugguguaaaagcuuucaccaacgagcuugaaaccgagucucaacgggaggaacagaaaauacgucgccaaucuugcucugcaaacuuuacucuguccgcuaggcuggucucuguccaugguacuaauuucugacucaacuaauuccugacucauucuucugugugcucucaggaccuaaacucucagaaguguccaauauauccauaacuuuuucuguuuuucaagcuguaaaaagaaagcuuauauacuccuuucagaagggaaaguaaagaagguagugggcagguuauauaauaucaacaccucguaugcaggauuuaaaucguauauuuccaauaugaugaacacaaaaucuccccaaagcuaaacaaucagaaaaauagcauuucaauucccuuaaaaggaacacuauuuaaaauuuccaagccaauuuaaauaguaauucacacauaucugagcuaccuuauucacuauuuuuaaaaaaaaguuaugaguaguuugcagagacuuuaauuauggucaagucaccccuucuccuccuguagaagggcuuguauaagggaguuauuuaucuuaacaacacuguccacaaugccuuuaaguauuccugggagggacauguucuuuuaugaguaaacuucaguaauauagccaauugaagucuuuaaaucucagcuuugaaaagcacuacuuugcaauuuuaucaacacucaacuuuucuccaugcuuuugggagcuccccaaacucucgccccuuucugucucaagucaaaauacugcugagguuucaagagaaugucagaccuaacaugacuuaaucagaauuugaaugaucaugaaaagacuguuuaucuaaugcaaguuuaggugcugaggauaauucuuuuucuuaacuaugaaucaagagguguugauuaaaauuugugcuuaauuuaggugggauguuugcacauagccuucauuaaucgcuagaagcacagugcaccuuaauguuucgaguuuggcguaugaaauucacagugagaucugcauccauauaucacuugccauuuuauuuuuaaaagucagaaaagcaaauguugcuuaucuauuuaaagguuuuuaaaaguuaacaucuguauuauuuaaggaguaagccaccauuuaaagauauuuucagcuucccagguaaucugugcuaucuacaaagaaaagacaacauguugaauauagcaauguuuugaaaauauuuccucuucugccaaacugagacaaagcaucuauaccgaauguacagaauuaaggaauuuuugcauucgaaugaacagcuuuauuacuuuccauguaaugucuuuauuaguuuccacccauaaaaagguacuugugccuuuaccaauguaagaauccccuucaaacugcuacuauuuuaugaauguauggaacuaaugcaauaucagggugugaacaugaucacaaggagaaaauaugguucaucucaugcauaaaugaauaaaucaaacaguaguguaguuuugucauuuuuuuccaugcagaggugguaggugagaggaauugaagguauuugacaagaaacccagucugcuguuauucauauuucuauuguaaacagggaugcaggcuuucuuauauuuuggucuccuggcuucuuuucuucaagcugcuguuuuuucccuuaauuugucuguaguuucacuggagacuaguuaauaguuuuaaguugaaauuaagccccaaggagcuauuguuauauaaaaaguaggaggugggagcuccaaaaugauaauucuaaaugguaauuauacacauagauucaggcccacuuuuccuacccuaguuguuguuaugcaaaauaauauaacuuagauacuguuacacagguuaaacgggggauaaacagguccccaguucuuuacauuaaucauuuaucaaacucaaggacgcgcucaaggaacaccaauuuccuuuccacuucuaagucacuugcucucagaccaucuuucucuuucccucugacauuccaucuuccugcaauguuuaauuucuaccguugccuuugcucucuuacauuaucaaggacagugacuaguagcaaauaaacauaguaguaaaauaauuuuugagagaagagagauuauguaagaaauauauguacuguuuaggaaguugaggcuaucugucaaaacugaaaaauuccuugggaaugaacuaaguuagguggauauuguuucucauuguaaauacaucuagguaaauuuaguaaucucacuuucacuuaacggaagaaauaaguaugaauaaaccugcacuucagccucuugaauauuacucaaacaugagguuggaauaaagaaaucuucaucuauaaagcaaagacauagacagcacuuggucuacugaucaaacuuuugaauucucaaaagaaccugguaaaggcugaacuaucuuuacugucagcaauccuugugagguucaagaucuguauugccagcaaaugcaaaggaguggcuuguuuuaauuuuauauguagcugcucuuuuuaccuccaacugaaggaccuuauuucaauucauuaccuguuuuuuuguuuuuguuaaguacgauguuuuugcuacccccuuuuaacccugacauacauugaaagcuaguucaaacuguacagauucaguugaaaccauuucuauuucauucuuauucuaaaaggagagagagagagagagagagagagagagagagagaaagagagagaaagagguggacauauuaaaauagagaaacauacacacaguuacccaauaucuaauacagauguaaagauuacuggaacacaaaccaaaaaaggcaugcggacaaguaauggguguacguucaaaucccucucaaaucaaagagaggcgcucucgaugacucauacauaccggacaguuuacuauuacaaagaaacaugccaaagaugcagccgugagggcaaauaaaacgaaucuuuuggaagcagaaagacuuaagaggaaaauagauggugcaauaucgcaaacucucauaguacaguucccucccacguugcucucucucucucucucccaucucuuuuugcuucuugcauuucccuucgccgccaguguuaaguguguaccucccggcacaacuuaccuugaaacgggacuccauugagcucucaagagugacauaagucccuagccaaucaccuagcagagcuucgccugggcggccucaauagaagcgucucgcccaaucagaaaccuggggcgaugagcauguugcguuguggcgcaacucggcguauacuuccgcgcgugcugcccgggauaggacucuggcagagcagcugcacacacggcagugcggaggcagagaagggguuggugauacggugcuauaaaucugugguccaguccaccucccuuuuaagacguccuccccccuuauuucuguucucacuuagagaugcagcagcuuacuccuguagcgaccuacuaaaaagcaacacggagaaagacaucgucuuuuugaaaaaacguucuuucgucucuuuucuuuguuccuugguuuguuuuucuugcaccuuuuuguuuaguugaacggcaauaggaguagucucuccgucuuuuuaaacucucuuuuuuaaguuuccccuccccuuucauauuuuuuuucaucauuucuuuuagcauuggacuuuggggucgaaagcauuucuuuuuauuugcuucuuuuaagccgagcacaguuuagguuucgugcugucuuaagagaacuauccagcagcuucuugcucauccuuauugggagaagugcaccguuacuuuaaaaauacacauacacaaaaaccuuaagggagaaagguaaguuucgguuugguuucuuuaaucauuaguugcagcgaugcgcuggcaaacccagaaaaccuguaagugagcggaauacagaaugugaaguuaauugcacauguuugccucauuucaaagcgacugcuuugcuuuuuuuuauuuuuauuuuuauuuuuuuuauucuugagagccagacuagaagacaguggacgcaugcuuaacguacugaauauucgaaaaugucacuugauagaaacuuaagugguaaauguggucaagauccagcaggcuacaaugggaggcuacauguucagugagcuucgggguugagguuggaaguucauuucgugggaagagagggauaacuugaauguuggaggggaaugcaugccucuacuuucgcaaaggaaucggaggacuggggaaaucagaagcccuggacuuacuugcagauuagaccaguggggaaaauccucagcuuaauugcauuaacuagauagcgugugccggggagaugggauugccagauggaauuuagaugcugcaccaggcagcgaguuguaguugccuggaaaaaguacauacagccuaagggcuggggcugggcuggggcugggguaagguuagaagcugucaaaacucaucauugccagaauugaggacucugauucacggauuccaaugauuguaauucagauuuuaaagaagacugccaauuuggggccgaaucuuugagccuauaccggauaugagauucccuuuguucagaaaagcguaaauaagauccuuggagccgugagugugaaguggcagcugcuugggagccucgcggugcugggcgcugggcaguggauuccaagcccuguccuugguccuacgcagcggagcccgccuuccgggaaagggagacucacuggcagccgcgaggcaucgcagcuacccagggagcugagucggcuguauagcccucagccccuccucgcagcuccccuuccucgaguagcuauuguuaaaacugacgccaggagaaagaugguuggggacgagacucugggcagacaggcacacgcuucauuuuaacuuuugugauuucuccgggugcaggggaaaacagccggcuuucuacugcgaaagagcgaauccggguagacgugggaaagggggaggaugcucgccgggcggcgagggcgggggaggugguggcggaccgaggugcuggcuuugccucggagaaguuuaaauuaucggcacgagggggugugggcgaaugugugcgugcgagcgccgaguggugcucgagacgcaaaguaugggggcaagcuacaaagcuggcccggguuguucaucucucgcagcucccuaccccacccacaggcugguuccaaaagcuagcgcucugccacccccccccuuccccgacucugccuagggcguguguaugggggggggggggaguagggauggcaagguggcagugcccacccuguaccucuguggcagacaggacuucucguggccauuguugcuuaauuuaugcccagcacguugcuacgugcccaccuauuucacgucuauaaagaauuaauaggaaggcuguacaacuguggcagauuggaggguggaugcguuccccauuuuccauuuucagguaucuguuaccaaaacagacguggagauugguuaucuucucuaccuccuaacuacagcuccaggucugccuuuauuguggugagggugagaaaaauaaucagccauuuaguguuuacgcuaacgcugauggacagagaugaauguccgagcacuucgucccuuaaauggacggguucugccccuucccccacucauguacacacauucuauuuggcuaagauucuaaaccugcaacauuucuccacgaccuuauuuauuagagcuauuccuaagauagugggguaggacgugcguauguuuuauuuuucugggccuacuauuaauugcaaccuaaaaagauaggcuuaaaaugaaggagaauuggagggguuacaagguagacaauagugacccaacagcuuaucuuccuaaaugauaaucccuuucuaaaggucaggagagggagcuuguguuuuguggggaaaggaaggucagggauguuugauaauccucguaaaauggcuucuuaaaugggacaucugagagauuugucaaaacugagcaaacaagucugugaaaaagaaaaauguugaauguuucaaagucaucauuuaagaguuuaauuaaaaagcaguuucccccaguuaucucugccauuccaugaaccuaucuuaacagacccuugaaguccccccccccccaucuuuuaaccacgggcuugggcauuccuuuuauagagcuaacccguuugcaguucugugggagaacgaagauuguagaccgaugugcuuuagccuacuuggaaaguaucuguugagagaggucuaacuucaagcagacaucuucagaaaguaaagugaagggcauuggaaggguuucagguguagauuaacaaauuggguaggcccauuucucuccaacacuucaaaacugguauucuuagcaauaaugcaugccugggaugggaauauuauaacuguuuagagggaggucaaagaggcacaggcgcucucugagcaguuuucccaggaacccgcacaaagucaguuaaggucauuuaauuccaagucugauuugaggugacacagaaaugcugguguugaaucaauuagcuauuucuggugucccuaaccagggucucccaaacugaggauggccugucuccauuuugaccauaauuguuuucccuaauuuacuaugccugauuucacuucccacuagaggguaaauuugcaccccccuucaucccugggauagaggaguccucccuccccgcccgucgcgugggggcggggaucucugggcgcccuuagcgaaccuugcugcaucaaacccgcaucauguccuugaagcuguaaccuccaucacguucuugcggcgacucgaucgcccacuguucaguucuuuccuccugccuccugcaauuucagguagguaugucaggugauguuuuuaaauguaguuuucuagagggaaggguuaaaaccaaaaccuuuucauuaauagaaaaaaaaaaaaaaaacccuguacgacaggugcucugguaauuaagccgccaagcagguguaaaaaaacgugugcggcucugucuccagaucuugggucuggguccagagcaggcgcagguuuuuuuggguaaaagagauuuaucugagugagggagcagguuggggauggucagcacucggacgcccccucggagcagggccugugcggggcuggugugagggcacugggaggaugugguucagggcaggugcaugcagggucgagugcaggauuuccuacuucacaucugaagcaggguauagcaccucgcacagguacuccggggcuuauuuagcucucccauucugucuagggagguggaaaggcgcagcgggacuaagcuuuuaguuuuccgucgagggacagacaggaccuuugggcuuugggcgaggggaaaaaagccuuuacauuuucuugaaaaaacagguauuuugugugcauaucuagacuuacacuuggcgcacgcauauauguccaaagugaccccaguuugugccugggucacuggucacugccccaaucccucaguaugcaugcaaacuugccccggccgccccgggaagcccaauggaggagccuggagggagcaugugccccugaggguggcggagcugggcacucgcgggccggcgggcggcguggcgagcacuccugggccccgccuccuggcgcgcugccaggcaagccccgccuccccgcccugcuacaaacggcgggaccgcggcgccccagcgucacugaggcagcagccggucgguagggcgggguuccgucguguuccaguccgccuucccgccgccgccagcgugacuccucugagcggugcugucggccggcggcgcgagccgugggagcugcagccgagccgcagcaggcaaguguaggggggcgugggugggggugggggcggggacggccgccccuccgugggcuccagccaggacucuggggccgggacucgguguccgccgcagcgcuaggcagcguccggcuugccuccacccgagcgcuggucgggcacgcgacaacgccacuggcggcaguggagguagcgcccgcgaaguuccugcaggggaccggguacccggcaccgccccuccugugggcacggggcggcagggggcggugggaaccgagugggccugggagcggagcggggccgguggcgccagccgcgugcacgggcguggacguacucugcaccgcggcguguagcgccaccgggaaacugcgcccagacgcaggugagugcauuggagggggcgugggggagggggcuucccgccccagcgccggcuuccuguggcgccuucggccaccuuaugggaggacacgcagcugcucuucgugcgggagcgcggcggcggcggugucuggcgggugcccaccugggacggcgccuggagacuuggagaggccacgcggugugccgggguagcgugaggccgugggcgcucggggcgggagccguggugaucccuuuugcgugguaggcgcagcugagcgagguugcagccgguggcggucgcaucccgggucugccugcgcgcuaguggcgcgaagcgcggaugcucugcuucgcaggcuucggguucagcuagcucgcccggcuuagguagcucacugugguacugugguuauacauuugccuggccaaaaucucugaggccuuggcgcaagacuggugagcacacuagggagacugaaggagccaggcugaccaaccuaacaggauuuaccagcaggugcagaggugacaaugaccagcagacaucucauggaaaagccuaccuaguuauccagggccugaacgcagacaccguaccucuaggugugagcugagccugaaguuuuaccuguccagaccgucauuuaaauuugugugcauauuuaauaugaugaaaccuuccaucuucuauauucucuuuacauuuucugaaauugugggaaaaggaggaauuacuaccaguuaugugcuuucuuuuaauuccuuccucaaagagcggcacuuagcagugucuagauauaauaccuucugaaaggacuaaagggccuuaaaaaacacuuuuucuuucuauuuuauucuuaaccuuaauaacucuguuaaaaaaaaccaaaaaacaaaaaguguagcccagugucaaaacuuaacgcaaaaaguccauugacuugagugccaguaggguauuccccuaagugaaaccuuuuugaaauacuguuuaguugcguuagaaggcagccuuuucuaaaaccuuuuguccagauuccucaaguuucauauguugugcuaggugauggucuuuugguggaagcugacguggagucuccauuuuggagugcaggauagaaagcucuccagaaucuauaucaucuuucucaucuggcacucuggguaugcagauggagacagauugcuggauggcuucgagaauuuuagucuuuauuuuccagcuuugggggagguuggcaaauccauaaagaaacacauucucaccaucucccucaacugucuuuuguguuuccgugauuaaaacggacuccuuguuaccugucugggugacuguguugucacaaggcaugagggauuuuuguuuguguuucccuuuaaagagcgauucuagauguuuaagccucuaguuccuagccaggucuguacguguuuccuccacgguguagugcauggcguugggaauuaagccuggccacacuguuccgacugcucacacuacuccuguggacggaauacucaguucuggucagcaucagccuguccacuuguuuccccaaucccugcggacccuuugucacuaagauauucuaguccuuggaagucuugacuugguuuugaguuuugguuaguuguuuauaguuuuucuucaggaaaaagaaacgaaguucaaucucuuguuuugugauuuuaauuaagacucugugcauaguagguuaagggagaauugugccuucaggccggaagccauaauuccucagcccuagccuugcuguagucuccauuuuuuuguauggacaggugauuuuggccgaacccuacaaacuauccucagcuauuggugcuuugcuuuucaacguaauaaauuuuuuuuucuuucccauuuucucuucuagaagcaagucccaaguugucuuaaaggacacagcagagccguccagaauacucugacugcuaaguuauaaucaaguguuucucuugacuugaaaaaaaaauuuuuuuuaaaucagugauaauuuucuggcauuauuacuaugguauaagaacagcagcagcacaguggggaauuguccuuaggcuuuuugcuucccugccucuguaaaggaccguauacuccuaacguacacuguuugucagacugguagggucgguuccugugcucucauuugaagucuuaagucuaccacuuugucacauucucaauagcgccuuuaucucccaugguauuuauauggagggaggggagaggacaagggagggagggagggagggaugcuggagagcuguuagccuuuaagugagguggggugccucugucuaggcagggucaccuugggccuggcuuacuacaguucuccaccucaguucuuguugccuuggaucuuugcugggcagaccaccuugcacacuucuaaugguuuuguuuauaguuuagcuuuguuagucagagcugcuuccugcacucuggcaucugaacaguuuuaggacucucccugcuugccucuaauuuugaaacuaagaaguuuugaacacaggcacucuguuuuuauuuuguauuggauccuacagauuagucuauccugguuagguacuuauuuggucauuuuguugauaaccaauuucaggauucauguucuuacugggggccacacccugcucuggacagaagacacaaaauauauagaccauucacuuguuugggccaguuucacuuaccgaggauacucacagaacccacauguuguaguuuaaugacaaaucugccauugcauauuguucucauuuuggaagaacaguugugcauucacuuucuucaggaugcuaacugguuuauggcuaguuguuuauuauuuuuagauuuuaagcaauguacauugacggagacaagagaagauauauaaauuugaaaaacagugcuugaagaauuuugcacgugaaaaacuguuuuaauguaagcuuaaauagcaacguucacaaucaguaguacaauuuauauauuauaaaaucccaaggcuuaacuaguguuuaggaaaaauuuuuguuagaaauuaacuugauauuuagcuuggccauguacuucauagcugucacuguaguaaggugacuaagaaaauuucucauuucaagggaaaauucugugugucuuugagccuauaaggcaauucuugugugguaacacugucuucagcguauucucaacccaccucagauacugacccuacauuucuggacaaugguauuuauccaaauaaucugcuuugauggggugcuaauuucugaaacugugcggggggcuuggaaugcaucuguuuuccugacucucuuaacucugguguuuccuuuuugacuguugcugaauaguuugugcagugacagguuuccugguaagauaucuucauaucuaaggguuuggggaaggaaugugacaugggaaacagccaagaaggucauaugcagaagugucaggguauuaaaacaaaaccaguuuauaaccucauuaacaacaaauuaacugugguguuuuauuuuuuaaaugugaaguuuccuauuauauaucuauaguguucauuuuuauagugucauuuucugacaguuaauagccaauuugacgacaggaagccccuauuucucacuuaaaaaaaagucuuuuaguucgaaaaaaggaauuuuucuccauaaacguauuuguguuuaaagaguaaaugauuguguguuuacaaaacacugaagguuuuguuucaaugccgugugcaguuugaauuuauaaguggagguagcuguucuuuccuauuccaauguaauagugggggauuaauaucuggcuuuuucucuaauuuaauuaauacaugacuauuuuccuccaacuuaaagaguuuguuucaaaaaaguuaauuuauaaaauuguagaaaggaaguuuaaaaaaaagauuuuuuuuuuucccgagacaggguugguuucucuguaguucuggcugucuuggagcuugcucuguagaucaugauggcgucaaacuuguagagauccaccugacucugcuaggauuaaaagugugcaccaccaccagccagacuuuuuacauuuuuaaaauuaccauuuuuuaauaguggggaagacagucuguuauuuaaaaagaggaaauuaauauuuguauuaacuuuuuuuuuccuccacaguucuguugcugugagaauuucauuauuuuaacaacuuuaaagacuguaauaguagaauaucaccagucucuauuuuuguaaacaccaggaggguaauaaacucuguuuauucggagugcuauuuucuauuuuaguucacguucuuuggcccauggucaaaguuacuuuaaaguuuccuuagauacuuucuugacugauuuugcuuagagcaaaagaugccggcugcuuuguaauauuuugcuuuucuguaucuccuuauuguggaguguauaaaauagcauuguguaauauuuaggaucugagcaucugggagcauuugaucaaggccuguuuuacuagagaaaugcacacacagagaaaauaccauagcauuuuuaccuuccugaccucuggggcaaagauugcuugaaaucugauuauuaaaaaauuuggaagagggauuauuuaaaauuuagaaauuggaauugcaguacucugaccagagcugaaagcccgucucuaguugagguauccccgugggccuguagcuuuaaaauggcucagagcuuggcuguuuucuuccugguuuguuuagggcccauccuguuuguguccauacauaucacacaugcaaggccuccucacugccagcuuucugcugaguugcuuugccucaguaagcuauugucacuuagguucaaauucuuuauuuagccgugccagguggaaaauacuaggcuugaaugcagacucuaauuuaaguguaguugcuuguccuggauuuuugaaagaacuccaccucacugucuucauccccaagaucaaggggagcauguugauagcgaacugcucugcggacugcacaaguggccaagcaaucacucuaaguuaguuuucuguacuucugguauucauugugcuguuuauaaauccucuuuaagucucuguuuuuggugcuugggacugaacaugguuucacauauguucauauuacuuguaauguuacaucuauagacauauauuacaccucuauguucuuuuccacccucauggaaggaaagaaaaaucaaaaacuccaguuuauuucugccuuggguauuuucaguauggacuuuuguuuucuguuguugguucuuuccugguagcacagaguuuauuacggagccaggucggaugcugguuacccaggcgcuguauuuucuugacuaaucaacaggcaggcucuuucuggaagaaggacaguccuuuguaaaaagaggcgucaccauccuuccugagcacccaugaauauuccacagaagagguagauagagcuggacugcagcagcugagcuauggucgguuagaccuuccagagcguggugggguccaacagggacagugcccucagccaccucuccugacccuaagaagaaaggcugaacacugcgaccaguucucagggacugaagggcuuuacuaggcuggucuggggccucuuguuccagcugcacaguaaaugccuuccucuggacuguagugcacaggaccacagugcagccaugguuccuccuccuccuccucauaccagcacuguucacugaagucagggaagaaggcugcaaucuaaaccacggagucugagccacggguagcauuucaggugucagugaggcacaaacucccacgaauugagucuggggcuauauggcgugcucgaaauucucugguaggucccauccguguccuccaaaguugcaugguaucuuuguagguaaggauauaggcucggauuggcccucuugucgugaauuccaccagccgcugauagaaaaaaaaaaacccuucacgcucucgguaaaacccaggcaguccucuggcuuccacugcaguucucuuguucauacagugagggaguugucgcucagaaucugcugaugaacagccuccaggaucagugggugggcaacugcgucaggcuugaucagggcuagcgugagcugaagagccuggggacuuuauacgauggaggucaucucagccaugccuuuccgcaggauuuagcuggacgaaucagugcaucccagcuugaucuagccaucccaaggccaggcugcuaaagggucuccugggaaggcaggugacuguauaguccaaccaacaauggucagcugugaauggaaaguccaaggaucuaguaguugcucagucucaguuguagauuccaacagcugugcuggcaaguaaaugcaagcaggcaaagaggagucuucaguauggaguauaauacaaauauauugcugaugagcauggaagaaaagcuuaaaauauguucuucuugaaaauauauuccaggaauauaaauuuuaaaaugugaauuucccuucuuucagugagaaaucgaauccuuaagcuugagcuuuuacgauaaaaugaccaguggauguuuucuugguuugaauuuggcucucuuaguggagaggggccaggaucuaguucccacaucacaaaguggaguuuaugggguacauuagucaugauucucucuccccacccaaaugacaagcccuggauggaugcccugucauguaaguuaacugaaacugcccacuagcccacuuguuaaaggcugcuugacgcuuuuuguucuucaggcaucauuugggucuaucugaaagaacaggagguauugcucaaagcaaauaagccacaguguauuuggaaauaaauucagcgaauuggguaagauagggaaaauacucaugaaacugaucacgcuuugucuugcuuccuucaaaccguuuuuucaaaauagaacugugacauuucuauuucacuagcugcuuuacugugguggccucuggugacauggugugggagggucuaggacugaacagucccagauguguaacauacacaaucuauaguuggggucagcacauuuaauaauucacacaacauaugucuguaaguuuauucagcccuuuccucccccagguacuguuuacugcauguugcuuuuuucuuucuuucuuuucuuuuuuucuuuugcuuuuuuuuuuuuuuuuaauagaaccuggguguucuuuuggguccaugucugugaaugacucauugucuguacaucccaaaucaucaggacuuccuuccaucccuuccauuauaguaaaugaaugugaagcagccacacccuucugugcucuuugaccccugugcauuagcacuucuccauuauaauucugagccuuguucuccuuuaccucugagcuucuuaaucucagccaggguuaggugacacuaauuauuugauccuuuauuguccucuccuucccguaccuuuucauccucucugaugggcgcucuuacauuucacucacugacgaguaucuucugugacuaaaugaauguugcugggaggaagagaaaugcacguguauggaugcuuguuccacacauggcucacaggcaguuugaccuacagcuauuuaauauugccugagcucuccuuuuuuuuuuuuuuuuuuuuuuuuuuugaggugggguuucuaugugcagaucuagcuguccuggaacucuugcuugguaauccugcuggccgugaucucagagauuagucugccccugccuccugagugcugggauuaaagguaugcgacaccacuggacaauuuuuuuuuuuaaaugucucauauaucccaggcugccuucagauauuuuggguagccaaggaugaccgugaccaucugguccucacaucuucaccuccagaaugcugggauuguaguguuuauggugcuggagaccccgcuucaggcuaugugugugcuggacagacacucugcccgcugaauugcaccccucaccauugagaacugggcuuauaaaaguucugggucaucgucuucgcgacugaguuuggagaguucauauaaagauccauaaccauauuaauugccucauggaaaauugaagggacccagcaacagagcacacagcuguccacuacguccugaagaugaaccaugauuuuguugaguucggggacacgaccugcccuuugcagauguuucugauugugacagacacuauagcucccagaaccauagagauuaaaaaguuaacucuaugaagauuuucguauucuuuugaauuauuauuuuugugaauguuugaaaauaaucuuugaauuauguuagauucauuaaaaauuuagaucuuugccucuuuuaguucauuuagagaaguccaguuuuauucuuuuucgauaacuuuugguugaaaagccguuucucuuuuagaagaugugugccucuuucucaccauuuccuucguuccucgagggcuuuuagaacuuagaauccucuuuccugaugcucccccucucucuauuuuuaaagauauuuuggguucugcagaagauucccgguguugggaaaacuaauaggauguuacaagcccuguaaaggaggcuucuggccuccugcuagucucauugcugauggugucagcuuagaaaagacauucuccucucagauggcuucaaaaagagcugauuggacaggcuaccaggugugcgguuuauauauguuccucucucuuccuccccuuagucuuuucagccuucagcaccgucucccccucuuuagaaacagcagggcaccuuuagugagcucucucccucgugugcaguagagcaagcugaugcgccagcagaacuaggaagaggcaccacaugucauguuuggaccaaugcuguaauuuuauuuuacaauaaggaagguggauauuauuaauccacuccugagcauaauagcacgauuugaauagcagagagcaacuuugguguguguuaaugucuagugagaugaaugcagaugaaugcuaaguagguagaaaaugucaguguagagccuucccuucggugacuuuaagcacuuagauuucuaguuaacuuuuuguucagccuggcaaacagauaugaagaccuauucuaucaagccagcauuaaugcagcuccugaggaugaacaaugcccacaaagcucugcucuccuggcagccacuugagcuaggccaguuauaacgaugaaucagaauguguuccugugcugagcaucuuagaaaaacucuucggaauaauaggagcuuaaugcuggcaguuuuaaaaauuggcacagccuacauggcguagcuaauuuuuugauguuauuuugaguaugaacaaaaguauaucuuuauuuuuaaaaugacuuuugcauuaacucuacuuauuuuuuugauuaguacauauacacucuaagcugacuuuugagcagcauuuaagucuuaauuagcuauauuccuugaugcaaugauucuggagaugggaauguuguuuguguuugaucuuuucuguaguguauaguugaggugccugcagggugucugggccauuaggugcuggugaagaguugagaauagguuuaacacucuugcccaaacaaaaacaaaaagcacagagggugaucucucucucucuguaaagaagguugggagugagccuccgagcaggcaggagggaacuuggguccuugugaguggugguacucaguacuuuuaugcuguguaucugaaacgugugccuuuguuucuauauuggcagaagccaggaagguugcaugauacuuuucaccaucacaucaccaaguccuuagauaagagcauuuugcagaaacucguacaguauuccuuaacugucuguuuaggagaauagacagaaaaugauagguaauauuaauuccauaagcaucaccuaaggccccaagaguuuaaaaacugugaaauugggaaaagggauuuaucuuuguguccugggcaucuauaagcaagucagacucuugcacacuucucuggggacagaaguguggcuuuuucuagucucuuccuccuuuucuguggcuuuuguucuuuugauccucuuuugugguaugugugacuguucccugguuugccaaguagccagucauaggggaaaaauauuuacgcaaaaccugcuauguuuuaaguuguggcugcagagagaugcugagaaugucugauucugcuguuggcugagaacagguccaaagcucaaccuuucuacaguuuuagucucaguagcauuauguauguaccagcaacuuucuuugguaaauaagcuuucuuuccuuuucuuguaaaaauaaaacuagcucucuuuucuccucaaaaaauuauuuugugugugugugugugugugugugcauauguacauaacacaguaucuauggagguuggacaacuuuguguaucuguccucuccacuuucacauguauucagcuuguauucuaaucaugcuuacaucauuggauggcuggcucccuuuucugcugguugagucaucucacugguccacgguuguuuucccaaaacuuucauaaagguuaucuuucuuugguucuuuuuuuagggcuuuuacuuucaaggucaagagacaauaggucaacugcucauuuauuuuauggaggagagauuuguauauccuugugucuuccuaaugccccaucuuccaggagcaaaugucuaggcagcuucuucaagccugucauuucuuguccuccagucuacaaaugcccuuuuggugguagcugcauuuauauauaguauauuucauucugaaaggugauugaacagccuguaugucgaucaccuugauguguugugaagguuuauucccucaguuggaguuggcuguuuucacagucaucugaguuugguugacuucuaagaguguugugugcauauuggggggaacuuuaaacuuuauagacaacacagcguuuagggucugaaaacagcaaagauaccgguuuugguuuuugucuuugcugcccaccucuuagagcucagcgaagacucagucaaguuaucagugugcugagagauggguagcagaugagucucuguguaugcuugacuugguguguaucccaggaagguagguaccuggcagcagaauacaugguuaguacguaauucaguggcacaguaacuaaauaaacaaaacaccaaacauauaacaaaaaaggaucaucacauucuguaagcaacaauuaaaagguaguaagccauugaaaguggggguuuuuuugagucagaagauggauggaugcuugaaagcagugaugacaugguguggaaccuugucauuugcucccuuggcaaucaccugugagaagugugaggcuccaagaaagcagcauaggagcagggaaggaagguucugacugacucccuuuuccucugcuugccccagugaaguucucucucccucuggcaguccugcuggcucugaugcccgaggccagggccauccacuggcagcuuuaaagucuggagaauauucacuucugcugugagcauuugugguaaaaugggucauccagcagcaguugugccuuaucuucauccuaauugcuggguucuucagugguggggccagcuguaccagcuuaugcuuucuggaaucugcagcacuucaaaggagaaugaccacagcuuguuccuuagggcugggauucuacccaggcuuaugcuagggcugagacuaggugacugcuggaaaggauuccuuugcaggcuucucucucucucucucucucucucucugucucucugucucucucugucucucucucucugucucucugucucucucucucugucucucugucucucucucucucugucucucugucucucucucucugucucucugucucucucugucucugucucugucucugucugucucucucugucucucucucucugucugucucucucucucucugucucucucugucucucucucucugucucucucugucugucucucucucugucucugucucugucucucucucugucucucucucucucugucucucucucucugucucucucugucucucucucucugucucucucuuucugucucucucucuuucucucucguccuggugccagcuggcaaucuugacgugcagaauuaguuuuuggaacuguaugaaggaaggcuauggguuguuuucucuaagugagggaaugaagacaucaucugcagacuuauuuuuggaugcuguuaagaucaagaaagaagauugaaauacuguauguuguauucucaauggcagugacauuugauaaccccuguuccuuguaguacagauucuuggagaccugaucuuuuuaagcuugcuacuuuugugacacaaauguguucuaaaucuggugggcuuuuagaaauaccacuuguuuuauuucaagaaagaaaaaaaaaucaguuuguacguugaguaagauacaggauguccaaacaugaaccaagaugaacagcccugguguaagagacuccuugguucucccccuccaggagggaucaaggucagcucugcaguucuucagcuucauggucagaaaguuggugccagugaaugggaaagaaugcagagucaacguaaucuguuuucacaccuuggucuguuuacaguguaaguucaggcucccuuugccaacuccugguuaagaaugcagauaauacagagacagaugauagaguuuuugagacuuauaucaagaauguuucaguugcauuuuuaucagaauuugauucacuaugggagaauuuuagggaaaauauuacuugaacuguaauuaagcuguagucuuacaucauauuagaaucagugugauuuuacccucuccacccccccccacccccccaccccagagcugggaagcauuaaauucauguuagaaccgggaagcaguagcugcaugcuggcaugccuuuugauuuccacuucaguguggauuguuuuacauaugcaguaggcauguuauccguguaugcugugugaaacuaguauacaccaaaguaaauaaggucaacagggugccucuggcauaaaauugccccaacaggcagugugggaaggcagaguagagcagagccagcaggugggcuccugcucaggguacuccacacugcucagcuguaacuuagggcaguacccgauggaacacacguucaaacaguuguugagaauuuaaagcugggaaggguuuuacaucuaguuuauaggacauggcagcuuuacuucuucaggugucugaauguauuguuuuuaauuagcauagaccaccacagauuuuugagaaaaauauuuuuuucaugcuuuuuuuguugguuuuuuuuuuuuguuuuguuuuguuuuguuauugagacaagucucucauugugacccuugguuguucuggauuucacuuaucuauaucaggcaggccuugaacucacagagaaacuccugccuuuguauccugccuucugguguuaaaggugugugccacuacaucuggccuuccucuuccuuaaggaauuuuauuuaguuaguuuuacuuugguugauauauuuuccagcuuucugacacuuugaaagauuaccguggagcaaacaggaagaggaggagaagcaagucaccugugaccuaagggucacucuuccauguaaggguccacucuuagcugcacuuguggaagaagcaagccuuuaaugcaggcccccuugggccucucuuucaagcugcagccgucagucaugcuuuguguuucucaugcccaguguuuguuguuggcuuaaagaaacaaggcagauugauuggcacuuuauuauauagcuugugaacauuugaaaacagccacuaugcuuuuugggcaacuaaaaaaauuuacugguagcuuuuaaaacuuuguauucuagagagaacuuaaaacaaaaaaccacuuuucucuuggacaggcaagauggcucagcuggaaaaggcauuugccaccaagucuauuggccugaauuugauugcaagggcccacaugacaggagagauggucacaaguucucuuuuuaccucugcauacgugaauuugcuuaugcacccugucuccauacaaaauaaauuuaaacaucucuuuuagggcucuauuuuguagguuuuaagcuuuaugguuuucuugugguuuuaugacuucuaagauuuuuuuuucuuugaugauuaauucuuuugauugaagauccaauuuucuuuugauuuguauuaguuuaaaaaugauuacauugcuacuuuauauauggcaguuuuuuuuuuuuuuuuuuuuuuugguugguugguuguucccugugcaaaguuaaucuuugucguaaacaccuguauuuguacugugugcucuuuaugaccuuaaguacugaggagguggggucuaugacauagaacucagaauuuauugcaaaggaaaugcauguaaaagguguguaauuuauuauuuauaauuaugauuugcgcugugaaugaagaagaguccauggaacuccuaaccugauaagugcugcucagcgaaggucauucauuuggauuuuuuucuucccugauagcucauuuucuggcugugcaaaaaggcaggcuuuuaguuguaaauuuucuagguacuaaguuaucaggugugguggggauucuguaauuuuuauuuuucuugguuaacugguaaacuuugaggcucagaucuauucagcaacaccugguuuguauccacuguagaccuugaaaucuuuaacagcugggauacaauuuucaucuuuccuuuaaaagacaauacaaucaggcagcuguuacucuccuaacuaacuauacauugaaugccaagccuagcagucagguuuguguuccuguauccuuucuucccuucacuuaugguuuugaaaagaggcggacuguaucccauuuugaaguaaaauaagugcuuuuuuucuuucuuuugagacagggucucauguauaucccuggcuggccuagaacucucuauauagaccaggcuugccccccaauuuacaagaaauugguaugcuucugcuucuagagugcugggaucaaaagcaucugucaucagacagugcuuccuaauaauugcuuggucaggguacugauucaggcaguaacaauguaaguaugucuguugauauuuuugcuuagcuuaaaagacuucaucaaauaagccacaguuugauuuugccauugauggaauuguuaguuuaugaagacuuuucacaaucccucucuuugccagauuuuguuuggcaagccacuuuauuucuuuaaaaaagugugucccugugcaugcugccauagugucuuaagugucuagacggccugguuuccuugaugucuuccauccacagggcauauuuccgcugccucuuucugagaauccccagggaaaauagcugucgagcccccagcccuaacacagaagcuaucucuaguugaugacuuacaaaggaaagauuaguuuucuccaaauggaguaucagugacuauacaaaaggucaggcccauguccagcaguaagcagccaacacuuaaggaacucaguaguaguuuuuggaaguuucugucucccagugcuuugucugggcuuuucuuccccgcuuguauaucuuuugcuuauaucuuuuuuuauuuuguuuuuuuuuuauggguuuucucuguuugugaaaguguguguuucagugucuguauauauuuuugcacuauggcuugcccccccuaccccacauuuuauuuuguucuauucuagauuuuucaauuuuuuuaaaaauuuuauuauuauaugccuguuuguaugcuaaugugggaaaaagaaugggugcagcuuuggaugggugggaaacugggaagaucuggggagagaaaaaccauaaucggaauauauuguaugggggaaaucuauucuggauaauaauaagaguaaaacacugugucccacucagcauucacuuaauguuaaaaggagcuacgauauauuuguaauuguuuuuaaauccauucuugcaauggagagacucaggcaguauuguuugcaggaaucugguaagacucaguuuuuuuuuuuuuuuuuuuuuuucuuucucuugaacaugcaugugugcgguggauauggaauccagggcucauacauauuaaggacauucuucacugcucauacacaguccuguucauacauuugccuuaaaaugacuagagugauguuuguucacucugugaaucuuaaaggauucuuuaagauguaugucugucuuuaagagcauuucugagcagucagaaaugacaaggaagaaaggagaaccagaaaacaaauccucaucugacuuccuuuaugcacagagcguagacgcaaacaguacagugaguguguaacaugguaucuuaaaguaguuuccuggucugcuuauuggagcauccuauuuaccugaaaugcuuuuaguuuccucagauaagucaaacucuguuuuauuuuguuuuguuuuaaauauuaccugguuguuuuuggaaggaaaucaaaccuuuggguuccuuuaguuuaugcuaucuguaauugauguaacauggauaugccaucuuuuggacuuuauucuaucaguuccaggcuuguuuuccuuaggagugcagaaagaagccacugaagcuguacacacuaacugcuacucuuccuggaauuuuuagagagggaagagaaguugaagugcuauuuguggcccgaguauacaaggugggacuuggggacaggugaggaaggagcaucugggggcagcaggcuuuagcugcccugggugucuggacuguuuuuaaugagaaacuaauugauuugaauuuuuaggacauuccuuacaugcuaggcaggcccuucaccuauauugaaaguuuuaccauuaauucugcuuuugguaccgaggauugaaccuaugguuuugcucaugcuaagcaauagacaagggcuccaucuuugagccacacccuaagccuuuugcucuuaacuuuucuccuuugagauaaaguuucauccaguuccguugucuaggcuccuugacucugaaucccgcugaccuuguguuuagagucugaauagagucgcaguccccgacacaucgaggauucugguucuugcucagucuuguuccuugggccuaguauuucuuuauuauaguaaguucuguuuaauuuauuuuauguguguggggauuuugccuauaugucugugaaccacauggaugcagugcccauagaggucagggaaggauagaccuggagcuggaguuacagaccauugugagcugccauguggaugcugugaaguaagcccagguccucugaaagaacagccagagcucuuaauagcugcaugucuuccagcuccaguuucuguuucuuaaaguaauaaauaaauagaugaauaaauguuguaaaguugcauaaauaaagguaaauaugucauguaauuuuuuaaaauggcauauucaaccuuguuauucuguuuauuauaaagccagccuuacaauacauauaacugauuaauuaccguuaauaaagcccuugauauuuaaacuacugagcauuucuauauuuuaaaggaacaucauuuauuaccaugugauaauaauuaaaugcuaguuucuguguagguuaauauuuuaaagugacuuuuguguuaacagcacuguucaucucauccaucccugggaauaauuaaagccuuacucucuccauuuguaaucuccuagcuaguagugaguuuuaacaauuuaccugagccacacaggaagaggacuuguguaacggauaaguacuuugaaacuuugcccuuuacaugaauugaugacuguuuauacggcuucaaaccaugcuguauuaaaaaaauauggacugcuucaggguuggacugaagagguuguauuugccaggaauaugcagcaggcuccagggaugaccucuggcuaaucacuuaguagcccugugacuucuaggccaaucauucgguagccuugagagcuuccuuugcuguuggaagaagggcugcuuucugaacagcaccgagucucuggaaguagacgggagcugaggucugagggggucgccgggcucucaugcuguacaucgugguacacacaugagugcacacacagcccacauagcagccacauauguuguaggacgacccugucacaaccgugugcucuaaagcaccucauuuuaaagcuguaauguguuacaugggcagcccuuucucugaugccuccggugugcuggcaguuuaucagcagcaggguugugauccugucacuucuuguuaaugaaggcuuuuauuuagcuuagcaaaucauaucuccuguuaacauccacgcuugcaaacuguaaacuugaaagagauguuugugacuuucuauuaauuaguagccaccuggguguuuuggcccuugcuuguagcaauuuagcuauauuucuucuguucauaugugguuugucuuaaaccagaaggcccugaaugccaauaaaucuuuauuuuuaaauuuaaaaaaaaaaaagcuuuccaauuaggugguugucuccuuucucaguuuuacuuccauuuuauucuucuaagugggaauguuaucauuuuaacggagucucaacucgacuugcagugcagcagcaaauagauagguagacagacagacagacaaaugguacuguuacugaaacaaugauagcuucaauguauguuuuuauucucuuauauaagauguuuuuauuaagagaauugugagauaguaaaauagagugacuaugagcugaguuguuaauuaggguuuauccuuguuguacagucaucuagaaagaaguggcucucugugagguaauguaaaaaacagaagguucagccuugagaaagaucuacaucuguguguucaaauauuuguuuuuuccucacucguauacacagacuuaaaauaucaaauauuuuuuuuuuuaggaauuaaguauuuaagcaugucauauaugucucauacuuaaucuuacauuccuacaacaaaacaaaacuccauuuacauacagccuuccagaauauguaaagcauaccauauaugcauauacuugcuuugaaguacucaaaucauucauaaaaucucagauacaaguuagaagaguucuaaacucaacucuuucauauaauuuuguaauugggauuuuuauauuauauauuccuuaauguauaaaauagaaucauuaauuacuuaagaggugacuuuucuugucauuuucagggcauuucaguagauugcugguuuuuccuugaguagugcuugagggccuuuggugagcugggguugguccagguuuggaagugcagaagaagcaggauguggaugcugcugaguguugagucuaggccacaggggauggcuaugggaggggccuuuaaggauagcugcugaacuaauagggaaaagaaucuugagacuagguggaugggagguacuucuagaaggcuuuauguaaacggaguucguuuuguugucggagcaggguaaauaugauauacuuuugacauauuuaaaaacuugauucuuaaaaauguguuauuuuuaauuuugagauuuuauguuugguguauauauauguguguguguguguguguguguauauacauacauacauauguuuacgcauauguauauacacacauauguguauauauauguacauacauauauuuuguauauguuuauacauacacauacacauauacauacauauuuauuuauuuaaaugucuaucuguguaucacauggguguaguguccaaggaagccagaagaggauguuguguccacuuggacugacauuacagccaguuguaagcuuccuuguauguggugaaaauaaaacccgaguccuucugaaaagcugcccgggcugcuaauuacugcggcaucucuaguccugucucccuuuuccuuacuuuuuagguagggucucacuauacaguccugucuggccuggaacucaacucuguagaccagcuuuacuucaaacucacagagauccuccugccucugccccagacaugcugggauuaaaaguguauaccaucacaacccuucuugugucagaagcagacuggaagagaguucugugggguagcugggguaagggaagcagaagagaagagaauguacugaaaggcucuguaccacaaagcccuggcggaugacuggauucaccaaauacauaugaagaaguucuucuucuagucauuugcacuuacaagagacccacaaaacacccgggcauuuuuauaaccggugugcguagcaugagagcuuuugugauggcucuauguaaugccuuuuucuuuucuucaucaaagaagaugagaccauuuggucaguuuuuauuuuugcgugcaaguuaguuuauuagucgcucagaaaagcaacacuuagcagucuaagguuuauguguguuaaaggaauucacuauaaacaaagaguauuugguuacaaguuaugcaaagaugcaugagccacgggaauuuuauuuuuuaagauuuauuauuuauuucauguaugugaauacacuguagcugucuucagacaaucauaagagggcaucagaucccauuacaguuggcugugagccaccaugugguugcuggaaauugaacuccggaccucucaaagagcagucaugcuuuuaaccguugagccaucucuccagccccccacaggauuuuuaauauacuuaauuuauguauaucaaggaccuuuuguuugugcaggcuauauuagucaauauuugcuauacuaguaacuaagaaaacuuuuaauacuauuaggaaaaaauaagcucaguacuuauuaacagauuuuuuuuuuaaugagggacauguguauauauuuuuucuuuccuaagacaaaagugauaaggauagcacaguuuugcauuuuuuaaccccuuuaacucuggccacaauagaauuucauucuccaauggcagcaaacugaaugcagaagcaaaggucacauaucuagaaccuucagaagccuccuugaaagaaaaacaacuuugcuaguuuuccuagaccuauugaagaugucucaggaaggcuggucuauaccuuuagucucagcacccagaagaggcggguaggguggauggaugguaucuagggcagccaggucuauauaaaugagaugcugucuuucaaaagcaccauugcuaccagauccuuacgccacaaaacuuuaaacccgggaaucacagggaggggcucuuggccuguauuuugaggacuguugggguagaaugcugacuucuuguaagaagcaaggccaggcccaccugaaccuuaaauggaaacuucgaaucaggauugcagggcacagcucaucucaucucucuaaggaagaaauugaaggguaugguguggggucagguggagcucaguguggggucccugcugggcacacucgaggcucugugugugugucuauccuggccgagaugcgugcguaagcauggaauuggaauccuugcaggugagaaugcugggcuuggcucuguugcuggcagcuuuuacauugguccaaaucuuagguauugcuuucuuuaccuaaaaauugaggcugugggcuaaucuuaaagugugaauguucugugauuuaugcacauuuuuuauaguccucucaacacuuacuuucuauaaauacacacaugcccacacaccggcuuacacauacaaggagcacuuuggaaggucacaugagcuaaaaaugcaccuuggaguaguucaccuaagcguuuucuuuuuuccuauauugguuucauuguccuauuuuguuucuuaaauagaaauugacuaaaugguacugugggugucuauagaaucuccaucuucguugucagucguugagcaugggugcaguuuuaaaaaaagccucaccguggagccucuccccccgccccccuuagucaugggacuagaugggaaaggagagaagugaggugccagucaucaaaacuguugucagacauguguugacuccuggugguugaagaagaaaaugccccccaaaaucuuuuucuuaaagcagagggggugguagccagggauguacguucauugcuuuucuguccgugguucaguguuugauauuuugguagaauucauuucuuucaguuuucaaaaaauguacugguuuagacauuuccugcuuuuugaucuggcuaacauucugaacauuauguuguuaaguauuaauacuguuaugugcuggaaccagaucgagaaaugucaaucccaguagcucccagcuccuaaugcuguugauugcuauuuaaaaccgaagacuuucagugagguaccucugcuagcaggaggguggaggaagaauuauuggcagccugaaauuucagaugauaugaaaguuacugcuuucagaaaagacacacguuuuuauauucugauaguuucuuagaauguauugaacgaauggcaauaaaaauggcuucagaauguaaaauucaaggugacaaacaucccacauuuacuuucccuuuagcugugaaagcaagaccuuuaaacugaaauuccugccuuguuuaaaagaaaugaggcagcacugagcaguuaaguuuuuaaaauauuguauuugauacaguuuucaguccugcugucccuucccuccacccuaccugccugccuacuuuuucauggaauucagggauuggacucagacuccagacugcauggcggugccuuuuauccccugauuccccuuccuuggcucuguuuuguauuuccuuuagauuuuguuuauguguaugcccaugcaugucgaagccuggggucagccuuggguguuguuccucugcuguggucccccuugucuccugaagggaaccuggcucucugcuuaggcuaagcuggccagugagcaccaggcuccuucacucaccuuaucgccagagcugggaucccaggugugugcugcuucuaacagcgguuuucaugggugcuggggauugagcacagauuccugauguuuuaacguuuugaagaauagggacugucuaagugauccgcagucuuuauacauuggcuaacuuuugaagguuacauuuugugguuuuuguauuuuuagguaauauuagucguuuuggauuuuugacaggguugaagacugguagucucauagccaaucccaauuguuuaacacugaggaagaugguacagauuugagaggaugguuuuuagaugacauacaaucuaaaaccaggacagaagugugaauuaugucuuuuuaaguuaggauagauggcaggguguuuuauuuaauugacaaaauugauggauuggguguuaaguguaucuuauacuauauaaauuguagaaugauaauaguuguauucaauuuauaucugagggaaaagagccuuuuaauuggacagaagggggaaaauguuguagguggccuuggugcuguuguauuuugaugcuaauucugcuuuccuaggaggggcugccuaggaagaggaggggcuucuggugaaccuuccucccucuuucacuuguaauuaaaggcuagagccugugaucgggcaguggaagggaagguggagcuaaagaguuuuagggagaaggaggagaggggaagaagagaggacuuccggaagaggaagagaagguggaaggaaaauauaacaaaaacuauuguggccuagagaaaccacaagugauaagagauguuauagauagaaaauacaauaauauagcgauagaucgucccaaucuaggugugcagcuuguauuaauauuaaguugugcuuccuuuacauggacuuauuuggguuggaaauuuaccacaacaaauuggcaagcacuuuuuugacugagcugucuccgcagcaauguuucuggacuuauauauuuguuuuauacuuaagguguuccugggugguauuuuuaaaggcaaagagcuguuuugagaaaugaggucuggggagcuguugaaucuguccuggagcucuaagccaagagaaggaaaggucagaggaaggaagacugccuuacuugcaaaaguguuuaggcuggacuuagaguucucuguuggguccaaccucaagggucauugucauugagugugcucuugauaugaacagaagggcuucucagaaaagcaggaagaacaugucagugcuguucuucauggcucuucuuuaauaagugauagugggucaucugaggagauuuacaaaucuccauauuuacaaauauggguccuggaaguucccuuauugacgaaagacagauggaaagucaguauuugaguaaaaaugucaaaucuuguaucguauucuagaguagauucagcuucuaaguguuuaguguaaaauggggcuugucuaacuugguagaauuuuauugcugagggugauucugucccaauaguuucuucacugagaucaaacauucugaaguagcuguugccucugagccuuaagcugaaagcuuuaguugccuuuuguaaagguagcaacaguguaugauccaugccauuugaaggguuuucuaacuguucauuuuaauuauaaucaaauaaaccagagacuagugggcaugggcauggugucacacuuccuguaauucuuacacucuggugauacaggcaggacgacugggaauuugaggccagcugggcucugucuugagaacuuguguuugaauacucuccccaucuccccuaucuaccaccugcccccucccccugaagaaacagagaaaaaagauagugggauuguagcccccuugaaguuauccuuagaugagaaagaugagggcuggaguggagagaguuccaaaggaccaucgcaggacauugaaucacagugucauuugcucaugcuagcugcccugggcucugccaucuuggugggaggaggcacucuugcgagccaauaaccuggcuguaagacuuguuuauauuggauaaguugaauguaagggacgggaaauucuugguauugcggaacuugaugguuggguucuuauucuguuccucagccuugucaagcagaggaucuauugauacugccuggaagacugacaguugcauuauagcagugguucugaaccuauggcucuagacuauuggaaaaacacauauuuccauugcaaccacuggaaaacacauauuucugcuugucuuaggaacuaagacacuguucaguagcaaaauuacaguuauaaaguagcaagaaaaauaaauuugggcuggggguuccuaagacuauugaaaacuuguuuucugaugguugagacccacagguuaagaacugcuuuauugaaaagcucucagaggcagugcuguguauccucauuccccagugggaauguuuaaaagacugaauauauauugcugauaugagaucacuuauagcaggagacauugcuaacuucaggaacuugauuuauauaauagaauucuuggaacucugcauauacaaagcaaggucugucuuuugcauccacagagcccugggacaauuacauuuuaaaagcaagugcuuaguuuccacuugguaaaauacgucuaacuuuugggaaaggacaagacagauggagaaaaaugcgaggcuuaacuuuugucuuuggaaugguacgggaugcuucaggauuuucgaguugguaauagucccuccacucccagcugugugugucuuguuugguguaucaagucuguaaagaaucuuggucuggccggaagggacuugggugugguaaggcaauuaaaggcucucaaaagaagaugcucgcucuaauuagugagagcugcaucucuuucaaagaagaagaguguuggcugcugggaguagcaggaguuacuauuaaggaucagugacuaagaauuaaucuuauuuagcugcauguggugauagauauuguaauuagaugugagagaggagacaugguaaucagacuugaaaauauaggcuaugaaaauucuguuucuccuugcccguggguagguuugcuugcccuauuguugggcacaggaugcuugguuucugcuuguggguuugaccuagagugucuugggagagcauuucccuucacagggugcuuuucugucuggaauagcaugggaacagcauaacccuaagggauacacuucugagucugaugauagagccgaaggugaugaucccccaucuuacuuucuuguucugugagucauccuccacuccauuuguuucagugauagguaggaguuuggaaaauuauaauggaaaagaaagugcugugaauaagaucauauuagguuuuguaaggcucugcaugcucagguuaugccugccauaauuggguaauaauuaguacuuuaggaaggcuauuaagauaaggauuuauuaguuuuucugcucuucacauuauaugaccaccaccugggagaaaauuuugugcacugauaaggaauaaaaugaucaaguuuuggauuaagaaucuaauuguuaaaucuugauuaaaugacgccuauuacguuguaauuauaucuaucuauaaaaacgggugauauuagauuugauugcuggguuuccuaaagcagcauuuuaagauaaugaauuuuaauuauaugugugccugggaaccauuuuaagccaucuagagaggaaaaaugggcaaggcugccugagaaagugcucaucuagguguacagcuuucagcuuguggcuuggcaagggugagagcaggaaaauuggauucuucucaugguccuuccuacaggagacuuccuuaccaagcuuccugaaccaacagaguuaacuuuauucagaaaaucccaaugacguuuacucgaugucagugcuaugugcaagugcuuaugucagcaucauuuaaaggcuguuucuuuguauaggaagaguuuaagaauggaggcgaagucuguccugaaauuuucauccugagcacccuggcugcauuugcucacgcucucaccuuuccccguguacagaugagcaaccuguagcauggcagacccauuacaggccccgaggugcaaggaugacagugcaagagccagaacucaggacucuucuagaauucucugugccccuguacaguaguguaauuauagauuaauuaguacuauugugcuuuuguaguuuugugcaguggauuuaugaauuaccuccuaagguaaauaugaccuugcaguaauuaaaggagacauaggcugcucacucuugccugaagcuuucaguugcucccuccugcccauagagcaauuucaagcacuuucagguguucgcaguuccccauuuuuggcuagauauaacauuuuaccuuaugaaauagccaaauaauuuucccuuuaguaagccagucaggucuuaucucauacccuauuguuugucuaguauuucguuaugucagcccuauauuaugauuuuuuuccccugucuucucucagucuaucucucgauuccccacugucaagcacuccucacuccaccauacuguuuucauuuaauguauuuaaaauuuuaaaguuauuauuaugugugugaaaaucuuugugugagcacagguguacaugaguucugguauguguggaagccagaagauggcauuggauacccugcagcuguagucacuuuauauggguccugagauucaaacucaggucugggaagguaguaauuuuuuuuuuaaacagcuaagccaucuuuccagcuccccaauuaaaacauuugaaguuuccaguaguauuugaaggucauauaaauguguguuacauguauuuuagaacagaugacauugccguuugugguuguauuuauuuacauuccuccuagugagcaugcauauauuuaaggggugauuauauuuuaugaucuaagaaguuuuagaaaaugcuucuuuuauuaauacucuuguuacaaauuuuggaagacauuuaucauuuguuucuuuaacaaagggauuuaaauucacuuuugggcauuaagugaaaaauagacuccauucuggauuuuguuucauuuuugcugaauauucuuugcccuuuaugccuauuguuagcuguguaagacuugccugggaagaugguagcuuuuguacauaucagaauuugagucauagaggucagguuaauucggcacauuuccacuuagcuaaaugggcuaccaugucauacuugugaguugggcucuacaucaaccaacuuugcagacuucguccuguucacauuuguuagcaacagcuacgucucagaugaccccaaaccauuggccauguguuaguugcuguuacagugaaugauagauaagcaagccaaaauucauucuccucaaaucacauaaucguugguacuggauuguucugcuacuaagagcaauaggcaagugugauagaauccccauugcauguuugggauaguauucuuuguuuuggagaggcccaguuacagggcuauaguaaguagcuucuugugcagguaaccaaaucucuuaauauuuauuugccauugucuuucgguccuuccuauaaggcuggucaacccuggaucccuuaaagcaagucacugcccuccugugguaaucacacaucuuugagccacagugacuaagcagcagacuuauaaccuggcaacuuuguggguuuacuguuaagagugugaagcuguuuuugccuuuuggcaguacuuugcuuucaucaagaugaucucagcuuucauuaaguuuucaucuaauugaaaagauugauuuuugaguaggugagaguccuuuuauguaaugucucaaaggacagagugugggucaaaucacucuucaaauggaugguaauugugaggaagaggcuuuucaaauggagauagcaaguuacccagaguuuauuggaacuaagagcuuuuauauguaauaagcauccacguuuguaaauaaugggaacugaaauacgcuauugacgccccggagcccauggguggaaccauaguuauaccauggcauuggucaccacuguaacccuugugcuucagaggaggaccuggacauuggucauuugagguuuggcuuuuugggucauuccuucuuuagaucucugaauugauuuacucuucuaauuuuugugcccuuuaaaaaaugaggcucagaagagaauccaagaacuaaauggguucuuuguuuuuguaggauacuccaaaaucugguggagggaaauauugagaugaaggaagucauuuaagcauccuuuucaguguuuccccaguuuguagggaggugguaacaccacagagcaggcugugaagaggagucgauauugaaacgaucacuuaacucuuggaaauacuuucuuggaaacacuaaauagcaguaaaucagcuuuccagaagaaaacacauugacauuaaacacccuguuuuucucucagguuuguaaugaacaaagggauauucuucuucaguaggaggaauccagggauuuuuaaauucuucuuacugccagcaacuuaguuucgucuuggcugaaagcuauaaggucuucuaaggguuauuuuaugugauaacuaaugacugaauguuuaauuuccuguucuuaaaauacuugucuguuucucguaaguuguuaggaucuugugcuuuuagaaaacacuuauaaaauguagagaaaggaaugaccuacuuaauacauguugucaaugaugaauguaggaguuguguuuuuucauuguugacauacugcuuagaaauguuuuacaaucuaaacauacuaauuucugguaguuaguugacuugcugugugugaguacgugcgugugguuuauauauauauauauauauauauauauauauauauauauauauauauauauauauauauauauauauauuaaagcagcaguguacacugauaaaaugcagaucucuuucuacuugucauugaaaugccaggugagaaguucaaggcgcuuuggcauguuuguauuucacuggucagggcuguuuccuagacuuuagggagugaguaggugguacucuaauaagauuacauuuuaacuguacugauuuaaaauuauuuucuugaacaguaggcuuugcccauacaagcuuuuuauaauuuuaauaauuacuguuuuaugacuaauguucuuauuugaagauggcugauauuucacaauucuaggaaauuuuaaaacagaaagcaugguuuucagccuuauauuugcgauaaagggcuagcuggugugcguuggaaugcaucucucuaccccuuaaauauuacuguccucagaagcuuuuaagaacucuggcaggacagcuugccuuuucuccugcaaggccugcuguacauguguuuagcaaucaaucugucauagaagugggugguucuuucuccuccuugaugggaagcugauggcccagcccucuugggcacuuaauguuccaggaaauagucacagaagucucugaauguuauacuaucaguuugugccaaauucugggcccugauguagaucugcuagccaccauucucaguucugucuuacuuacaguagaugagauacauacaucagacaacgugaaugcuuuggcuauucuccauggaccuugggcuacuucuuggugcuacuguugagagcacauuuuuauuucaaucagagggacagaagaacuaaggcucuuuuaaauucaacucuccauaccugguugucuuccaucacagaauuuaagucauugccauagaaagagcuuuuggaggacucugccauuuguuacaauguuguguguuuaaguaugcaugggaacuaguagagagaagaugucaacuagagaaagugguuuacaaaaguaugaaugaaauaaaguccagagagcagugcaaaggcucuuuugucaacauguaaaacugagaaccggguguugcuugcuggaagcugugguaucuuacuguguccugauaccacaugguuuaaauacauagcauccagugcagguuaugaaauucuguuaccggcucauuaaugggguuggagaggauuguuguugauguucuuuguagaacugagagggaagccauaguggaaaacuggaaaacucaggcucugucagugggaagucauauugcuuggauugaggugauaaguuuggagagagaacagaguuuggagagcagaggugugaccuucagaccuuaggcagagcuuauagugggcuuaggggauaacaaagccugugaaguccuuuacauuuauuuaaggucacaacuccccaguuuucugaaaacaaggagcugaaaauuuucucugcugucauaagugggcauucuuugccuuaagguauagcauguggucucuuuucaaaagucaguuagucaaacccucauggcuuuuuuccucuuuccuuuuagaacucauggguauucuaugaaauuuaugauauucuaauuauuuuuaucauuguuauuuugauuuuuuugacagaguuucucuguagaacaucccuguuuguccuggaacucacucucuagaccagucuagccuuaagcucaagagcuuggccuuccucugccuccagaguucugggaugaaaggugugagccaccacuguccagaugauuuucucauuuuuaagauaauguauaauuuuuuuuugcuagaugguuccguuucugcucaucugcaagcaaauggaaguaugaauuggauggaauaaaaucagcaaugugucagagaagccccuggggagaguuugcuauggccccuugucacaguuuaacacuucucaguaaugugucucuuccauccaccauauauaaggaaaauaagcagacuggccauucuaaaugauguccccaugagaauaaaccacggaaggagaaaauaugugagagauggauaggauggcuagcggccgucugaccuguucagggugugugccugagaaguugggagaaggauacuaggauggaaaaguuagaguagaaaaagccccguguagcuggaaagauggcucaacuguuaagagcauuugcuucucuucaacucccagcaugcacaggguggcucacaaucaucuauaacucgaacugcagaggauccauugcccucuucuggccuccacaagugcgggacacucaugaacugcaccuguguacauauacacacaaauacucauguauuaaccaaaacuuuaaaaauacuggaaaaauguacacgcauccuucuaguaguuuuaaaguggugguaaccuggggcacuuggggagcauugaaauacagucaguacaaauaaacuaagaagaagaguggguaaacagacagucagcuagcuacacaauauuuuuuuuaaccuggagccagcaagaaucgggugguaacaguaggaagcaaaugacaacugagagaauuuggggauucuauuggucagcuuggcuucuauaacugaacaccaauaguaaggcuggcuaaaccauaaaaggccaucuuauugcaguuagaaagggugaaaauccaagaucagcuuguuucagcacugguagugagucuacucuguucucucucucucucucucucucucucucucucucucucucucucucucucucucucucucucucucucucucucucucaugugugugugugucuugugggacauaacuuaauuuuccucuacuuuuuaaauuacccucuucuuuuuaaagcuucugcauagauauagccuugagacuaaggcuuuggcauaggaauuuuguaaaauacgguucauccauauauggguauuuuauuucuuuaaagaugaacagaaaugggcugccgagauggcucagcggguaagagcacugacugcucuucugaaggcccugaguucaaaucccaguaaccacauuguggcucacaaccgucugaagacagcuacauuguacuuauguauaauaauaaauaaaucuuugugcuggagcaagcagggaaugagcagagcugacuggagcgagcagagguccuaaaaauucaauuccuaauaacuacuugaaggcucacaaucaucuguguacucacauaaaauaaauaaaucuuuuaaaaaaaugaacagaaaugaucuucuuuuacccgaauuuuuagucccagucuuucagucucaaagcgaaaugcuuuuuguaauucugcucccacccagcaguuugguguuuccaaccugcagguggguuuuuguuguuuuucaacauguacaacaguuucugcccaauucuuccauuuagaguugaguuuugaugguugguuuacauuugauuucuucucuaacaucuucaguuuuauagugugaccucuuugucagaaaccacuuugaaagucaugaugcuuuccaaagcuacuuaaacagaacaugcguuuaaguggcaccauacuuugacacaggugcuagagagggucuuggcaguguuuuuacagaacgucuucaggugucugccuugcugagauugcugggcauggaaucugugguguuuauguuggaaaugcugacacgugaggacaggguguuucauguuauuuuuacucaguguacuuagccagaucauauaucugaaaacaaaauuccuuaauagggcccugguuuucaaacugaagagaaagccagcaguuggacccuugaaucuaaagcccucauauauaaaacacaaaagcauaacucuggcucccauccacuuuguuaauaauuaguguauacuuauugguccuaaccuaguuaauggcuacuugccuguucuucacggcaaccguggaacauccuuucuauuucugagggacagcagugugucuggcagccuuuuuuuuuuuuuuuuuuuucccuucaaacaaugaguccauagguguuugugaggugagauagcagaugccauucuaguuucuucugucagguuuuaguaugaccucuuuuugguucaaagugaauuccccgagcagcugaugcgccuuuaauuaauccauucccaagugcagaaguauuccuguuuuaccugcaaggcacauaggggugugugagucccugagaaugauucaaauggcuuggcaaaaauacccacuguccuuucauccaagcuggcguuucuggauauuuuuguguccaucccucuaacucacccuuucagccauaaaagcuuauuuaaagaauuccucugugaucucugacggguauucauuauccccguuagaucuaucuuuccaggacaaaacaagcaagcagggacuggaucuaucacaucuuugagagcacuucucuagccaaagaaucuuagagacaguaucuccuuugcagaaaaggcuuuuuuaaaauucugcucugcagcugccacuuuugugcccguguuaauggguuauccuaguguugcagauguuuccuuaaacaaacaacaaaccaacccuauguuuucuggcauuaaaauauauauuccaggaauguuaugccauugaucucagagaacaaaaguccgcacccaaaaaagggguuaaaugagaaacuucagggcauggugguguaagcauuuaaucccuguagaugcaagcagauuucuguggguucagggucagccugaucuacuuagcaaguucccuaacagccaagguucuauacagaguucccacaacucgccauacccuccaaaagaaagaaaagaaaagaaaaaaaaaacuuuagcucuucgcauagccuaaaaaaaauucuaagugauauuuugcaaaggcuuaaaagauccaagaaauuauuuuuauagcuguauaacuuccuucccuuuagaauguuuacuuuucaaagggaaggaggaggaggcacauuaguguugacucagguuucuaccauacugacuagaagcaguagcucauagacuauaagaaaggaugauagaacuucuugccauuuaaguguggaucugaaggucuggcagcuaaagauuaaccacuaagcaugagaagucaucuuaagacagaguaaggcacacaauugcaggugaccaggcuuuaucacuccacagguuguuuaucauucaacaguuguuguuuuuguaaacaaugcugacuccagcacuucagcugagaauguauagccaaaacacacgauuuuauauaugaaucuuaauuccacuauauaaauccguaaacuaagaaaccauuuaugaaaugauggcugcuuggguugugguagaguacauuccagcugaccauuuagguuauggcugcagcuuccgucugauacuggauuaggcugggauacugagaacucaguaggaacagaccaugcuucaacaguugcugagccuguagaaccacuagggcuaucgcaggcuggaaguguaagcugaaaaaaaaauaaggggggauucuuaugcuguauucauuagcauagagaagcucuugguccauuuucuuuuauguggauuuuuuucaucccccuuccccccucugguuacuagguaagagacagggucucuuagcugagccgugguugugacugcuguaccgcauuugauugcuccucaaggccuccuugguuuucaaccucucacugcuuuucauccccucccacugacuuuagaguagacaacuguuaaccguccccuuucuuccuauaauuuguauaccacuugucagguccauuaaagagcacuuuaugcucucuuuaucuuuauaguauuaucuauagugcucuugaaaguggggguuugcuauccugcacucugcccucaauggaaugacuccauucuacuuuuucugccuuuuuaauuacugcuucuucuuguuguucuauuugugugcacacucacauguguaccacacuaccuuuguggaggucagaggacaacauuuacagaaucaguucuggggaccaaacauaggucauaagacuugcauggcuaauguuugcccacugugccaucucaccacuaauuagugcuuugagucaagcuuuguagucagacuuguguugaguuugcucuuaguucugcugcagccacuccuuuccuggugguugguuuuguugagcuuguguguauaugugccaggguccuccuguacgaugccuaugcuggcauccugcauguaugccuccuguaaggaguuccaggcaugcaugcuucaccacacucagacuugcacucuuuuugcacucuugccuccuccucagagucagaugcuaacagccccugguuugguucucugggcuacuugucuuguaaaagcuuuuccugguggcucucauccuuggcugcauguuagaauuaaguuguguggauauaacaguaccaguguccagaccuuugggagagagucuugcugauuuuaguguguauaaaauagacacuggcucuaauaacugcuuagcugauagggcgaaaugaauauauauguaacuuggagucuguuaggucucaauaagcaaucauuugcaguucucagcaaguuaaucuuuuguaagcccauuucuucauuugaaaaacagggcuaaaacaacccaucucauuuaguuguuaguaucauaugaggcuaaugccuccuaaacgggcuuagcacacugccugacauauccuggcuuaagccacuaagagccuuauuccagccaauguugucuccauuuccaaagcccaugugcuuugacauuccuuguuuacugcccuuuccucguggcuuugaauacuugcuaauuuuacagauccaagagccuuagugauauuuuaguauccauugcauacugaagugaaaauguguauuuaucucuuaaaaucuacuagauauaaaaagaagcuucugaagaaaaugagagaaacggcaucaaaacuucuuugaauagaaaggaaaaugggguuaugugggugucauuucggaauuucaguggcuuagauuucuaaauucuucguccucagucuucuuuugccuucccucucccucuccuucucuuccugccuccuuuccccucuccaccacugaagucucuguucuugagaagcucugcuuguuugccucuuuaugcacccuucugacacuuucuuuugucuuaguaagcauccgcccuuuguuuaucuggaaguauuuuuuuccccacuuuugauucaaggugaccuuuugagugacagaguaugucuccagucagagaggccagauaacaccaguugaaacagcugucuuuugaauuguagaagguggaucuuuauugaaguguguuuuucaauaguaaagugggcggccucucacaguuuccguuguucuuguucggauaguccaguaaucaccuuuggguugucaucauccuccuuugcucaggguccaugugcaguuccaaaucauucaugucuuagaaguauaagaaaucagucuuugccugauuuuuuuuuuucuaacguagucugagcuauauugcuucucucaauguaaguuagaucuugacagauuauaucauuuugauaaaaugagguuucaggauuuuaauuuucuuacaguccccuugacuuucuugauguauaauaccauuuuguuguuaaacuacacuuccuuuuucaaaguacaugcgauauggacuuugacuguucuuuuggaaggugacuuuccuucaguaacagagauaaaugcucagguacagacacaguuucugauguccuuggaaagcuuuagaaaucucucaaguacagcgagcuggagacaguaagugucuaaaauagagugcagcaucagugaagaccagccaguuggccuuccaggacaucaaucagcaucgcaggugaccuuaccucuucaugggugacuucaucucagacugucaaggguacgcugaaguuuggaauucguauuucucaggaaguggaaccuagucuugucacuugcucugacaacuucaugagcuggguuccucucccuggccuuuucaguuuccaccauucuucuacggaggcuggagcugcucagugccucagaaaugcgcguuuacagguugacccaggccuugagucacuucugaguggcugaauaguuucagugcuauguguucuagcugguugguaccuggguucugggagaggaggcacugagggugaguggcaguggcuucaugagauuucccucauuuugacuauuccugcaaaaaaaaaaugcguuguuugugaaaauaugugauuuaaaauuuagguuucaucuugacaauauuugguuuuuaagggcaauuguaauugaaagacccuaagucuguuuuuuuuuuuuuuugaucuccugggacagaauucaugaaaaguucauaguguacuuugcuccuugcgugggccuucuucuuuuguggcuguuccaguauguuuucauuguuuugcuuugagguacacugccucugcgaaucccauugcuggcuuucuucauucccagccauuaguaauaguuguuccucaauggcccuguuuaucaggcagguaccuuaagauauguguccucagccgugugggggacuucuugucaugucuguuucuccaaggaaaggcauguaaaauaauuugacacacucuguauuaucaccaugaucucauagauuucagacauacaaaaggaugugugcagugucagaaaaggaaucgaauauauuuuauuuugugauuuuuuuuuaaugaaaaacuuaaauuucucauuguacuccaaauguguaaagauuauuuuucuguacacuuuagugaaauguuuggcaccuaaucugcucauguuacuuauucuuuaccuauuuucugagcuccaacuuuucauaugaauuaucugauuaaaaaacuaauuggcaguuggauguagugggugugacagcagcauccucugccuacaccuacuuaagggccacugagccagucuccaggcuucauuuucuucaugugagcaaggaaauggcugcacauggaugcuacucaggcuuuccagcuuaaguuucuguacuuauaagaguucugucuauagaaacucacacacugcauguggccaaucucggaguagauugcucagagcucaugguucuccuuguccuuucccaugguggcaccaugcuguguccccaaagaccaaguauauauaagauguuccucauuguuaggucucaguuuaaaugucacuucaccagagaggcuuucuucuuuaucacucuuuuuuccuccuguagcaucccgauuuucuucauggccuuggaauguacuggagacaggaauugaccuuuggcuuguuuaauaccuguaccuccugcuacguacccugcaugccugacuugcucauacuuguacucuggccagcccagugucagaaacaugguaggcauuuauuaagugggugaaucuaagugcaccccauccucuguuugagcacugcacagcacacaguuuucuuucugcauagucacuuguucugucuggagccuucaucauggguuuccccaugucacugugacaucaucccucuucacacuccagcuugcauccuguguugcaguucuauuuauguguucuguucuuugcuagaaaguaaguagggaccccuugucugagucaucuugaguauacagcauguugcucuguguuuuaugagauuuaccgauuggaggaaaugcaggugucaaaguccuucaaauguguugguauuugaagcacaucuaauuuuuaaaaaaaucuuuuuaguugugacuaaagcccgucuccuaggaucugucaugucucauugcaguauuuaccucauuguuuucagguugaagcaugggcacucuguagcugcccagagcuguauugguuugcugugugauuucuucaguuuaggagcucucguugcccauguggcugcucuaaguggucccagguuuugaacggagaucuugcugccuuuuacucucgguacuugguacuuugaaccagcucuuuucuguuuuagggggcuguaguuuaagagaugaaguaaaaguaauuaugcccaacaaaucaacuggaaguagggcaagucugucucuugaguaaaggucagguaccuuuuacaacuauggaaugauuucucuguauuuucugccuaugggaugugaguuuuguugauugccuagaugagggguacuuuucuucuuuggcuagguuaguaucuugggcuaucugggcccucagcugaacucucaagagggcaugagagaguuuaaugagcaguuguagaaaaacgaggaaaggggcugauguucaaaagcaucaggaucguuugacuuccuuuugcuuuucuccauaguuacauggcccaacuucccugccuccgucaucucucacaacuuggcaccuccaucuauguacauuauuuuugugcccagguuuguuuaccaagucuuggcggauagauugucuugcagauagcuucuuuuucaucaguaaacauagacagaauugucucauuaaacuauaccaagaaguauuuggcuauacaaagugauuuucucaguaugggaugguucaaacuaguuuaucuucagaauuaaucuuaguucauggcuuagcucucuaaaauggcuuaauccccugagugacauuaaaaguaucaggcguguaguauuaaucacagcuuccugacaauuugcugacccuucugagacccccuguuaaguauuaugcuaaauugagcaaaaaugcccacuauguacuguagguuuggauucuuacauaguaucuguaagguauguuucuuaaaaugccaucuggcucucacuguuagcuguuuaguaagaaaauguuuugauuuggcuagcugcaugaauauuuuuaugcuaaagauuuuuuccuucaaauaauugaugguauguacuacaguaauuuaaauauuuuguacuuagaacauggcguuugauggaugaugaauagucugcuuucuaguaaguaaaaauauucuuuugaguacgugaagaaaauauauccuagucuguaggcacaguuaagguacuugugugugugcacaugugugugugugaugugcacaccauaacaauaccuuuuuuuguguaguaccuggcucuuuuuuucucuuuuccuuuuuuuuucuuuaaaucucccuccccuuuucccuccuuccuuucuacuuccuccucuuuuggucuugccagcucugacaguuuuauaaguuguucuuuuuauccauucuuuaacuucuuauuaaaaagggauuuuuuaaaaauuuuauuuauuuauuuauuuauuuuagcuugguaugguggugacaccuuuaguaccagcacuggagaggcagaagcagauagaucuaaaugaguuugaggacagccuggucuacaaagcaaauucuaggacagccaggacucagagaaacucugucuugaaaagccaaauuaaaaaaaaauauauauauauauacacacacacacauauauagacauauagacauauauacauauauauuauacuuauauauaauauaaguauauauuauguaaugcaauauauuacaucuaauuauauaaucaauauaauauucauacuuuuuuaaagaaugaaaaaacacauuauagcuaggagaacuugccaagguuaaaauuccuucagaggucaccaaaacacuuugagcuagauuugaacugguugcaguuguccguggaccucgugugggcuuucacuuaauuccugucuauugccauagauuuuuaguugucucguaguuuuggggcaggagauggagcucaggcugucagauuuuguuguaaaugcccacugucucaucugaaauucugaacucugaugaagaacugaaugaagcuuucauuuuauuuuuaugauuuauuuaguuuggugccagugaugggaacuagagccaugcacauguuaacuacauagucugucuaccauugagccauaccuuuaagccuuucacgccuuuguuuuaauauauauucaugcaauuacaauccuguuuuuuuauguuuauuuuuaaauuuucaguuagguguaugcauguguguagguacaggugccugcacaugaguucaggugccugaagagaccagauugcauccugagguagauaguagguacuuuuaauuauugaccuaucucgcuuaacaucuuagguuuuaaauauugcaaauaguggcuguauuuaggaacuauacuauauuacaugugauuaauuugauuuuagguugcuguaguacauuugcuucuguaacauuaaugcuuauugaagaacaugauaagaauauugucaugaacaacauagcuaugaaugugagucaaaaguugucccucugugugguauauauguauuguaggauuugacacaaaagggcacacaguaaguugaucaaagauagcaugagaaaggaacucuacugagacauauuaggaggacuuaguguugguaaacguuauccaguuggagauguuccucuguggaaagcuagauuccuucuuaguagauuagaaguuuaucuugaggguuaauggccaucuuguguuaaaaagacaaccauauauguguaccaguauucagagaaacauagagcaccucaaguuauauuuuuaguacauucucuacuguagucuugaguucuguguuugaaccucucaugccagguuagugaacacguguaaaaugauugaaguauacgaguauuuaaugcaaaugccacuccuuccuuaguuugcauauggccuaggaagaagagaaaacauguauguauuauguaugcccuuuuguaggaguagagucuugcucucuacacugggagccaugcucuuguucacguagacugaauuggaaacauaagauuuucuucucuuuaaggaaaauuaguaugaauucugugggaaggggagucaaaagcuuuaaaguaauauucugcaacuuuaaggauucccaguugauagagaauaauuuaacaugucucuuaaaaacuucaacuuuggaguuucuccagcuuuuuauuuuagcuuuaucuuuggcuuuuuaguuaaugagacaucgugaaaaugauacuuuagucucugccuggaguuauggaaaccuucaauacuguagaaguuuaagagacucuuggagacaucauuauuauugcauggugguguccucuccucuuuguucaaaucucuauuucuagaaaacaguaaauaauugagagcuauugucuuaggauuuuaaacaaauuguacucauauuugccaagugaaucuagagauaguguuguuauggugcuuugaaaacuuauuuaggagauaacagcagauuuuggggagcacaggaaaaugcauccaucaccaauauugucccuuuguccuguuguacagcacacagucuuuaggguuuugccuuggacccaccuugguccuguagcuugcccacuuugcuguuuugaaguaguuuuucauggaaaucuauuugaguaaauuaaaggcaacagaaaaaguaugaauuaaucuucuucacacuucuacucugucuuuaaguacccucuucuguaucuugaaauauaauuugugguauaucaugaacagcuuugaacuugagacagggucauacuguguagcacagguaggccugaaacccugagccuucuccaucagucucccuaguucugagguuauugcuaggagcuacagugcgcaguuggacguuuguugaauguuaauuccaaggcuugcaguauacugugagaugacugucagcuugucauggcgggggaauaggugagggucagauuccccacugauaccuuccaugcuugggauaaagcauucuaugcacucauuuuuuuguuaccucugaauucacuuucuucuuaaucucuagguauuucuguucuggaacuuguucuguagaucucuacagaagagcaaccugccucugccucucgauugcuggaauuaaaagcaugugccaccaccauaccacugcccugcccuuagccccugucuuaguuacuauuuuuugcugugaagugacacaaugaccaaggaaacuuuuauaaaagagaacauuuaauugggggcuugcauacaguuucagugaugacucuguaacugguaugguggguagccuggcagcagaaagaccagcugacaugcuguuagagcaguagcucagagcuuacaucauauccacaagcauggcacacagagagagaccaauugggaaccaugugagcuauugaaaucucaaagccuauccuucaugacacaccucugcuaaugaggccacaccuccuaguccuuccuaaaugguucaccaguuguggaaaaaguauucaaucagagccuguggggaccaugcucauucagaccaccacaacuccuuauaaguggcauuuguauggauaaagguggcuuucucuuagaacccagggaaguaugaguaagccaaagcaggucugauuuccaagugcauuuaacacauguugugguaauauuaggauauuaguaauacagaauuggugcuucuguuuugcuuauuucauggaauauuuugaagaugaauagaucuaaaauuaaaaauccucaguuuagguaauuaugauaugugugaaguauuuguaucaauuuacucuccccagcuuauuguuggaguaucucuguacugugucuacagugaauuccugggacauuuauacuagggguacccuuacuugcaauucucuggucaucuggaccugucuguccaucauguagaguagaaaaagcuaugcacacuuuagaucuuuugccucuaggcugucauauuauuuuaauugggaccuacaucacaggaaacaggcugacauggcagucuugggaaagcugcagaggaaaccucccauucauaaaggguagugauaugugauaccucuaugggacuguagauucuguuauagacccucccugucuuagucaguauucuauugcugugaaagauaccaugaccagguaacucuuauaaaagaaagcacuuaauuggggcuggcuuacaauuucagaaguuuaguccauuaucauuguagugaggagaauggccgcauacaggcagacauauaggugcuauagaguugcugagaguucuacauguggaucugaaagccuaugccaagugacucacuuccuccaacaaggccauaccuucugaugucucccuaaugaucaagcauugaaauauaugaaauauaugaaauauauaugaaauauauaugaaauauaugagccuaugggguccauucuuauuccaaccacuguacuucccuagacccaaccuggugucuucuuucuccuuguuaggaaugggaagugggugagagagacugacaccacuccagugagacaguucaguggguaaagguacuuguaacuguuucucaaaauuguucuuccuugaagaguaaugcuucccacccccaccccuccuccuccagcguuuccugcagugucaauugcuaauaguuucuugguuagugguggaacuuugugucuaugugucuccagguuggaaauuuuucugguuucaaccaguauagaucucgugugugcugucagucucuguguauucauauguguuaucagccuuguuauguuuggaagacauuguuuccuuggagucauucaucaccaggggcuuucuuaacacuuccucuuccacauaaaucucugagccuugaggcaggacggguuugaugaggacauccuacuuaauaugccaaagucucuuacuguccauuauccagaugucagucggucucuauguucauuaccgucuacuccaagaagcagcuucucugaugaggcuugagugauacacugguccauagguauagcuauaugucauuaggagucauuuauuguuauauuccuuuagcagacagaauauuauacuagauuuuucuguagggcccaugaucuaucuaguuucagguuuuuggcuucuuuagcaaugucaaguaugaauucuaucugauagacugggccuuacuccaaucaaaacuuguuaaucccauaacauuugugccaccauuucucuuacugauaauuacucuucucuuccaguaagaugcagaguaccuuacagcaacacagauucuaguuaguagaggucaaacuucuaguggguaccagcucaauuugucugcguuuaaugacccaaguguugucaguguagggccuuacuuaccaucagguuguggaggguaacagguagccugugauguuuaggguuagguauauggagccccauuugaccaaugacucaacaagguguaacucauuccuggcacugagauguauuucaguucuaaaugaagaaagcuacuauucuuuaguuucaacaaagaaagauauaugggucauuguagguagaacaaaauggugugcugagagguucugcagagcccugcacaguggugccugccagcuuugucuucaucugacugugguaaaauucugaccuuugugaccuuuaguugaaguguucaccugucuucauuuacuacucuugcauccaucuccaugagccuuuguauguacuccauacucugguccuaguagugaguguagacucacuuucagcugaauuccagcacauguaguuuccauguuuuuggagugaauccuggguauaugcuuaacaaagauggguuuaaacaagccuguguauguggggcaaugcauuuacaaaaauguuauuuaugcuaccccaacacugaauuuuaguuagaaguugucagucaaagaguucugucaaaggaggaguggugucuccacucuguuuacaaaacugacugaacuuuugaagugaggcuggagaaaugguucucuucagaaaaaugguuaggcucuuuuuugucaagccaucuagauuaaaauaauagaugauggugagaaauauuccuuuuaggcugauuuggaagaaccugcagacaucauugcucuagacuaacaugcauuggcuagcacugggcccuucugaaagucuuaccagugaugaaagacuguuaaccaccaagugguuugcauguucaaucuacuguucugccagaauuccuuuaaagaaauacucacuuuacauaagacaaaauuauaguagggagggacuacuacucagaaauccaaucagaaaagauucagccagugcaucuuuguaauuucaaacuuugauaauaaagcagaaguuuauuuaauguuaacugcacugcggaugccaugugcucuuuccugcuauucucuaaagcuuuaaacauugggaagccaaugccucauuucuuuuuguucacauucaugucuaaacuggguuguuuuaguuagagguaguuuccauagcagcgggugacuuugccuuuuuuuuuuccuuauuggaugaaacauuuagcauaggucagccagaauggcuguagguucuggaagcauuguauguguuccuuugacuucuugggguucaaggcuacucaggaagggggaacuuggaauguucaugucuuguguacccauguucugcucaccuuguauaggugccugguaucuccaaugugucagagaaauuguuuucugaccugauugcuucuucuaaucuuauacauuagaccuaggcuuaaggacagggguacacacuucacauguggucuugguuuuauuuaugcuucuuuguugagaucugcuugucuugaauugugauguggugacagugugacacacauacaccugucuucuuuucucccucugcuuacugaagccuguguucugauuaaaccuaacagcuagguuuuuggugguaauguuggcuuaacucaaagcuugagguuauacugaaaguaauuauauccugaaagggauauguguauguuaauggugggccaugguugccuuuccuauacagacaacccaagaugauuuuacucuugcagguacuugggguugugauaaagacucuuccucuuggcaaggaaugcaagcccauauggcuaaauaagugaguguacaccugcugccuugauugccuucauggcuauuauucugcuuuguuagaauuuucgugcuuaugacgaaaaggcaaagacauguaaggugcaugugggagguguggauuuccagaacacuggaucguuauuaucuugccuaacucaguguuucucagaauccuuggugaaggcaguauaucuccucuuuguagauggaugcuccuuuuagucagaagaaagguagugaggaugcugcaggugaagagagcuuaaauaacaguggaaagcagacuggaagugaauggaacuguuggggaauugcuaggauuuauugugugccauggcagugcugggcaugugauaaauagguggcagcuuccuuagggaggugaggcagcauagagucagcaaaagccuugcaaagugaugguuguaggauguuggcuauuugggggaagcuccauguaguuuggaauuggaaaguacauugcaaaugggguaagcaugcaagcaaaggagacuuucaaugggauucuaacccuaguuucagagcccaguguuucugcuuuguacauguguaaugaaauccucauuuauaggugggcuaggugugguacaagccuagaauccuagcucucugagagacugaggcaggaggaucauaaguucaaagccugccugaacuacaguaugaguuuaaggccgccuaagcaacucagaccuugagaccuugucucaauaaaguaagaaagaaggcugagugagaauauggcucacacagcacaacaccuacuucgcaaguaccaggccuaccugccuucuauauuccccucauuuguaaauugaagaucauauauauaguucauugaaaauaauauauagagcucauaaugcgcaugaugauuaaaugaauuuuuuaaauuauuuggcauagaauaaguagucaauaaacaguagccuuuuuucuucuaccuuucccuguuuuagucaaaggauucauugaauucuccaaaaggcaguuauauuaacaaccucuuuuuguaucaaaauuaugcaaaaucaguggggauucagggugccuuauuuuucuuuuaauuaaacaucucauaaccacaguuaaugcaggcuuauaaaaaccauguuuaaauuuagguuggcuugaauggaagaaacauggugagggaaugugagugacccugugugauugcgucacuuuccugauugugaacagacacuccuccagcacuuuaugguuuguauuaucagucuagguucuagagucucuacuuccacgcagaagaagaugcuugccucauccuggaaaaccuuauuuguaaaauaagcaggguggguggugaauucugaguauuaaaguucuaagagucugagcaguacaggaugaaauaccaaggugggaaggaggaaagccagguggauucucucucucucucucuuuuuuuuuuuuuaaaguagggcaugcacuuaaaaaaaaaaaauguauucacuuugcaucucacugucccccucccggucaccccaucccacaauccuuccucccuucuccucugaguguguaggcgggcucuccuggguaucuacaccccccacccccaggcccauuaaguuucugcaaggcuaggcaauccucucccacugaggccagacaaggcagcucugauagaagaacauaucccagggacaggcaacagcucuugggauacucccuacuccaguugucaggacccacaugaagagcaagcugcacaaaugcuacguauauguggggaggccuagguccagcccauguauauacuuugguugguggcucugucucugagagcuccaacgguccagguuaguugacucuguuguucuacuuguggaguucccauccauccccuccagggccagcaauccuuccucuuauucuuccuugaguccccaagcuccacccacuguuuaucugugaauguaggcauuugucugagucagcugcuggguggagccucucagaggauaacccugcuagucuccugucuaaaaagcauaacagaguaucauuaauaaugucagggauuagugcuugcuugcccaugggaagggucucaagaugagcagguuauuggcuggcaauucucuuagucucugcuccauucccaugacugcaauuucuguaggcaggauaaauuuugggugaaaaguuuuguagguggguugguaucccuauugcucugcuggggugccugccuggcuacaggagguggccucuucagguuccauauccccaaugcugugagucacauuaaucauccacauuaauucuugggcccuucccuuaugccaggucucugucucauccuagagauucccccuaccuucucaccauccaaaccccucccccaucaguuguagauugccauucauucucauggccaucuggccaucucuccugucccucccuucagcagauccugaccucccucccaacuccccuccccaucucuucucuuuuccauaucccuccuuccucugccucucaugacuauuugauucccuucuaaguuagauuugcacacuccucacuugugccuuccuuggguuuagcuucugcggcugugugaaguguaacaugaguauuuauuuuauggcugauauccauuuauaagugagcacauaccaugcauguucuuuuggaacuggguuaccgcacuuagggcaauauucucuaguuccauccauuugccugcaaaauucauguugucuuuauuuuuaauagcugaauaauauuccauaucauggauguaucacauuuucuuuauccauucuucaguugagggacaucuagguuguuuccaguuucuggcuauuaugaauaaagcugcuaugaacauaggugaacaaguguguuugugggaugguggaguaucuuuuugguauaugcucgggaaugggauaacuggguuuugagguagaacuauugaaggcauacacuuuuaaaguaaggcaaguuaaauagcuaaagcuguaauccagaugugaggcagugcuuuggcuguugacacugucuauauuuaaauacaguauuuagaaaucugggguuaaaaauugcagcaauugaaguaaaaauuuccaucuuucuuugucacaguuugugacugugcuaaauguaguuuaacauaguagcaucugcuuuagauguccaggauaggugaugacacuaaugauuaggaaaauguuuucuguccaguguucccauuucauaugagagccuucugaaauucuggagucuuguugcccaucuagauguuaggagcuacagaagggguuauccaagcuuaaccugaaagacugacagauuuucuaugguagcauuuuaaagaagcaguuuucuuugucuaaugauaaugauaccagccucauacucauuaagcacuuuaguuuguaaagugcuuugaccuauuuucugcuugauauuuguacauaacaaaaccuuuuaaagaaaguaggcccuuuccccccuccccguuucucucuuccaagaaaauagauaauucgagggcuaaauaguuugagucucuggaaaguuuuucuuagguucacagacaucucuaccuucuucauuccuuguagucaccaggugauaggcccuguuuucaauaacuugaaaauaugcuguguauauuacacaggugauucugcacacagagacuuacacguuugucccacuguucaguucuaacucagggaacuagcccuguggacuuguagugaccuugaagcauguauuuggaguguucucugcacuacuggugugaguauggcaugaagucggagccacagaaguggggugagcacagucuuugcucuguaagagggcaggggcauugccugggggcugaagcaccuugacuuguuucccucuuagaagggaugucugggucugugugagaggugggauuaguagggugugaggaaaagaaaugugucccuguuguguggugguagcucagcuuuaacucauggacauucuuaggcaaccuaucugcuagaaauguccuugggaugcuuccaccaaacucuccucucauuggaauuaaaaauaaaaaauuacauguuaauuggugcaaauuguuggaauguaguaaauaaccagaaguuuaauuuccauaacaagucacagauguaccuaagccauuuuuuuuuccuagcugggauguagguuuuaaauaaaacugccauuagaggagagagcaggagagcuggaucaaggggaauaaaauaauuaucuuggugugacucuugucuuuaaagaugccccaacuuaccucacuaaauaauucauauucgugugucuaaauugaauucauuuacccccuugggacuucacacaaccuaaaagaaaaauguuacauagguaaauuccaguaagaaggcauacuuuucugagauaaggggaacggauuaucauggacaagacaaaggaggguguuacucugcuuccccgaugccuuccccgaucauuguacaguuuuauguguccuaguguacuaucucuuaguuucuaguugcuucuaaguccuacagauuaguaaucuugcagcguuaugaggaaaauauacauaccuuguuguaucagcugacauuucagaugcuuuuauuuuauauaaacugcuuaggguuaaacgcuaacuauagcaguugagauucuucuucucuuuuccuuuuuguuuuuucuuuuucuuuuucuuuuuuuuuuuuuuuuuguccuuuuaaaugacagugaagaguaaaauguuacccuaaguggccauauggaggauuguggcccuuuauaacaguugugaguuaaaaagugguauuucuguccauaagccuuccuugucuuuuauauucccuuugaaauuaagcauuucuccuguucuggaucuuaaauaugacagaauauuuuagugucucuaucauacagaggaaccauguuuuuaaccuaccuuaugaaaacacucaacuacugggauuaauuugaggauuuccaaucagccuuucacaaaguguucuacccugagggaguuccugauagcugugauuucuguagaagaaugugaaguuaauccaauuucugugcugauuacuaugugagcugucuuaauuuagcaguucacaucuaucugccuguauguaacaacccugcuacagaaacagaaggcauaauugacuugauucucacuguacuccuguucccuuuuagcuucugcagccaaauaaugccuuggaaauuaauuaggcccacugaggcugggaugaaagaaugggguggcaaugauucaucaccagaaguuaaugguuuaauauauuccaugcuuuaacccagacauagucaaaccacaggcccauuucacuauucuacaguaggacaaauggccccauugagggggaguguacucucacuucauauuuacuaaauggugucuguaauuuuaaaacuuuuuggggaaaacagauuuuucuuguucuagagugauuuagauggauuccuaauacaaaccaacucucuuggagugguggcaaguacguucacucguucauucauucauucauucauuuguuccuuuguuguuucuagacaggguuuuccuauguagccuuugcuguccuagaaugagcucuguagaccagacuggucucaaauucgcagaaaucugccugcuucugcccccgagugcugggauuaaaugcacgcaccaucaugucaggcagggguggugauacuuuaagaccagaucccaugaaguagcccaggcuggcuuuaacucagucauacaugaggccugggauugcaggccugugaaaccuuguugcaggacuuuagccuguaaaaugaaaugauaguugaguuuuacauuugcuauuaaauggaugaauacugaauuauuuuuugaagaauacacuguaaagaauucuugcagagaauaagcuugauuuacuacccacuuuuuaugcaagguuuccugagauuuuuuccuucucuuuuuccagcucucuguguggaaaccuuuccuuuguuuauucaucuuguauucuuagucccuagcaaauaaaacauauuuuggugaucuuguucaaauacaaguaguuggaaagaaagccagguuuuuugguuuguuuguuuguuuguuuguuuguuuguuuguuuuuugguuucuguuugcuuuguuuuuuuugauggugaauuuaagcaguuugcugauacaaaguguaggcauugagcuauaugcuuucucuagaguauauccagaauuugaugguuucucccugacagcaccuuggucaaagucucugucauccuuaugugccuggguuacugugaauacuugccuggccucauuucuucagaugugcugagcccugcugguccucccacucaggagccacauagaagucuuuaucuugaacacuuuuguaguuucuuuucuucagaugaccuucacggcccuaugcgaucuggcuucuucaccucucugacuagcugcucacucuccguguagcucuucauugcucuacaaagcagccuaacuuugacaugccuggaauauuugucuugauaguucaguggggucuacaauuguuuucucuuccaucccaaauugcuguaacagaacaaguagcagcuuuguuuuuuaaacacaauacauguacugucugacagcacuauaggucagaaguccguucaaaguaggucugagucauugaagaugaaguucccucuggagccuugaggagaaaagguuuccucaucugcuucauccacuuuaccuacuagaggcugacugaaguccucaugaugcugugacuucuggaaagugugacuuucucaucuccuccuuugauguacaggagucauggauaauucucugcaaucuccuggguggugugggacaaccuaauguuuauaagaucuguuuauuagcauucuuaauuccccuugcuguguaacaugacagauucacagacuuaggggaauggguugcagacaucuuggguggacucuucucucugcacagcaaccagcuuacuuuucuuugaaaaaauacugccucaaagguuauccucucaaugacaucugcugucuauuaauugaaacuaccaccauuaucuccacauucucaaugcuacuuccucugcucuacauuuuccuucauuucaaagcaugcuuucucuauauguguucuuucugguucugcuuuauacguccucuauugcacccugguacuuuuuuucuugcagucuaauaaaacuucccauagacccuaagaggugcaugcagaugucuguugaaugggggagcaggaagggaagggugagcaagucuuuuuaauuuaauuuauuuuccaacugacgaacaugauuggcuauaauaagcacaggacaaagggaugaauuuagggcccugaucucaccuucauccacaaagccuuuaauccugccagcucugaauccaaaccuacagaugcaucaaaagagacuugacuuguguguagaagcuguaaugggccaauagauaggucuagcugcugaagaaaguuucuuguuguauuccugcaguggguugguccguuucuaaucucaaggacaaauaucugagucugagguugaagaauucguggagccgaugagauaaaguggcauaagguugacuugacaggaguuuuaugauccagggguuucuaugaagcuugaagacuaauuauuguguaggaccuaugaaacaguucuaaagagaacacaccaacuguucacccuuguaaucauggguucucucugauuucaaagcuugguugaauauucuuuuguuuacuucaaaaaaaaaauccagaaauguaucaugaagcugucccugucaaggaguucagugggaacaauaaaguauuaacugcagcaguggugaccccacagacaugugauuucaucuguccucaugcugcuuacucugcucucauaauccaugccccugccuacuuuauguuccaguuucuuagcaugaguucacuaaaggaagaaggugucugaucaggauuccaucucccccaacucuacuuuuuaaacuuuagagauaggugacuuccuuccaccuuguaacucaaacuugguauuuagaggaagucuugcuguacagagggaggacauugcuaggguucugcucuggugauguacaccuagcccugaguguaaaguccaaggucauuguacccaaacuggauauuguagucugagagagacacuuguccuugccuuuagcgaugauucuuuuuuagagacaucauuuguauuugccuagccuuccuagccaguaucaaauuaaaaccauuuaagaccuguaacuuaauaauggauuucugaauucuuuuguaucaaaauuuauuuucuuuuggcuuggcuucuguucucuuggcuuuugaccauuuugcuaagugaucccaaaagcccacauggucuaucuucauaaccucauacuggacagaggcaugaaacuuaccugugccauauuucaggauuuguuuugacuuuugaguuuuuauaguuggcaaauguucuugauguagaaaucacacaccuguucacuucagagauaaaugguuuccuuugcuaaggccuguaauaccaauguguauuucagggagugaagguaacugguggaaugcucccaaaauggaaaguguucuuucauuguuauguuuguugugaaauauuugaggcaaggcagaaaaacaaacuguugaguuuacauauauuaaagauggugugauucacccuuucaaaucccuaaacucugaagaaacugcucuuguucccugguacagaucuuucaaagggagaccaucagcaaagcaagagaguaaggcacugggcuuguuugagggacaaagaaggcucagaugccaaagcugguaauaauaaaggaugcagggugcucagugucuguaguguaccucguguuugaucugauaggucacagguggcuguugaugguuuaggaaaagcucccuggaaaaguuaaugugacuugagaugaggaagggccauuggagaggcuauaagucugagaguucauaucacuuuuacuuaauucuccacccccuuaaugcagugguaguuuucauacucucaggcuuaagucaugauagaccagugugguaccacugagccagauugccagccugggaacugguaugaggguggcacacacagcagaggaguagaauguugggcacacugagccagccuugguaggagccuuggaaugaaugaucaucucgucacacugcuauggcucugacuuggauaggucugcucucucucuaucugauggaauugaagcuuaggaauccgcucuccuagcucauucaugacaccaggugaauuugacaggagaauucucaagauauuuuaaaaguguuuuuugacuagagucugucuuacauggugacucuuuggaagagguuugaaaauagcagagauuaucuuaguuuacagaauguuuuugcuguuguuuuguuuuuaaacuauggagauuaagaaauggagacuuuucauguuuuuauauguagcugggccagugugacuucucgaauucuuacuguugccagcuaugagaaacacagugcuaguuuugaucucagaauuccaccaguguuaagaacauguagaugcacaaguacacaguaauguuugcaggaaguauacauaauugaaagaaaaaaagggaagaaaaaaaugaaacauggaaagcuuuagugucugugguagcgaaauuauacaaccacgaagagaaaaagcucccuuccugccuugcccugugaggcccauggucccaucaaagggauccucaccauuaucccuuguagcucaaugcaaguauagaauauucuagauugauuuaugaaagugccuuuucauaaguuauugugcugagaauaacaggauaaaaagcaaucugaauuggcacaauugaugucuaaauuaagagaugaacauauaugaaacauuuuuuuaagccuuaaaauuaauggcucuguuucacugcaauacagacagcuuuuucuccuuuccaaagagccucagagccaguagagccuauaaauagcgcacagccggguagucugugguggauugaguggagcaggaucaccuguccuuaagugaaggggaaguagcuuuacauuuuuaguaacugaauuguuggccagcauaaagguaagggccgugugagcaacuuauuuauaacuucccauaaaggugugugucugccucaagcggggagacugucuggcucugggaauguaaaagugcaguggaaucacuuuccaucagcggcuuucucagcuuaguggcuucagugagacuguucacaucucuggggcuugcagaggagggcugucaggagaucagcucauuagugucucucucuuauggaacauaggggaugaggccauucaaucauuuuaaccaugguuuuagauaauguuugcauauuaacuccugaauguguccugggcauacauuuuggcuugguuuaaccuguugggugugguuguccugcuccauaguugggcucuugucaaacuauuucauggcuauaaauaaagcacuuuacuaucucagguucaguguaacuguacgaugaugaacuguacaaugaaagacagcaggguuagacugaauucucuggcuaaggugggagaaaggaaggacagcaggacaucugcaugcaccuacugagaaggcuuuaaauccucucacagaugccagaguccacucuguucacauuuccugugaaucgugugcagucaggcuuugcacucugaagcucaaacuugcaauuccuaaaauauaaggagauaguuuucucagcccuuguucauuauuuauuucugagucugaauuuuccuauugcuauguuugucauuuuaagcauauggguauauagcuaaaaaguaaagguuggcuuuugggccaccaucagagcucuguuuaguuuucaggcaagcugaaauaaaggauaaauggccuauuaaugcuauuggaggccucauggcaggacuaauuuucaacuaugcuggguucacaauuuacauauuauaaaaauguucacuugauaucauucggggacaaagcugacauccuaaacacucauuacuccaauacauacauacauacauacauaauccuauuuauugauauaauuauuucaauugaaagauacugguuuacugccucuugguauaugugaacaguucugggugaaacuggcagagacuagugugacuguaguggcagaauacccucaggggaacucgauucccuuuuaauuugaagucccaagauuaaggaucauuuguaguauaauguaacagugugggcaaauacagcuucgcuuaaugucccuuugauauuuaggagagagaaugcuuuuaugcaaagcaaucacuuuaugaaucgcuugacugcuuuucucacuaaaauuucauucacauuuccucccuucucccacauccaugagaggacugcauguaguaguauuuucauuucauuuauuuauuuauuuuuauuauuuuugaaacggaauuuaaaguagcuuuuaaagauagcuaucaagacaaguagguaguacuguuuuaaaaaaucagacuuuagcuacaaauacuuaaaauuuaugcaagaaaacuacauguuaaauuaaauuuggagagauuagauuggaauugccucaaauucaaugaagccccacugcauggacgaugcugggaagaugaagacaaucacuguaaauuugugcaagcuaacauguuacauuaccuugcucuacucuaacguacgguacuuuuuguguccauauugcagacggcaacuccaaacuaacauggcagucagacugugugauguggcuucucugcuuagaagcgguucgugggcagcagagccuuggaccggggucugugggauuuuucuuaaauucuguaggcuacuuuuuuuuagcauguugcagaagugccgaggccauaccaaacacuugaaucuuuaauuuggcauacuacucauucuuacguacuaugguauggccaucauuaaguauuaaaagcacauugcaauuuuaacuguggugguauauauagaucagaaccgugcuguuauauguaacugaaauaauugaaauuaggacuuuagugcagacucaaaagaaugacaagcuuuuuuuuuaaaaaacaaaacaaaaacaaaaacaaaaguuuugguauggucugaauacuaaguuaccguaauucuuuacauucuguuuacuauguauuuuuuugguuacuacauuuugaaguuauuuacaauuccugauucuaaaaaaaauuuuugaaauuguaaaucuggcugaaaacuauuugcccaguaacuguugaagacugugcauucugugaacaguuguguugagccuaucaauggaauaugcauuauuuggaaaauauagcacauuaguaucauuuuauucagagcagaugguccuauagcugaaagaugcugugauuuuuuuuuuuucagugcacacagccuacugcagcuguucacuugaauguuggcuuaggagcucauucuugccaccugaacauggaaauaaaugugcaauuaagugagaguguuugcuguccuuacuacacccuacuaauuucagucaaugaacgcuuauauuucacacaccaucccagugagcucuagacggaaccucacauuugggguucuuguacuuuguguaccuacccuuacuuuugcauggugguuuacuuuaauaggccuuggccacugucucucauaguacauuguuuuuacaguugcugaguagagguagcccgaugagaguuuuguugagaagaauaauucacaaccaacccacaaacuggaacagucagacuuuuaccagauuuucaaauaaugucaauuauaauauauuuugauauuuuucucauacagaaguccaaagauuuauuaauuauucuuuaaguauucacugagaauacuuacccaagaaaaguaguuuaaaucuuggggugguguggggggaguucauuucuuuggaaaagaaaugaugcuacugaaagguugcacauugauuauuuccuaacuacucuggcuugaguccauuuuuaucuugauuauacugauucuugucccucagcagucuggaucuggucaguuggcuagucugucuggugcugcuuucuuacguaaacuucucuuggcaauugacauuuuguauccauagauguacacuuuuauuuuuucuuaggcaauuugcuuuuuaaaagacauuuuccccauucaccuauaaucagccccuuucccccucuacuuugcuuuuuuuuuuuuuuuucuuuuaucaaauucuuugccuuuccuacauuaaagccuccuaaagcuagcaggcccucagucugcauugucagggcggagcaguucuguggggagcugagagguauauuggacgugacagaguguaaucuuuucacugaugauuugauuuuuggauucccccauagucuuggcuguccaaaguuggacgauuauuggaaaacacuuuuggagagaguggggcugugguucauaacucaaagcccaucaaauuacuuuuagggaacuacauccaaaauuguauaauaacugauuuuuagaguaguuggaacuguuucaggcaauuucccccaacucugcuguuuaucuuuuguuugguuuauggacaccuuaguacuuguguuuucuauagccuugggcuggccuguuuggagaagguguguuuauauuguuguuuucaugaacuggauaugcauuuuugguuuuguguucuuaaaauuagagucaaggcaaaaauauuacccugaauuguuuguggaugcuguuuuggugcuauggaucaaauauuuguugaugguuaucagcugccaaauugacaaaaugguuaaacagagucuacaaauguaggcgaaauauucauaguuuuacucccaaauuaaccuacccuuucacuucugaacauauaacaucuauuuuuuuuuaauuucuuaccaaugauagcgguaaaaaauaauguuaaucaaaaauauuucaguauguaaccaaaacaguacauguugacaaauuuuuaauuuugaaaguacuuuugcuccuuugcuccuugguuuuguuaacggaugccugucagucuuagauaauugacucuuaugaacugaagacucuucuucagaauuacucuaucacuuuuguuuguuugcuuguuuguuuuggcagcauguuaagcauuuuuauuuucuagaauaauuuuuagucaggacacaguucugugcccuuugguauuaaaucacuuccucuguggauacuacagguaagugaggguauaugacuauacucaggauaugauucuagaaaauguugcaacauuuaaauugugcuuaugugcauguauggaauauguauguagaaauauaauugcagccuuauguugaauagcuuacuauggaauacaauuagcguaggugcugcacuuuuuguugaagcuuuauuauaaccucagcaggaugacuuguguucagugacaaguguuucacucuuggguggaaucucuaauagguugugaaauaugaauucugacauuucuuauuuucucuguuuuuagcagguaauugcugccauggaaacacaacugucuaaugggccaacuugcaauaacacagccaaugguccaaccacuguaaacaacaacugcuccucaccaguugacuccgggaacacagaggacagcaagaccaaccuaauagucaacuaccuuccucagaacaugacacaggaagaacuaaagagucuuuuugggagcauuggcgagauagaguccuguaagcuuguaagagacaaaauaacagguaugcaauuuuauguagauguaugacauuuaaaggaccaugggucagaauaugagaaaaugcuuugggaggccauaucugauuuuuaaauuauuauauauauauauauauuuuacuguugucuaaagaccagaucucacucuguacugcagguuggccugcagcucaccauguagugaggcugcuuuugaauucauaacagucccauauuaguguacugaaugcugagacugcaagugugagcuaccaugccuagacguauuuuaacugaacacugaauuuauucugagaugugugugugacaguuuaaccuuuguuucaucaguaccccugagcuugcaugacugaacauuucaacagugaacgauaaggagaauauuuugcuuuacaaaggggaggggguaccuuaaaauaaaauucucccacuaagucacuuugguccuuuugcuucuaguauguaugaaaaaauacuggcuaguauguuuucaguuaaauaauugcagugagagaaugagagaauaaugggaguuggugcucuguuucuuaacaaggaaagaggauguggcaugugggcauccuuuuuacuauagagauaaagaggaaaagauggaaaguugggccuaaguagcuccccauuugcugaauuugaguaauagguaguuaagaaauaauauuaguauaccuuguaaaaaaucugaguaaguucuuuuuaaagcccaaaccuauuuaaggcgcauguucuuggaauaggaguuaagggcuccuacuggaauuguuuuaaaauacuaaaaccauaugacaugacauuaaguauagauagaccccauggucuuucaugugaacuuugguaggucauacaacuacuuuacacagucugugaacaagcaaaucauacuaaguuuugaagugacucaaauuuccuuaaaagugauaugaagggucgggccaggcaguugaguaacuggucaugugaccaugaauaaguuaguuccuggcuucagcucuaguuaauugacaguaagagcagagaucauacuggggacauuuaggacuuccaucuaggugauacuuugagcagcucuguaaucgaagcucagagucucauuuuuucaagaucucuaagugccuggagccaaugucuaugcccgagccucauuguuuuguucucugaagcuacagacugaagaccacagacagguuauccauucauaucagaucaaaaagaaacccauugucuccaagacauagugaauaauccugucuuuagcuaguuguguugcuucuguguucauuaucuuaucaggagaauucuucaguuguugagaacucacacucaaauuuccuuucaucuuuguguguguguguguguguguguguguguguguguguguguguguguguguuucaaggaguaaagaauggugauugaaccaaacucuucauucaugcuauaggcgaggugcuaucacugagcuguauuccuggcugcuuuuagguuuccuuuacaaacagaggaccaccaguauaugaauuuaauagagagguuuugaaaaguugggcaagguagaaaacaauucuguccccuauacuggauuuuaucuuuaauuuuuuaguacaaauuuuugcacguauuuuuuuuaggcuauuugaaauaaguaaugaagugugauaaauggcaugcaggcuguaacaucaguuucugugauuucuuguucaauugcucgguggccacccuaccaauagaggaugaagaugcuugacuagucuguaaaaaaaaaaaaucacauuucuuuuuuaugaaacugggagugguuaagugaaaacauuaaaaagcuuauccaucuuucauauuagacauuugccacagaaaucaucuuaggggauuuuccguaucuuauccguggguagauaucagcuggaaugaucuuauuuuuucauaagcccuuuacagggcuguuaugaggcaucaugggguaaauuugaguucucagucuucgcaucuaugggcucuuuggcuucagugcaguaagcagugguaauggaaacauggcuuaccucagacacagaugcugaaacggaauugauucuugauguucuuuugcuucacucuccuugcaguuagagagagucugugauuaugucauuucuauuaagauaccaggagaguauauuaacucacagcagugccuaaaaccagugcaagcccaagcuagaucaaguucagcguggcaaagggaggugggcacacaaucccgccccuaaccauggagcgauuugcaguuguuagcugaugagaaaauaagggugaguuuucuuuuaagaguguagccccugguaaguugacuguacuccaguggaagaccacacauucaagaauauuuugggucauacauacuggucuugaggguuucaaagaaaauucuuagauagagggauuggguggauagagaacuuagagggggugaaucuaggaguuguuagugaggugaauauuaggcaaaugcauuguaugaaacuugaaacccuuaacuaauaaaaccugacaauuggaguuggccgugguggcucacuccuuuaaaaaguucuaaguucuaagacagucaggucuauauagagaauccccgucucaaacuccuucccccaaauaauaauaaaauaaaaacaguagacccaaaauaguuuaguaugggauagaguaaauacuuggagacagacaucguucuuuauauuucaauuuuuaauuucaacuugaaguuuuuauaaaauagucacugagaauauaagcaaaacuauccgaagagccaguagcaauuccaggaaaucccacagugacuggcauagucacaguguguguaucauaguuacacugugguuuucccauucauuuccuuugagauaguuuuuugcuauauaguccaggcuguucugaaacugaccauuauucugguucagcuuuucaagagcuggggauuagaaguguauggcacucaaaugguuuaaaagcuacaaaagcccccaacaauuauuuaagcacuuaccaaacaguuuagucugaaguucuugccacugugguucugucagaguugauguuuguguuuguaugaugaacaugguacuaggaaguguaaguuaagaagccuaggacuagaacaguggcuaagauucuaaucuuucauuauuugccugggcauuuucucuugcccauucuuggugguaagagcuugcuuugaauuuagcagcagaacaaacuaauaaauaauuagguagaauagaacuuuuacagagcuaucaaugggccauuuuguggagaggguguuguauuuggaaagagaauucaugaguuuugaggucaagacugaagguuauaccacauagauaagaacacccacauuucucucacagucagaucuuuggcuguguacuugaguguuuuaggucagugauucucacauuuggugacagauuugccuaagaaagagaacaaaaccaaccaaccaaccuuagauucuggacguuuuggaagucucaagucaaagcccuccacagcugauugugaaggcucagcaguugaagaauaaugccagucucuugaacuuugugggugcccaggcaucuucagaaaagccaguacauucuagcaaguacaagacacuugguguccuucagacuuccugauaggaauccugagggagucucagaauacuauaggagccugugaguaaccuauggaauuuucuuuaguucuucaggaagacaagagggguuccuaggucuucuacucauuugguauuggacugccugaguaaggugcugaaauugaggugccucauucgugacuagcuuaagcuuaaaggguuccuucaugaccacuggucucugaugaguucauucuuagcaacuaggacuggagguguuacaauucagaaucucggggcucugucauuaccgacuaccugcccccauggguaucccuuaagcaauuuacuuuccaaaaguggauaguucugucauaaucgcauuuccuuuucuuggaaaaggaagggcuccuagaguuacaguuugggccuuugcuaaugggggccccuuguuuuaucuugguguggugccucucucuuacucauugagggcaccuucugugcugacuuuauuugcauccaguuaaaaguuuuucaauagacacaaaaagaaagaccagauguaaagcaaacaaacaaaaccuccagggaugcagagacuuugcagguguugaucacccuuguuaguuuguaauugaaugguaaccagaagugguuuccucccuuuaggggggaggggaagccgaacuuuagagcugguuuuauccuuguuuacucuaccagaacacugugaguuucaaacauuuuauaggauucucccuccuuuuaaaaggaaauguaaucuuaacgccucaggauugaaauagauaaugguaucucuuuaauuagucuaauacauaccuucgaauuuaauagcauuuguuuacuuucagucauagcggacacaggcuguuuugaugaauguuaauuugaaaauacaaugcuguaugucaguuaugauuuggaguggauagagugucagaugaucaaaaauucugagacaaguaguuaacaacagcagggugugggugggcaggaacuucaaaaacucccauucugagccucuguguuguuuaaucauaagguuagcggcaaggcugcauguguucccaggucugaagcccaggauaaacacuuuguagauaccuauguagccugaacaauuuguuucuagauuguagagcuaaauuaauauaaaauaaaauuagcaucagaauuuuggaacuacaaugaaaauuugaaacaugucaaaccagaggaacuuguggauuuuaucaguauaucauuaguaaauauuaucuuuucauguaccuuuuuccuuuccaaaggucaugccaaaguacaagauuaacauuauaaagacuugucacaaaaguuugagaaggcauuugaauuuauuccagacucuuuuuuguuguuguuguuguuguguuacucaaacuguguguguguguguguguguguguguguguguuggggguauauggcauuugcaugugaguguaguguauggguaugugugugcucuugaaucuguaugaagcucagagcaggacaaccaaaucguucucacauuguugccuugagauugggucucauuaaacuacaagcuuguccaucagcuuggugggcuaagcaggaagcucuggguaucugccugucucuguugcuuaaagugguuuggccaugucaugguuuuuaacauggacgcuagaaaauuugagcucaaaucuaaauacugaagaaguacuauugcccacugaaacaucucuccagcccuauacuagguaguuuuaaaauaauguuuucaaacucauguguauauguauguaugccuacaugaauuuauacgcaacuaugugcauguaggaacuugcaaaaucuagaggacaguagacucccuggggcuggaguuauaggccuuuaugggucaccugauguggguucuaagagcugaaucucuggguucucuaagagcaguaaccacuguuaacuguugagacaucuucauucccuaaggucgguauuuuuauagaauaguuuuggugucgguguugauuaaugccaauacauaauuacugaaauuuauacauacauacauacacacacacacacacacacacacacacacacacauauauauauauauauauauauauauauauauauauauauauacacacauauacauacauauguacauauuuaagaaguuagauacacuaccacucucagagaggaaaaucuucuaaucuguuagauuuacugcaugaauugaauacaggaaauuaaugaaauucaaagaaguaguuaaauaagggggugaacagaauauuuuuuaaaaggaaaaguuugguuuuugaaggaugguaaauuagaggacagcauuuagaaaaucuauagggggaaacaaaauagaaggaagguuguuuuagcaagguuuguuuguaugaccuuguuucaggucuguaaugaccgaggucguuccuuucccugaugugggcugaggagcacaaagacccuagagggaaucugccuugcuuuuggguagaacaggagccaggcaggggucccugcuugccuuuguuugauucuuguccaucuuuagcuuagguagugcagaucauuuuagggugauauugugggauuucuguucagauaugaggcugaauuaucuacuguauuagguacuuuucuauuaguaagauaaauaccaugaucaaaagcagcuuacaugaggaagccuuuaucuuggcugauaguuccagaggagaggccguaauaguggagaaggaugggauugucacuggaaggugacacacagggaagcuggcugaucaccucucaccugaaagcaggaagcagagaaccaccugggagugggaugagguuauacauuauucaaaguaugcagagcuccucacaugcuaacauuugguaaacuccccagggccaucagcugaggucuaaaguguugaaacaggugaguuuguaaaggacauucuuacuuaaagcacaccuacucaucucuauacuggaguacagaaucagccugccuuugauguuuucacucauucauuaccuuauuggcuugacuaucauaacacuacaauuuauuuucuuagacuuugucagaaaucugaauuuaccgggauauuuuaaaauucucaccagaucauuucccuugaaugcuccugagcggagugcuuggcacugagguuagaagugugcuucagaacuugccagcuucaucagggcucuuuuucugcuaauugacuuucaccugagcacacugccgcugccacauucuguuguggaaacccuuccaugaaaaggucaacuagaacagauacuuccuggcauuuuauuugugaaugccauuugacuuguuaguucuguauacagugacuuaauuucuuucuuuuuucuuuuuuuuuuuuuuuuuuuuuacuccuuaccuuuucuucucuuuuaaguuuuagaauguuaaauuuugacauuguuagggccccucuuaauuggacauaaacaaugcacacauuuuuuuuucuuuuauuaaguuuugagggaagguuuuuuagcccauacuugguuugaacucauuggauagccaaggccagccucaaagaacucuccugcucccagcuugugagucuuggggcuacagaugcacaccaccauaccuggcucuguaauuaggucccuuuugagggcuuugagcguuagaaucgcaccgguagcccuuaaauguaucgugaagaaacagauacucagcuaaaaacgauauacuggggcugucggugcacagcgaucgaucucucagcagagugccaccuacaucucugucucauuugagggcugaccauaacuauaauuucaaauaaauauuccuacuuuuuacuuuauauauccucagaggaaagauuuuugcaagggauuuuguuuaagcuguguucuuuauucucauguuaaaugggugcaauguagauuuaucagaacuuucuaagcacuuauauuaaacacuaauuuugaaaguuauacuccauuuuuauaggcucagguaaugguuuaacugguaaggccaugagugagcaaacgugaaccuguguucaguuagacugcucaacgcuuacgugagaaaccugaguauggcuguuggcacuguaacucuagugugguaguguuacauaagacacuugaggaucuuggggguuuacuggccacuccgccuagcuaaaaagcagcaaucuccauucagggagagacccucucucaagggacucagggagaaugugaugcaagaggacaccagauaucuccuggcuuccaugcaugcucugggcacccaauuacacaugcucagacaugcaugcacacacucaucacuacauuuuuuuuuuuuuuaaucuuuggguugaagucuauccuggccauuuggcuuguuuucuaaccuuauuggaauuguuugacucugaacuuaaauuugguuuugggaaaacauccccuaauacacuuacuaucuauaauccuuaguuuccauggucugggaagaauacaaagcuuauuuuuuagccuauaugugaacaucaucccugggagauuagacaaagaaggaauaguaaguuaaaggagccuaggaagguuguugaugcuuuuauaccagccucggugagcuagagcucugcuguaugggaaguguucuauguggggugugugugugugugugagagagagagagagagagagagacagagacagagagaaagagagagagagaggagagagagagagagagagagugugugugugugugugugugauggucugacuuaaagcuugacucccagugggauauuacugaccuagaaacuaagcguguuguuacauuuagcuguaagguguugauuagcaaagugucaccgagugacuugcuugcacuuuuauugacgccugucccuucaacugacuaucccuuuaauguaaaucacaaauccuccugcuaacguucugauuucauccacuaaggcauccagauagagaaguacagagaacaguggcuuggauguaaggaagcccagcauuucugcaguguuagcagaucacaggacuuagaagaagaaaaaaaacgcugucucuuuguuuucuuuucuguugaaacauucauugaaaacacuuaaagcacugcuucguucccucacacagauuucuacagacuucaguuuguguggggaugcggggcgauuuccgcaagggcaugguuaacuuagcagaugcaguuuuacaucuuguuuuccuuuucuguuaaguccuuaugcauauugcgaauuagaguuuauuuuuaguucuuaaugaguccuucucucaucauuguacuuuuuguugcaauucuguuuucaacauagugcuuugauuucgaagggagcgaauguguaugacuuaccaauuuuauauuuacaccgucuucugcucaauuaaaaugguauguuucucuguguaggauaacagacuuauuaccuugcccaugaucucucauagccuguuugaccuuggacucuaccuuuaggaagucaaaucuuccuuuuaagaaaaacuucaggggagguauaaaugcagguaaacaauaaacuagaauuacuguauggucuucaaggucacuggaagguuuacugccucccucguugauguuuuaauguccucauaaggaagagcugaucauuaacaccagagucuacaaucuaacuguccucugaaaucuuccuaaccuugggacucauaugagaacucuucaucacacagcuggaauggaugaugguuccucuuagucugcuuuauauuuuuuuguuccauuaauuaauuuauuuauuuacuuuacaucuggaacccagccccucccccaauucuccuaguuccaaucccucacacagucccucucuccauucuuccaucucugccucuucuguucugagaaaagugugggcuggguaccauuccacccuagcacaucaagucacugcaguccuaggcacacccucuuccacugaggccaccauacaaagcagcucaguuaggggaacaagauccacagguacgcagcagagucagggacagccaaccccugcuucaguuguuggaggacccaaaugaagaccaagcugcacauaugcuaaauaugugcauguaugcuuguugcuuggugguucagucucuggaagccuccaaagauccagguuaguagauucuguuggucuucuuauugaguagguauacauuccaggucccucaauccuuccccaaaccuuuccacaaggcuuccugagcucaggucaguugcugguuggagccucucagagaacaguuauguuaggcuccugucuauagcauaacagaauaucauuaauagugucaaggauugguucuugccuaugggauagaucucaaguugggcacuuaccuucucaaacacaaagaauugugauuuaacauguuaaaauuucaaugucucauaccauuguuuuaaaccuuuaaauuacugguguuucuagguucuuauugaggggaugauucauagguguuagaaaagaugaaaauacagaauucucaauacugaucuguaacauauaugaauauacauccauauauuucccuuuauaaaguauuagaauccaaaagcuuugacagaaagcaaagguaacauucaauagccccuccuuucagguucuggaacaucuaucuaaaucuagaccugguauuaaaagucgauacagaaugaagcuagagggauaguuccgcaguuaagagcauuggcuguucuucaagagagccuugguuagauuccugguaccugcacaguacauuccaacugucucuuacgccaguugcagaggaacggacgcccucuccuggacuccagcauuacuaggaaaguucaugauauacagacaaaauaucuguacacacaaaauaaaaacacaucuuuagaaaguagauucagaguccucugugguuagcuuccuuccugcaguucagaguuuggaagacacuguaucuggaccuggucuucaguacaagggagccuuauguucuuuccuggcuuuaagccagguggcuauuuuccaaaaaacccucccuccuuuuguugaggggucacaagguaucagauuucuccaguaggugcugacaaauaagagugagaauuuccuucuguuguuuggcuuucccauuuacuaacucccuuuuccaaguacccuuccaugaagaaauguguucuaaacccucagaguagaaccauuauucauccaguaucgucuugaagcugccuugaggggcagaugcugacacacaugacguuaggaacaagugggcaguggcuguuuugcagcauguuagcuugucacugaguagaaaagucuucccuuuaaaucuuagguccacaccaagagcuccugccuucccauucagcaccagcugcauucuugcuguaacaaacauccucccacucugugacuggggacaucauuccaucucagugacugacaguucuugguucaggaguuggcuacugauggcugaaaagcaauuguacgugcuccuggcuuaacagaaaguccccccuccuaauuuuaugaauuuaaaauaauaaaaaacuaauauuucucaugguuaaagucuuaaacuuuuaaauuuacuccgccccacccccgucagugcugaggauugaacccauggccuugcagauguuaaacuugaggggggaggaagagguccucuggccaagacucuuaugucuuauuugaucacagugauggcgcugccguucagccugugugagaacuuuggauauguuugggaacaugugcacuguugcauuucugauuuauggagugaugcuugugugucaugguuggaguaagcagagaacuagucuuaggaggugggauauucagagugguccaggcuuuucuguugcuguucugagcuggagugcagcagcagucugugugguuugcuaaugauuugaugaguauaccaccugguagagggguuuuuguuuuagucccuuagguaacaguaagaggaggauuucucuuugguuuagauggaaagauuuguaaggaacuuugugaguuuaaggaaaguuguuucauuuucuuuuauuuagaccauucugcaugugacuucucuuuuauagugugauaggagacuaaguggugggcauuuccuccaagucagcuacagaaagcaaggccaauaaaaggacuaagagucacuuaggcaguuugccucaggauccagguuuaucuuuucaucuuuugacuguuuuugaaagacacagucucacucugucucaggccugaagcucagucuuccagcaauuuuccuucugagugcugggauuacaggcaagagcuaccagaccuagcucauguugauguaggcauuugaagaguccauggcaggaggagauugagguggagacauuaucugucuccuuugaugucucaguaacccugaggcugcucuauagcugccuccucuuucuuccaaucaccuuugcaucuauucugguaaguuccccuuugcuaauuagccagaguagauuuguauuucucuugauuugugccuuaaugaaucguacuuguguaaugcauauguuuaaugcuuucugucagagauagccuacacacacacacacaugaucuuauauaucuauaugauaucuagaaccuacaaguaagacagaccugaaauucuugucuuccuggaacuggugcaauuuauuccuauaguuacccccaguugugcccauuuuucugcagaugauauaauugucaucuucaacucagucugccauaguugucuccuccauuuagcugucuugaguucucagcagaaacuuuaugucuuaguuuauuuguuguguauuuaugccuccuaaguaccugcuguagaaucguaaguguaauuauuuaaaaauaaauucauucaauguugcacaguuauguugcaauuuguauaagcuuaaaggaaucagauaucuguucuggugagguuggagcagaagaagcuugaucaagaggacaccaaacuuugggagauggugaagagaaucuugcagaaaacccuaauuaggccauacauucuaaacuugaaaaaaaaaagccccacaaaauuccuuugaaaauugaaaaaagcuccacagucacuuaaugaauaggguuuuuaguuguucauuuuugaaaaucuuguuuuaccuuuuuuucucuuuuccuggugauuucuuuucaauuuuugaggcuggccuugaacuugccauguagccaagaaagaaaaaaaaaacguuuaaaggacuuaauucguaaaugauauguauauuacaugacugccuguuguugacaugugaaugugagugaagugccuuuagaagccacaggagggccuuggauccucuccaguaguugggagcacugaccuggguuuugucagaacaggguacucuguugacagccgagcaguccucugcagccugcuccccuguucuuuucuuaauacuggauaauggugccaggacauguuaauuuugauagguauaauaucaagaguuuugggauaagcgucauggcugaaaagugacuguguucucaugcuaagauuccacauugaacuuaggauaauuguuggguaaauuuugauggcugagauuaucuuuaguuguucuguuccgcacaaauucuaaagaauggcuaggaaaguaaagaaauucuagguaacuauuccauguaauaaguagaagagauaucauucaaacugcuaaguauuguggaauaguuaguugaaucgaauauaaguuuaauuuguuauauuuuggagaaucgcgauaccucuuucuucccaagaaugauguugcugggcaugguggcucccacccaugaucucggggcaagaagcagaggugggacaauuuagaauucgaggacagccuuggcuauguagugagacauugucucaaacuaaauaauagauaaaacacugauggguauugaaauaauguuuauauuaauuucaacugauuucaaagguaucugaaauguuuaauacaugaauaagucagaaguguggcgguuuuuagcaugguacaacugcuugagugcuuguguugaauguaauuuggguguggauguagauaacccugauacaguguaagugggguuucguguucagauucuuuucagugugguuuuuuuuuuuuuuuuuuuuuuugguuuuguuucuguuuuuuuuuuuuuucuugcuaagaaguaucuaguuugagaaaaaucaaguagucugaauguaaaugaaauaccuuaauaauguugccaacuaaggagccuagaauaaguacuucauaguuugcauugauuugagaauaggacucaacuaaucagagaucuggcagcaucacaaaauuauucugucgcuucuaaauaaaaaagaccauuuuacagucuuuccugcucuuuauaaauagcaaguaagaauuugucaguaacaaaaccagaaaguugcugaacaccaaaggcuguugagagccagaaaagagcggagagguuggcacugagugaacacuuuauuucuuugaguuugcucagaauugaacacauaaugcacuguguaguguuguaaccuguaggaaguuguuuaacaagccucacucuagcacauagggcuaaacauaguuuugggaaguaauuugacaaggguaaggcagauguccacauugugagcacaagcauuagcgaacacccuuggcuuagcuuuuguucacagaugagauauguuaaccaaucuagguauugaauuuauaaggcuauuuugcagauagacuuaagucucuaguuccagaaaccaccuuucuugggucuagucuugaauuuuuuuucuuuuucuuuuuuuuuggggggggggcacagaguugcuauaugaugugguccaaacagugggacauagaaguuaugucgcuuaucagaucaugucaauauaguuucaucugauuuugugaacacauagcacauagaacauauaagccacacaaguucccuggugucaggugaacaggacagguggagcacuauacuccacacgauaaaugacuuaaaaucuaggcgaucacgaauaagccccuuuucaauuucuauccuguuauagaugauagcaugguaguaagaaagaugacuucuguauucagaguuuucuuguuucgcagggaauauauaccuggaaauaccagccguagugcacuacaucucuggcaagagauuaugaugucacugucaccauaggacuacaaggcaagcuucugccugugcacuucagucagggugauuuuucuguggcaccagugcagauagagccacacuauuccgucaucuaacaauucauuuuccucuacauauuagguucuuuauuauaguauuugugcugaguuuagacuggagguuuacaauauccucucuuuccaacuuugcaaugaggugauuguagggaaaugugcaugcgugcuaugaaugugacagucauaggaacuguaccauuuuguauuucuuuucagaagccaucuguuaauugaugggcauacagccauguggucugagugguuugcuguaauauaagcuaccccuuagcaaaaacaaaaugugcauuuauuucuucauugccugaacuuauaggcauggcuuucaucugacccacagacuuuaccacuuuugugaguacugccaacuuccuugucaguugggauccacugggguuguuccucuuuacugcuucagagacaucuuucuugagguuccagaggcugugucugcaguauuaaguagguuuccuuggaccaaguauuuagauuccaaucugcccaaacacaauguuuccaaugggggaauuucuccuagauauaaaauucauugcuuuugugugacuauuuuaaauuuaaaggaaagaaaaaauauguuuuuuaaacucuugaaaaaaaaacaacucuuguuaacuguguuuguucaucaaauauaaacuaagcaaacuguuguacacaggaagagaaauccugguauuuauaucuaaaucuuugugcugagcgaggacagugacagucauugcuucauagaauuuuuuucacuguaugauauuacccauuauucuuucuguaaugauucugccucuucucuaaccuuucuuaacauggugucaccucuuuuuuuuuuuuuuuuuuugugaugaauguagacuuggauuaaguauaauuugugagucauguacgcaaugucaaaauaaugucuuaugguaaacuucuucccacuuucugucuccuaauuagaauagcauaguaucuggauguggagaacauucacauccauguacauuuauauaaaggagacuucaaagaugcuacccaggguagccaucuuuggcuuugcaguuuagagaugugcugucuuucgcugugguauaugugaugagaauaguugcacaguugagacgcagugcuaaucucuacucacugacaggucagcaggucccuuguucuuuuucaaaugugagauguuaucugggaaagacuuggcuuccuaccuuagccuggacuugagcggacugcuacaggacugagucuagauguugaauguugggugaaaggaggcuuguggaagacguuguuuauccauaugagugagagguccucaugugggcugggaagcuuguggagacuuuaaugauuaaucuugcaucaucauuccccuugcaaccacugcagacugacuguuuucagguguuguuccucagugagugggucagucuuguguguccugcaugcuaauccuccuguagaacaagcuugagucucagggagaggcaguucucuugucucugcagacagagugucuccugaacugcuguccagaucaaagacuuuacaaaugccucaucuuccugucuuccccaugugcuuuuucuuguuuccuuucauuucuuugucaagaaaacccugaauuucaucucuugcuagacuucagcuuuucauguuagucauugguuaauuaaaacuggagugaccagccaugaauguucccaguucauuucuaggacuggcuucucucuuauuuaugguggaacuuaacauuuuaagcuuguuagggcagagacugugcgguauugaucccaccuucuuuucuacagcuagaaaaccauacucagaguaugaaagcauuuuaagcaaucugcugaggggagaaguaucuugugugggagacaguuuuggcaguaacaagcauguuuggcuuuagucauaagaauugcuuucugagcuucuggaagaggaguauguaaaucaagcuucauuuaagaugaaucuuguuauaaugcagauaccucucaucuaucugcuuuauaaugauggauuuguuuugagggcuuaagugguuugugcaccugcaggaugcuaguccuuuucuuucagaguuucucccccaaccccuuccuuuuauaugugguccuuuggauggaucaagaaagaacuguaaaguuucagucaguugauuacacacaaaggacaagaaaucaaaugcagguguauuugguuggacagcugugguaucugggugcacaggaccgugcuucuaagcgaugcccaagcuccacugaaagcagugaacuuggagaaguuaagcuugggaaaaucagccuuggauauuugaaaucaaauuugguuuacuagcuaccccaugugccuuugagcaaguuaauuaucaucucugaaucuccacacuuauuaucuuuacaauguuuauaaauguguguacauagaauuaaaugugcugaaucuauauaaaauguguugcuccauaagcaguguuaggcaguagaguauucuuugcuuccaggcagguagguagauauauuuaugggcuauugggaauggacuuugcccuuuaaacuuacaggccuuuuugcaguggaaaauauaggauguugaagcuuuugaauaaaauacauucuuuaaaaguauguguucaagaagaaaauuuaucuccagaagaaucuuuuaucauaaagaccugguacgguuugcauaaucuaauguuccuuccacaguuaauauaaucaaauguuucucuuugaaauuucggacaaaacagccuuccuaguaaauugcaaggcugacauaaugucaaaaaggcuacuaacuaauuauagagcuuaggggcuuaauugugugugugugugugugugugugugugugugugugugugugugugugugugugugugugugguaucuaaauaaaaaugcuguuuugcagagaguaaaagccacauuaagaaagcugcacugcuucuuaguagacugacugcucacugguuucuuugugugagugugugcaugcacccaugugaagauugacaccagcuggucaugaagcaacagcagaugcccuuuuuacuaccacaguuguuaacuggcuuccugcuuugccacaauacuauuuugaggaauauagcuccucugcccucaucucaaaugauauuuacucgaacaacugaacaacuccacugccucuuaagcuggcagaagacaaagcagagacuauaaguaucuguguguauggagguccauauauguuaauucaauggagagauuauuacagacccaccccuuuaaccgggaguagaucuggcauuagcuuagaguuguuaauguccuaacugaacuuuagagccugcguuuuugguuaccuguaaucuuuaggcuuuugcucccaucacaacagcagccuugcuauuugaagguagaggugcugauggcucuuuuugaacaacuaucugaacuaguagguggcaagugcuggcuuuugucuuucccacguccccuucgaggugcuccaccaucuuacucuuucauacuggagaacuuucugaagauuggaaugagaggaauccuucuauuuucucucuucagauuaagcucaauuuucccaaucaagacauucauaguaccuaguacagcacuugaacauuuggaggauuuaauauacucucucuguucucgauuaccuaagauugaauugugugggaguucuuaaugcugucugcaagggugauguauuaagaacccacacuuucgccaacuuaaacaaggucacacugcauugccagcaaauucauaauuacugggacuggaacuguaggaaaauauagagcuuuacuaguuguauaaucagggcagauauggccauuaaaauuaacucacagagaaaaugcccuggugcagaggacauuagacguuccccauggaauuagacuguuuagguaauauuuaccaaauaaucacuaccuauaacuuugauuucagcagaaaagauacaguuuaaacucuuuccuuacuaucucuguauaucugaaguuccaaaacccguuuaaaguauuaguuccuuugagucucaggccagcuuuauuugcauuugggcagaaugugaguuuuggagccacccaucuguuuuguguuugugugaacagcuagggugaacccuguccuggugcuaauccuugguaauguccuuugggaagcuggucaaaaugcucugcauguugagagcuggccuagacuauaguaacaggauccugucaacagcucccucuucaugugaucugauucauuagagggcagcaaggagcuguuugguaugacccaaguuaguggcuauuuaaauggaauaaaucauugcaucuggaggagauuuagacugagagagacugggccuuuggagagaaacuugaccaggaagcauugugucccucuacuccccggguucucucuucccuuuccccugcucugugguacccaugccaugagauauuaagaaagcuuggaaagucugcguugugccgcucuggugccagaguugcagugcacagccugucugaacagacacacaugaugggagcccaggaacagagaguccaucugaagaaagacaacacauuugcaacuuuauuguguauggggaggagggagagagaagggcagcacaauaagagaacuagguuuuuauaaaaaaaaaaaaaauucccccuucgaaauaaaauucuccaaaucuuguuuuuuuacuuuccuaccccucuuagucaagguauuuagcucuacacaggggcuguugggcgguugcaaaucuuucuuccuuuuuuccuuccucaaauauuucacuguuagacuucaggaugcaagaguguugcuugacagaggaccaucagcaaccuguuucugauaacucugggauuuaaaagagacccaugcugcuuuuauucuguuacuucauaaaacauuacuacuucucuaaaugaaauaagagauacgcaucaaucaguguacucaccuuuuauuguugauucaacuaccagguuuuuacagaauucacucugcauuuuauuugacuuguucaugaauagucucggcagacuuaauuauauuagugaaaaagcacuuucaacaaaauuauaugcugacaucccauaauucauacuuacagauuugugaaacagauuuauguaaaucuaucaaauuacucuauauaacauuauuuuuuuuaaauugagauuucauuuuaacgguauuuauagaaaauuuucauacgagaaauuuuacaugaacuauuuuaaaaaauagcucgaaugacucccuuaugaagacagaauacuguaacauuugagcaucucaucuccauguucugugauccaucugguacaagacaggggcaggggaacauauucacaagggcagcuuuagcccuccuugaacacaagauaacugcucuuaguaccuucaucucuuuguggcuggcucauucauuugguuaccgaacauuuacuuacuaaauagugauagggccuuugucaggagcugagguccacuugcccuacuuugguuaguaccaaaauggaaugaucugccuauauucaaauuagcccagcaugcauccaaauugccuaauauacauauauggcaaaauaaaacauaguaugaggcccguuggagagcuaauagggagaacuuuucaucgcuacuagugauggacacugaacaugaggaguaguuaggcauguggugucaggaagugcuuucguagagggucucagagguuggugugaguaagucacuuccggaagugugcucuagcacuggcacccaaaugugcagaguagggcaagucugaaggaucagcagaaacaacccugguagaagaaaacagaaagagagugaucaucuuagaaagcaugggugugguuagcuugugcguuuuaggaaggcugccuauguaucaguaguggaagauggcuuucaccuugguuucagagccuagaggagagagugauuauucagaaagaguggagaagcaauagaccaagucaaaaaauuaauaacaaaggaugcccagcugaggaagagaggcaaauuuagcuguguaaguagauggcaugcugauaggaagucauuuuagucacugguccaggacccacuuccuacuggucuuauaucagacauuauuaucaggaugagguccacccugcuguguuuaaagagcaucagcaccccuucuucuguuucucucucucaccccauuugaugguucuccuuguuccuuauucuuguucauugucuccuuagacuggaggcuugugaugaagaacacuaaucagcauacucauaggccuagcaagauguaggccuuugcaauagugaaugaauggauacuuaaagaaauacuuaaguauaacuuuuccccacaaauucuuguugagaagggucucauuuaauauugguuagauaagauuaauaugccagguuuuuaaauaaagaauuauggcagucugcugccuuuaguuuuagaccuaagggguuaauuugauauuuuguacacugguaguaauuucaaauagggaagggaaaaaaaaacuaaauaaaaugaccuuugaaugaaacagguccagaagauuguguauuuuuaauuaaaauaugcaauuaaguuuuuaauuaaaguaugcuguuaaaagcaauguagguggcuagggaguggcuaaugcccugaauuacacgguuugggauaaauuggcauuuacuguguucccacagugucacuucaacacuaacagauucuuuuccuguuuagcuuuucuuccucugacccccaacacuauuugcauaguccccucuuccugcuagggccugcugggguguuucaguucugugcucuuagccauugaccaugguuugagcagcguguucaaaacugcuuuugugucaguuguauuuuagacaugguuuucuaucucuugugaaggaaggcagcaauacuuuccuguggcauguauguucaguuaaaaagcaugcaaaaaaaaaaaaaaaagacauguacaacuuggcuggaguguggugcuaguccagagagcucaguacuccugugagaauagcuguuuaacuguccaucaaguuguuucccuagggaaguucuggaauucuugccauaauguuggagccaaggcuuggauuagugguucuuaaaccuuugaaagccuaugggcacagguagcuugggaagggagcugggaagcaugggaugcuaguucugcuuuuaagaaauguuuuguuuuuguuuuuuuucauaaugaacuauaauuggaauuuaaauguggaguuuuguaagaguguuuccaaaagugaacuuuaguuuggggguaauuaaugcauguguucuaaacucagaguaacuuggaauauuuugaacgauaugggaaagguguuugguuccuaagccuucccugguguagguccugcugguaaguaacuauggaacacaggaauagaaagacgagcuaggucuuggcucaguaguuuucacaguagguuuuccuuccuucgaguuugguuaacuauugcuuuuuuaaaaaugaaaacuucugggggcuggugagauggcucagcagguaagagcacugacugcucuucugaagguccugaguucaaauuccagcaaccacacgcuggcucacaaccaucaguagugagaugugacaccuucuucuggugugucuuaagacagcuacaguguacuuacauauaauaauaaagaaaaucuuuuuuaaaagagcaaacuucuaaccaggaauacaguauaaacaagauaguuuuaaaaaaccaggcacuuacuuaaaaauaaagaguaaacugccauuugccagaauccacagaaaugagacaguaggcgauauauuacacacauacauaugaagccuuuagaaaaugucgugauuauuaggcaugcagaagauguccucuguagacagccgucagucccacaagcagugccuggccuugcugcuuuaucaccugucucuuagguuguagaagggaucaccaagcuuucagugccacccuuaacuuuacaggaaaacugcggcuaucaaacaugaccacugugagcguauaacugagcaguagguuaccacagggaugaaggggauaaugggagggcacugcccauguuuaugaugccuuucuauaccugaggcuccaguaaguauuugcugacuaauuaaugcacuuuauccugaaaaucuauuaaguuccuauuacucucauacuuuuuucucauucuuacuaauucuuuaaggacuucauacaauaugaauuuaucauauucaccucuauuuccagacuccuccuagauccaccccucauuucucuacccacccuacuuaguguaauuuuuuuuuaaguucauuguaugcuaaucacacaugcuugauguggccuuccccugaagcaucugugaccuaccagagcaacaaacacuccugaugaaaauugacucucgcuucucuagcaacuaucauuugccagggcucuucagcuagggugggacuccaugcccaccaccccucuucaucugggguuugucugacuugagcucacauauaccugcugucacaaaugugaauuuguaugucuagcugcgcugcuguguuuggaaaacacuucguuauaguucucgacugccuccggcucuuucacuuuguucccucucuuucauaauggucccccagcccuggaagagaggggguguuccggaugucccauuuaggccagagaaugcagcacucucuuguucaaugcaccuuuaccaguuguggacgucaguguuacucacaggcuucugcaaacagaagcuucucagauaaggguugucucuuguauuaguuccccaacauuuuaguuugcuaugauaacaguggacauaagaauggaccuuuagagaggagacaacccuuacauuguuuuauuauuaauaggaaaaucuacuuaccuugaacaccuucuauuuggcagauggcucucuucucaauaaagccagaucagaagcuuuguuuuuguuuauuguuuuaaacagggagaagagguucuuuggggguaacuaugugauuaggcuuaaucaauaguaagaauuugauucauuguuguagcuagccagauugcauagggugucaggucauaguuaaagaaugggcuuccuaacaaugaccuuuauauuuuuguuuguuugauuuuuuuaaauagcaccauuuaaauucuccugguuucauuuucaaaccuuccacugcucauagcaaguuaggagccaggacuccugcugaccuguagagcagaucagcaggaacaccuggagcaaucuucuccaugcacagcuuugggcuuagaagugugauugccuaagacccacaccaggaggcccgaaauaguagauaaugugacaacagagaaaaagaccaccgugcaucucuuaaaaauacaucuguaaaauggugucuucccuguggagacacuuuacaugcucaggcccccucaauagcuuccagauguucuauauacucuaagacuccguuuucuugggucagugagaugacacaucaagacagugugguuucugccaaacccaaugaccugagcucaaucccuggaacauauauacgguggaagaggaaggaaggcucacuccugcaaguugcacacacacauagguaaauauuuuaaaaagaacauccccuccaaaacaaacaaacaaacaaacaaacaaaccccgcguuucucaggaugguuguagccccauaacacugaacuuuuggaaagcuauuuucaugcuucaaacccuacugauaauaucaggaauuuggagagcaggguucaggcuuuccaagauuucuaagugauucuagcauguagcucuaguugaaacuguugcuggcagaaaaucuaccuguagaaaagagaauugcauuccccugaugcaguuacuaguuaauuuaaucauagaguaguagagugauaaaucuguucgguacaggguugucugucucuuccguuucuaucagauuuuacuaucuuccugauaugaccauaagugaauauguuuaaacucuguacuguagaguaggaguggaguauaugcacuacuugucuggauguagucuuucucucggaugucugcuuucucaguaccgaggguugucggcauuguuucagugcucuagcuguguaggauugucuucauuuucaaggugaaggaggaacaguuucucagaaagugugaagaaggucuucaaagucacacaguugguagguaguagagacaagauuggaacucaccugccaggcuccaaaucccauauaagcugguuucuuacuuagauucauccuuuuugucuuuugccaacuugaauccugcucaaggacaguagaguugcauuccauacuuguacaguagacaaguaagaaaugcuucucaaauugguaaaaaucugaaggcuugaaauuaccguggcuugacgugugacucuucuuguagauuuauuuaaugugcaugaauguuugccugcaucaauguaugcccaagugugccuggcacaugucuaaauuuguaguuaaaugugugcauuuguggcucucccuucucauucuuguucucugaagugcugaucuucugacauagggccuugcccauguuaagaaagcucucuaccagugccuaaugccccaaggcuguuuucuguuguuuugauuacaggaaacacaguuuggaaagagggaauaugcuagcuccugauuucccaaauucugaucaugaucuccaaagcauauucccaaguucuguguuuuucuuaucaauagcaaggaagucacacuuuggaauaaccagaguggcugucuuuaauaccaacaugcagcacuugggggacccauugagaacaaauucccgccuuuccuaugacacugcuagagagccaggguuuuaagaaagcauuuguacuuucuaggaaaagucugcuguccaaucauuucuuucauuuaugucuccugucucuucuccaauggagaaauuuugccucaauugaaccuuugauuucuggugggagcaaccugacuuaggucuguguugcaguacuuaucuaucccugcuaucuccaugguuccuaacacagcaccacugagugggagguuagauggccagcugauggggccaccaccauggcaacaagcaagaguuguuuggauggaugcgcaguucuguguuucguugcuuaccuuuuuccuuuucacaucaucauguaugccauccuuugcaugauccuuugcuuguuuugcuguauugcauuuuuagaucagaauaauaccuagagaaaguuccauuucauuuguccaaagaaaugcucuuuuaaaauugugccugugcauguuuguauggccacaugaugucauacauuguuuaaagacaucucaaucugagaugugcuguuaguccauuuugucauguaugcccauuacaggugguuccuuauacaaggcuaaaugaugcagaucaaucacgugguauagaucuugauaaaaucaaaggauauauuugagggaguuauaaacaaaaacauggcauuuuuauauagcacaccuuuuuaaaugcauauggccaaauacauaauagaaauagauucacuaauagccauuaucaucaaguauuuacuguacaaacuguauauaacugcauucucauaugaccaguauauuuuuuacaucaguacuaucauaagcacaugacuaugacuugugcuaugaggucaucauagugaugaugucacuaggugauaggaauauuucaguuuaauuagacuuuaaugggaaugccauuguguaugcagcacaucauugaccaaaaugccauuaugucacacauuccuacacacacaaaucauuuuuucauuuuacugucuguaguaacuguaguuucgaaaugugguaaugugucagucugcgugauaaaacacugacagauucuggguugcuguuucuaucuuccgucucgcuccgagcuuucucuaugucuucuggagcuccgcagagaggugcacccaguuuuggggcugcugccauguccuggauuaggcaugugauguaugaugggauggccugggccugugugguuucauaagcagcacugcuugcugaguucuaaagauaucuaaauuuacaaaugacaggagccugugcuaaaagcuaagucaccuccuguccguggguuugaacuaacaugccucuccucuuccgucuccucagggcagagcuuggguuacggauuugugaacuacauugaccccaaggaugcagagaaagcuaucaacacucugaauggauugagacuucaaaccaaaacaauaaaaguauguucacacuuuucuuaaguuugcuuguagaauaagaguuuauuuguacuuuucauuugggccccgugagccugucugugagucauacaguauaauguuuuuguacuuauugaacaaaggaggcaacuuuaauauuauauguggacauuuauauuagcagaaagagcaacagugcccuccgauauauacuguauaaagccccuaaauuaaguccuuauagagagacuccuugaacuauuacuggagggauuguugcacuugucugaacagcaauaguuaguguuguuuuguaagccagaaaggcucagccguguuucucaccucugcccuugacacagauuaugacuguggcuacuauguaucuagaugggucacagugcccuugcaugcaaaacuuaaauuucauaugaucuaccaacaauaaaguauuacuuuuuccaguuuagcauucaaaacaauuugugauuuugagcaagcacacugggucuggugguuguguuucuugcuuucugaggagauagacuaacucauguguccuuugaagauguacaguaaguuauuuuauggauauuuuucugcaggguuauauuuugaaauccuuaccucaguucucuggauaagaaguugauccaguuuuaagcauagauuucuuucucuuuagcaaauaaaagugauguugccucuggcaaaucuagcccaugucauccauucacucccuccugcccaguguggacaucucacaucaaucauggugcaggcucuugcugaauuuagguguagcucccaaguauauuucaaaauaguguuccagacguaucucuaucaauugacuccaguuggaaccuguuuucuucccaugauuuaagaagccagccuacacuguagccuaaggaugagaaguuagucaagacugacuggaguccaucuugcuuacagacuugucuagaaguuuugguuuauguuuugagggaucucgaagugcagugucaucuuuaugcuuaagguaauuucucuuuggauuaacaguuaaggugauguguuaacccugggccguuuugaugccucauccuuuauauuuaugaaaaaugucugucagugcuuuucaucuaaaggaaaugcaugauggucuccaaauauacugagaugugagaugucugagaauucuggguguuuuuaguaaugggaaugucuaaggagacaauggagccuauacucagaaaaggaacuguuuauugugauauucuaaaagcaucuuagagaaguuuaagaugacaaagacuugguuuugaucuuuuuuguuuguuuuuuuaaucugaauugcuucccccccaacucuuuacacuugcccacuuaaucuuuccucaugucagauguucagucuuuuaauagugauaauacagugcccuuaauaauggugcccacuaucuagcucuccucaggcuguuuuguguguucugaguccuauggauuuuuguaggcuuccucuuccuuaacuaaaaugaucagcaguccuggaaaucaauugcuuuuaguguugacagcucaaguuguuaaaaagaaaaugaaaugugauugggcuggcucaucucagcaaaugacccuuuuccucgcuccagaaauaaucacccuuguuucauucuuagugagucacuuauuuugcuauacauacugcaugcuguaagauccugaaaaagguagagaugcagagaaagcaagccaagguaagauaaauguacucagccuuucccauugaugccagcggcuccccugcagacagugguccagccugcucuccucaggccucccauugaugccagcugcuccccugcugccagugguccagccugcucuccucaggccucccauugaugccagcugcuccccugcugccagugguccagccugcucuccucaggcccagcugcuugggcugaauguguaagcaaggacaguagugcuuuguagcuuuuauccugugacaucuacuugugacuuucugaaauuuagaaggggugauaggcaggcagcaagcuacuucuuuucccugcccccauuugguucuugcaaaaauaucagauaacagcugguauccucaguuuggcccagcuuccuuuugagaggcaaagcagaccauucuucagaaguagauuguacaauuuuugcuuauguuuguauuucuucuuuuuuucuuucuauuagacagguuuugcauuccuauuaugaaaucucaaguguguuuuuucuuguauuuacuguuuucguggugaucuggaagccacacuuuaauccuggugguggcugaucuuaccaauucucucugagagccccucugagcugcuccccugcuggguuguuccaacucagguugaguuagccugaguuugaacuccauguucucuaccuacaagaaaccccagaagacuggggaucagcaggauccagauguaguuuagacuugcacacgauucugucugcucugaguguggaggagaccuuggagcucauacagguuagccacgguugcacaguugcagacagcaguaacucuaguacaucuaauaccccacuaacacaccaugcucuucuuuagaggaaaagaccuacuuuguauauaguugcuaauauauaugacauuuacaauucucaaauauuuguuuuuguucucuuuuccacaccacccaccguaucaguauggcuuugguaaauuccugauuuuuuuuuuccuuuuaauauuggaguagugauugaaguacugugaaaggagguuuaucaguccaguagggcuuuguguaauaguugaaaugucaaaugacuuauauuuguuauuucuucagugaguuaaacucccuccggccccacgagaaucuaagauacuuguuacauugaugugugaggagugauuuagaugcacguguuccagaaccagagcuguaguagauaagcgagcccaggugaucagcaaucugcauggcagucaaccucuccuuuuaaguggguggcuaucugcagaguuguugccuugcacacaugguucagguugucuuguagccucuucuguagucagccuuuguggucaauucuguuagacagaguaaagugucugucaccuugaguauguuaaguaagugguguguguuguagcuuacaguucaguuuucaccuccaggaagagcagcuuagaaucaggaaguccgaagcugucccuucaggcuuuauuuugagcagcacugauguacuuagccuucagugugaugaaccauguuuccggaccaugcugugccuccuagggaaauguguuuacaacaucccuugcuaggaacaagggauggauuggucagcagcauggagcuugcuaaccccugcccauauugucccuuuuauugacauaguagaugacaggugacuguucccagauguuaaugucuuaccuuagcaaggguaggaaaacgauauaguaucugugcaguucagacaguagaacuccaaaguauucugagggcaguauaagaaauuccaugcuggugugaugguaucuuuccucaguagcccuccauugccugugagaaaugacucuggccuucucaggagcgaggggcuuagugacugcuggucaucaugugcuuuccugacucauuuuuaaggaaacuuauguagagauauguucugaauagugugcagaacacuccguuuaaagccagaauaucuguccuuuugucuagauuaauguauuagacaucaacucgugaguagaagaaaaaugauuauuuuauaaaguaaaaccuuucauuucugaagugccuguguauucucuugugcacagugauacaaacuacugacccagcauaucucccacauucuggaucaguaggguaucaguaugaagcuuucuuuuccagaacaggagcucugucacuggaauauaacuguauauuauuguuaggcacuaguccagaaaccagccucucccucugaagucuggagaucugcacggaaguauagaaguguccccguguauucucucuuuuuccauaauuauccaagcauguagcagacuaaaaauuacauuugccugaaaauuaacucccaucuagaaauguggaauaucuucauuaaaauaauuaaacuacuauuuaaguacauauggaaaauucuauuauaaaaauuagaguauuaaauauuaauaauaagcuguuccuuaaaguguucaguuugacagugauuaagguaaucuaauaaacuuuuauucugaguccuuauauugcuuuucaguuuuuucuuaaagauuuauacuuuuuuuuauuucuaaauuauaaacuuagaaaauguuacauuuccuuuuccacaccuguuuagccaggaguuguacucaacauggaucuguaagccucuguuucucacuuuucuuggucaccuggcagugucaucuuguacaagacuuucaaccuuuuaacuuccauuuguuucuguaaaugacuuggaacuccccaaaccaggaaaucuaaauugauccaaaacuugagaccuuagaauguugaugggaugaaucuucaccaugacacuguccaugcacaaaauaaguagagauaauguaaugugugcccuucaggcuccugauggauaaugcauauaaugugugaagaggcccuucucccaaacauuaagaaaucaggaaaaaaaauggcauccaaaccacuguguguguuugaguguguuuguguauguggugcuggugguggugguggugcugcugcugcugcuggugguggucaugguggugugugugugugugugugugagagagagagagagagagagagagagagagagagagagagagagagagagagagagaacaugacaauaugagagaaugaacgcuugaagcuaacucaagaugucaugcucaaucuacuauucccuguguuuauugacccagggucuuucauugaacuuagaccuugauaauuuggcuagucuuacuagccaaugugccuccugagugcugaaacuacagguggccucuguaccugcccagcauuuuagguggauuuuggggaguccaaacuuaaguucuuaucucccaucuuuccaauugagaguuagauggccgucugggaguccacagagggcaguaauuuuccauucuuugaauagauuuucuuuggauauccuucucuaguugcuggaguggaagugagcuuauauagacaguggagugaggagcagguccccagaucucuuaugguccuuucaccugccacuuaguggaacaugcuuggcgguggacugaaucuguguuccuugcacggaagugaugggucauucuguuccccaagcaugcucuugaggaauacccuggucuugggagauggcucugcuuaugcaaaugagggcuaagagaaugcugcuggcagguuuuccuuuguaaccagccuagagaacuuaaagcuuuuauagcuaccuccauuggaguaaaaggguugacaaaugcuugagucuaccugucugaaggugagggagaggacaugaaagucagacuugaacacuggcauugguuuaagaaaucacuguugcuauuucugcuuugcuauuguguauuuguauuuguuuuaugguggggguuugcuugggaacuuaauaagucuaacugcccagaacuuuaaaucauuugaccagcuggucuuuuugauaccuaaaaggaagaagcuccuaaaagcacuggacuaggaggcuuauguguguggaucuaugucaguuuggguuuuaaacuaacaagaggaggaaaaucugaaccugauucacacggucagaaaauggcaccugagcaggccuuuuaauccaccugccaugcuuuuuacagaaguguaccucaguagagacacuucuggaaggccuucuagcuguggcugcucugacuuccgacugcucauggacaagguuggguugucuuuuguuuaauuuaugagccaggagagcugguucuccaucuuuuucgccuguucugagaagcuggcuagauagagucaggcacuaacuucaaggaguccaucccauccuuccuucucugccaugccugcuuuccaccauaacgucacaggacucuuuaaaaaguaauugugaaggaacuguggcagucacugagaggccaguccuuauuuucuuucacagauaaauuggagcccacguuaguuuguuuuguuuuuguuuuuguuuuugagacaauaaaccuugucuugcuagucugaguguguguauauguauguguguguguguguguguguguguguguguguguguguguguguauguauguauguauggcucaggguuuaaucauuccugcucaggcucugggguaacuaauggugaucccucaggugagugacaaaaaagaagcaaaacugggcugcauccugaaaacagaccguucagaagagugguuucccgugagaucuuuagcuaucuguuuuuaaaacccugauguucaugccuguuuuauucauauggccccuucuuacauuccuagaaagguuauggagacaaccacauuguaagguugaguacaauggguauuuuaugauuucaguuucccaggcccuggccaggcuguggggcuccuggaaauccuugggaucaauagacuuacuuuaacuucuacaauuuugcauuuguuggugacuuauaucccuauaaaugcuucgaacuugcaacaugggaauugucucauucagaaacuaacauuagaaagugacucuuauuuuuuauaaguucucagggaaaccuaaaaaacaagguccaggguuugaacaugauggauuuuauaucuuucugauaagggcuuuucagaacuucuguuguuccacagaaucccuugaaugggguaguugauaaaacacagacuucuagucaccaggaguuaaugaucugaucacuagugauccaggcaaggagaaugcuacuguaacagcugucagacacaucuuggccccaucuaaguuagugagccuuuauaauucacauguggguauacuuaugcuuauuuccaaauauauguugaugcaaauaacaagaccccuauuauggguuauauuaucuucauaguagagcaaugugcauucaauagauaaaaugccggauuuaaugaagaaacaauaaauguuuuccccucuguauaguuagcuccuuuucagaguauuuuuagaucucagguaauucacaaguaaaauaccauuguuuccuauguauccuuugguuguuugggucccaugaacuuagaaugggucuucaugguggucaguggagaugcuauuguuaauaaaagauaauuuuguaauuuauaauaaggucauaucaccugcaccugacccuguauguucacccuuccuuaguaucuauuuuauuaaccuuuuuuaauaggccucucccuaaauggcaguuuguugcauuauuauaaaaaacauaacauacuauaaauaguuuuuaaaguauuuggucucugccaccuuaguuuaggaacauuuggccuguaaacugaauauugcccggcagccacggggacaugaaaccuauagguuugccaaaagccugcucagauuuguaagaaauugucaaaaacaaaaaaacaaacaauacuuuaguguucuucacuaagcagugucuugagggaauugugaaguuugcauggucugcagauugcccugguccacaaagucaagggaacugugaaggugaaggcuaacaccaccucucaccuuuguacuuuguucuccagagcacauugauccaccagcagcaaaggggauacuauuuggaggguuaauuauagcuagugaauguuauugaugcuaucaaucagugagagcggaggaaagggcuuggugccaggacauccuguguaauuaaauaccacaggaugggauucugaaggugaggucaggucugaagaggacgauuuaucucaaagcaaagaugaagguggcacgaucccuuuuucacuccucccuucuuaaguuucuggagauuuuugucccgugaagguugucauguuuucuaucaagccucucuuguaaacucuuuacaacugcccugagacaggcuuuaggagcacaguaguuauuauuauuauucauuguuaaagcgcuuuguggggaaauauguagcucaggugucuaauagacauuuggagaaaggaggaucguaucucugaaugaaaccauuagucuugcaaaucaguucauuuaaggaacguuuucccaugguuuuucuccaauggugaucaugcugagagugagagcauuaucuuacuguuugggguuauuccccacagguacugacuacauuccucacagucauucaacuucaaucaagucuacaaaacucauguuggagaacuucccguagcuccaugggaagugccauaucuuuauaucaauuucacugucgucaugccacgcgcaugucuuccucaacacacauucucauuuugucauaguuaaaggcuaaguauuguagcaaguccagaaugucuccugcaacugaugggagaguucuguuuguucauuugauuguuguuauuuuaagugguuauacaguuuguauugauggaggcuuacuacagacagacaacccuuggggggaaaaauuaguuuugaaucuuagcaugaaaauguguguacauguacccaaaagguccccuaaacauuguggcggguguuguaugauuuacuuacaauaaagacgcugaaguuauauuugcuuuuaaaaauguacuuacuacuuuuguauauucaguuacuuuuuaacuaaaagaagugaauguguguguccaggaaggaacaugcacacauaagagcaugugucuacuggucggaacaccucagugcuaauagcaguacuugaggucuucuuccaucaauuggggauguccagacggucacacuuuuauuugcuuuuuuacucugcagaaauaguuuagaaacuuggaagacauuguucuguugugucucaggagugucuuugucacauacacuguuuguugucaauaacauggaagguccuugcuaagcuauuugccuauauagucaaagagaaacuauagugaaggggccgggauucuauuccagccaccauaccugagaaauagaacuuuuuggacccucauuuuaaacugccaugcauggauggaauuggguccacuuaacugugcuuagugucaugcucagaggcuaaguuuaggccauaugugaaaagaaggcccauuuguuacuucugcaguugcuaguuuucuuggcauaauccuuauaaccaguauccuuuuguuuuccuuuggccauuccauguucuuagucucauuaacagugucuucugaucagucagucucaucuugauguuggagcuaaggucaauugccuugacuuugacucagugaaauuugaagcugcuaggaagcugagaagccuccuuaguguaaacaaccaguugucuuuuaaauggugcaugauuuucaaaugaagcacuuaauguaggagagcuugaaguguagguauauuucaguuggugguaugucaagauccuucauuuuccuuuuuuuauucugcuggccugccuccaaaaauuaaauuauuuuuucacacauaacuuaaaucuugggcauuaguaauagaagaaauucuguacuuguagaaaccaacucauccacuuugauguguuucauauuuuuuaaacacccuuuaagcagugguacacaccuuuaaucccagcacuugggaggcaggcagagguggaucucugaguucaaagccagccugguuacaaauugaguucuaggacagccaaagcuacacaaagagaaacacugucucaaaaaaccaaucaauugaucaagcaaucuaugcucuuuaagcaugaugaugaugauggugaugugugcacacacauggaggucagggacaacuguguggaguucuccccuucugcauugaugugaauuccagccguugcacucaucaggacugaauaacaagugcuuacucugagcccucucauucagccauguuucauaguucuuauauauacauaagagaauauuuaauuuaucaaagcgaaguuccauagcuucuuagagugucucuucagguaucuccuuggcaacagcugcucauucucucauugauugccauuucacuaguuauuugugaguucaaaggccauguuucaacaacuaauauaaugaagaaacacacagauagaaaagucacaucucugaaugaaauaucuguaucucuucuuuguguuuuuuagacaagcuaccuuuguucuuauuguccuuuuguuuuuuccagacaggguuuuuuucucaagguguggcugacuguccuagaacucauucuguagaucaggcuggccuuaaacucagagaucugccaaccucucccuucagagagccaggauuaaagacaugugccaccacugcccagugcacaguugucuuuucuaaggaaacugaauuaaaugaucucuguugucuuuuuuuauucccgcaccccaaccccaccaguaccauaguauucuguugagcuuccuuuccuucagguauuuaaauccucaauuucaagagcuaaaacuuccuauuaaauauguuuaaucgaauuuuccagucucuucuguugauaauacuuacuugaacuuuuggcauuccauaucagauuugcggcuuguucuacccuuaaaaaaaaaaaaguuuuauaaacaucaaguuaguucaugaugaucauauaccaucuucaccacaacaaaugugugguugauagcaauguaugcaaaguaauauggugguuauuuccuuaguuccaggaguugugucaccuacaagacaggaugauaguagguauguccuauuucuguacaaauuuaaaaguggcacaaucagugcacuguagguacaggcagaguccuggaauucagacuacaguggacaggacuggcaagcauuuauggagugguaagauaaauguuugcaagaaguuggaaauaacuagaacauaggcaaguuagagcagcaucuuuuauuuaacagagggaagcaggguagcaggaagccuagggaaacuguagguuauuugaauuuauauagaaaaaguagacagugcccugagccucaagguucgagaaauguuagguucuaaaagccauaggaagcacuccaggcauuuuagacagagaacaccaucaaaaguauuccaugguaucucuguacucaguugaauuaaagcaaucauuauuaaucaaaacagugagcaaaccuguuugaaguaaaacuugaaauucuauuuuccccccagugguugugcuuucuaauuucuguaucuuggaauauuaaaaguuaacuacacuaauauauaaacuucuauaagccuuuugcuagaagagauugcuuccuuuggucccaucauuuuugcuggagccaaucuuuauucugcacuguucucuucucuuguuggccacccauggggaagcaugccuuuccugaaaaaaguaaucuagaacuaugauauacauguggcuugguguguuccaggacauguuccugguaguguuuugcacauggaaacagaucaaagcacacaucuucccuuucgguacauuuuaaggucuguggccugaauuguguuuggagacagaaucccucugugcaugcucugagccccucaggaggaagcugugcaucagccaacuguggaggcaugaagcugggauggaaccuuugcuccacuuagcacaccgagggccaacuuguauuuagugguagucacuuuuucagagagcaacaaucaggcuuuugcuuuacgauaugaauagcaauuaacuugcaguguaaaugggcauaauuaugaccuuucccauucuuuuaaguuagaagaaauugaauuaggcuuuuuaaaaaaugucuaaagugacaaguaucuaauuuccaaguuuaauauuuguaguucugggucaguaguugacaagugauaaaagcuguucauuggugaucuugucagugggugauuuuuuuagacguucaaaguuuaaaaagaaaccgauugcuuuguucauuuggggaucauaccacuuuaaucugucgguauuaaagucaccguuucugauauucucacugaugaaucagagacagggcaguaguacuuugggacagaaucauuucagauggacuucuguagaaugcagucauguccuaagauauuaaguuucgcauuuaaugaaguaccaguucuugcccauaugauacuauaaguuucuuuuaauuuuguguauuuuuauuaacuucuuuugauagcauacuccuugcauguuuaaugaguaauuaguuuuagcuuaugaugaggaaaugggcguuuaauuacaaagaauauaguguauuucagaguacuccaauuuugaaaccuaauuacuuugguaaacuugucuuguuuuuuuguuuucucuguccaguguagucucauuugugaagagcacuuugggaaagucauuggcuacacagucucucugcuuucugcuucucccucccaccuucccucaaggagccucaguauugcuugccuugguuuauuauaucacuuguaggcuugugagaacuuccagaauaaaccugaguuuuaaauugcuaucuuggaagcagauugguguucaguuuuuguacucccuguaucaucuuuaaauauuuaaauugcagacgcucuggcugccucuuaaauuagauccuucacuuaguaguuuugacauuucauaaccuugcuccucaggcauuaaauauucaccuguuuaaauggcagugaaaauuuaaaauacaaacccauauauuaauccaaugacuagaaggaagaagcuauuugccccaccaagaccaguacuacagauucauuguauugagguauuuauagagaauuccucguguaaagaaaacccucuugagucuucucugagggaauuuaguuguaaagacccacaaggguauuuaacacuuugaagauguguucccacaucuucagucccagugugguuuuguaggugaguauugaugcaaggcauccauaaaacuccagauccacagcaaagucagagugaugaccauugcugauaauuacuagguagagagauuggacugguaacggauuuaaauccccaaggugauuguccucguaucucuguaaggcuucccacugugguuuaaaguguacuucgucuuauaauccucugagauugaagagcugucuaccuuuucuuggaaggcaggauguuguugacagugauaucccuaaccaaauagaggaacagggaggcugcuuccauucuaagaaacuuacagagguaggauucaaccaggugcaucauggaagaaaggucagcccaaaugccccuuguuucacuuccuggaaauucccaggggugguguucuuuauuucuauggaauagaauguaauaaaacuuauuuuuauuaugauaagcaguuucuacaguuaaucucaacuagugaccacuauuuuuagggaaagcuacuuuggaauacauuaaugcaugugacauaaaaauaacugguuuagugacaucuuuucugcuaucuuugcuuaguuuguaugugugcuuuaagaaacaggcuagaguuacuuaaaaauucugaacucuuauaucaagugaacugaccagcuaguuuccauauugugauacugugaaaaaaagcuggaccaggugagaaaggcagggaggcagggaggugaguuggugaacccagaccucagcacuggcuaugcuucuccuuacacauggcauuugccuuaucuuuaccucuuguguuggccacaaucuauucuucuauuugugugcccugccugccuuacaagauagucaaaggcacagaacaaaacucuauaugucuuauagcugguaaaaaccuaagccugaaugugacuuuauugguaagcaguauuuguuaccaguucuuuacagcauuauaggaaacacccuuuuaacauaacuaggagauaaagaaauaaugugaauguaaguuugugcauuauaagccugguauggauguucaaaccucucaaacuaagcauccacaaggcugaggcaggaggauugccuuaagucugaggcgagccugaacuauauagugagucccaggccagccugagcuaaagaaugaagucccaucucaaaagccaaaccaaacaaugggaaaagcaagcaagcacacaaaagaauggauauugaggggagggcugcugaucccuguaugcuuucaguuuuuacauaaucacuaaauauaagcccuuuauucuaaauauacuucaggauaacuuaaaacaccucacccacacaugucugaacuguacaaagcagugaaugucacugcaugaguaaaugacucuggaaagcugagauggacuugguuacucuaaacuugauuauauaggucuuucuggacauagucggaugcacguagaggugaauaauauuuauagcacggccacccuaauuuuuagacucuuaaaaaugcuauguacaguaaaaaguacuuauuuacuccuaaaaacuacuuuuaaaagguaaaauugugugguuuaugugguauaauaggauuaaggacuuugucucaaguuaacaggguaauaaagugaaccuaguuuugaacccaggcucacugacuggagaauugucaccuuucaucacugugacucucccugccuuaugcuaagcuagagccuccugccugccucuccuugcuuuuccacucaaugagaaggcauaaaugcuuaugcuugcccuguagcccauggugaguggcucucacaaagagagcccuucagucacauagucuagagcaaagugacugcugacuggcucccugcuacaggaauaaaaccaugaaauccucaauauggagugggccaagugccagauuguauagcuuccuuagaagauugcaaaucagccuagaaaagagccuugguauucauguauucuuaccacuggauucaaacaugcuuccgaguccauggugccauagguacagaagucccaaggcuagacuuuugauuacuugaaguuuuccuccucuuuuauuuuguauuuauaagucuucauuacaacguagcuagguauagagagaaaagaguguaugugaauauuuucucuuugcuacugucccagauuccuuuauggaggacaggacaguguaaugugacuuucaaauaagcccuuggaacagcaucuguauuuccagcuguuagcgagcaaacugauugaauaaagacaggaauauuauaagcccuguuggggcaaggguaaaagauaccaagaacuucauaaauuaauauaaaaagcuggccaggguuuucuuuuuguuuuauuuccuagaaauauuauuuaaaaguaauaaagaucuauggguauaaaacaaaaagaaaaugguuaaugcuuuuuuaaaauucuaguuuugauaaaaagauucuaaauuguaguaguaaaccugauuaagguugguuauuacuagguaaugugacuaagcugaaguaaucauaguacuagucuaagcaagucaauuccagaguuggacauuuugguuauuuauaauaaauaaugcagaagacaggcuggguuacaaaauuucuguccaugcaguuggccaauccugaagagauccucuguaagccaaagagaacauguuuggaaaccacauggaccuacagcuuucuaaacaauguuuauaugauauggguaaagcagguaugaauuucaggucugaugagaugauggauuucgucacaaugcucggguccagcuuguuguggacucauguggucauuaacuagauaagauaggcuugguuuaugacguaguuuugcuuuggccacauucuggucauugucuaaacacugaggauccagugaugagcaagacuugaauagcgaggauuauaaacuaauacagauguuuugucuacugucuuguauaauuugggauucuuucauuaaaagacuucuuuagaugucaaagagacagaaagauuguaggagccugagaagacaacuccaaggacacuuuuuuccaugcaccacggggcugauaacacguacaacucacagaucacacacacugcggcagcaugcacaagauucuuauguguucaagcuagacaaaauccuaacauggaaaaaggggaauaagccccaagucccaccuccaaccaagagcgacuugcaauugaaacuugcugugagcaggaaaaucuuuuuuauacaauggagugccaguggguauaugaagcccacuucagggcaggcucggggauacuggcucacacaaaaaggacucuguuuauauuugugagcuuuuuuguuuguuugcuggauuuuguuuuguuuuaagagaaagaacuugaaguuggauguguagggagaggggaaagacuaugaugaaaaugcguguaauaaaaauuaaaaaaauaaaauuaaaggagauuuuuuugaaagagcauaacuagcagauaaagacagccaaacacuugguauaaaaaagaaggcuaugaaaacuuguggaugagaagaauauggauugugagucccuccuguguguaaaucuccaagaguucaccugagagugguguuggcaucagugauaugaaguccuucccugauaagagcuacacauuguuauauggaugccaccaucuccagagauguagaaaaaaagucuuaaauguacccgaugaguuaagaauauguacacuuggaauaauugcuugcaaaucucuugccuuuucguugccaccccugaggacaacuuacuucccuuguccgcgcugugugccacuggucuggcucgagaccucauggggacuguaggaacgggucuuuggcauuccuccuuuucugaacccuacccucagcgagccaacagcacacacuugucuuuagacagcgcuggcucucugcccgcugugaagcacuuguggagguuucugacaggagugagaguaccaguguucuuaaccuuauucccuuuucagguuuccuaugcucgcccaagcucagccucaaucagagaugcaaacuuauacgucagcgggcuuccaaaaaccaugacccagaaggagcuggaacagcuguuuucacaguaugggcgcaucauuacuucucggauucuugucgaccaggucacugguaaguagccagugguuguggacagucuugugcucccugacugacgggcggauugugaaauauucugucuccucacacagcagucuugccucuagaacacaucaaagguauaugugggccagaaaaugcaauuuucugcuggaauuguucauaaauaugcauggacagaaauagauuguggaguggagugagcgagcuugagucauuuccaccccgaaggugcagguuugaagcccguuucauggcuuguaauaaauuuauagaugcuauaaucuucauuuucaagccuccaugugaaaaaaaccccuaucccccuuauaaacaaucuuauuuuuugugaaaagcaaauuugacugcagcagcgguaugcagcugguucucugagcaaggaugagguugaauccacucugguaauugcugcgaaggcaguuuucccaggcucugcugugccauagaggcauacguaagaggaugagauuuugagugguagcaauuuguuuuaugccuaauguaacuuuugaccagaugagaauaugauguucauuagaacuuuguacgcaaagaccauuucugauaacagugugagccaauggauagcuggugguauggauuggauuacagaguuuuaaaauaacauacacauagauuuuuuuuucuauuauaaaagcaauacuuguccuuuugagaacauuuuuaaacugaagaaacauggaagggggagcagaaaguuaccuggggugccuuauuuccaagcuacccauauugcaauauuguguauuacagugugugaauuuuucuuguaaagaaaggagcggauuaacucuagaauaaaaccaggccacguuuuuaaucuucaaguagagaugaguuccguuguugugaauuugagcagagcaguguaggcuuuuccauucugugcuguuaauugccuucacaggaagugcuuuucauagacuucuggcgagagaagcagcaguguguacacuuccugggagaguggccuguagacugcgcugcugugagaaagucugagaguguauaugacugcauuagcugcaguaacgagcccguaauccuccuggugcggucugcacacuggggcaaaauagaaacccaagcuuaacaaaucaaacagaauuuauucuaagcaacagaauuaccuccuuguucaucgcauuaauuuuuuuaaaaagaauuugguucuuaaugagaaauugguggacugagaguaaacuuuguauguaacauggaaaucgugucucuuccuauuaaugauggcaaaggaugacugagccuuccuuucagagagcgaaggauggugggugaacagacaguauuuccugaguggggccuaucagcagccuguuggaacuuugcuagaacuacaaauucugggguccuacaccaaauguagucaauccugagaauugacauuuuacaccucccagucccauagccccacuuguguggaugauauuuuuaaaccuaugcuuuccuaauggagcagccaagaauuuuaguauuuuacuuuccuuugcucuguguguucauguuuuguuuugccccccaccccugccuucuuuuucuuuuuuuuuuucuuuuuuuucccuucuucuucuucuucuucuuuuuuuuuuuuuuuuuuuuaaauucaagaucucacuccaugaccaagcuaccagguuggcaucucacacuugaagcaaacuucuucagccugcugagagauggaaauaugcuagcuggaauguguguucucaauaggagcccauagagagaugaaaggggaagaauguauuuguagucacuucuuuauacguacaacuuucaugaaaaacacacccuuuuccugaaguggaauaagaagcucagcagcucuggcguugagccuucagguguuggccguguaugguguguguaucuuacauagaaaagaugaaguaacagcauaucagauaaaacaugccucgagacaaugccuuaucuacccuggaaaagucugagccuuauccggguucaauuguaaagcagacagacccccccccuuuuuuuugagagggugcucuaaaucacgaugguauagguuuccucaacagccccucauaacuucauuggcccacucugaauuaucuauacuuuccuauguacuaggcuaaaaugugguccugugagggccugguugguugccaagaaggcguuucuccaaggcugccuaccuuguguugaccaacugugaucugcucaccugccugugcccguuacaugcugcuauuccaaauuguaaacccagaaaggccuuguucaugcccugucuugccgccgcuguuaucaaagaacagucagggaauggccuuccaagcucaagaggaauguuggaggcgccagaaguccacaguucugcugacuuagcguguagucuaugcugcauuacuucugugagauagcggaagggaagaauagaagagcuucccagaccaugaagauccucuucagauucuguuuucuugagagaccuucauguuuauaugaugacuaugacaaauggcauuucuuagaauuuuaguuuagcaauauaugcucucuaguguuuuuagcaaauacauauuuuuguucuuauuccaaggaaggggcugccugucugauagcaugauuggaaaaguacuugggcacccaguuaguguuacagugcacaggaggcaggagggaauguagggaagaaagcaugggcuuauguacucuguacuuuauugguuucuugacaagcacacgguaaccagugagaccucgcauugaauagguuauuugguacauuuuuaaaagguggaagauugagguucugaguugaauuacuaagguaaaauuuucuuccugauguguuuuuuuguggcaaauguuguuuuugggugaaaagauguuaaugagaaggaaaaauuaauuuauccuuucuucucuucuuccccuuuccugcucccucuuucccaaaucuuuacuuaaaucuaccuuaggcauaucaagggguguaggguuuauucgauuugacaagcggauugaggcagaagaagcuaucaaaggccuaaauggccagaaaccuccuggugccacagagccaaucacuguaaaguuugcuaauaauccaagccaaaaaaccaaucaggccauccuuucccagcuguaccagucuccaaacagaagguacccaggaccgcuagcucagcaggcacagcguuuuagguaagucuggucuaguucuugugcccagcuacuaaacuggaggagaaugugcagguugacugucaaguaauuguaucaauaagaucucugcuuugaguuugucuuuacuauuguuuucuuucuuuucuuuuuuucuucuguuucuuuuucuuuaaugggcacagagaaaacauacuuggggaaagagcaacuuuugcuguuaccagggugaggacaauuaacuauaagggcaguucuccuccaggagugacucugccuccaagagacauuuggccaaauguagagucauuugugauggcauaauuuggguggagaugugacucacaucuaguggguagaguccagggaugcuguucaguauccugaggcauacagggaacccugcagccacagguuacugggcccaaagcacacuuugagaaaaaccaggccugcagacugcggucuaaugugcuguuuucuuuuuguuacucuuuucuugcaaagaauuuauuuuuguguuugagcugucaaguagagcucuuucaguuagcugugcuuuauaauauagacauuguuaaagauacaugacgauaagaaugcuauacguuauuucaagugcagcccucucuccuuagguugcaucuuacaguuuagagguugacacacuuuagcuguaauguucagagaggaaaucuauuaacauuucugggucaugguuuuugcaacugugucuccucuuccucccuucccuucuccuuaccaucucccccucuuuccuucuccuccuccuuucuuuucagcacuuuaaaaauuuagaagucauuagcuucugugucauacagaaaguaguguuagucugaauucugccucuggguguuaauucacugaugcauuuacccaaacccaaagaagucacuguguuacuaaugggaauaaauaacccaaauucucaaguuaucuaguugcugaauaaacaagcagaccaggaggcauucagagcauacauacuuugugugggaaaaaaaaagagugacuugagauucaguuaggaacagugaaugucugguuuuaugaaugaaucacccaguuuuuauuuaccacucagccacaugguaucauauagcuguauuguaucuaaguccuaagcuaauuuuuuauaaguacaugcaaauauauauucuuuccuuucuaagacugauaguuaacauucaaucauaaacuuaguaagauagaggaauuaauuagcuuacauguuuucuagcuuggucacauacauuuuucccauugguauaauagaguauagaaaagagaagaaauuuuuaaaaaccaacuuaaaauaucuccuccuagaagcaguuaaguaugugacuuagguguggaaagaaauuucuguuaaugccuggcugaauaccuaccuaagcuggccuuugagagaacaaugccauuguuaaaggcaggauugaagauggauggccagcucccugguccauugaguucauuugcuguaauuguaggagaaaaagaaaaaaaaaaaaaacauugaggaaaacaaaauguauaucaccuuuggccuuggugacaaguaguggcaacugaguaagaggcaagggcucugagcaacuugguuauuuccuuccgcagagagaacucugagcgccucuuuccagugcugcaugcaugcccucgcucugacgccuuucuaacuuuauucacuuguugcuguuucugaauaugguacaguucaagccgggugacuuugagcuguguuuccuagucauucugcccaguuagcuuuaguuggcuguuaggagaaagcuauacugccaugcauuguugcuuugugauuucgauuaaagcuguaguguuauuugcugguugcuauuuauuagagaagugcuccuagauucucaagacuauguccaaggacccacagacagcaguaagaguccuggucucugggcagcgugugcuggauguugaguaccacagcauucucacucaaucuuccuuucccccuuacacacccaugccuuuuauuuuugaugaguuaaaguuuuccaaaguugucacuacaauuaaauuuaaagccuuuaucuuuuguccaucccauauuacaaaaaaaauuaauuuuaucauuacuuaugagauuauuuggcucuuaaaggaaaaaaccaaaccuuucuacaggaagggaguaaggaacauuaguugaaaggaaaccccagcauuaguaagugaggaagacuaguguguguagagguuugaucuuggagucccagcuacucuagaggcugagacaggaagaucagucagagucccugccugauugugaagugcucuucuuauuguacuacauuugacaucagguagccccaagauguagcuguuaccagcuugcccagugagggcaaaaugaagcaaugagguacccaggauggacgauuuuucuuuccuaggauucgccucacugcucauccccaccccugcuuugucuaagugguaaaauguguguuacugugugcaagggaauguguuuaaucuacacuaggaaugagagaaaugagucaauuucuacagugcaaauauaucuuaaugugugacuggugcuuuuuaaaaguaucuuuaauuuggcagucauuaccuugcuuuucuucuuuuauugaauaaaaguugaucuuugaguuuauaagacacuugagguuaaggacuugaaaguuuuguuggcaucuugcucuuuucuguaguugagauguuaauuccucaacaguuauuucuucauaguauuuauguuuuagugccuucgcuuugaguuugccacuucccagcaugaauuuuagaauguucacuguguuguuuuaauguuauggugguaccuuggcagcugagaaagacagaagaauacaaguuauaauaacgaugaaaggacuuucagaauucaugaagauuaaaaaauaaaauaaaauuucauguaauaaggauuaacuuuaaaagugagcuuaugagguuuauggcucaaucuguauugauaauuagaauuauuuaaauaugaacacugcuaaucugauggucuaguugaaguguuuauaguauacaaaauaaggcagaauauuuauuugaaucaaugaugugauuucaguccccuaagaauauuuugaguacaggauauccaaauuaaacuguaaaccaaaaugucucauuuaaguuuauugagugugaccuaggcaauggcugugugucugcuucugugaguguuugugcauuuuaaaagagccucugcaguuagcaguuggguugagcuuuaggcauguugcuaguugcauuggcuugguuucauguuggaaggcacagaugucaagccucaugaauacuuguccucauuuguagaagaugugacuggauaagggaacauugaugagcuuagauugguuaacuuuaagccaacgguugcucuacacuuuggagaaguuuguuaauuuuuccacaguacacaaaauuguguuuucuuauuuguggucuuuuuuacauauuaugucugacuuuaauugauuuuuuuuuaacucaccuucccauauagauuguucccuagucuaccagcugaauagcuugaaaacuaggcauauacuuuaguuuuaugcuauauuucuaaauauucugcuuugaaaugaagguguucuagcugguagagcauucuauuagaaaugugccuaguaauaaucugaguuacagaucgauccugugauaggcagcauuuccaaaugucugugcucugcacuuguugucuaugcacauggguuguaccucuguaaucaaugaacuucagauucugaguucuagucaaauauacaaacaggaugaagaugaaauauauacucuaucagauauaacaauauacugauauauuuaucgaaaguaucuuaguacauuaagauuuugcuuuaagcaagguucauaaaguguuaacuuuuaucacuuugaauguuuugacuucgugugagagacguugaauugacuugugucuagcuucuggacacgguuucugugagaauuagaggaaauaacugguuuguuuucucuugaauuccccucacuggagcguccucaacccaauuuccuuucuuuugggacucuuucuguaaguaaagggugccuccauucaagcucagauuuucuagauagucuuccagacccauggaaugugcugcuugugauuuggcuuauaccccagcuaaagccugggugggagcagacauuggucaccuucucaggaaggcucagaguuccucaggacagcaugugacagcgucgaguggaugcagauaccgcugcaguccagauguuaaauauaauuuaagaccauucuggcuuuaaauagcacacuacaccggcaguugacuccuuaacaucugcucccauaggggagcacgucaucugcguguugucccaaguuaccgcagagagaggcugcuagccugggcuccucuugaauguagugacuuucaguuuuaggugauccuguauggaacuucuccugaagcugugggacauggaggugugacagcucugccagggcuacuaugacauuuucuccuagagcuacacaguuuacaauuugccaccugcugcuggacaaaggcagcuugaugucugucugaaguacccacuagcuucuuuaaauuccagugggacauauaaguguguagcagggagagccagggaaaugggggucaacucccuguagucacuagcugccaugccugaacucuuuccuggagcaguauuccacucccuugcucauggaggaggagaaagggagacauguaggaaacuugguuuaaauucuccaggauugaauuuccccuaagauugggagaugaaugagggucagaggaccauauaagacucuacagguggggccgcucccaggcccauugaaggucuucagagaccuccuugcaaaacucccagaaguccuccugaggauuguaggaugggauagaauugggaauucccucugugcuuauaacuuacuucaauggcagguuugguucucauccuaucuuaaaagcagacacauuuuaaagaaauucuaugucuggaguuuuauugcucaccgaaguggguggagggaaaugcagcuacuaaauuuuguccuuuaaucacuuugaacagagacuucaauauguucauguuucccacagguaccguuugucaaaugcauuucauagcuaucauuccaguaauuugaugaaacuuucuguaucugaucacuuuuugauugguguugagaauuuguguucauuuccuccugauguuuguaaccuugguuuuuguauauaaaggcauggcaucuuuccucaucuucacucugcaggacacagagucaguccccagacauucuguacucuucacaccugcucugugcuuugugugugcaaauauucucacccagucagccuucuggguaguuuccauccuacauuaaguggugggugauaauuuugguacccuuugcuuugacauaaccaccagguauguguuauaaagcugcagugcuuggaucaguggucugugcuaaguggugccuuugagguuguggacugcaacacggcagacccaaauagaugaaggaagaucuagugucacugugauuuguucucuugcaugagagcgacucaacaguucccuuuuguuuuuucacaacacaugaaagcccagaggaggcuuaagauuagggacaugcagggaaaacauguuuccauaucugaaagaccagaaggaacacuuuggccuuuauaaauugagaggaguugcuuuucuuaugugcucuucucuguguuuggguuaaccucaaaaagcugauaccuacccacuucccaaaauacuuagcuuuucacagguauuaaaagacaaaaucauugugccucaccucugaccuggggcuguggagaguggggaacauugcaguugggugaguuauauggcucuguauuagacaugccugcuccucauguguaauuuauugguaaauacuagaagcgugaggcacccauaaucgucuucuugacacugauaaugcaggauggcccaaacaaguuuguccauaaacaauguaauugugcaucucugucaaucuacaucuuugauuuuagaagaugagaacuccucugaagaacuagcucuguggguugagguuagcugguuaaucuuuggacgcuucaguggccucaggaacccauggaauuguaaggaguaaaagugggcguuugugaaggugcuggucaguuccaguuucacuuuuagaaccugccuggcggggagucggaugucagcuguuccggccccuuucacauucuguuucuggcuguucccucagaugaccaccacuuuuuccuuggcugcacugaccuuguacagauagccaguguucuaccacagugggugcccauucucucaggaaugguaaaagacccaguguuuugaaacaucaaauacauuuuuugcaccauuauccccauggaagguggcaguagugagccuagcuuucaugaacuaaaagggggaaauuaaacacugaaguuugcuaaauguguguuuugcagguuggacaaucugcucaauauggcuuauggagugaagagguaaugacauagguucaugacacccauaaucccuucccacaaccaauugauuucuuugauuuggggagcaauauuuccacccucauaaacuuauguuggguuuucuuuugcauguguagccuauuguaaaguugcuuuugaagugcguugaacuccuggaauaucuuuauaccacuauaugccacccagucuuuucaagucauuauuucagauugcauugcaacauuauagcauguuucuguuacauguugguuuucucccuucuccauccucaugaagccgauuuuuagauucuuuucuuuucuuuccuuucuuucuuuccuuuugccauuguuuaauuuguuguuuugugcagcagauagugaucauuucauaaucaguacuuggauuguuugucuguuacugcaagccacagauagagccucgguugacacaucaaguagcuguauacaucuguuggggaaguagaauugcuaaacuuugggaaaagagaaaagaacuuaaacccauugcuguaaccaaucuauguuccuuguauguguguguaugucuguuuccuguuuuguuuaguagguuuucuccaaugacgaucgauggaaugaccagucuggcuggaauuaauauuccugggcacccuggaacaggcuggugcauauuuguguacaaccuggcgccugaugcagaugaaaguauccuguggcaaauguuugggccuuuuggagcugucaccaacgugaaggucauccgugacuuuaacaccaauaagugcaaagguuuuggauuugugacuaugacaaacuaugaugaggcggccauggcgauagcuagccucaauggauaccgccugggagacagaguccugcaggucuccuuuaagacaaacaaaacgcacaaagccuaaugagcucuuguccucaguccauuuauauaugaaaacuauacaacaaaagcaaguuaagagaaacuuuauacauuaguaaaugucuuuguaagucaguguugagauggggauaaaugacuacuuagcauccuaagaaauaugugagauuuuuuauugcuaguauuugaauuaaaacuucuuaaauaucuuuuauguuugaauauggacaagagguacaggguuuuuaccugucacauugcauucuauugccuucuuugaagaagguggaccuuuuaaaguguuucagcuaagggaagacauuucuuuucuuuuuacauaacugccuugauccugugaguaaguacugaggcuuuguguuguagcucuucaguugguugucuuuccccaccuccuuaucuuuccuuuucuuucucuuucuuuugucuuuguuuuuuccuuuccauucuuuaauuagcuuuguguuugguuuacauuucaagcauugcuguuaugucucagaaaagcauuuugaaguuuacauuuuuauuuaugaaguuacaaacaguauuuauuuuguaauucugauuugggcuggggcagggggggcgacauuauaaacgcuuauuguaagaauacuggagaacuuuucguaaagcaguaccuugccaaagagauaagagccucuuugauguggguuuaaaaaaagcaucuauuuuuauaaaaaagaaaauuuggagaaacuuuuuacugguccuggaacaaauauuuugacuugaauacuuugagaaaucucuucauaugacaccuagugagcuuuuaaaauuuaccaggaaauuugcaacgguuggaaaauuuagaaagauuuaugauguagaaaaauacuuuugagaucuuuguaugagaggaauugagucagugagggaacacugcugguuucauuuucguaaucaccaguggggcgucugaucauccugguuguuaugugauagauggcucacauugauuugugauuuugaaacaaauaaaaaaaauuuacaaaagaauauauaagagcaggcaagaaauuuaaauuaccaagagaugggggaaaaucuguucuuccuaaagaaaucccuucagauagagcucaugguguuuagugauguacuugcaguaucguuugaagaauuguuuugucuuaaggaagaugagauguugcacacguuuggauggcagcaagucagcaaaggcgaccugaguuggauauauuuggagguauuuugagaguuacguuuaaggcuaacaccugagcuuugugugauguaaauaagaccuuguguuuaugaaccuuucagcuaauuuuauuuuuuucccuuacauaucaagugauguucagguuuugaauguuuuguaucaguucuuuucuuuguaaauggcauuaacauuguuacuugaggucuugcuuauucaguucuguuguccugaggacuugaauuuacagugcaucagauucguuggcuaauucugucuguagauagucuagcuucagcuguuuauggugaugcuacauuuucguuuauaaauauguuugugguaaaaaaaaaagaaaaaaaugaguauaaccauagguuuugaacaaauuuccuuacauuuuucauacaaaaaucauaaauaucuguaugcuauugaaauuuaacuuuguaugaugcuuaaaccacuauuuggggaaauaauaaaauaagucuuuaccauguaugaaagaaauuuuaaaaaauacaaaauauuuucugauuagcaucuagcuuauaauaaauuuucaaaaaagcugaaggcaacuguggccuucaucaggaugcacugagaacuauauaguuacguccugcguuuuguauaaacugagaugcucaugugcuuccccuuagaacaggcaaugugcuaugcauaacauaguuguacauuaucuuugcaguugcuuugaguuuuauuuuuuauuauuuaaaacuguaguuauaaaaauuuucaguauaguacaguacauauacugugaggcgcgugcuaaagugaacaagcgaguuuucaugcugacccacucaaugcuauucagaacucaauuggcuuagcacuuucucauauccuuaggugcauuuagauugucagaguuaaccugcguuaaaaaaaaauaaaauaaaauacauguauauauuuaaaaaaaaaaauaagguuucccuugugggcaaacagcagcuacacgcuucuuuccugugcuacuguagcaaaccacagcauugaugagaaggcaugcggacugugcuucacuucacaguguuuacccgagcacuuaauaaaauguaaggcugguauuuauuugaaguuguacaguaugacuuaauucacaucuguuggaauagaaaauauauucuguugaguauuuaagaggcuguacauguuuucuuuuguguuuggauucuuugugcuuuuucauguucgguacaucaauaaacaaaguugaagggaaagaacuguguaucuuuaaauacaucuggauugugggguaccuaugcgcagucuaguucaaaaauaaauaaauaaauaaaaag

SEQ ID NO: 1981 - RNA, 5962 nt, Mus musculus
uaugguaagaguaaauauuaaaaggccuaagagaaaaagccaauauauaaaaguuugaaaaauauuaaugccaucagagcuuguauauaauuucuaagcaaacaagaaaacauggaacaauauaauuuaaauccugaagguaaauaucuauuagucaagguugauauacccagugguaagagucacuauuuauugccaaauuuuauuuuauuauuuuuccuuucuauauuggauauuuucuuuauuuacauuucaaauguuauccccauucccaguucccccucuagaaacacccuaucccaucccuccuaccccugcuuguaugaagguguacccccucccaccccacccacuccaaacuccccgcccuaacauuccccuacacuggggcaucuagccuucacaggaccaaugggagggccucuccucccauugaugucagacaaggccauccucuacacaggcugcuagauccaugggucccuucauguguacucuauguguacucuuugcuuggugguuuagucccugagaacucuggggguucugguuauuugauauuguucuucuuccuaugggguugcaaaccucucaguuccuucaaaacuccuccauuggggaugccguccucagcccaaugauugggugcgagcauccaauucaguauuugucaggcucugggagagucucccaggagacaacuauaucaggauccugucagcaagcacuucuuggcauccacaaucguauuuggguuuagugacuguauaugcaauggagcagucucuagauggccuuuccuucagucacuacucaacacuugccucugaauuuccucccgugaguauuuuguuccaaacuagaaucacauagaagacaaauuuuagguauuucuaugugggauuaguuagauuagauuagaguagggcaacaucugugagagauuacucugaucaaguauauugaaguaagaauacacacacacacacacacacacacacaagcacacacacacuugcgcgugcacacucacuagagagagaagcaauuauucccugggcuggcguccaagaauguuaagaaguuaugugagcaagaacauugauuacucucuucuuccuggcuagagacaggaugcgaucaauugauauaagagcaagucaucucuauuuccuugccacaaaguauguucccuucuaauugugaguacaaaugaacccucuauacuuuaaguaggacuuuuaggaaauuuuuagagaauaacaagaaaagcaacuaaaacuugaagggcaaugauuacuuuuacuuugaacacaaauuuggcaaggccacaaaugccuuagcagcacugauaaauuuaauaagagaauaauuccucuucuaauagaggaaaaaaagggcagucucuucauuagaucaaccauguguaagauacuucauaaaaggaauaauauggauauagaaaagccauuccuuuguauuggaucauaauggaauaaaaguugaaaucaagugcacgagaaaccacaaaagcuacaaucaaaaaagugaauaagcccucuuaauaaggaauagguuauuaaagaaaucaaaaagaaaauaaauaauuuccauuuuaaugcaaaaacuagcaguaccuagcugaucaucuguagcacuaaaugaaugcauuagggugugugugcauagucaggguagggaggaguaaaauuaauaaucacaguaaaagaguccuuuaaauauuugagagaauguauuugauagacaauagaggguugaagaaaaauaaaagguaaacuuuauaauuauauauuaauuaaaauuaaauuuaaaaaaucagagauaucaaguaaaauaaaaauacuguaccuuaaaauucuaauggauaaauaaaacaagaaauuaaucugaaauucagauugcaauaaauaaaaucaguggaaugauuauuuagauagagauaaaaagaaaaggagauaaaauaauaaaacaauugguucuaugaaaagauuaacguaauugacaccuucauacaaaaccaaucacaggaaaagaagaccaacuucaauaacuuuggagaggaaaaaaggaacuguuacaacagccacuaacauaaugcaaaauuuuguuauuaaauaauuuaaaaccuuguucuaauuugcuagaaaucuuggaagaaauaaauaacuaaacauauaaaacauaacaaaauaaauucuggcacacauaaaugagcaaaauagacacauaaaaauguggccaaacaguaguuaaaauuauccacaaagaaaaaguuaauaauuuuguugacuaaaugcuuuauuaagucacaaugacaauagaaugcaaacaauuccucaaaacaaaaaggggaaaaaauuaccaaacucauuuuaaaaagccaguguuaauauaguauagucaucauuguuauauugcugugacgaaagaccaugaacacagcauagcgacucuuguaagaaaaagcaagggccucuccuuccauuguugaccaauuaggccauccucugcuauauaugcagcuagagacaugaucucuggggguacuaguuaguucauauuguuguuccuccuauaggguugcauacccuucagcucuuggguacuuucucuagcuucuucauuggagacccuguguucuauccaggguguguguguucacuucuauaugccaggcacuggcauagcuucacaagagauagcuauaucaggguccugucagcaaaaucuuguuggcauauguaauagagucuggguuuggugguuguuuaugggauggauuccuggguggggcugucucuagaugguccuuccuucugucucagcucugaacuuugucucuguaacuccuuccauggauauuuuguuccccauucuaagaaggaaugaaguaaccucacuuuggucuuccuucuucuuggguuucaugucuuuuucaaauuguaucuuggguauucuaaguuucugagcuaauauccacuuaucagugagugcauaccauguguggguuuuuuuuuugggggggggggcauuggguuaccucacucaggacgauauccucuagauauccuccauuugccuaggaauuucauaaauucauucuuuuuaauagcugaguaguguuccauuguguaaauguaccacauuuucuauauccauuccucuguugaggggcaucuggguucuuuccagcuucuggcuauuauaaauaaggcugcuaugaacauaguggagcauguauccuaggucuugugaagauuauaugccccaauaaagggaaauaucagggccaggaagcaggaguggauguguuggggaagagggcagggggaagguauaggggaauuccagaaaggaaacuaggaaaagggauagcauuugaaauauaaaugaagaaaauaagaaaauaaauuuuuuuaaaaaaagaaagaaaaagcaaggauuggggcuuggcuuacaguuuuagaggcuuuguuccuaucaucagagcuggaagcauggcaacaggcaugcagucaugguucuggagcauccacauguaugaaccuaugguauuuguauucaagccaucagaccuggauaccaaaauuuuagauugugugaagacacaaugugaaagugcucaacaauuucucucauauucauaaaugaaaaauaauucaacaaaauacuugcaagucaaauuucaaaacacaguucgggcccaucaacauuuccuuguggaucaggaacaacuuuuacaacaaacccugccuagagagacuauugucaagaagugcugguugggggugggcuaucauuuucucugguaguauagccacauuaaguugcccuuggacuacugaauaaauucccacccauauuauaggcaguaguuguaacuaaauccauuggaccacacaaaaugagacagggauucauugagagguaguccaaugggaguaagaugagagaggagaaugggaggcaaaauggucaaaacuuuauuauguaaguguauaaaacuaccaaacaauaaacauuaaaaugacagauuuaagugaucauauaucacagauaaaucaauuuuaucucagggaugaaaacaugacuuucuacaugcauaucaaugaauuuuauguacucugcacauagauaaaagggcagaaauuaccuaaucaucucuauaggacaaaguucaucauccuucaaaguaaaaucaagaacaaguuaaggugcucacucucuccaaacuuacugaauauagcauuuaaauucacacauagaccaauaaaaccaggaggagaaauaagcaggauacagagaaaacagggaaaaaaagccaaguaucuguauuuauuuacagauggcaugaucccacacuguaccagaaaacucugaaacaugcaggccugucagaaaaguuguaagaucaguuuucaaaacucaguaucuuuccuauauaccauuaaugaacuugcagagacaaauauggaaauacauaccaauaaauuuuucuuaaaaauuaaaaucuaucuauauaccuaaccgaagagguagaauaauucuacaauaaaagcuuuaaacacugaaaagaaaaagcagaagaagauaccagguaauggaaagaccuuacauguuucugaauugauaugaugaaaaugacuauauuauugaacgugguaugcaaguuugagauuauuuccacuaauucucuaaagauauucuucuacuccucuuuacauaaguaaaacaaauaacaaaacaaccacaaacaguuacacacaguuauugccaccuaauuuuugacaaagauaacaaaaauaauugugggaaggcaaaaaaaccagcuucuuuuuuuuuuuuugauucuaguucauuuauuuauaauucauuuauuuauugguaaaauguaggaacuuuaaaauguucauaccaugauuuauuacaggaguugcuccccaaaaauguuacucauagcuggauugagagaguauuugggaaauguggcaaugugguuuacauaaguauuccacauuacaagucuacuggggauccuaagggauuugccuuuguggaauuugaaacaaaagagcaagcagcaaaagccauugagguaaguacuucugugggacccugaaaaguaaagaaaaauaaagaaaaagcacaggguuagcaagaguaacaaauucugcaaucaaucuuuucaguuucugaacaacccaccagaagaagcaccuagaaagccugguauauuucccaagacagugaaaaacaagcccaucccuuccuuacgaguagcuggugagugcuuacuuagaguggccaaguaaacaauaaacuaaugacuguaaauaauaaaacuauguuguuacagaagagaagaaaaagaagaaaaagaaaaaaggcagaauaaagaaggaagagagugugcaggccaaagagucggccguggacagcagcagcucgggcguguguaaagccaggaagagaccaaggaaggccucugagggcucugaagcagaaaccccggaagcuccaaagcaaccugcaaagaaaaagaagaagcaggacaagguggaagcauccagcuuaccugaagccagggcagggaagagggagaggugcagcgccgaggacgaagacugccuccccccaaggccaaaagcaaagaaaagggcucagaaggauggcgucggccaagcagcuuccgaggucuccaaggagagcagagguaccaugcauggcaguaagguuacaaauguuuuaaccaguucacacaacggacuuacggaaaucuuuuuucuagacuuagaauucugcucuacugaggaggagaaggagacaggagacagaaaaggugacucgcucucaaaggugaagaggaagcauaugaagaaacacaaggagagacauaagaugggcgaggagguuauaccacugagagugcuguccaaguaag

SEQ ID NO: 1982 - RNA, 1371 nt, Mus musculus
ugauuucaaugcaccaguuuauuuaucagcucaaaucaucaccugucagaagauacucuaaaaagaucucuggaggccaacacacgagaauauauuaaacauauguggauuggaaugacgggcaauuauaaauauuuuuuucuuuauaaaaagguaguacuucaugggcuauccaagucagcaauuuacaaaacacacuuaaaagguggguuguauaagagaaaagagcagaguuuuuggacaguagaaugaacaggcaucaccaaucaaauacacuauucauccuucaaagcaucaaagauggggggggggggagggguggcaaaaaaacugguccucacaacacuuugaaaacuucaagaauuuaggaggugcgaccaggcacccaguucuugcugcuuuaaagcaggucuuagaguuguuggaccccucucaacacaccagcaguguacuuggcaguugcuuugcacaagugggaacugggaaacucuugcuucucuuucuccaucaggccaacggauuuggcgccuggaagugcccuuggguggggcuggaguucaggagcucaggacuucaaacuuccgcgugcugagaggggcggagcccggaguacuacggaggcggggcgcgcgcaggucccaccucccuccgugcccucggacuacagccagggccucggaacguccggaucaugggcgcacaggccgguggcaguuucuuggagcgguggcuccucgauggcucccggcgggcgcgcgcccugcugcucuaggugcagcugcaggagcgcucggcgguacaugaccuccagcuucucuagccgggcccgcagcgcccuggggcugcccggcuccuccucacggccauggccucucgccuugcgguugguggcgggcucguccggggcgagggucucgacggcggccucccgcucgccgcugucgcccggcagccgcagagccuggcggaagaggcugcgguucucgcgccugagccgacgguucuccagccucaggcgggcguucuccucgcgcagccgcgcguucugccggucccgcucgucccgcgcgcgcagggccuccagguggcuggccgccaggucggcgaagcgcuccuccagcugucgccgggccccgcccgcgcggccucgccagcccacgccgccaccgccaccgccgcccucacgggcccggcccaggcggcccgacucgccgcggcucccgccgccuuccccgccgcagcucccgcgccggguggcgccaccacgcaugcgccacaucgguccggucuggucgcgccgccaguccguggcccgaggggccgcgcgcggggcgcgggcggacuuggggccuggcugggcgcucggucgcg

SEQ ID NO: 1983 - RNA, 37066 nt, Mus musculus
cgggaucucgcgaguacgccugcgucaggugcagucauggaggcggaggaggcggauguggauguggaaggagauguugcggcggcugcacagccggggugaggcgcggagcgggguccugcgggccgggcugugcuaggcaagggucggaggaugcgguuggccgaggguccguguggacggcgucgggacccggggugcucccagccggaagucggccggguccgggaguggacccggugccccagguugcacuguuuaucuccacuuucugggcugcgauggacaguguuuaauucggauuccuaccugcauucgcgcugucucaggcgccucacagcaucuugaacacuggcgucuaauuuaguccugcgcccgcuagcgaccugguccagucguuugauuccuccuucucagagcaaguuguugaaaacuugggggaaaggcagcuuacccuaaaggauccagauuuuagaguuggacaagucauguuugccuuuugcuuuugcucuuccuguuuacugucacucugaccgugaucaaggcauuugaggcauuuccaagcaaggcuccgcuugcuuggaaaccaagaaucacuugucgaucuuacuguuguaagcaucgaaugaaauaauucugagagauguuuuagcauauggagaaugcucggcagauguuuucuuugcuguguuaggauaauguagugaagacccaguuaggggugucaugccagugccugcaaggacgggcagugugauuuuaaacugaaccugauuugacacgugccuuuaggaggacgcgguaucccuccuuuuaaguaaugggggccagauaggaccuccuguagaagccagguacauuacuuguaacuugucagcgacuucguuagaauucugcugaaguacauacuauuacuaguacugcuccauuuucagcccauauaguucauuugacaggagggcugcuccacuguagacugccaguccuccucuauaaggcaccagaauaagaagcauuuuaaaauagccagugaguucuuaaaaugugaugaaaaugagggguaguuaacuucacauaaauauuuucucaaaaguucaaaaguuacguggauagccugagauagcaauaacucuacaccagugugauauaucagacuugagcaagugcuugugauguuugagaaucggugaccucagugggcgagggcaguuuggaguucauaaaggaauucaccugguguucagugaccgucaccugaaagcauuggcucugugccucucucaaggguucguuuuaacuuuccugguuguguuuaguuuuucaucccuuuuucuuguaccauuuucuugacacuugagacuacugguggcauguuguaauguuaaccucguauguuaggucucaaaggagagacaaaugauuaccugaggugcuguauuacaguggaacuggccuccagguucuuaaagcauccuucagucuugccuguugcaggguauggcuggcauacccugccuccuacccuauuuucuuuagcccugaaguuagucugcccuucccccagcugcccuucucuauauaauucagccauuuuggcuaucuggcccuuuuggucuguccuuuacucuauuggccugucucuuggcccaggcagccucucucuguugcagcuucucucugcauucucuuuacauggcccaguucagggucauauucucucuggauguuccccaccauugcauaugcucucccuuuuaucuacaaugaacuuucuucuccgccauacuuaggagcagucauguccugucuuuucuuuccuucccuucccuucccuuuccccuuuuccccucuuccccuuuuucuuuucccuucccuucuccuccacuccccuuccucuuccucuccuccuucccuccaucccucucucuccuuucuuccuuucuuucuuucuuucuuucuuucuuucuuucuuucuuucuuucuuucuuucuuucuuucuaugcagcaugcaagcaggauuaggaggguccucaugucagccacugcuucuggagcaucacugacauuauguggaauggugcccuguaaugcuggaguuugaaucauguugaguuuagugugccgagugccccuugagguauuuuguguuacaggggacaguagcauuuaaggaacucuugaagauuaguuugaaacauaccaguuuuaagcauuuacugaaagcuagauacgaaaaccaagcauugcaauuugguuuucuuucaacuauuauuucuucucaucuuccuuuucugaauguuuuugaacccuccuugaggaaauguguuuugccauaagaguugugcucaguggccauuccuagugauaucuccaagccuggcaucucuccugacuuaauuucugucaaguugauguuuugcuacccugccauucuaauguacaaaccuaacucucaaauucaaccuaacacuuguuuuuauuucccuaaacccucacugaccugugucugugagcuuccgaucagaacucuaacuagaaccuaccagcacuucugugucucacaaguaccucagcaucacuguaucagcuucccucuuucagauuuuucucugagcugucccuaguucagugcaugauggcaacauccacacagucuccaggcacagaccugaacucccuccuuuuuccuucugucauuuuucuaccccccaccccccaaaaucuggucacuuauuaaguguccuuucagacagcacucuugcucauucugccuuuuuuauagauacaaauuauugcuguguuuuucuaguaguuuuauaauuauguucucuacauccaaaucugauuauguuauuaccuuccauuuccaauaggcuuugauaaggcuggccaggaauuuaccauauauuggacuccugauccuccugacucuaccuccuaaguucugguauuacaauuaaguacuaccaugguggguacuuuugugauaaaaucuucauucuuuacuacaguccucuguccguuacccauuuguuucuuuacucauucauucaacuguugauuacauucugugucauccccugaguguauauagcaguugugaaaaugaagucccugcugucauaaaacuauuaauucuugguggguagaacagacauuaaacuuuaugucuguguucaaugaagguaaauggacaagggugaaggaagaugagaagcuggcuugcuagcuuuuucuccugcacugacccagaugugaaacaaagaguggaaacagugaaagaaaaggggcagauucagaaacaaacagguccuagugucuuggacggcuagggagauugauguuacaagggcuaagagaguauacaguggaaaccugacagguuugagaggaaagguuauuuuaagcuuagccauguaacuugugguccuuaaggagauucagguagguguucugaugcauauaucaagugugaauguugcaaguccucacuaugguagaccacaugaaaauauuucugcaaugacuugaaaugauaguaggcucuugcacucuuggcagacuuaacuguucuaaaagauuuaacuauuguguguguguguguguguguguguguguguguguguggcuguugugcugcauuacaguucucucauaggcugacagggcagagcagguauuguuguguucaaaucuuuguuaaggaaagaaggugcuuuguaucaauaacuggccaggcccugucuuaugugaucuguagcugaaaauggaugcaauaucguuuauuuuuuguauauuuuguauuacagaaaugaugaaaguacagcaucaguuuuucaagaucacuaucuugauucaacguggagaagggaaaauggcugucuuguaaguaagcuaagucaggugacauaacauugcagcuaguugcccagagugccucuucucccccucccuuuuacuuuauuuuuuuguuuguuuuaacuaaggccuaauucuccaaaaccacagagguaauauauggagacacuuccuuuaaaaauagaggaaccugccaggcagugguggugcacaccuuuaaucccagcacuugggaggcagaggcagguggauuucugaguucaaggccagccuggucuacagagugaguuccaggacagccagggcuacacagagaaacccugucuugaaaaaacaaaaauaaaaaaaagaaaaaagaaaaaaaaauagaggaaccuaaccagguguggugguacacaccuuuaaucccagcacuugggaggcuagggcaggcagauuucugaauucaaggccagccuggucuacugagugaguuccaggacagccagggcuacacagagaaacccugucuugaaaaacaaaacuaaacaaaaccaaacaaacaaacaaaaauagaggaaccugccuggcagugguagcgcacaccuuuaaucccagcacuugggagguagaggcaggcggauuucugaguucaaggacagccuggucuacaaagugaguuccaggacagccagggcuauacagagaaacccuguuucaaaaaacaaaaacaaaaaacaaaaaaacaaaaauagaggacccuuuuuucuucaacucugacaaaaugaucucuugagaaguaaauuuagauccagcuaauuuagggacaggucuuuagcacuucacauuugucaacuuugauuucaauggaagacggggauaauccuagaguucaugucuucauguagcaguaacugcauacucaccugccaugccagacuggaggguagguuaaagcacuccaagugccgucaaggcacacguggcucugcugguguggaauucauagacaaaacccaguugggcaguaccuuggcagacaaaccauuuguagauugucgacugagggaauccguaaggaaaagucaauaacggacacuugaggaggugacauuuaacuugaaauaaaauggaaaaaugagugguuacauuaauuauaaaaauuaacaugcuaagcaggagaaauagugagugcaaaagcacuggcuuaugcugacaaguuuacauuuuagaagugaaccaagacauugaagcauagagcuuucaguacagacuaguggauuuguguuugucagauaugcuuuggcuacaaugguaaagaaaggacuagagggagccgggcgugguggcgcacgccuauaaucccagcgcaugggaggcagaggcaggcggauuucugaauuugaggccagccuggucuacaaagugaguuccaggacagccagggcuacacagagaaacccugucucggagaaaaaaaaaggacuagagguaauuagagcagaaacagagggacugguuaggacccauuuguuauaauccaagcaagguuuuaaauaguggcuuagcccugcauguuccagaagagguauaaggggaccaguuugaauuauacuuugaagguagagcuguucaguagauugcauuuggggauggaagagaaaggaaagaauccacagugauuccuggcuguuuaaaugguaaguggugguugacagugcucucugccaaguuagaaagccagacgagauacugaauucaguuuugcauguuucauuugagaagccaaauagauauucaaagguauuguguggguagugacuauaauagcauggaucuuaaagaaacuggaguuggaaauuacauagcuuugagaagugaaaugaguaugauuauuuacucagguucuggccgaagaaaaacagacuugaguuuuggaaacagguuaaauaaauguuuagcaaaaugccugaagccuaggaguuuuuuuguguacgguggccguuauuaccacaugaacuugggaauccaacaggcuuuaccgcaagguuucuuugcuuccauuuaacaugccuccagugcuucagauaccuuuguggacuguuuaugccugucucagggugauugugaaaaucaaaauguaucuguauauucaccuagugaguuguagcuguuauuguuuauaucauaucuuucacucaaugaaauaagauagcuuuuuaaguaauaaaauauauacagagaguuacacaugccauucuuuuguuuuuaaauagccuuggacucuggauagcaccaucagugaugagaacagagcuaucauugagaaaaugcuguuggaagaagaguauccuucaucaauuaugagaagaguaaagguuuuagggcuaaaaaaggaauuggugcaaacauuacagaagaggccacugugauuauuagauaaagauuguuuggccacagauuuugauuguguaguuucaugucacuuaucugugcaaaaagcauggcuuacuggugaaucugagacugacacaacaauucugaguuuuuguuguuagccaacucugcaugcaaagugugcguaaaugcuuaggaacgguagaauauuuaagucagaaucuuaauucuaagucuccauuuucacaaccauauaagcuaaaacugagauacuuaucuacgcaaggucaagaacauguggaacugugcagcuuacaaauguuauaugagaagaauuuuaaugaaagacaaaauagacugauuuuuaucucagaguuuguagguccuuaucuguggcucagcaacaaacugcguauucugcgccaguuuaacuucgagacucaguuuucuuauauauaguuuucuuuuauauguaucuuauauaugauaggcuuaaacaguaauuucugauuuuuuuuuggccuuuaaaaauugauuacuaacaaauacuggcuuauuuuugucuuuuccauauucauuuuacagauuucuguccacuauugcugcugguguuguuguuguugcuguuauuauuauuuauguguguuuuuguuugcauguaugucugaaucucuuguuccugguaccuauggauaccagaagagguggucagaucucaguugagagcugccaugugguuucuggaaucaaacuuaggccuucuggaauagcaguuaguaucuuaaccacagcucuguucacuaucuaauccagaauuucuguuccaacugcuucuguuugaaacauuugaaauuuuuuucuguauuuuuaauugccauugguuagccccuuuuaccaaauauuacaguuauugcuuagauuauuuauuuaaaugagaggcacauguaaucuccaauuuucuaguacccucuuuuaaaauaaaauaaagugaaauaaaugaauuauuauagcauauacucuuuuauaguauaucuuauuuaaaguauuagcuuauaugaaaacauuguuucuuuuuacgugugugugugcagggguauguuugugugcacguguguaugcaaagucagagguugacugugguuguuuuccuuauucacuauccacauucuuuucugaggugagacuucuuaugaaugugaagaugacugauuuggcuagguuggcuagccagucaaaugcucuugggagccacugccugcgcccgugcuaggauugugugcacacaaacuguugcaccuagcuuuggacauagagccuagggauccuaauuauauucgcaugauuguguagcaggcacugauugagccauuuccccagccucaaaugaaaacauccguguuucauacuaagucuuuggaaucuacaguacauuuuauuuuagcacuaaauaucaguuaaugcuaguuguguuccaaaugcuugauccacacaugugacuaguagccaccauauugaacagugcaagucuagguuauugaacaggagucccuuguucacuuccaaauguagaaauaaguagaguaagaguuacucauaagcauuugagaauagagaggaauauauguguuugugugugugucucuagcacauagccuacuguaugacaugcgguugguaguuguuaaaugaagaauguucagacuuagggaagaagcuuuguagcagguuaguuccagcgucuccgaagggaguuucucgguacauuugacguuacuuguauuaauguguagaaggauccugaguucuuuucugugaccuuuaaauauacagaaacauugguuccuaaauuccccuacacaacacauucaucaguuuacuacuuguauuuuagaaaugaaaaggauugaugcuauucuuucuuggccacuugugggagggaagagaaaggaaagcagcauugcuauggugcugacugcaggaacugugugguguguuugcuguguuauuccuacugacgcuguggaaagcaccagcuugcagcccuggacaagcuugcagcaggauagcuuuugauuacauuugaugucuuuuacaagucugucugcuugaugucacauaagaauuauaugccuuuaauauuguuuaaguuuccuuaauaauauauagguauuauuuaucuaauaaaucacuuccaggaaaauucuggguuaaucaaaaggaggauaauaaaaaauacacaaacagguaaaaaucaguuuauaguucuauuaaaagcuuugaauugcaguuuuagagacuuaccaguuuccuguuuucuguuuuucaugugcagccugcagaagucaucaaaagccauguauguaucuguguuuuuuaaaaccuuuuuauuuuaaugauguguguucccuuguaucucuguauggcuauguguaugagugcaggugcccauggagaccagagguguccaguccauuggaacuggaguuacaggcaguuguuguagcgugauaugugugcuggcaauggaguacuguaacuacugagccuccaaucccuuuuaaaaccuuuuuaguucaauugaaaauuacaagaaaaauuuuaaaaauagauauggucaguggaaaagcccucuugauucaagagaggauuuuuuuuuuuuuuaaagauggcuuuggcacagauguuaaaauacauaauuuuaugccaucuuuuauuugcuaggcuuuuaagaaaugucuucucagcaguuuaucacauaguaaagaaagacaguuuccuaaagauuuauauagaugcugcugugaauuauauuaugaauugaauugacuuauguucuguuugguaauuuuaaauguguugugugcaguuuuauuuggaucugugacuuguaaauacugccuaggaaagaggccaggcaugcuucuagucccaauagucggaaggcagaaucaggauuuccccaaguucaaggccaucuugcucuauacagucccaggccaacuaggguugcauagcaacauuugucuaaaaacuuucaagaaaaauuaaacguuuccaaauacuguuuuuaauuggaaaaaagauggucauaagugcagacuugagcacugagcaaccucugcuuuuauauuuugcugaauagcaaagugaaguuagugagaagaugggauggcuuguugaaaguagagagcuuccuucguaugcuuuaauuucuugugauacagaauuuaaaagcaguaaaugagaugccauaguuuuaugauuuaaacucuuagauuuugggaauauauuacugccugguguuuacuuucagucugaagaggucuacuugcuaucaggcugacuucuuuugaugucuuuuaguguuguguucauucagacccagggauuguauuguuugggcuccugucauucugauagagauagagagcaggguaaaccuuacuguuuggcaccagcugccucagcugccuccuucccuccuccuguaagacuaggaagucaugguuuuagcucgugacugguuuaacagcagcucccaguccccuuucacagugguugcccagaaccaucagaaaacagguauuuacauuacgauucauaacaggaauaaaguuacaguuaugaugacauaacaaugaaaugauuugauuguugagggucacaacaacaugaggaacuguacuuaaagggucauagcauugggaagaaacacugguuuauaaccuuuagcugcauaaauauggaauguuccauuucauuuuuuguuuguuuguuuuguuuuguuugcaauuccucuuuuccuucaggguagauucuccugcaaaaccagccagucauucaguaaaguggacaguagaagagaaagagcuguuugaacaaggacugguaaacagagaaauuuuaacuuacuguaaaauuauucuagaagcaaauaaaaaagaaacuguguauauuuggauaggagcuggauucuuccuuuuuuaucuguuugucauuguacauaauccauacuuuucauacagaucuuugaagaccagaaacauuuucuuguuaugcuucagugaaaucucuuucaauacagaaguuuagaaguauaaaaaguguaugugugguucagcucuugaaaauacuucauaacauggaaaacauuuaauaaaauaaccauuaacuuuuaaacuaucaagaguagauuguauauuuuucuuuuaggguacauguaacucagaauuaaccuaaguugauuuugagacuguauauauauuauuuagguaguauauaauauuuauggaagguuuuuuaauaaaauugaauuauuaacauagaaauuaugagaaguaaaauauguauuuuuuuauccaguagcaugagagcuaugugguguuuuaauacaaauauguaaacuaucuggagauuuuucaaacuuuucaauaugugauugaaucuaaaagucauuucacuauaaacccaguguaguagguuugcuacaggacauuuaauagguauuguggauacaaacucugaguuuaaaaguugcaauuagugcagaagguguccaguugauucuguaaaaaaaaauaauaauauauacacauauauauguauaugcauacuagauagauagauagguagguagguagguagguagguagguagguagguagauagguagguauauaugacuuaccucacuuuuggacuguuguaaguuucuagaacuccagagucaaagaaaugugggcuuggauuuucaacacauagucuaauagaucagguuucauuuugugcuuuagaaauauagauaaauuuucuguuaguuguuuucuuuaauguggcagcugcuugaaauauuacuaaguaagguacuauaaagcaaauuuguuucuguuuugguaacaggcuaaauuuggccgaagguggaccaaaaucgcaacacuacuuaaaagucgcacaguuuuacaagugaagaguuaugccagacaguacuuuaaaaauaagguaagcagaguacagauacccuaauuaaugacgaaauuuaggaaagucagugagcauaauuacuuagugcaaacuauaaguauagucuagauuguuuuguuuuugauauuguuguuguugagacaggcucuuaauacacagcucagucuaaccuagagcaauauuauaauccugcugagugcugagauuguaggcaugaauaaucuccuccagcuaacuagucuuacugcugagaguuucuauaguuacaguaguaaauacucauagaauucuguguguguacgugagcaugcaugcauggcacaccagggauauggaggugggaggaccugugccguguggauccugugccguguggauccuggagacugaacucacgcugucaagcuuggcuuacccacuaagcccucugacuggcccacucgcuuuuuauuuguuuguuuuguuugcuaauuuuuaaaaucacuuuggggcagcuguauccaggcugcagccaagugcagcgcaccugugcugauguacgugcuguagugcuucagcaccucuuccuuguucugagugaugcugcuguaaagucuguaaagcaguguauucauuccugagaggaaauggcaagcagccuuaacgcuuucuccagaaaauaucuauuuuagaaauauuugcacugugaaagaaaccuguggaaauuuuauaauuuaggagauagaaaugcuuacuaauauaauuaugaaaucuguuuacaaacaaaaggguuuuuauuauuguuauaaagaacugucugaaaaauuuauuaacccuguuuagaaagauguauucauggucaaguuccuuaauuuuucaaauaauuuguucuguauuuaguuguguacauuuuuugaguuaggguaguucauuuuuaucauauauauacacacacacacacacguauaugaauguuuugccuacaugaaucuguguuuaccacaguguauucaguguccucagaggccagaagggguugggcauugaauccuuaauuggaguuacagguggcugugagucucuguguggguucuagaaacugauccuguccucuggaaaagcagccaguauuccuuaauugcugagccagcucuccagaccacuguauucauuuaagcucuagaagcauaauuagauaaaaauuggaagugccucaggugagauccuuuuuuccaauguaaauaauguauucuacuaguugugcuuuauucaguauagcaaaaaauuggaauuuuccuaguuguucaucaccagaugacugaauaaugaaacuuugauauauauauaucaaauauauauacauauauguguguguguguauauauacacacauauauacauauguauaucaaauauauauguauguguguguauuuguguguauauauuauuaagcaagaccacauucucucagaaagaggguguugucuuucauauaggcaaucuaggaaauuggguacaacauaacauguagaaaagagcacaagaaaggcuaacuauuaggggaugaagacagacagagugccgaugauggacaugaaauaggaaagaggauauaaagcuaacugcuuuucuagucaagcaaaacuaaaacaccaaaauucugucaaguagucuucauuuuuggugguggauaagugcauaauguauucagucaugaaaguguaaaauccagugugacgcuccacagcuucagggugacuguucuaacuauguagauguucacugaaauguauagacuuugggucugguuaauugggucuaacauugaaacuuuggugugugauguuuauuuuacuuggcaaguuuuuuuuuuuuuuuaauguuuacaagauuuuuuuuuuaaagcaaguaaagguaugucuguuaacauguacuuacuuuaaaaaauauuuucucuauuuuguguguguguguguaaggugauuaaacuuuaaaucuuaauauugugugugugugauuuugauucuuuauaagguaaagugggauguggaaaaagaaacaccaacucagaagagcagcagugaucuucagguuaaaaacaaagaugacaggacgaaggcgugggcagcagccuguuuaaggggaagugcugaucccugccugaaugcuguaaagauugagaaguuaucugacgaugaagauguagauaucacagaugagcuggaugaguugacuucucaaacaucacagaauucuggcagccaucuuacuuuagauguuccuaauaguaaaauguauaccaccaaucaaggagaauuaugccaagaagguccauuagcuaaaucuucaggagagucucuucagaaugugaagcaaggugaaggagaagcauguucaagcucagaaauugcaucaugggcugaaaaacagaaaaguacugacaaaaacucagccgaauuaaaugagaaauacaauaaagugguggaagaacacacucuacacagaggagaaguaagagaggaagccaagcacucgccuucuccagagcccugugagaggcaggacucaaguggaaaugaaaugcuuuugccuccuugccaaauugaggaggaaaaccaugaaggagaagagcuuaagccaccagaacaagaaguugaaauagauagaaaugucauucaagaagaagaaaagcaagcgauuccugaguuuuuugaggggcgccaaacuaaaacaccagaacgcuauuugaaaauuagaaacuacauuuuggaucagugguaagaauuacauuauacauguucugaaaacuugauacucuaaaguauauugauucggcccaugcagaauuguggauuugcuagagauccaaagagcuuuugcgugucuuccuucaguagucaugauuuaaaguuucucauaauggaccucuuaaaaacuuggguaagcauggucauccauugcuaucccaguacaucaucccacuguagaguggaagccuggcaagaagggaguggccauacuuuuuagguggcagcaguuucuuggggccguguugggaagcuuuaacuauagaacauauuguccugggaaaggagagacuuuccaguuuucacauguauuucaguauaaauaaggacaaacuuagagacaggaauauuguugagccuguagugcagaaauugucugaaauagcucuucaguacuugcaacuuuguggaaugagcacaauuacuuauuaaaccaaagcacuacccuccucauuagccuaaauacacagaaaguaacuagacuuguucaugauagcuuaguaagccuccuuuaagcauccauaguugcuauuaauguuguagagagcuuucuaguucuuugggugggaauucuguguuguccuuuauuuucuccucuaucaaagguuucucuguccuguuucaguggcuuucugcuagaaagauuaauaugcacauuguuaaauaacucauuuuacuuagauaacauuaauuuacuuggcuuuuaaagccagccauguucuuaaaaaaaaaaaaguuugcucuuggcuuuuccucaucagcgcuaaagaaccaucuuguagcuaaggaugucguuagaguaaggaauacacaggagaaacaacugacguuuaccuagugcuuugugguuuacagaaagcugcccuguaucaucucauccgaguccucacaacaguccugugaaauagcaaaugggaucuucgcuguuugaaacagauuagcgcaauucucagauagagguuuaggguaccugccuuugaucuuucaaugagccacugacccaugaacacugucaguccaacucauucuguuacuccacagugccuaguugauagcuuuuaaauguggguuaaacuagaucucucuccauaccuggguuugguuuuggaaauaaaaagauggauagcuaaaguugaaggccuucaaaacaguuucuaccucagaaaugucacaacuuguacauacuuaauguuauuuuagauaaauuucauuuguuacacugaauuuuggauuuuuaaauuagcaggauaaauuacacagauagugucaguuauauggcaguaguuuccuaaguccguuucuuuaauacacaaagccuauuugguauuguuuaaauaugaagauuuaaugggaaaguauaaaagcaaaagaauguuauuaaagagaaaguauaaaguacagaacaauauacaggugguaauuuuuuuuuaaaaggggaagauaaaguuuuaaaaacaaagagaccuaccagaccuuucuuuuccaugagaacagguacaauugguuuuauuuagggguuguguuuuuaugaaaguguuaauaaacuguuaauaacauaauucgaccuuauucuacuacauaccauacauuauauuuaaacugacuucacuuuccuuacaaaugaaaaccaaguacagagaggcugaagaccuguuuacaggucccaugaggugugagggcagcuucagcuucauuguugguucaguaagcucuuuaaaagagcuguaacuccagccuucccuucuacuccuucagagcuucuggggugcuggcucguuggcucuuugguucuacucagggaaggcgauguguguggcgaugcuccucccuguucuagcauccuguauuuguuuuugucauacaacuuaacaccacugaaaaugcucccauuuugugaauugucgccuaccauacauaguccuuuaagaggcaggcagugguaagaugguucugucuguuuuauccagugcccacugcuuauaagaagugcuuagaagacaaggcauuuuguuguuggaggaagaagauugagugucuuuggugaacagauauauuuacgaucuaagucaugacuaggucuguugauuagagaagacagagguagacaaagccgguucucagaccccugacauccuuuaggagcugugcucuuuacauuccugucauguuguauaguuugugugcuuucaggaaacacugaagucucaguuuuucuguggaaguuauaauauucucuaucacaauuauaacaaaaauagauaguauuucuuuauguauuaauaaucuccauuggaauuuaaggucuuugaaauucggaacuuuucauugcucuucucccagacucuuguuccuacagcagugucugggacguggaacagauacuuagagaauaaagugagcaagucuugucugugcagucaguuaaggccugcgucacugucugcaucugcaucucuccacuucuucauguuaaguaggugcuggagugauucugccagcuugugggcucccuucuaagaugagauuggaaagucguucucauaggauugugaaaguugagccugucuaccuaacauugcagcauugauuucuaauauuguaaaguucacuguuccuguucaaaguacauuaaguaaauaagauuauuguaugaaucuuuaauuucauuggcaguuucuugauuuccuuuggaauacccuagaauaugucuauuuguuuuccuuuguagaguaaguucuuacaauuaaaaauaaauauauaauacuuaaguauuuuuugagagagcuaauaguuaacagcauuggcaaagcugggaaaaccuugggaccaagaguauaacucacuguuagaccagcugcccaucagcaggaggccaguacuguaaaaaggaaugguagggggugucucaguacuaagucuccuaauucccaaagugcucuuuuauucacugaugcagaugugaauugguuuuguacaaaacaagcuucuaauuucaagguuaggggauaccugggaucuguggggcuuaguuuuggggaaagaauacuuguaacacaaucauucuuacaaauauuuguaaguuguugaauccuuuaaagauacuuuacaugugaaaaaaaggacacuuggguauuuauuuguuacacaguuagguguugagugaagguaaaauuuuaauauauuucauauauuaaaaguuuuccccagaaaucuuuuuuaaaaugucuauucauacaaaauaauuguacuuccaucucuuaauuagggaaauaugcaaaccgaaauacuuaaauaagaccucaguacguccuggccugaagaacuguggggauguuaauuguauuggacggauucauacauaccucgaguugauaggagcaaucaauuuuggaugugguaaaaauaaaaacccaacaucuuuuacuuggcauuuuauccuuauagcacccauuaauuuuuauaaugguucaaauucaaguggauuuaaguacauggaauucagagagagagagaguauaacaugaaauaaguguaucauuaagauuuugauguuaaagagauuucugcuaauuaaacagguucccuuugaagauacaauuuuaaaggaaaguauuuuaucuucauaauagaaauaauucaucaaaagaauucuuugucaaguaaaaguaaauaacuucaugagaaaucuaagaauagcauguuuacuuuacaaauacgaguugagacgagcauaacuguuaaaaaaaauuuagauguugggaacuuuuuuugcacauauuccaagaucgaacaaagucuaauauuugaaguauauuuguuguaauauauuuugaauaaggauuacucacccuguacuguauuccugcucgaaucuguauauuuaauuauaauaaaagcacaacauauuuuuaugagacuggugagauggcucagugggauuugccccugagccugggacuugaguuugaucacugggaucuacuugguaggagaggaccuauucccaaaaguuguccuaugauuucaacaugcaugcaccuacacacaugcauacacaauugcuuuaauuagugaaagucugucauucuugauuuuucugauucaaaguugaugaguauacauaugucagugugaauucuacccuaucauugaauuuacaugacaaagcucugcaguaagcugauggugauaggaaccagagccuucccuccccugguuuuggaguugaucuaagagagcuaaccacaaagucucugacaaaugauuuaguuuuuuguguguugagaaugcacacuuuaccuuagggauacucuuucauguagauggcuuuugugccccaagcucuguguagagacuagcuuuauagguaacuaaguuacuuuuggaugcagccacaaagagaugacauacuguuuuuuguauuaaacugccaaaguuagcaaaaugagcuaggugcucauuuaaccagaaguuauacacauuacuuauuuuuuagauaauugcuuucauugagcauaacagcgcuauuuaaaaacuaaguggcacaucaaaucuaugauugugggauaagaaucauggggguucagcuguagucaguauaguaugucuuccuaauuaacagauuguacagaauaauagauuguuuuaucuuuccugaaucccaauagagcaggcaguauauaacaggccacaaccacuugauaaaguacgagcggccgacagaaaggaugcagaagcagcauaccagcuugccuggcgccugcagucuaugguaagcagcugcucauugaguggcgucugugauggucaaacuaaguagagucuauggaauuuaaguggucagugagugggagaacauguuuucucuuguguuucaccuuagccauuuaauuaugaaacagagaccaaacaaacuaggaaacccuucaaauucacuggcagaguauguaaaaacauguuuuaccaaaguggucuugauuuauaaaccuaacaugucaggugcuccagagaaggcacaaugguuaagaguacuuguugcuguugcaaaagacccaagcacccacauggaaauuacagguguuuguaacuccaguuccagaggaucuaacaugcucuucuggcuuccuggacaucaggcaugcauguagugcacugacauacauguagggaaaacaaccuaaacaucaagaaaacauaaaaacagaaaagcacagcaccauacacacuagcugggugugguggcaugugcauuuaaucucugcauuaaaaagggagaggcaggcagauuugugugaguucaaggacagccugaucucuacugugagaccauaucucaaaaacaaaauaacaguuguccagcaaguuuccuguaagccagucacaauaagaucucauuaguuucacauuaaauuggugacagguaaaauaaaucccagauuauuuuggcugugaacaauuucuacccagauuugcuguuuuaagaaagguuguuuucaaauggcucuuuggauuguacaaguuacacaccucucuuucgaagcugguccauuuuacacaccucagauacaauguuagcaaaucuagcuaagucauagagucuacacauuuuguggcuucucaguguuuauauuaauuuagcacugaccuuccuaaagcugggauaaucuuuuucuuucuuuuucuauuuucacuacaccuuuugcuauguguucuuuucuaccacagauaaauggaagcaaauccauuugcuuuguucuuuuugaucuuaacauauuuuuaucuugguguuuuagcuccuaagugguaauggaaaggaaaguaagaaggaaaucaagucaaaugcagaaaauuguuagcgccaugcuuuuuaaagcaguccuuugaugccaccgccuaggucugccuugccggcugcugcuagugcccagaauuggguuggguaucuaagcagagaacucacugguacacauggucaguagaauacaguuuacugagugaugaucagacauuacuuaaauaguuauuguuuacauguuguguguucauauguuaaagauuuuaaccaggcuaauuuuguuacguuugccuuuauuuuuguucugaauguagcgaacgaggagacgcaggguccgagauccauggggaaacuggugugaugcaaaagacuuagaaggacaaacauuugagguaauuuggccauauuugugguucauccaugaaaccuuguuucauuauuuuaauuccuauauauuaugcugauuucauuguuacuguguguaugaucuucccuauguuaauuaguuuauugaaaaauuaccauuaaccaagccauaggcaaaugguagaguuaauuagaagucugacuugugcugagaauuuugauucucaaucuccacauuguugucucuuaagucaagauguguagcauguaguuacauaagcaugcacgagcggacacacacauacacacacacacacacacacacacacacacacacacacagacacuaaaccggcuaagcaccagcaauaggcaaugguggucucacucgccaccaugguuccugugacuagccugcagaaagccagcaacagcucgcucuucccuuagccccauaaaaugcuugcucgcucucuuucucucucucucucaaaugauauucuuuugaaugauguuugauaaccaauugaaauacuguucuaaauauuauacauacugaauuauauauauucaaguguuauuucuacuaauagaaguugggucccugauaggaaacauaggcaacaaauauuguacauauauacacaugcacacauguguacacauauaaaauuuguugucaauaauuaguguaguagaguggaaagaaaguauuaguuuuguuaucucaaguagcuacuuaacuguacuaaaucuuaaauuuuaacuuaugaaguaaggaugauagcccucugaaagaauuuuaaaagaacugagaggaaguguauuaagaucuuaguauuggacauccaguaaagcugcucagacgagguacucagaaauguuaccuuccucaugcccccuaccugcccccagccuuacaccugaacucuugcuggcauaauaacaaguaauauaugguuccuucccauaagguuggucuaaggauaugagguacucccagagugugaugaggaaagaguucauaaaaagugagauguuugaacccaaggaucaggagaagaaucaccucaaaauguagauggaagcauucuaggcugcgggaguugcacaggcaaaggcacagauauaggaaaauacuaauauucugggaaaggugcauaguauguauaauuaagaguguagaggugacuagauuaugaacauuuacguaguuaacugcacagcacaccaugacacuauuauuagugcucuuauuauuugcuucauaaagauguggaaacugaagcaugaaggcuccagagcucggugauggucucucagcuaaugauguaguagagcuguacauuucugcuccagaauuuuuugauuuuugaggacccccaguccauggugccagagaucaaagcgaggccucgugcaugcugggcaugcuucaccacggagcuaccuccuuagcccuuggaaucugcacgcuugauugucacacauucuugauuaucacacugugauaucugaguugugaaagaaaauucagccaccucagcccuggaaacuaaaaaugggaaaugauagacuugaagguuuuugaaacuuaaugacuguuaccauugauugaaaugggcaauucagaagaagcaaauuuuccuuuugaugcggcuauauaauuugauauaauuuuagaaguuauugcccaauauuuauuaguagcaaggaaacaauguauaccaaccuguuuggucuuguucucacauguucuuaacuguuauauuuauucugcccuuugauuggcucuuuuagcauuugucuguggaggagauggcaagaagaaaagaagaggaaaagugcaaaccuauuaaauuuucgaaagcuucaaaacuuccaaaaagguacaauguuauguuacauaauguauuuuuuuuuuaacuuaacacacauguguagaaaguacaugaaaaaaaugcccaguaguugcauguauccaggaaauagguuuuuucuuuuucccaugcacgcguguguauguguguacacacaugcgcgugcauucguguuauugucucuguaugcauaugugagccucagguucaugucaagaacguccucuauuauucucacaccuuauuuguugaggcauggucucuauuaaaaccacaacuugccuguguuguuaauuuugcucgucagcuugacuggaauuacaggugagcuacuaugcucacacagcauaugcauggguuuccgggacuccagacuccagcucucuugcuuacaagacaagcacuuaaccacuggaccauucucuuagccuugcugauuacauuuuggaauuuuuuuaaaaauuauuuuauuucacagauuaauaguuugaaaaaauuugagcuagugcuucaaagcucuggcacauugaguauuggggauuauugccuaggggaccugaguacaacaggagucacucaacccucgacauggccaaauagucucguuuucugguugaauuuugacaaguuguuguggaguuuauuguuuuuaaugugauacaguaagcugaaauuuauaauuugcaauauggucuuaguaaauugaguuccuugauuuuucuaggccucuuccugccugcagaugcccauuaaguagacuuuaguuuuggcuuuucacuuuucaaagcaagauguuaagaaauacuguugcaguuauguuucccuggcagggcuuggguccucauuuauaaacuaguuaaagcagcucucgcugcuugcuauguucaaggucuuuaugugaucacagucaaucccuugacagaccuuugcagcguuagugucacacccauucaccuauaagcuaauggaguggcaaagagacauauuauauuuggucauacugcucaguguagaaauugugauuuaaguccaggcuuagaaaggcccaggaguccuuagaccugguacuauaauucuguuaccucuucaaaagggaaauuuaaccuuacccucugggaaaaaaaaaaaaauuuuaauaagccuagacuccuuacaauguuuagacaguuaauauucuggaucuaaaugugagacuuugauuuauugugauuuuuaaauuauucuguguuuccaggaaccuuuuaaaucaaugcaugguuuucucagcuuugugcuuuuagcauugauugauugauugauuuagcaauuuagcaacuuaguauaaauaaagguacuauuucuccuauugaucaccaaauaaaaaggucugcuggaauaagccuuauauaucauuguuuagucaucuaauauacuuuaacacaguuucauucacaaaucauauauaucuugcuuaaaaaucagauuuacaauuuguagugucucguuuacaauagagcauucccacuaaaaaugucugugcaguuuacuuguaauguuuauuuuucauggcacguuaauauuagucaccuuugcuuuucuagacuuugacugguauucaguaucuaaugcaucgguuugcaauaucuacucuuguguuccguccauugucucucuagcuuucugauccuccauguuccgcagcccuucaggaaacaacagccugcuccugucugugcagguuacauucagagacauucuucaguuuauucacucuucagcauuuauacguucccacuccaucucagucugcauuguuaguuuucguuugauuuuauuuguuuuuauguguauggcugcuuggcguacauaguguaagugcaugccugacagccuuggcagcuaucggaaucugcuggaucccuggaacuggaguuggaugguugugagggacgguguggguacuaacaaucaaccuuggucuucuggaagagcaucuaggccucuuagccuccaagccauuucuccagcccauaagccuugugggagcgggggagggggguaucauuuuguguuguugguuuuuauccacuuuuaaauuaguuuaaagaucuuuauucuuuuuuuuauuuucaaauucugcguguuuugggcccuggggcauaagccuaguaagacaaaguacccucacagacgcucaucaguugggaauucaacguguuacuccaaggugucugaauagaaauauuucugauugaauuucuuucuauaaaccuuguuucagugccuggagauaagguucaguccccagcaccuacgguggcucacagcuccauuaguccagcuccagggaaccugacguucucuucagacuguuauggacaccaggcacauacaaacuuauagaccugcauccaggcaaaauacugagacacauaaagcaaaacuuuauaaaucuaagaaauuaauaaauuuuaaaaauuguugugcuguuuuuaguggucaaaccuuucuuaguguuucuuucugguuccaaacauguuuuuaaaucuacccuugccuagauucuuucuccucuccauuucuuuacauuuugaaauaauauagggcuucuuuuuacauuaguuuagcagacuuguuacucaauaauuuaaaaagcauuuauugaaucuccauuguaguggaucuauuaugauaguguuggugugugcaugucuuucuuuugagacagucucaauauauaaucccugguuggccuagagcucacugaguagaccaggcuaaccucugccuccagauuugugggauuaaaggaauacaucauaacacucaacccguccaaauuuuaugagaaacuucuuacuuucuguuggguuucaugucagggaaacaguucuuucauugcaguguuauuaucucuugucagcuguccuuguuuaucauaaaccuuugguugcuaaaaaaaaaaaaaaaaugaauuuccugcuuucuaucagaucuaaaagcacaucuaacgucuuauaagggauucuccuggucuaauuguuuuuccuucaggcaaaaguuuggauuuauauuauugcuaauuuuucuaauuaaugauuaauacuuuuucucagucuccuugagauuauauuaauuuuuuuucucuuucagcucacuugauccuuuccaacugauaccuuguaauuuuuucagugaagaaaagcagguacuuauugucaauaacugcuuauaaauaaugcuccaauuggaugggaaauacccuuuaucucugugugugaggcauguauauaaaugaauuggacauggcaggcuauauuaaggaucugguaaaugagucaggcagaaaaugagaggaaagggaguaguuugcugcuggggcuuugaagcuuacguguuuuaaaaucuaguuugcauuggacuuugaugaauggugagaccuugguaggguggguaaggagaaaagauggguauugcuaucagggagaagaaaggcucucucuuuaugcuuuccuucuccuuauauuucaggagccauuucaggugaaaguagcugcagaagcacuuuuaauaaugaauuugguaaggauaacacaguguacuuuauuucuuuuuguucuuguuuucguuuuuuuuuguuuguuuguuuguuuauuaaguacucucuuuacaaggaauugaaauuuucuuuugaagaaaggccagacaguuguauauuuccauaguuuagaacaaaaugaauugaugugaguuuugccaacugacuaccauuauuaaccauuuaccauauuguaauaaccaaugucugcuguccgguagaugaccagaacuccaccgugucuaaaaugcagaggcuccguguuuguucucaguaacugcagacagacacgucuaccaauugugugugcuaguguuggucuucuacaggagguucuauagggacuucuugugccccuagagugcagauuucuucagugaaaaggcuccaucuucccaagccucugaggcaacaggaggccugcagggccucuccuucagagcauugucacugcacugacagccguauuccaugauagugaggggauugaugugggagcuguguuugcagauguggucugagucugcccucauguuuccuuuagcacgcccacgugucuauggcagaggugauugggcuucuaggaggaagauacucagaagcugauaagguccuugaaguaagucuucuuuuaaaacauuucaguuaccagaugcuauaccaaauauuuuauagaauuuagaaaauauaaugaaaauauugauuuauaucuuuaugugugagaguaugcaaguauagaaaguuauauguucagaaaugacuuagcauuccacauaugagcaucuguuuucuaucagagggaaaggauucugcagccuuggcuacacgcuaccuucaccagagaaaagcuacaacuaagggaaggaauauaugcuagucuuauggguaaaaacugauauucaucauucugcugaaauuauuuucauauauaauaggaacuguugaaaaugcaacauuuaggcauuauagugcacucuggaaaacuaaccguuaucauaccuuuuagauuagaaagugcuagcuaaaguccuagccuacagucacacuuugggaauuuaauuuauuuggcaaguaauacaauugguuucacuauaauccuucaagaacaaucucuuacaggucugugcagcagaaccauguaacagucugaguacaggacuucagugugagauggauccuguaucacagacacaggccucagaaaccuuggcucuuagaggcuacagugucauugggugguaccauucucauccugcauuugauccuaauccaucuuuacgagauauugacacacaagccaaauaccagguguguuguuacauaccuacauuuuguaaauuauuacacauccucuuguugauuucuauggaauaacauuauuacuuuuagcuuuacaauucuaacauucuuugcaucugcaguuuugaaauaauuugcuuuuuuccaugaaauuacauuaguaagcauuuggaaggucagcaguugaguauaagcagguuuguuguuguuguuguuguuguuuugguuuagacagauuucuagagccuuuaaaaacugacaauaugcaauaggacaggacauguaacuguaguagcuaaaagcauugauaccuuucuuggggaaaaaaaaguuuuguuuuuauucaauuuuauguuuaauguuuauuuucuauguagauggcuauuuguaaguuauugccauguuaaugagcauuauagucaaaugaugucacauuaugguaugugaacacguuuguaguacuuguuucauuuuguuugacaaugacuauuacucuguagcccuuugcuagucuggaacgugugguaauucuccauucuaucuugaccucuugaguacuguaauagauauauaccaaccaacauaccuagcuuauauaugugagaccuuuugcugccuuuuguuuucaacuuucuauauauguguguuuggugaggugcacacuucuaugugcuugcacaugagccagaggagaacauucagucacuuugcauuuuauucccuugagaugggauuucucauugaaccuguaaccaggcugguacucagcagugcccugucuccccaucucccuccccguccauccccagcacuaaggcuauagguuacauguccauauaacucuauaccagguuuauuaugugcauucugcauaggugaguccugcuccuccugcuugcauagcaacuacuauuauauacuaagccauuccccagucgugcugcauguaguuuuuaaagaucauuucugguggaaagcagaagacuuugggccugaaaauaacacuuaaggcauuucauugggcugcugcucuuuggauggggccccuuuuuguuuucuuuucuccaguuagcuguguaguguauugauauuugaaauuaauuauacuuuucuuaucauugcagaguuacuucuccagaggaggagcaaaauucauuggaaugauuguuaguccauauaaucgaaguaauccuuuaccauauucccagauaaccugcuugguuauaagugaagaaguuagcccugaugguaccuaccguaaguuuucagcaauaauaaguucuugcuaucucuauccucaaaugaaagaacuuagaacuguaaaacuauuuaaugagauacauugugaaucagccaaggacuugaugggugccaccuaguuaaauuagccucuuuccuuucauccuaguguuaccguggccuuaugucgcgcccgcucucgaccagcaagaacgacgcgaccaccaguccuucuaacagcaguuuauucaguccugauucuucuuguuuauaucucccccgaacccugggccucucacuccuuuuauacucucucucauccacgcaccgcaggccacgcccccucgccagucacgaggcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacagccuuaaauaaaaggaagaaauguagagcaauguuagagcaggcaguguauauacugagcacuguguucacaggcuguacauucugggcacuauaaacaucacaugcauaagcagugugucuauacugggcacuggagacauuguagugcauuaaacaugguucucauaucacgaaaauaguuucauaaaugcaaucuuguuuucccugcuaugccauguaaauaaagaaaaaacaaaaccauaaagucuucucacuccuguugacugcuaauauaucuuuauauauuuaaaucugcaguguuuuuucugccuaugucucuuaaugaaauuuauuuauuguuuuuguauuccuaguaccaacuaguuagcacugaguuuuuauugaaugaauaauaauaauaucaguaguaguccagaaugcccuacugaguacagcacauaauacacauaauuuuucaacuuaacucaaauuuauaaagguuauaaaagaaagcaucacaauaaacuugccuuuccuuuaagucacaucucagucuucugaguuuugaucaugauccucucuauucuagucauuucuaauacaguuaguugauacuggguacaugugacuuacguuuaaauauuauaauuuaauaauuuaaaaugcauguaauucugcuccugaccaaaaugauuuaauaaugaagcaaccaaaauaauaggcaaaauaugcagaacaguauuuuauuuagaauauaacucaggcugugaucuuugagucauuugcuuugcauuuuuuagaucccaucuggcacaagaguugaaguugucuagaagcuuugagaugacuguacuucccuacuuuuaacccaggcucuacuuuagaaugucucugauagcuaagcauuuucugaacuuugaucaguuacaaaauauacauauugauuaguuaucugauaccuugguggauaaaaauauucugaaugaaaggcuguuuuuacuuaggugccuuuuuuaaauagaauuuuucuuaaccacacuacguaguuaaguacgguuuaucuauacauguaauguuuuuugucagcccuacccuguaguauuuauucccacuuucaacauuaauuaagaauaguaauuauucaacuauuuuuauauccuggcucugacauucaccauuuauuuuguuggacuuauacucucacuugccucugauaucuucuguuaauggggaacaaaauuaccuugcuuacagagucaguacuugaaaggauuguagcaugcaccagggcuucaguagguagcuacuguagcuggcagcugugcucuguagguaauccaggugugccagguguuguccucaccaaggcagacuugcucagugaccccgcacuaugucauugcucuucacuugcaaugagagaaauaagaagagaggagaggagaucugagaaaugaaaagagcucuaguuauccucaggcuugcugucucuuuccucucccaaacaccucuguuuuguauauugauaguuaggcuggccuuuguuuccuugggaaagugccauuguuuuccuagucaggccuggggucgucucaguuuuaaaauaugaaugccaccugcugaugcagcauugucacuggcuugaugacuuguucuaaagaugccuugcuuugcugagagcagucccagguugucacugacacugcccucuacugcucagaagauucuuggcuuggaagauaacugagaggacaucaugccuuucuacagagcugucagaaaaggggcacuguuuacucuuaauuauuaguaauagcuuagcauaaacaugcuuggaggggcaaauauagucaggcaguaaacauucgaugcacgcucaguguguucaaagagccuaccaagcuguaaucuaaaaacguugaagagaauuuuaaucagaaggggacuggagaaauaguugaugaaaauguuucucuuuaaacuugucuuagguuuaccuuacaaauuugaaguacaacagauguuagaagaaccucagugggaauuaguguuugaaaagacaagauggauaaucgaaaaauacaggcuuucuaauagguaugugcugagguuugugauaaccccacauuggcagucccucacuugaaucagagaaagcaaagccuagauuaauaauagaauacugaugucugaaauuauggauagcuuauuucacagccaauuguauauuuaucucaucaauugcuccuuaaauucccuccuacagcagcguccccauggauagaaucuuucgccgggauuccgaccuaacuugucugcagaaaguaaguugccuuaauuguuaauugguuccauugugcagauuccaaagcuggucaucuugcuguguuucccacuguucuguggauacauuuccaauuuuuccauuauugauucacuuuguaaaaugaguguguuauacugacuaagaaauaauucucuuguagaaugcauuugucaguguuaacugauauauugcucggcagguuauuauuguguacagugaagaaccuuuuuuuuuuaaacuuuauaaguaccguguuucccuuggaacuguaauggucacuuguuuuuaagaaauauaguauaaauguaauuugaauuuaaacggucauuucuaacuuuguacuugaaaauucuaaagguuuagaauuuuuuuucuacuucugauuaagaugaauagacuguuaacaucuuugguuuguguuuagucuuuuauuuuaguuuauuuagucuuuugggaauaauccuaaaaauuaaacuucccaaguucuuucugcugcuuuuuucuauauacuauugaaagaccaaugugugcauucccagaaaacugcccaugcgcuauguacugagugcucguuuuguuccuuugguugugaugggcuccgauuugaaccuugcacacugucugggcccugugcuucaucccuaaacccacaggcuuacgugcuugguuguuugcauuguuuguuuuuaaaacuuuagagauaauuugucucuguaaauguaacugcuaaaagggccaaaaucacagauuuguacaaagugaggagaauuccuugcgcaugguuuauuuccugcggaguuguuagggagcuaaauguaccuucaccagugauuccagugcccucgucugagauuugugaggacaguguuucucauuuggguauuaagaaaucugggguuuaaaaagaaauagugacaguuaugcaagcccucuuaauacuuaaauauuuaaauauaaaacuuuucuuuuuuacuagcuuuuggagugucuaaggaaaacacugagcaaaguagccaauugcuucaucgcugaggaguucuugacucaaauagaaaaucuguuccuuuccaauuacaaaagcaaggaagagaauggacuggcagaagaggauaguacaaaggaauuguucauguaauuauuuuaaaguaagauguucuaaucuuggcaugcuacuguaaauaauugagauuuuaaagcaauauaaauuauguuuuuuuuuuaauccauaaaacucuaaacuuucucacauagauaaugugagaaggaagagagagcccuuguucucauagugguaaucaagagugguagagcccugccuaugcuaagcugugcagugggcaugaaagcuugagcucugcucugccucguggugugcggcuuaauaacuaggagaugaccgagcuccgcuuuuucucagagggacuguuucucacuuugccaucucauuacacacacuuucuucccauauguucugguggugagauuguguguguguguguguguguuauuuggauguugcagccuagguguggaacauuaaugggguugagaacuacugacuaauaaaucuaacagcaugccaacacagcaaaagggagcauccuuaguaauguucagacaggaguccaaaggggagaagaaccaauuuucagucugcggugugugcuucaucuuacuguguacacuauaccauaggacagucagccuccucugcgauuuaaauguuuaaaugaauuucacaagggaaauaauuagcuccaacucuguccaauugcaguagcaugugacaaaaugucauugaacuagacuugguaauguagcccucaaccuagcuuuuuucccuacugucaggagaaagagaaaaaugagucacauauuacaauagaaaaaaaaaugccaucugguauuuuacauagcuuaacccaguuucaugcacuugcugaauauuaaaaguaaacuuuuuucauguuguaaauucaaauuguucauguaaguauuagugaauauuucugcuugcuggagaacugguguuugacccuguccaggccuucuuauuggcaacaguuuuguuauauugaaacugaaugugaguuuagaguuuucuuuuuucuuuuuuuuuuuuuuuuuuuuugcuguaguuguagccaaagggggaggcagcacuggauggagugacugcagucauaggugaccugaaucugauuugggcacugugauuuaaagaaaaggcguuugcuuucucuaggccaaguuugucuuauguagcugaggcuaauccagcccugaguguugcuccuacucugauuuaucugcuggcuuguuaggcugcacuuuuggaacuuuauaagaucguguaauugcaaaauuaauguguagcuuuaaaagagaacuagcaguuuuuccauuucccucuguacauuuaauacgaacaaugaaacauacuuuguaaaauccucuugaaaucuggaagugcaaggacuccagagcaaaaaucaggaauccugagcucucaaccuaaucugcuuaagcuuugguaaggggccucgcuccacgcucagcucucuaaacucaucaguugagauucaaagagcugaauucuaucacuuguugucucuucaagcacacaaggcuacaaaagucaguagcaauuaauucauuccuuucuguuuuccuuccucuucaccugucucuucauaggcuguuggcacagaccugaaauggaugauaauuuacuuucuugcaauuuuccuagaaugcuguugaauuuuaaaaaguucuuucucaaaucuggacuuuacacaugccagugguuaagaguauucacuacccugaucuauacauuguaaggacccaacgggugccaauagucagaguguagggccuugagaacagaaguuuuuaagcaacuauugagaaaauacaacuauuuucugacuguagaauauauuuguaauuuaucuuaugaaauauuuuuaaauacagugaaauauauacaaagugcaaguaucucaaaccuacuguugaggaaauauuuuacauaggaaucagauucuuaaccaguuuuuaacagcauaaauucaggauauucaguuauuguuugucugcuuuuguuuucugucuguucucugugcugccuucucuucucuuguccuagugucuacuugcucuggcagcuguagguggccaaccuaggccuccugagacugguuagagccaagaccuuaaagaagcacagaugagucuggaacuugaggggacauguaacacagaaguucauggagagagagagagagagagagacagagacagagacagagagagacagacagagaccgcccuucccaacaguguuugcagaaguggaggaccagcaaugccugagucucuuuauccuggguucuauuuuuauuggugcauaaaaauagaaauugagcuuaaauuuugucucuuauucugacaugguuaaggacacuuaauaauaguacuucucuuauauuagacuuacuguucuucaaaacuaauacucaagaaagcaaaaucaguggaacaagaccaguaagguaaaacucgcuggccauuguuuaaccuuggcccuucuucuccacuccuuuuaaauggcuaggagcucccagucuuggaguugguauggccaccugcucaaugcucaugagguuuuaggcaccaagcacuuuagcucacuuugaccucuuccauauagaauuuaaaauuacauuuuauaauuguguuuguauaacaugacaguauucacauuuuggauuaaaauauuccuuuaaucuaaaacuuggauuauuuuuccuaauaaaauuaaguaaaauguuuguuauacacccuucaaaauucugagaauuugagacuguaccugaugaaugguuuauguucugagaggguuguuggaaaaaugcagaccguguucuccaucccuuaccaccacucagguguuuguuucacuccagccaggagcacugcagguccuccugucacaagccuggacaucugaacuucguccuucccauccuagccagaacucaguauggcuuagaucauccaugggaggcggaggugcaguaguuagaaaucaguagauaggaauuuuauuuagguuccuacuuuuacagcuugugcgccaccucacagggugaggugccuuuuuucccuuuacugucaaacccucauauucaucuauucauccauucucacagcucauagguacaagagcuuuauaucauucauugaaaguaauuaaacagacccauucagaaaaugccugcagucauuuauuguuuagcauugguccaggcuucuccacagaauguuccucucgggcuaggugagguugguagcaugcagacuggaagcaccguuagccucuucguuucuaaggacagagaaaguggcagccccggcauuccagccuaagcuguccuacugcucuuuaguuuaccuuuucccauguacauugcugaguccugacggaaggaaggcgcuagagaagccaacaaagccugugcacgccuccacucugucucugcucugugccaacugaagacacccaauuggccaccugcuuguggacacacuugaaguucaccggcagacauccuauguugguuucucagcaggagagguggccacccaaauuucccuuuucuacuuaccagcaaggcacuuaaucuggugucacgugacacucauagagaaaagcaccugcacagaagcacaagaagagcacacacauucuguuguguuagcauuaacaaacuuaacgaacaaacuuuaucucuagagcuucaucucuaguuuuguauuuagcucuuagaacaauauaucuuauaauguauccagaaaaaucagaauaauguaauauccuucgauuauuauuuccugaccuuucugaaaaaguuucaugcaugcuuucauuuccuguaacuuuguuuucugauaucucuucuaccuuacucccuuauugccccgaccaaaucaggaggaaauaaaagcauccaagaggaacuuaaaagguucuaaaugaaacuaaacuuuaaagccgaaauuaauucgcagcaucuguguagcuuuuauuuuuguccuuugcuguuucugucauauauucaugugaguuccagggaaaauaaccugcuuuguugugucugaggguuccuaguagcuuaucaggaauucaauaaauucauauuuccgguguuauauguuaucaaaaaauugaggccugugugguggugcacaccuuuaaucccagaacucagaagcagagucagggagcucuccagugcucaagguuagccuggaacaggaggacuacauaguaagacccugucauuuaaaaauaaaacaaaacaaacaaacaaacaaaaaaaacaagacaaaacaaagcugggcaugguggcgcacgccuuuaaucccagcacucgggaggccgaggcagaggcagaggcaggcgaauuucugaguucgaggccagccuggucuacaaagugaguuccaggacauccagggcuacacagagaaacccugucuugaaaagaaaaaaaaaaaaaaaagaucaucugcuucagcauaugaguacuaaaguuguaauuagauuuuagcaugauuuauguagaggagucuuuuauaaacgccuuuaaauguguagauuggaguugauuuauacaguuguguuguauauaagauauugcaugacaguuuaugaacuuguugcuguuuucucacaauauuaacaguuuuguaaauuuuuucacuaugcauuuacaguguucuauaacaauauaugacuuaaaacuauuuuauacauuuaaauguuauguuguauauaucuacauuaaagaauauuguaaauaucaauguuuguaaaauuauaaguuuuccaaaaauauaaacucauuuuuccauaucuacuuguggcauauuaaaaauaccaguuuuuaagcuuugacguauuaucuuguagugaaagaggaggaucaugcugucaauucaauguaagcaaauguuaaaaauaaaacagguaguuuuugaugucuuuguaaau

SEQ ID NO: 1984 - RNA, 4680 nt, Mus musculus
acauuaaacauuuauuagcuuuauuuccagaugaagaaauucuaacucagaggggaaguauuuacccagagagagcuauagaaguguggggaccaacauuugaugauuucaugugucuauaagaguugugugccucauccuuaguuauguugucugcgucuucccucacuguguaucuuaguuuuccauuuauguuaugacaaaugacuacacacgcagacguuuccaauaccacacauuucauuacucuuuaauagaguccaacucaccuaaaccagugugggugacugaacuggaagccguggcagcugcagaagucacaggagacccacguccagccccuucccagcaucucuuacucauguuguuccuucaucucccaucagcuguaccaucagcugcuauugucuucccuccaagugugcuuccugcuuccucuaacacgggcugccagccacauguugcuuucucuucugucugggcugagugucccucuggcucugucugaggagaacaaugggauuguguuuggguacaucuggguaacccaagauaauguucccaacuuaggagccaacauuuaaucacaucuuccucccuguuaugugauagcuauagguuucagaguucagggcccaaucaauuugggggauacuuuuuagucauccaaacuuucuuuccuccugaaaauggcuugucagauuacuuuaccaagaguggaaauaaggcucuguuuggcuagccacucucuucacuuguuuccuuggugacugaaaacgcuaccuccaccuguuucuuccuuauuauccaaccuucugaaucaguggucucauuaguguuugauccuugguaauccuucccucuagugccuaguucaaggcaccauggauuagacucaggagaauggaaguacuuccuacagggaucuagcaacagaacuuugcagugucccauguauauauauaugggaagucaccucgugaugccaagggucagccguuuagcaggaagcuauaaaggacaccuaaaauucagaagagaaaggagcacaucccuauccaguuuugagcacaagguagacuaaugaaaagccaaaggcagcuacuacaucugagcagcuucuauagauuauaccaugugacacucuuucauguacuccucacuucuauagguuauucuaugugacacucuuucauguacuccucacgucagcccaggguggugcauauuauguuuacaaaugaggaaacugaggcucaaccagcacagucuugucuaaccucuaaucaccuaacuagaauugggucagcuucuacacgacacccuugaccuacaaccuuggccuugggcucaguaaaguaaaaggaacaugagugcagugccccauggauacaaauaagagguguccacauuguaaugagaagaauaccagaaaccacaugaugugaguccccagauuagcaggagaggucugaguguaucagauuugacaauauauuuuugaaggugcucacucaagacuuuuaaaaagcauuugaaacuaaauaucaaaaauaaccaacugugugguaaagggguagauuuacuuucccagcacuugaugugacaacuggcccuaguaacgacaaaaguucccccaccgacuuaccgauauuaaucuuuaggaucugcagacauguaaaguagauacaauuugucauauucuuuucaaacagcugcuccauuguccaucacagguuacuugcucagcaucaccaagugacugguuuagauuaaugacaaccauugucagacauguacugcuauaauguacaaaccauuuuuaacauuccuuauuuuucauuguccuugaaaaaugcuauguugaaauaauaguaaugucuccagagauuugcuguauguuuuuuguuuugguuuuuuuguuguuucuuuuuuguuuguuuauguuuauuuuugagacaguauguaucucuggcuguccuggcacucacuucagagacuagacugucuuuaaacucacagagaucuacccaccuaccuccugaguguuaggauuaaaggugagagcaaccaugcccaauaugguaugucuacaugugugcaugcaugugaacauguucuauuggugcuguauaguuaugccuacaugugugugugugggggggggggucgcauguuguauuagucaggguucucuagugguacagaacugauagaacuaauuuauaucuauaucuauaucaucuauaucuauaucaucuguaucuaucuauauccucuuucucuuccuuucucucucuuucccugucucuggaccagcaaguccagcagugacuaucuaccaucaaaaaagcaaagaaucguaugauugucccacuaaugucucaguuggucuuaagucuauguuggagucuugaagaagaagguagcaaaggcauaccucagaaacaagauaaacuugccagcaagagugagggcaaggagcaagaaacaaaaguuuccuucuucaauauccuggugcugucaccaggugugguucauauuuaggguaggucuucaaaccucacuguugcaggauauuugguaacaccaugaaacccaagauuguguuauuuacugaaaaaaaacuguuucuaguuuucagccuuuucauacacauuuaaucccuaugguggaaauauagaggugacuaguauacaccuuuaaucccaaacaaugaagguaaguuuaguuuguagaaggaaguacccauguuugaaaguaaugucuaauugagugacaaagugaugaaucggagaaagauuugacagaaugaaucagagauagaauaugaccaguucccaugagaagagaaaggaaagggaaacgacuaaagagagggcagcguagagaaaagaaaggaggaaagcaguuuuaccaggacaguuuuacagagacagacugaagagaggacaagcuagacccacgugaagucacagugaaccagagaaugagaaagagccagaugauuagaacauacugcuaaaguuaauaugaggucaaacagagccaaaguuugagacugagagagaauccaguuugaaucagucagcuuggagaagaguuugagccagaccuucugagccagagaucaaucagaaagaguuagaaaggguaaguuuauacagcagcaagucucagaggcugaaagcauucgaggccuagaucauauggaggauagaagcuuccagacuaggccuaaguuaucagacugaagcaguaagucuuggagaugacaauuacaucaggugaauaaaaguuacuuuuauacucacauaaccugaauuuggggugggucuuccaaucucugaagauccagauuuagggugagucuuccacuucagaugacuuaaucgaaaaaaaucccucauaauuguguccaacugccaggguuuuaguugauucuagaucuggccauuuugauaagauuaguuaucacacauauguaugguacacacauaaggggaacacuacauuacauaauugcaugaauuauguccagaagcccagaguugacgucagaagucuuccuugauuguuuuccacuuuauugguugagauagggucucuagcuuuacugagccuggcaauuccagcuacucaagcuagccagcuugcccaagaacugggauuacagguagcuggcauacuuguuuggguacuggggauucaaacucuaguccccaugauagugcagugucuuaguuacauuucuccaaugugaucaaacacuaauuaucuuagcugugaagagacaauaugaucaaggcaacucuuauaaagacauuuaauagggcuggauuacagguucagagauucaguacauuaucaucaaugcaggggcauggcagagcccaggcaggugugauacaugagaaucugagaguucuaccucucgauccaaaggcaaacaggagaagacugacuuccaggcagcuaggacaaggguccuaaaucccauguucacagugauacaguuccuccaacaaggccacaucuacuccaacaaggccauaccuccuaauagugccacucucugggcaaaguauauucaaaccaucagucugacuaaaccaaucugaagaagaaagguuuauuuggcuuaacuaucccagucaugguccaucauugagggcagucagggcagaaacucuaaagcaaggcccuggaggcagaaacugaaguagagcuaauaaaagaugcugcucucugucuuguucuccacgucuugcucagccuacuuucauauagaccccagaaccaacuacccaggaguuuccccauagacuugucugcagcccaaucugauggaggcaaucccucaacuaaauauuccucauuccagaugacucuagauuaugucaaguuuacaaauacaaaacagcacaaccagccagcacccagagcaaacauauuacccauugagucaucucuccagccugugaaaggguuucaucaagcagaaagagcuguugaaguucaaguugcuaccauugugauagggccuaaauaagagguuugagguuaguaaaggaagacacgaagcagauaaaggcagcucugggagaacuggcuccaaggagcauugcuuuuucagccagccauggaauccacuucacucccuuaacuaaauaaauggca

SEQ ID NO: 1985 - RNA, 1245 nt, Mus musculus
gacaugucucuguacccaguguuaggguugugggcacucaugccuauauccagcuuuuugugugcgugcuggaagguucagugcagggcuugaugcccucagaggagucacucuuaacuacugagucaucucccuagccuuucauucuucaugguugcaaagauucuacaccuuaucuucucuguuuauauauaggcagguuucccagcuugcuguucacaaaggaggaugggugugcauuuucccagugauuuguugacuuggaguuugggguaauacaugggagugguauagcugggucauuuaguaggucuuuugaguuugugggggaaucuccacauuaaauuucacaguagacuuacuuauauucgaauaguggauaaggacuccuuucuguccacauccucaccaucauuuuguucugguuuuguuuuguuuuuuugaagccagaacauuuauuuuaugauugauuggaauccucaagaugaacugggugcugcaacagcuuuccucuuggguuuagguguuguuccuucauggaguccguaucugaaucugcaauagacaauuuuuagguaccucaucugcccagcacugguagcguuccaucucuuagccuuggcacuccaguuauacuuucucuucugcuuggcaggggagccacauuugcaauggguuggcuucugaaggugguaggccuuagagccacaccaguggcacuguguguguguguguguguguguguguuauugugaugcuuuccaaaggauggcguucccuucuccaucuugcuuccacuacugaggccagagaacauuauuuguuuuuuuuuuuuuuuuuuuuuuaauggcucuaaaagauauuaagaaacaucuaacagcaagaaacuggccggggagaaaaugaguucuggaaguccaggccucccucuuugggacagggcauaaacagggcacucccagggcugugccacauuccuaaucacuccgccuguucaccagcaaccuuugugcucuuccuguuugcaaaauggacacagaugaagaaguuuuggaaaacacgagaaaucacaaagaaaauaaaguuguuccuguuaguuucuauguauguuuauacauccuccaugcagaaaugauagaacgggcaaacucuuauaacagcuucaccuuguaaagauuuuucuaucucaaauauuuuuuaaauguaucuuacauuauuuauuuauacaaauaaagauuauaugca

SEQ ID NO: 1986 - RNA, 11741 nt, Mus musculus
aaaccaaugacaaaugcaaacuucaagcuuuaauauguaauaguaaauaauaaagcaauguaaucuuguugagucagucagccugcagucucuucuaacuuaucauguccuuucccaucccacuguggccucuaguauuuuuccguguguggucacacugacaagauuccuccuuaccaagguagauagcuacugaaaagcuacauacgcugucuaacucaaccaacacucagggaguuacaccgcuuccccagccccuuucccugggggaaaaaaagucagccguccacccuucaagacagagacgugaugguccacuguccaacucuacuugguuuuguauuuugguggacagagagcacuccagguugcuaauguauauuguucaacagaucuuucaaauaggguauaucagagauaaacuucuugaauuccucaauaucaaaaaauaucuugguuuuaccuuuaaaaucaaaugccaguuuggcaggauaaaggauucuuggcugaaagccuucgucuugcagaauuuuuaugauaccacaccacuggcugcgugcaucuauaguaccaggugauaagucagcugucagucugaucuuggacccucuguagguuauuucuuguuuugcucuggaagcuuuuaggacucucugcuuaucacuagcacucccaaacuucacuaagaugugucuaggcgugagucugugcucauccacugaauuagggacacgaugagcgcugacaaucucgaggcucuggucuucuagcucggcaaaguuuucuucaauuacuuccuuaauuauguccaccgcuccguucucccgguuuucuuucucuggaaucccuaucacucggauguuggagcuucgaaaccuaucuucccucucucucagccuuucuuuaucaacgaucucccuggcuaacugcauuguauccuuggucagucccuccacggcaucuuccuguucgcucacccuggccucaaucgugcaagcuaaggaauucagaucauccagugaacuuuucauauucaggacgucggaaacguaaauguuuuugauuuugucgaccucccuuugcaucugucugauaacacugaucacgccucucuugaaguuuucuucgguuucaaggaucaagucugcuucuuuggcuguuggcucuucuguuugcggcaccuuguaccuccccuuuucuauguucguuaaaaguggagugacuugugacagagcacucaacuuuguacaugaauggcuuuuaggaccaucgcuaccugccccuaaagauucugauggagaagucaaauauaagguuagacacggcaucccgauccuuugaguagaagcagcagcugcuccucccuccuggcaucucaccagcuuuuuuuucuuagagucccagaccagguaacuaaaggcaaguucuuuaagcccauggaaggucuccuuuuucuuagucugggaagccgucuuucuguuuacuucuuccucugauucagaaucuacuaccaaacuaaugaagccaaucuccucagcacuccuggugauuuucccaacaccacauucuccugccacuacaaggcccugaaaggccgagcccagaacuucgcuucguauggaggcuaccuccuucuuccccauuucugaguucucuuccuccuucuccuccucccccuccuccuccuccuccuccuccuccuccuccuccuccccagaguccucuuccuccucccccaacucugaacuuucuuccuccucuucugacuccgaacucucuuccuccucuucugacuccgaacccucuuccucccccaacucugaggucucucccucugaaguuucuucucccugugucucugagauuucuucuucuucccccuccugcuucuugagaguuccuuuauucuuccgguccaguguuucuucuuuguaagucuucaccucuggacuagcaacuucuaccucuuugaugaacaggaagcucaaacugucacucgcuauucuucuagcuucaugcuucgugucuccuagcguuuuacccuagaaguuuaaaagaguuaguuaagccaaccauguuuucucagugaauuaaaccuauuuuauccucugaauuuaguauacuugccgugaaaauaagcaaauaucuguaaauauuuuccccugugguguuaaaggucaaagucagggccuuggacaugguaggugagugugcuugcacacacaagauagugcuagaccuaucgucuauucucaaagacacggguccccaaauagauuccgucuucuauaaugagccuaacaguugcuuuuuccgaaguacuuagaacacauuuccacaggcucaugccugcucugacuuucugugcccucaguaucuaauguguugcgcguaacugacugcugugcacaacgaugaucucgcuucauguuuugcagaauccuauaccauuaagacccuuguaagccagacccacugggguaguuauuuauuuuucccucuaacauaaguuaacccuuuucccccuuaaauuguauguauguauguauguauguauguauguaugugugugugugcgcgcgcgcaccacagcaauuauguacaagucagaagacaacuuucaggaacuuuccugaaaaacuaacuuucaggguuaguuuucugguuuaccacugggucccagacaggcccucaggucaucaggcagcaagcaccguuacccaccaucuuggcagcuucaauuuuaacuauucuuuucuuuuccuuucuuuucucuucucucucucuuuuuuguuuuuggugagauagugccacuaauagucuaggcuagccacaaauucaugucacucuucaugccucaggcucugccaacauucauagaaaccacgccugauuuauaugcuguugggaacugagcccaggccagcccuccauucuaaagaccaaaagauaggcauagugacgugugucugucaucucagcucuucagaggugagguguuaggauggggaguggaggcuagccugggcuaaaucugagccuuggucaacacaaacaaacaaacaaacaaacaauagauaaauacaaaauagcgagcaacuggaauaaacugguuaccaagguuggagcccagccuuucauaaggugauaccaccuccagguguguuaaaugaagaccucaauaugaaaaacaaaaucauaaugcuuauaaaauguauacuuaaaaaaccuaaaagcucaacaaagacauagaaauaaaauaagcacagccuuacuaaaguaaugggaagaugaaaaccaaacccacagauuuuggcauucaccagcuagauuccccacaauaucguauggcuaaggggacccaggggauuucuuagauguucaugcaguggucccacuagugggcgcaugauagguacccucuagaagaaaucaaaauguaccaggaaaaaaaaaagagagagagaccagagcaguugugcuguacaaaccugcaauuccauuaggaaagagucugaggcaggacaaaaguaagcaagaggccagccugggcuacacagcagacccccgugucugugaagcuaucucuguagaccauacuaccucuagagaucaacauacagugauuuaugagucaauuaaccauggaauggaaggcuugaacacuguacaagggcugcaaucagagcggucacuaacuagaaagaccccuucggcuuaaguuaggguuaagugaggagcaggacguggacggcagugacgucacgaggaggaggaaagccaagcguagggcuccagagauggcugacuggucgagcucuugcagacaacccaaguucaguucccaacacccacaagggguggcucgagggaaaaugacgccccugaggacaccagucaacguacgcccaugaugcacagcggcacagcaggcaaaacccucuuccacaugaugaaauauuuuucacaaagaacccuuagcucagcuauucacaccugauaauucuacugaucuugccucagccaagcuuugguuguucccacucauuuguccccuuuuaaugaacacuuuuaagguacacuuauccuucaauuuuaacacaccaaaauguucuccuauccaucucuugaacaucugccaagcaaaccuuaauucugccacucaccucuugcaacucuuguuuccaauuuaaaaugcuaauaccagaauuuucagugugggagaccaggcuuggccucgaacucagaaaucggccugccucugccucccaauugcugggauuaaaggcgugcgccaccacugcccggcuaaugugcuuuuucuuaagggcuugucuagauugcaccuauacucuucacgaccgccacacccacucucacacccgagcccuacacccucgugugcucaccaaucuuucccgaagcucguuucuucuuccuccuucauuuugcgggaacacaucuuucagcaacucucucagaaaaggcuuucugcugguaaacugacggaggcugugaaggucugagaaaacguucgccuccccaucacacuuaaaugccaacuucacggagcacugcagcucaggcuccaacuccuuuucuuucagaaggcggaagacuuggcuccacugccugccgacauccagcguggcugccgagaagucagcagccagccuuaggguggcuccggcgccuccuucgggcgggcucucuuugggggccuugagacgauucucuucacucugacagcuggcuucucgggcuggcuucucauucgcauucuuccagucuacaaggcugcugcucucuccacaccugccauguuccccacgcagggcuucucccccucucucuagugaugauuucaggacauggcugcuguugagugguuuagcuuuguccugcuuacccuucuugcuucucacagucagguuuucaguguccucgucuguuccagaacuuaacucuuccacuuucucuccuggcuuuggccuuuccgagauugcaucuccuucuugcugcccuauccgcucuuccaaaugcuucacccaaggugcuguucguuuuaacagcauuuccuuuauaucguuuuuauagguuucucucaucucugcaaacaucaccucuugcauuuccauuaaagcauuaaacugcuucaucauggaugcagguacuucgcugugcuuuaagcacagagauguggccguuuuucucucccugucugccgacagcuuuucuuuccgcuccuuuugaagccuggcugcuuuggacugcacgcccgacaugguggauacacugacacaaagcgcaccuuuuccuggcgagagcgucagaaguucaaaauccuaaaaggaaaaaaagucaucugaaauauaaacaaaugaaaauguucuuacugaguuuuacugagaaacuuggcaagaauaagcacacuuaauacuaugcuauguguauccauagaccuuuauuauaaaguauaaagggucacuaaugugaugugcuccuggagaugcuaacaaggaaaaaaagucagaacucacaacuuaugcaugcugacuaaagcccauugagaggugggcuugccugcaguuccgucuaauuaggagagcaaggaaggggcccaggaguugguggugagauaggcagcauagugagacuuccaucucagcagcugggcaauagagcacacacacaguucuaaaaaagcaacaugaaagagagcacuggcaagcugggcacgguggcucacgccgucaaucccagcacuccagaggugaggguugguggcuuucaaggcaagucuggucuacagagcuacacaaggagacccugucuuuaaaaagaaagcugauaaguaagaggauggugccuaccagugugcguuugauuccugggacucacaugaaaggacucacaaauuuuacaaguuguccucuguagcuaaauaugcagcagaggauggccuaguuggacaucaaugggaggagaggcccuugguccugugaagguucuaugcuccaguauaggggaaugccagggccagaaagcaggaguggguggguuggggagcaggggagggcauaggggauuuuuagagggaaacuaggaaaggggaaaacauuugaaauguaaauaaagaaaauaucuaauaaaaaaaauaaaaacuaaaaaaagguagugucuucccauauccuuuaugauugcaacuuucuauaaauguauuagccaaaaucaaaacaaaacaaaaacaaauuguccucauauaaaauaaaacaaaacauauaaaguauaaauaaauaaaauaacaaaacauauaaugagauauaacaaaaauaaauuuaaaaaaaaugaauggaaagguaaaaaguuguguguaccacaaacaaaaguuuugagguugaccuaagaacauuacuuuuuuccagagugaaaaauguuagauacuuccugaaggagucaaaauaaaucccauuccccuuucuccucccaaaggcccaaucuguacugacaggcccuuagacugacuagccaggcaguggugcccgcccgccuuugaucccagcacuuaggagacagaggugggacgaucucugggaguuugaggccagccuggucuacagagcaggucagccacagcuaaacagagaaaccucaucucaaaaaccaaaauagauccuuagacuguggauucaaguuagagcuggaagggaaaggcuaguccauuucaacaacagcauuuaauacggauggguguguguauaauacucccacugauaguuuuuaaaaaaauggcguuuaagccgggcaaugguggugcaccccuuuaaucccagcacuugggagguggaggcaagccaauuucugaguucgaggucagccuggucuacagagugagcuccaggauagccagggcuacacagagaaacccugucuggggggaagccuuuuagauauguaaaaggagcuuagucaggcugcaccugauaaccagaacucagugacauuacuagcucacaggccuagaacaccaugaugcccacuggaccaucuaugaacagauaccaagaacaacguugugcugugcacaucuguugagaugccaccuugaucuggcuugucgcuggcuugucgcuggaguguccccgggaucuugacacucaagucagacuucuguuagagauuggaucugaccgaccuucaccuaaggcacaucacacaggugagcagccuugggaauuuagagugugagccuuccgugaugaccucagcuuaauaaaacgcuuccagaccgccuaugcgccgucuaccuuuuggcuugugacacccacucagaggacagcaacugggaaggaacccagaccaaccuuguagguaggucaucauaucuuaccacagaaccuugccagccaccugcuggcacaucauggcaaaccauacccaggcuuccugaagaaucauggaauuugugaaccagaaaacagauaacugaucacagauacuggaggacccaaaaccaauuccauggaaacaaacaucuugaacuccaaggcuguauacugaacauguggccgaggauaucccaggauggggaggagagggagcaggccugcugacuugguuucucaaguuuccuucgcugucauaaaaugccuaagacuaacauuuuaaugaaaaacaggguuucuuuccguccauucagcuucggggcuuacuccacugcagcuugaccacucuaggcuccugauagaagcuuguggagguugccucugcccaucgugugaucucgaggaagacacugggaccucauuauugcucuugugaccucauuuaccuccaguuggccuugccucuaaaggcucuacuaccuaccaucaaucagcacaggaggauugcuccaaauagaccagccuggguuacagggugacucuaucucaaaauacaaaacaaaggaaauaaaacaagcaaagauacacauacaaggaaaaaacgaaaaauauagaagauucauugaguucuacuaccaggacccacauggugagagagaacugacuucuccaggugguccuggcuuccacacuggugacgacacacaggcauacauggagacacacacaaauaaauaaaacccaauuuaaaaacuuaaaacauagcacuuguaaagugaagcaggaagaucucuauguaucugaggcuagccugggcuacuuagagaauuccaagucagcaaggggggauacacaacgagauggugucucaaaaacaacacucaaggggggugguguuggcacacgccuuuaaucccagcacucaggaggcagaggcaggcagauuucugaguucgaggccagccuggucuacaaagugaguuccaggacagccagggcuacacagagaaacucugucucggaaaaaacaaacaaaaaacacccaaacaacaacaaaguagagaauaguauguucuuauauuuaauucagaaauucaaagcaaauuuguuuugucuuauuuggucaauuuugucuuauuucggucuagaacuuguuagaaccaaacuuacauuugucccccaccugccucauacauaaagccaauaccauguuaaaggcagggaguaccaacccaggccaccagcccugagcuuagaaagggguuuggcuauaacuaagaaaacuuuaugaaugugagcaacaauguacucacauacauaaaauaaaugucuuuuaaaaaauauauuuauuuauguauauauuauucuauguaaguacacuguagcugucuucagacacaccagaagagggcaucagaucucauugcagaugguugugagccaccaugugguugcugggauuugaacucaggaccucugaaagagcagucagugcucuuaacugcuaagccaucucuccaauccccaaaauaaauauaucuuaaaaaaaaaaaaaaaagaaagaaugugagugcugccuugucuggccucagugggagaagcuaacccugcagacuugaugcacaaggauggggggggggggggggggggaaggggaggaacaaugugaggggacagcauuuauaauguaaauacauaaauuaaaaaaaaaaaagauggcacuguacuuuauuccuagcacuggggaaguagagacagguggaucucggaguucaaagccagccuggucaacagaauaaguuccgggacagccaggucuacaacagagaaacccugucugaaaacaaacaaaaagaacacauaccuagcauucucaaggcccuagguucagaucuccagcauagcaaaaacaagucuguaacuuuugcauuguuaaacaaaaaauaucacauuuccagcaccuauagagucuauauauguggggaagcuacaaaagaauaggcaauaguacugaaguugaaaaagaagcacaagcaaacaaacaaaaucgaggccauuuuucugcaccggguacacaugaguuccuggaagacuggugccugcagaggcuaauugucagaucagccugcaauacccaauacacuggaaugcugcagguccagagguucauuaucuuaucuugggcuaguucuagcucggaggacaccguuccaggacagucccugugucuugugaccaacagauaagaaccuuuuagaaccuauuaaucuagcacaccacuacacagagcauccauccacgaacucauaagaaaugacagauagcaucuugguacugcagaaaugcuugcccagacucuccggaccugucuacccgccacacccaauguacuuuaaauuuguucuguaagauuauaaaacuuuauggaacaaacugcuuccaugauggaauauggaauuugugguaaccuacaucugugugccugaaacucagacaaucaaaauggcuccauaguaaacuaucuuauuuuuuccucuuuaauuccaccacuuaggagguggagcugaggugucagccuccgucacaugacuaggaggacagcuuggacucugagauucucccaaaagcacauuaucaaaccaaaucagauacaagaugagagauuguuuuuuuuuaaauccuucuguacugcagguuagauccugggcacaagcuaugcagagcgccacccgucugcgcuacauagagccuaaaccacuaaggcgggaagagggagagaauccacaauccugagggaggggacucaaaaaauaaagaacucguugcuaauuugaaaaugcagugagauaauaaacauuugaaaagaggacagacaauugacaagaggagcuaggcaaaggccaaggaaaugcaaauccaagaaggcacuccuccuucucccagagucaggaagucacguccuuccccccacccccaccccccaggcgugaguugguggcgcacugcuaaaauauccgcuguuuccaaagguagagacgacgaggaagcaccccgccacuaaacuauuuaaaaugcaaaucaagcugcgguggaauguggucucagcaguuggcucaguuaugcaccuuaccagaaagcuuagggauaagcaucagacuauauaggauauuggaugggaagagaaaaaaaagcucacauacuuguucaacguuuugagacaggguuucacuaaaacaguucaagagagcauucaauggugccuuuuugccucagaccucaaaggaccuauguuugugcuuauuuuuuuauuuaccugucuacuugagucggggucucuauauggcccuugcuguccuggacuucaguauguaguacaggcuggcaucgaacucaagugaugcaccuaccucggucuccuagcacuagguucaaggcccgacucauuuuaugcuucaaacucggggauuuaaacgauucuaggggggggggggucaacgcucucaaacaucccgacacuagguuaagaacccucccuaaauuacacgcaacacccacucucacuucaauccaagacacuugucacauuccagagggaccuucuccgugcccugcgagcacacucugcagcuuacccaaaucugcgccuuccccaggaaggaaccagcucuccucaggucgggauuggucuguccacgcguuucacagcgccuggaauuaagugcguagcccagaagucaaguuaugacuuacguagaaacccacacgccuaugaccaguaaacguucucaaaugugcuuaaauaguaucugcaaguuaucaacaaggacacuggggugggcguaaggagaaggcggcaaaaagggaucgaacaccccggauccaaauucaagguggcaaagagagggcccgaggacgguggcuucugcccugugugucaggauucaacagacaccuuuaaugcccgguuuucuagcaaacuuuguuaagaaacugauggaaacuccuucccagucaaagacagaggaaagcguuugaggguggaggcugggaaggggcugaaagccggggucccccaggcucuuagcagccgcucuagcucaccuccgccuucgcgcagcugccgccccgcugucucauugucccccacugucacggcacucuccgggugcaggagcaauucucacugcccaccccagggccggccaggcagagcagggugagaaacacggggacaucuggggcuuaacccugagcagccuuaccugagagccacgaggugcagcccugaggucacacacgcugacaaaagcagggcugggcgucugaccgcaggagagacucgcugggucucaugca

SEQ ID NO: 1987 - RNA, 3527 nt, Mus musculus
agaggcuuugagcugaacucuaagguguuagccaggguguccuagagggggcagugggguugcagaugugacagguguaaaggcauguggccccauagaggcuuucagaugacuucaguuucaguucaugggagagaagaauugagagagaagacagauggucucuuguuuguuguaucuugauauuagagauuuagacuugagccaaucugugagugucucacagauaacuuuuaagaagggcgugguggcgcacgccuuuaaucccagcaccagggaggcagaggcaggcggauuucugauuucgaggcuagccuggucuacaaagugaguuccaggacagacaggacuacacagagaaacccugucucaaaaaaaaaaaaaaaaaaaaaaaaaaaaagauuuuaaacucucccagcauuugggaggcagaggcaggcagaucucugaguucgaggccagccuggucuacagagugaguuccaggaccaggacagccagggcuacacagagaaacccugucucaaaagacaaaaacaaucccagcaacucaggaggcaggcgaauuucugaguuuucgaggcuagccuggucuacaaagugaguuccaagacagccagggcuauacagagaaacccugucucgaaaaaacaaacaaacaaacaaacaaacaaaacacaaaaagaauuuaaacuccuuucagaaaaacacgcauaugcacuaagcccuaagauccugcugcuagggacugagcauggaaaggguuuugcucccaugccugaugaccuaguuugcuucuaaggaaccacaugguggaagaugagaaccaacuaaggagaguuguccauuucuaccccaccuugaucguucaguuccuggauaaaagaugcaaccuuuaacuuaaaauaugccuuuaucagcucuaaaccugggcagauaucuaugcucuaugcuauuagaaucuaauuuccuaucgauaacucugaguuauuacuauguuccaucugagcuacucuuaauuccaauaggucagcccucauggccaugauuuuaaaauucuuaucccauggugucuuauuuucucucuccuuccucucucucauccucauggucucuucagacuccaagccaaggaaucacaaaccccaccuaucucaauucugcccagcuauagacuguaggcauccuuacucaccaaucagggauaacucggggcaaggucacacagcaucacaaggaucuaaauucagacucucuccucccuggggauaagcagaccuuggggagcuguuggagucuguccaaagaccuuaacucacaaagaccacagagacagccaccgcugcagaccacaagaggauuuuuauugauucaagucguugaagauccccccucucagcaugcaggccagaggggagacccagaacaaagaaagaacacacuuuuuauaaggggcagauuuaggcaacagggcuagcuggcuuauucucacugguguagcaaguaacguuuucaggcauugguugguuugcaaagugacuagugacucacucugccuacccccaugguugguuauuaugauuuggucagcaaagcagcaguacauuuugaauuuauggguuaguuauuaaugucacagcuauuaacaucacagggaauucuagcaaggucagggugguuuguggucuuucucagaauucaguguggggcaggguaggggaauuucucuuggagcugcuaauccuguuaugguuauuuuucugagaacaguucauuuuguuuuggcagcuauagacuuagucauuuugaccgcuauguuucugaaagucccuuuaaggggggaaggggcuagguggucuugaguuuaguuuggauucuacagagccaguauuuagcauuacaauauaagcagaagaccaaacuuuaaaagagauguagcugagggauacagcacuugucuguuugagguucuuggguucuuuucuggcaggggagggagaggcauuaccagagagagugagagccauugaagaauuucuaaacacagaagccaucuaaucagaagugagacuggcugggcgugauggugcacuccuuuaaucccagcacucgggagucagaagcaggcagauuucugaguuugaggccagccuggugaguuccaggacaaagugaguuccaggacagccagggcuauacagagaaacccugucucgaaaacaaacaaacaaaacaacaaaaaagaagugagacuggaaacaggagcaccaguugggauucucuugcaagacccagggcacaaagcaguaaaagcaauaaggccugcugggagaggcaccaggaacgaggguguaccaggauguggucacaaacugaguaacaaucacaauuauccccaaugccauucuauucuacuuccuuaguuacaggaucuccaacucaguaccaaggacagagacuccacuucccagcuuccuuugcaguuugcuauagcuucucaacuacacaugaauagugagacuucaggcaaagggaagggacaugcaccuucccuuucccguuggccaggaugcuguagccauccagcuugauccauaaagaugaggcuaaugcccugcaaacagaaaaggagucggaaggagaugggguacuguuacaccugcucuggggugcuuauuccuuuuuugauaaaauccaaaaguauucucauccaaaaguacaccacuguccacugggaccccuccugaaaucagauaacauccuugagaccucaagacaguccaaaggugugaugguuuguauaugcucagcccaaggagugccaccauuagaagauguggcccuguuggaguaggugugucacugugggugugggcuauaagacccucauccuagcugucugagagucuccuacuagcagcuuucagaugaagauauagaccucucagcucugccugcaccaugccugccuagaugcugccaugcucccaccaugaugauaauggauuggaccucuuaaccugagagccagucccaaauauguguuggccuuuauaaaacuugccuuggucauggugucuguucacagcaguaaaacccuaacuaagacagaaguugguaccagggacuggggucaggccugaccaugcuuuuguuuggaagaauguggauuuagggacuuuggauuuggaaagccaguagauguuuuaagugaggcuuaauggaauccuaguagaaauauggaagacuuuguugcuguaagugauuugaacugugcagaccuggcccaagagguuucaauggggaagaacuucaguacguggccuagagacuguuuuuguaguguuuuggugaagaacauagcuguuuuuuguccuugucugaagaaucuuccugaggcuaaggugaagagacucagauuaauuacauugacaaaggaagucucagaaaugcccaucauagacuuuuuuucucugguuaguccucaugaagagcauuuuaaacaagcauagucagccgcgaaagga

SEQ ID NO: 1988 - RNA, 5272 nt, Mus musculus
ugcuuaucaaguugaauggauaaagaagauauagcauacacacauggugggauuuuauacagccauaaaaaugaaaucaugaagaaaaauggaugugccuggaaguuaacauuaacagaaacaaggcagacucagaaaaacagaguuacuuuuguucauauguggaaccuagacuuaauuuauacaaaacaaacauuuguauuacaaauauaguaaauaaauaugcuacguauuauacaaacacaaauguaaaguacguaaggacaggcauggugacauaugccuguaaucugaguaguaagagaagugaggugagaagagagaacuugaagccauccugggcuaugaggccaaccugggcuaugaagcaagcccggucacaaacaagcaaaacacaaaguggagugugagaggcaucaccuggacagcuggucuaagcagauuccaguccugggcccuuaguccucccgugcacacuacucuucugccaugggagguguaggguugaaaacuggaccggggcagacuucuaauucaagucuuaaccuggggaagcaggacuggauuggacacaggcuuuccacccaaggcagcugcaauggcaucccucuagcucuggggaaaugcuccauuggcagggaaagacaucucccuaguuauucaaggcaggaaccauguaugucauuaaucccagcucuauacaacucaguaaaugacagagaaacaaaauuaauuggcaaccccaaacccuuguuucuggcucaaagauaugucuucagaauggaaauuuugacagagugcuaguucuacaaaugauauuguauauaaaauggaugaccaugugacucgacugcuacugucuguuaaacaacccaagucuccuguaaccugucaagguuaucugaaaccuaauugcauuuuuauugauuaaguaagacugcauuuucccccuaucuauuccuuagcaaauaaauuuaguuauggaccuauugccuccccugaaaauguuuauauuugaauagucacuugauaccccaugaacaagucuauaauggaaucuaagucuagacuccuuccuuugcugcuccuuaaaguuaaaaccaacuaauucauuuacguuauggguguuuugccuguaugagugucaguguaccacaugccuacagaggccagaggaggaugucaguucccccuuggaacuagaguuggagacaguuaugagccaccauguaguugcuuggaauugggcccaggcccucuggaagagcagccagugcucuuaccacuaagccaucucuccaggcaccuuugcuaacgucugguuucuucucuuucugcuuaggcuccaacuuguuucacagacaguuacagaaacuagagcccagagaguccuuccacucugugcuuaugagcuugcuccauguaguuggacgaacccugccucauaguagaucucugcccucaagccuguggcccaugagaaugacguaaccuaccuaucgugaccacuaaguaaccaucccuagcauuaguacagggcaguguguacguaacaauuaucauuguaaccauguacgcuaucaucaucauuucuaagccuuagcugucucaccauaaaucacuuauaauggagacuacaacuaguaauggguguucauaacuuugccugugaagccuucugaguaauuccuuucugaggaaaugccaggcacagccugcuucaggguggugacucuguuacuauguagacuggguuauccagagaaaauaaaggccuggacaguggagccagcacuggaauuccugaggagagggcagagagaaccuggugauggugaauugugccagguggggaggaggcugguggaggcgccaggagaugauaccgcagaggaugcugggaacgaagcucucugcugcugcugcugcugcugcugcugcugcagcagcugcucuauuggagcaaggugcccagaauagcagagaggaaagcagaaguuuugcuuugcacuaagaaugcuuucccccuuugguauuuucucuggagacuacagugaagguuuggauagcuuccaauuaauuuuuuaucugcuuagcugcuguuucuuugaaugcggcgcugagcucugacugggucacgggguagccaucuuugucucauuuggagaggagucagaacuucuagggccccaggugcugaggagggaagaguacaggaugaauacagagaagguccuuaauugaucuuggccacuguuuuuauuauuguguuugguacugucucuguagccagaggccgcaagcaaaggucgucagugggagugugagccguauucuggcaagcagucacgccagugaaagcuccauuauucucuauggaaacugggaagaccagccgugcuguuuuuagagaaguuaguauccuccaaagcacaagccagaaaagcuacaaagcugcagcuucuaacaggaagcaaggaaucuagaaggcaaagcugacuccagcuguggugugugacacacacgccaugggaccucaguauccccacuaggaaaugaagaucaugaccaaggucccauuagugacgucucuucucucagcagaagaauuagcaaaaauggccaccugggcacacaccucuugcaaaauccugaccuggagcugggagagguuugcagagguaggaagagagcaucuugacuuaaaagaggccacagaguagcuugagggaagaggagaugucuaauggaagucagccuguacugucuauaugcccagccauugugugguaucucugagcugcucucggaugguuuaaaccugggugugacucccagaaacauguuuucucagugacuucaccuacuauuuuaguguguuuccuaagauaauucuagguaagagaauaucugaaacuggauaauuuuuuuuuuuaaugaacaggaauuuacccgacucauggugcucagggccaggacaucuaagagcgaggugcuggccuuugcagagggacuucauguuguaccauccugggaaagaaagcagaggggagagaaagcagugacugagcaaguaaaggccaaacucauuuuuuuaugugaaccuagucucucaacagugagccuaccuccaagacacagcaugcaucugucuacucaugggggcauaguccuggugaccccaucaccucuuguuaggucccucucuccaacacugcgguuuaaguuucaacacauggacuuugagaaacacauggaaauauagcaguuccauuaaguauaacagaccaaaacucaggucacaaccauacacagccuuccugaauacugccagguggcacacugaaugagucccaucugcuuccagcaaacauucaaacugauagaaguuucuagagcccuuugucucuugggcucaucucugaugauacccacccuuccuucagcugacaugcugcugaaacugaguguccggcauccuuguuugacacacauaacagauacugagcuugcauacacugaacuuguacaaggcuggcuaggguauugugcaauuaaagaaaacaaagacaaaacaaacaguauuggcuccaccccgauaucuggggaucaguuuucaucugcaguuuuguauaaacugauuccugaguaggcagggcuuguguaucugagccaagaaaaaccuuccucccaacccagaaggcagaagccauagcucacaaaagugccugcaccuggggcucaugggugacauccauucuagugccucagaagguuccauuggacucuaaccaaggacagagaugcuaacuaggcauaggaggugcagagguacccccccaccucaccccacugagggugucugucucugcccaugagacagaugcuuccacugcagaacccaggaaggaggaauggggcugaauuccugaggaauacuugcucuaagcugugguuucccaacuaucuagacagcaguccacagcguuggagcaaaaauccucguggucuacugaguccacucacucccauguuccaccggggaugggaaugguaauaaaggguuaaaguggaagaggaaaauaaagugguaauaaagcuaauacucaagagagugaucaacacagauucccaacaaugauuuuaugaguaacagaaguuuuuaaaaaaaaaagucucauauccaaguguuauagcgggugagggucauaguugcgaacuuuuaacccuuccuagcaagcuugcaggagaggaguuccuaaaaggguguccugcaggaggauggcauuccacuggccucccagagccacuccccaggagucuguccucaagggcacugacuuucaggccuugcugucccugauacugcuuggcuggguccuaagugaagccaaccuuggagacucgggguuccuaaggagggaguccugggcauaggacaggaguucacaaaguccugacucccugggaaaagcacaaaugucuucugcacuaauaacaaacguccucuuugagacuggcaggaauuccagaccgugcccugaguucugaaguacuguuuggagguggcggaggucacucuucucugcagaauagacaauguucuuagcacccuugcaacagacauuuuuuuuucuucuguuuuucuaggacagacaggguuucucuguguagcccuggcuguccuagaacucacugucgaucaggcuagcucaaacacagagaaagccugccucucuaacugcugggauuaaaggcauacaccagcgcugcccugccaauuuuucuuuauuaaugccaauacuuaauugauucacauguuuuguuccuaauuccuuaugccgauaaaaucauauuacuguguuacuuacuuuaagaaucagaauuuggguucucuuuagugcuaucuuggaaacucuuacccuuggccacgggacuaggucuuugcucugagaauuauagauuuuagaaguaggguguguagaaauaauuuuaaucgcuuucuucuuccccaggccugguucccagaaugaggacucugaggcuacauauguauuauuaaaugccuaggccauaagcuuuggcucauuccuugacaagcucacaacuuacuuaacccauugaauuuagucuacgucuaccaugugguuaguuaccucuccuucaguuccggcccgcuucuucuuucacuucucagaaucucccugcugguuuacaucugucucuucagucugucuucuugguccaucuccugucugucccucuccuuuua

SEQ ID NO: 1989 - RNA, 12615 nt, Mus musculus
auuugguuguuaaacagcuuaaauuuuauugaccucccaguuuuuaaaaaaguuaaaggucacacaucuaaguugauguucuauguacagaucgugcagaaagaguaugaagagauacaaauuagucaugccaaaaagauugacuagaguacagagccaucuucauaaauacauauaaaauucuuaugaagauagaggggauugccagguuuucugagacacuuuccaaaguuauucaaggcacaaaauauacaccauugugaauauacauauucuagacuuugugccucugauacagcgcagagauuuggcuucaugacuauuauaaaacuaaauauacugaaugagauuguuucuugggugaaaaagccagaccuauaaacaucaaguagauaauuacuccagaauauggagaauacaaauacaagcacuuuauuuuaaaaagcaaacacaaaagaucauguaaauccaaguguuaacugugucaagcuuccauuuuggaucauuuagaaucuacacaaguuuguucccagcucauccaucacuagucucuacuaaggaaaaugauucuaaaaauuaacaugguuuucaguauuuaaaaucucacuauuuauauaaaagccuagagagaccaauaauauccaauagcuucaaaagauaaacuaaagacucuuagauguaaucaacuuuaccaacaucuguccaggucuguuuaauauuuacaggggaaauauacucacuauaauuuuuuauagaauagcaaguagggaguagacguaggggauguagaaggggagagagaauucagaaagucuuucucuucugucacuuuuaccucagaaucgucaaagagcaaccacuuccccucguacuccuuuaagcuuugcacuacauaggaaauuuuguucucaaguccguucauguuaacgccuguuuggucacuggauuccuuguuccugucagauucgugggucccauuaguaguaucauuaguuucagaauuucuauugucggugaauggugucccaaccaccuuaucaggauuagaugcuuuguuguacagcucauaaucugcuuugcucuuuuguccaccgagaaguccaauaccuucuacauuuuuuuuguucaaaacuuuacuuggcugggcauuuccaccaacucuaauugauacuucaucgucguaguucccagccgucccccuugcuugcuccucggucaguggcucuggcuuaccuaguucacacaucuggucaaccacaaaauuccccucaucgagcucuagacuguuaaggucagugacuuuaacagaugcgguauagugcccacuacuaauaguaaugccacugugcaucacaacggcaaauaauccauagcugucauucgucggcuuugugcuccauucuucuagugacaguuuaagaggugucaauaaaggaguguugaucuuggaaaguccaccaccguaacagucaaaccuuuggaaggaaaaaaagguuuccuguaauucuguuuuacacacaaugugaagccaaguaguaaguccuuaauguuuacuuacaagcaaaaaaggcaaacuaaggcuucaauucugaggaaaaugcacacacaaaaauauuaaaauaggaccuagguauaacggugcgcacauuuaguccuggcacuugagaggcagagguaaguggaucucuugaguucaaggccaacuugguguacauagcaaacuccagaccauucagagcuccucagugaggcacucuuuaacugauguuuggguguuucuguggaaaguauauuuucuucauucuuuuauuagauuuguacacuaggaaauuagcaugcagaaaccaugaaguauacaauagcauaucagaaaagacaagauuauucaaaacagccacuuuuauaucuauuuuuaaaagcuuuuggacaaauucucaacuacaaaauuucccaaaguuuucagaaaugaacuagauuuccuuuaaaacugaaaauuuuaauccccuccccauuccccaaugucagguaugguggcucacaucuguaauccuagcuugagucugagucaacccuaucuaucucagagaaggaauagauuguagauuucucagccuuuuaaucccagcacucaguaagcagaaggaagugaguuugaguucaaggccagccuagccuacucagacacucugucuuggaaguaaauuuauaaaaaaaagaaaaagaaaaaauuacuccauuucagucccacagaagcagacuucuacuacuagcaccuacagaacgcauaugaaaaggugugugagaacuguacugggcuuucuggagcuacaguucaaacccagaaccuucucucugcuagacaagcacacugaacugaaccaccagcuccaaaagagcauauauuuaugcccagugaaccugcuuacuaagagcacagagucgauucucacaaacgacuucacuuggcacagcacuguagacaaagccacugucucccucggcuuauucacaauacucacuccaagccacuagcagcaaagcacuucagaugaauagugauaacuucaggcauuuuaucaaacaggagacuucgcucugcuuccguauaaugauggcaauuuucacagaaguauuuauccucuccuacaauucucuccacugaagcaaacugugaaauugcccaucucaaggucuucauuucuguuuuuggcucuggagaaacuguaaaacagaauuguucacucauaaauaucuuucagacauugaaaacuuaaaccaaguuucaugugcaauaucauucaguuucaaauaacugauccccaacaucuaaauacuuaguauuagccgaacauacacacacacacacacacacacacacacacacacacacacacacacagagagacacacaccaaaagccaaauaagcccaagucucaggucagucgccagucucgugauuccucaggacauuuccauacuuuuuaugauuuacauugaacacaacaguagcucaaguaguaacuuaaaaugacuucaguuaauaaaauauuaaggucucagauguuaaaguauuucauuuuuuccauuacaaauuggcaaguagaauuaacaaguggugcugagaacaggaaggacgcucuagccaucucagucugcacacacaggcuuccccgcccguccgcuuacuuucagagcucuccucgaccuuggaaagcucaucuucuugcacuggaacacuaauauccuggaaaucuucucuucuuucuguuaagcuuucacauuccaaacaccgaguccuuaacacgagcugaccuugaaacaguuucucuacuagcucaaagccaaucuguucagcaccuaaaaugaaaaugggaaaauguuuaugcagauuugcuuuucaguauagcccaauucauuaauucccuauugaaaguacaucgugaacacaaaaccuguuuucauaucuuauuaagcagugcuuuauucaugaaauguaaaauuccuaccaaaaauuuuuuaaauaugaauuacuaucuuuagaacaaugucggcugugucuuuaacuugcuuccuaaagacaugucuuuauaaaacugccccagagaaacaaaucuuuuggagcaaccaucaaccacaauaacuacagcacgcccggcagauuuucccuaagaggaaugaauacaugaguaaacaaaaccaagcaaagcaguuauaucucaggucuaagacucacugaacucaguuucccuugagcucauacugcauagauaaaaggcgcaaaaaaacagcuuucccauuaaaaagguuuuuccccuuuuuaauuaaaaagguuuuucccauuaaaaagguuuuuaacuucccaaguuuagaaaccaucaagcaaaauuacccuaauaacaacagcacuacauaauacauguacagugcuguggcaaauugacuaucuuaaauccuguccaucacccucacuagccaaccuaguaacugcacugaccuuuguuuccggacuuggcuucacugcuguccacaggugugacgcuacuuccuggagauucggguccaccauuagcuguguggucacuuccguacuucuccaaguccucuucaacaucacccuccuuuuccuuagguuguccuuuggagcgcugguuaguuguuauuuuuccaagacuacagaacuuggaaagaaugcuggguugcuuaguggauggcuuuaaccaauuuauuuuaacuuuugauuucuucugugagggcuuugcacucucacuuucagaaacacacuuggggaugaucuuaggagcagccucuagugugucuccgauagcuuuucucuuggaucugguuugucucugguuuucuuccaauggcugggauucccuggacaguuuaaccuuuuucuucacguuacucgacucacugucacuuuuucuuuuccaguucccuuuggggagcugcucuuugacguccuccguauuccucauacugucaaucucugugcugguaauuccaccuguuuccucuuucugaagagauuguucuucaaccuugccggauaauucagccagguuuuuuauuucuucuuuuuuuaggaguuggcauguuucuugaauguuucccagaauacacuguagcacuuccugugcaucaugcuguagaaauccuucauacauaggguugaguucccuaugaauaaaaaggcucacuuuagcuaauucuaguuuuguuuagucagagaaauuuuucuauuagcuauuuuaaauauccaaaagcauucuacuaauuugaaaacucuuaccuaaauuuacaguugaaaguaaaaacaauuugaccauuauuuaugauauuauauuauaauaccaucacccucuucuacauuauacguuugugugugugcucacgcauucacaagggcucccauguauguacauguuuauuuuugagcacauacaaguauuuguaaccugcaugacacauuuuauauacagauccacaaguuauaaucugaacuuccuuaggaccacguguccaggaauccucgcuggucuauggggcacugaagugguaacuguuuccuacuuccccaaguccccuucaagauuaugcucauguccuuuagguuguccuuuagagcacagguuuauuguuauucuccccagccuauagaacuugaaaagaaugcuuagugaccagcuuuaaccaauuuaacuuuugauuucuuuugugucuuacauucauggucagaaacacacuuggagcccgagcauguacagaucuggggguucaagccacaguaucauaaaaaugacuaaaucugucaauacucggggcuuuaccgccagugacugaguugguguagaccguuuaccuguauuuuuuuuuuuaaagaaugcaguaugacacauaaguaugaaucaucuauguauaggccaguacucuagucaagcaugagucuuucgacagaaaauguauuauuucacaucaggaagacuaugaguaaauuugaauauaauuaaucuaguaucuuuuaauuuuaaacaucaguuugaaagucuuuggguauaaaggcuaugagauggggcuucaauuuucaauugucuugccaucuacuccuguguguucauauaccacccucuucuaaagacaguaacuaauagagaaagaaugguaaaauuguguuaaagccuguaccugaguguguucagcagucgccuuggcuguguagcaaguucaucuguauauuucucuggauuuaagagaaaacuagccugaagcuguucaacugaaauuauuaaggacuguaaacuacauauaagcucauaacuugccaaagacucuucuuugcagcuucccuaucaagaaaaaaaaaaccauaaaauuauuuuuuaaacauuaaauaagugccucuuuccuucuuggucucacagcacaauauagcuuuucuaaauuuaauuucaguacagcaaaaucucuauuagucauaccagucaacugguuuucuucagcuuuuuuuuuaaguugcuuucuauauggacaaugauuuuuuaaaucaguuuucuuuucauuuauuuacuugcaauuaaggcuaggaguauggcucaguaguagaguuucacuuguauauguaagaccauaaauucagucuccaaaaaacauuaauggcaauuaccauagacuccagugagauacuuuugaucgugagggacaagugacaagucuaguuaacaaugcauaaaacacuauauaaggcuaugaauaaucuggauaauauacaguucugaaaaacuuaacagaaauauucugucaccacuguucugaacucuccugagaaucuacuaccuuuuuauuuuccaaauaaauguaauucuucccauuaguuccuuguugcguguguguugggggcauggcgguuguugagacaggguuucaauguguagcccaucuagccaguaaaucacuauggagacaaaccacgcuuagcugccucccaagugcugggauuaaauguguguaucacugggcauggccuucucucuagcuuauuuugcuuuuuaaauuauuuucuuaaucuuuuuaccuuauccuucugauuagagucauccuucagagcuucuuucuuccuugaaauaauauuaaauaagugcuucacuccagucuuaaagccaggacaaaaguauaacaccuacaaaaagggcacuguuuuaguacugagcaaagaacacaccuaaaaucacuacuguuuucuguagggcacguuuaauguauauuaccuaaaacugauaagacccucaucaaacgaguucucuaccccaccaagaguaaccacugauccucagcagcacuuagcucugaaccuagguaauauuaguaagauuaagauuaccaggauaaaaaccaacaaaauuguaauaacacacaagauaauaaaaguuuuuaaguggacauaggacauaguaccaggaaucaagcaauaaaaauuaaaguuuggcuuuggcuucuuccccuuaaccaaucuacccaauuucaguaucuuaccuuuacuucuuucuuacccagaggaaguaauguacaguuuuugaguauuaccauacagagucuauuuugguuuauuuauaauuuaugaaaaaaguauggacaaagccauucaauagucaauaauuuucagaaacuuucaacauuacaucacauuaccugaagaauacuauucagauaacaaguguugccaagguuauucaaucccacaaaugguaacaaguucucucucuucucgcagcuuacuggggaggacugugcagcaggaacaacuuggucacuguuaacacagagggaagagaaaguguaaagacgugccaucuuaguggaaauacuacuccccuaaacuuaauauuuuuacaauagggauaugaucauugagcuuuauacccaacccugaacaauuauuggugaaacacacaugggauaagaucuacuuuuaguuauccaacagacugcccauuuuguugaacaaugagcuaccauagacuccagcuagagcaauuuggaauauucacuuuuauucucuauuuuuuaauauaaaaaucauuuaguuuuaaugaauucgaaaguaaagacaucaugcagcuagauaaaaguagccacucaaacaaacucuuguccaauccuauaggacagccauucugaagccauggaguuccauuuagagcuuuauagaucuacucucaauuacauuuuugugcacuuaucuaccauaaaggggcgcgggggggggggggggggagggugaguuuagacuagaaaacccaucagcucuguauccucuccugugacugaugcacccguacugcauguacagucuuuccccucuuuccuuucuucuuagugacuagagaauuuacaugcauuaaaaaacacucaucuuuaaaaucuaguuucaaaauaaacugcaacuguccuaccucuagcagauauaguaguucuggaguauaaaaaacagaacaaacaaaaaaaaaaauaaacuguuuucacacacacuacacugcaaaaauaucaagcaguguuuacuauguuccuacuacacaauuuuuuugguuuggucuccccccccccuugcgugccccaccccccaagaaaagguuucucuuuuucuuuugguuuuuuuuuuuuuuggcuuuuuuuuuuuuuugguuuuucgagacaggguuucucuguauagcccuggcuguccuggagcucacuuuguagaccaggcuggccucgaacucagaaauccgccugccucugccucccgagugcugggauuaaaggcguaugccaccacaccuggcucucucuuuuucuuuuucugauuuuucaagacagggcugcucuguguagcccuggaacucacuuuguagcccaugcuggccuggaacucagaaauccaccugccucugccucccaagugcugggauuaaaggggcgcgccaccucuaccuagccccuacuauacacuuuauuccuuaucuugcuaaaugcaaaucaauguguacuuucuuuuaaccucugucaacugucagguucaguugaguacagaacuaucaacccaaguucagugcucuuucacugauucagaguacagaaauacauuuaagggggcuggagagauggcucagcuguuaagagcacugacugcucuuccagagguccugaguucaaauccuggcaaccacaugguggcucacaaccaccuuuaaugggaucugaugcccucuucuggugugucugaagacagcuacaguguacucauacacauaaaauaaauaaaucuuuaaaaaaaaaaaaagaaaaaagaaaaaaaaagaaaacgaaauacauuuaaaauaaaauacauacaucucagauccucuauauucagaaguuuuuucuucauuuucuugagaaucaguaaagucuaaggcucuuuuaguuuccuuuuucugaaaaaacuucagagacagucuguuuuucuuggauggacugccucuugaaagcccauuacuuucacuagguaugacgccaggcauuuucuuucaaaauugcaaggaguugacgagaauuaacuuauugaaggaagcuguaaucaccaauuaaaucuauuaaucacauacaaaaagauuucauuaguccccagcuaucauauguaagugacaaaauuagcaacuaugaaaagauuuaccaaaagaauggaacaaaucaggacaucuuauuucaaaaccuaaugccugacaguagacacuuaagaguuuauugcuuaucaaugguucucaaccuuccuaaugcugugacccuuuaauacaguuccucauguugugcugaccccuaaccauaaaauuauuguugcuacuuccugacuguaauuuugcuacugcuaugaaugguaauuaauguaacuaucugauaugccagauaugaaauccccuguaaaaaagguuguuugacacacuacuggggggucuugacucacagguggagaaccacuggcuuaaaugccaaugauacauauaugcaugcaugcagacacacccgcacaaacuuccuuuaaaauugcuacuaaauucuuauuaccauaauguggguauacauaugcauauguauggguauguguauauguacaugcauuaagagccauaucucaaaaauauccauuuacuaaaaucauucauacaauaagaagcaaaaacucugggccagugagaugguccagugggucagggcgcuugcugcuaacccuaccaacuugagcuuaaucccagggacucaacuucucaagugugcccucugaacuuccugugcacacccauacacacacaaaguuugaaaacaauaggcuuaagcaaaauuucauuuucuauauacaaaaauagcaacugaacaaugguaaaaaucaggaaugaauaagaaaccaaaguaguaguggggacuacagucuacaaggccacuuguagucaaugugaacuacacauacaaagcuggaacagaggucggaaaaacuugcccgucucaugugugcuaaagauuacaauauacuuuaguuuuccaacuaugcucuguuuugagacagggucucccaguguagcccuggcuggccuggaacucaaaaaucuaccugccagccucuucuccccagugggaaguccuacggccaagcuacacccagcuccaauuguuucuaagcuaugugacuagaaguuucaagguaaaacuuuaaacgggagcgggggagggaggaagagagauacggcaauaccugugauacuuuauagaaauuuauuuuuuauuuggaacaucuagaagaaagauaauccuucuauuccaauauuccaaaaauaugaacgaguuucaaauauagguacccaaguaguaaguaguugagguacacacaaauugauucaaacucuaccccuaaacauuucaccccaguucacuguacacugcagggaaaccauuucugggaaccaacucaggaaaaacuggacaacuggcaaaauuucccaucuuaucugcaacuuaaauuuuugucucuuggccccuuaaauguucuugaugaaaugaccuguuaggaaugauaaaccagccuucgcaaaacugucagacuucccccaagcacuaaugacuccggaaaggugucuuccugggagccagugagagaaaagucaucagccagcucaaacagcggccgucaucucggccagccacccaaucugggacccucuaaacagccagccagcacugauggucaccaagagcgcgacacuuucccgggugcccaaucuuauguucuccacgucccuucucagagcuuucagucaaaaaagccucuccagaacuauaacccaagcuucgcacaaugaacuuagcccuaagucuucuugaccaaaugacaccgugaauccucagucccacuacuuuucaaaucuguguacaaugauaggauucaacucuucuuucaagaaaaacgugaaacaauaaaaacaaacucuugggcgcaggguuaagacacguggcgccguacacacuucuggagaaacuguaagucaagaaaaugcgcgguaaaauuucgcaagccccgacccaggacacugcgaucacaaacaucucuucucccggccagccucucccauuacgaaaggcgugggcagaggggcacuuggguccugggugugccaccccgggggucgccgcgcccgccggcagucccucgcagcgcagcccgagccuaaggggcccuccccaccgucagcaccugccgcgcagccccgggcccugaaccccgggcgcuccuuacccggucauggcccuucgcgaguccgcggcgccgccgccggggagaccagccgggcagagugcgggcgcgacaggugagcccggccgccgucccgggagagggaucgcuggugggcgccucccgcgggggagugaccauucguccgcggagcgggagccgggccgccgcucgguccugcccgccgcggcaccacuacauccccggcgcagcccggccgggaaggcuacgggcgcacagcgguggcggcgcucccgagccgcaggguccccgcacggccgccgagggggaacuuggcgcguuuuccucagucucaggacccccgcgagugaacccccgcccgcgccagcgucgcggcuggagguggcguccacggaaagugccgguucuccucuccacguugcagaggcgcgaaaggcgcgagccgccgcgcgaccgccccucgcccccggcacgcucggcuccggaaccagcuggaacgguaguuccucccggggccuaacggguucugcaguuuaaacagcgcaggcagcggcacgggcagcucgcgcggguccucgcagaggcgcgcgcugcgcaggaggccgggcuggcgcgcaggaggcucacucgcucgcucacgcccucuuuuuuuuuuuuuuuuuuuuuuuuuuuaauucuuuuuaaacauuagcacucgcgaguugaaggggagggagcuuacgggucgggagaugggacagggagugacugggacaagccccuuccucaggugcucaaaugcgccaauccaggcugaacaauuuccaaaaccucauuccuccgccccaccaggaagagccaaucaaaaaguaccuauacgaauaaaacaauuagccggcagagaagacagucugaccaauaaaaaaaguacaaggaacgaggcccagccaaucccgggagagcauacggcgcccuggagcggcucuuugcaagcucauuggcgcuccagugcgcgcuuucucugccgagguuaggguuccgcuuuccguuuuguuagcauggggagguggcgagcccggaggguguggcuucugggccgaggccccggugcaggcccgccucuuucuuucuuuuuuuuuuuuuuucuucccccuccuggcgugcccucuccggaaggguuaccaaagacgcucggaaaauggcugaugcgcuuugcuagcugcucggcgcccgcugggcguccaguuuaccgaggaagccgcgguccacccuaucucaaguugugcguuaagaaugagcacugccuuagcuagacagugcacagccgaacgccuuggagccucggguccuucuccc

SEQ ID NO: 1990 - RNA, 2477 nt, Mus musculus
ggggggcuaauuaaauuaaugagacacaagcggcaacaaacauuguucaucucauuuacagaugaaacaucacuaggcagcaagacuguuuccaacaaaauguccugcuacauggcaauuaagaacuaaacccagaugauagaaaaacauuaggcuguguacugccauuaagauaagaaagcaaaugcuauucagagcaaccuaaaccacuucgagagagaguugauuuguuucaguccuaaaacccugauuugcaguggacuacacaacugaugcacucuaaagagagcagcgcauggcuugagacacagcugggcaaaaugagaucaagugcuaagcugauugcaucacuagggaccggaagugauaugucaaaggaccccuuccgggccagaagaaccuucaagcuuuuaucuaggaccccucguuccucugaagauuuaugggccuugcaauagauaugcaucuuauauaacucuuucuuuccggauuaaagagagucaauucugaacaugcuucugauuggcauaaugugggauugcagaugaucucaauuuuuacgugcuaaaaucgaacuuucaggagaaaugaaaaugacugugccugucaggugcaggcgggaaagcaucugcagacaucagcccagccaucugaucuguugcugagacugaucccuuugcccuaaccuguaucggccagguguaaucuguacacccuuaaccaggaauuaaaacucuccaggcugcugcuacuuuaauugauugaugcuaaaaguuuagaaaauacagccuaccccucgaucacagagcgccuuuaaccaagccuucucuuucacagcagcacccucaauugaaacuggcagagcacauuuuuagcuuucgagcggcucugucauucuacaaggaaugugucugccacuucacaggauagcuugagcugaaagacauguacuuugaaucagagaaucaauagaacgcuuaauggacaauuaggagaacagcuguaggucugucagagccccaucuguacacagcucaaacagcaagccuggacagggcgggcagacaacauccacugcuccagggcacuggcccugggacagagucucccucucagcucucauuuaaugugaauauaguguucuuuuucauuacaaauuuuaacacguguagaaaauuauggaaauugcuuaagccauuugucaacuuauaucaugugaauugaucaauaaauuucacgacuuuguuguuaauguagauaaauuuuggcauuuaauuaagcacuagugaaaauguggccacuuuucauuucagcagaugcaucuguaauacagaacuacagggguaaauacaacccaaucagggcuuagcgcuaaauauuuauagacaauguagcaauuccaaaaaaaaaaaaaaagacacaaaagauuucuacaaugaaacaauugcugugugcaaaaucugaacugaguccaauagagucuacaggagcugugaacagaaucgcaacauuguaacuccacuaaaggacugcuucuguuuuuccuucagaauucugccccuacaguaaauuuauacuccguagaaauaacuucaaauucucuucacagaaugaaucuaaauauuaaaagacaguucucuaaguuuguagacauguauuaagauuuccuuguuaaaauaugccaauccuuuucuauuucuguuaguuaguuuauuugaauaccaacugggguguucuccuacagaagagaagggaagucugggaugcuaauuucuugaacauagacaugauuuugguuacaaggcuggucaagagcacacuggggugguaacuggggacaagaugccagacaauggaaauggcaggaugaacuucuuaggcuuccuccauaugaccugaggggccccaagaugaaauccuugcugcugacagccagaagccccauagccuuaacccuccguggcggagucugacaugaugaacugcuguaucucauuugagggggacaggcgccucuuggugauucugcugcugccuucagggaaagagggacucauaaucccguggcugucuuuacagcgcaauccgccccauaaugccuuucccaccauugucugccggcuuucagcaggaggcuuggcuggcugggcaagggcugcguuugcagagaaaagccggcauggugccuguguguaaaaccuuuguaaguauuucaaaaaaaaguuuagggaauucaaagcugaucucucaguccuguuuuuauaaugcuuccaugucaaauuggccaccauggcuccggcagcuuggcacuuucuguuguuuuggcagaguaggaccuagucagagaugacucucuaaauucagacucuaauagagaaaugagaauuaagcagccaaggagaaaauggauagggucuuuuuugcagaacaaaauuacccaucuaaagucccagccaaaauucuuuuucuggagcaau

SEQ ID NO: 1991 - RNA, 1316 nt, Mus musculus
gagagauggcaaagagucuuaggccggguuuuuuuuuuugcaaccgcacccccuccccaccccgcccucuaucgcugucccuggggaucugcccccaaggcuaggagggcaggacagaguagcgauguggagaauucgauguccgagcgaccuccucggaggaguggaucgaguuaaauauaacugcgcgaauggaauggcgcuaaaaauaagguagcagcuggcagauccucugcccugucccgggaaaggagggggcaagaaugguuucgcccagggaguagcuaggagguacggcuuccgcaaccugggucgggggaccacugaggcuccacuagauuguccggaaauggaaagggguagccgucuggggggcgagucucaggucuggccuugggaugcucugggcuuucaaaggggucagaaggcuugaacaugcgccuggacguaagggucgaagggcggggcauccagauaucauacccugccgccagggggagcugagcacuaggaaagacgcggagcuugggagguugaugggugggcccucaggaugagggugcaucguugucaccacgcacucccucgaggcccacgguggucgcguccucugagcgccccgcccuacccgucucagggccccaucaucagauccacaauugaaacguuuccaaaacgggcuauuuauuuguucccaauaaaucgaucgguggugauuaagaaaucgauauggccugggugggcgagucucgccgccagggaaaggcgcuuuugcgcgcgcccgcaggacuacggaggguaggugcgggccacagaaaggcgugcccggacgaccacacccgaagacaggguaccugggcacucuugcucagggcugucgaauccccucgggcugcaagccgagggcacgggugagacucgccacagacccuuccuuuuuuuuuuuuuuuuuuuucucccgcgcgcgguagagcugaggccgccagcggccgccgcgcggccccgaggcuuuuguugcuccucggcuggcugaauagggauuuuguaaagcgggacagauaaaaaugagcagcaucauauuguuugacagaaugaucccgcgugaugaagugucggcuccgaagggggugaaaauggugaauuccuaaaaacccagcccucggcuucuccagcagcuaccguuagccuggagggacccagcggacgccgggcccgcggugucgcaucgaacugcgucggcaagacucuagcuugcaaugccaagucauuuuuaagcccugauccugcccagaaucuuucuccucgcgaaugaaaag

SEQ ID NO: 1992 - RNA, 1371 nt, Mus musculus
gccaaagaagaggcgaggauguguccagcgcacgugaaguacaaggaaugucagcucugguaggagagacugggaaaucccagagaugcugggguggggacuuuaaagugacccagggucagcgccugcuguugcugaggugaguggacucgguacguccguccgaggggaacugguguucccagcccggagugguuugagaugaccuuggucgcccugaccaaccccaccccccucgcuuuuaggccgcuucuuugucagaggagagcacuuaccgauuugagccuucuugaaacccgauuaauuugugugcugaaggccuaggggaaggaucuaugaaccccagguuauaagagaaugagaggaggaagucagggaggaaacaauuucuguauuguuuauaggaaacagcgaaaaaguuagguacuuccagguugccagugugccucugauucuguaucgucaccuagagccauuuuuccuaguuacaucaaauuaauaaaauaucuuaauaugcaaaauugcauuuuuacaggcauuaggacaccacagguugacgauuaucccauuacacaacucucccaucaauaccaguagcucuuugcguauggauuucaaugcugcuccgaguugggcggcuacaggcuuggggggcggggguggggguggggagagcagugacuauccugagaggucuggaaucucuaugguuuuuguuuguuuguuuguuuccaguugaucuugggguuacaccuggcccuaaaacgcaugccugaguugauuuccgcagcugcaccacuaaugacgcgcugacucaaaaacgucuauuccgcugacuagacagucuucucgggaaaccgacaggagcuaccagcuggagcuggcugcacccuaggcaagaggucacaguggcgacugcucaagcaacucaaaggaagguggggaggaaaagaaaacacgauccaaauuuacaaauuuaggaaaaccuuuugcccaacuuggauugccaguuguauuggcgggcgcaaggcucagaguggaccggaccgcgaucuugauggcggagccucuggcgaaggcuuguacgcgcgcgagaacccuggcuucaaggcugcucucgaggccgcuuuuuagucuccaaaugagccuaauuucgauuucccggcuagccugagcuggcucaggagacuuuguccgccucguugacggcugccucucccccuucgccaaggccggaucugggcgguccguucccguguaucuccuuggaaccucucuggggaaagggguggugaacaacucccagcugccgguuccauuuguugcgccuuuuuccuucgacacaauaaaagucaaauuaauugauucaua

SEQ ID NO: 1993 - RNA, 314 nt, Mus musculus
agggaauugucaacaaagggacgacagaagcgcaacuccucaccgacuaggcgcuagcaucccgcaggccccgaaagcucuucgggcuguugggagaccccugcccacgcuggagccgggugugggguucagggagggcgugagaguggguggguggggguggagagggcgugggccuaagaguguccuccggacuguagggcuucuuaccacccugcccucuccgcccccugcauuuuucuuacuacccugcccuccccucuuugcuaauauuauauagaccaacuggcaaugcagaacaagguugugauuua

SEQ ID NO: 1994 - RNA, 50434 nt, Mus musculus
aucacaaccaucccgguuuuauuuauucacaugauguuuuacaucggaauuucccuaaauuacucuaaggauuacauuuucccuacauuuuguggagaauuaaauuaguccacuucccugauuucaucauaaaaccaaaagcugcuuuccucagaggacuuuguguuuuugcacacagguccaucccgccaggggugggaaccaaggcgauaucauuuccuuucaaagcucacaccuagaauacggcuuuacagcgagugucaaggagacucguccccuucacacauacauagcuacagaagacuccuugacuugcccaaagucaaccaccaggccaagcuggucgaagucucgaacacgaaggaacguguuccuugcccgaggacugcgccaucuggggaaaagaaaacagccggcccuggggcaaacgaaggugggagcuggagaaaaaaagcuaagagaagcgccaggcaugggcagcuguggaaagggagcagcagacuugggccuugggaccuuccuuccaccccgggugccuucccuuagcaucccggggaccggugccucggguaccgcacugaacagcucuguccggaccgacggcggcuugaccuuuccgugagaauuuagaggggagaacgcggagacuuaggccagaagcucucuuggccagcugggcaagcagcccagccacaucgcugcagggucaggaguggaugucaucggugcccgccaccugcucucugcgcaucacucccccuacaucagccuccaggguuccagcucccccagccuagaaguguaaaugggagaaagaccuggaacgcauuaggaaggcuacccagcgcggaaaggcacccacugugaaggugguguggagagggauacgcaauuggcacaagcccucuggcugaguccugcguuguccagcugcgugcgcucaggaggcaaccgaugggaggcaauuucccccagagucaaccuugcagcagaagccgcagcugggaucucagguaaguuaccaugcucggcuauggcugagggucucagaaagaagcacccucacuccaccauggcccgcgccuguggggccuaaagggaccccgcauuagaagagucucgagaagcaacuuuugguuccuuuucucucaagacaccucccacuccucucaacaaacgguagacaagacucagucuucaucuaaaacacacccuuuguccuuguuacauccuuuucugcaaagggcguauguccgauucauggggaauuuuucacuaauacaaccucaggcacuaaguuuucucauugcucucagacuucaccccggaacgcagcgcccccuccaggaagccuuccucaaccuuccaauuuagguuagucgcuccuucucugaggucacccaugcgcaguaaugacucagcuauucauucucugguucucugaugaaccccuuacuaccuaacacugcuggacacaaggggagcauucagauuagaagcaucugaccucaaacaugggcuuggagacucugagcugaucaaaccaggucuuaagaguuggaaggaggggcuggggagauggcucagcggguaagagugcccacugcucuuccaaagguccugaguucaaaucccagcaaccacaugguggcucacaaccaucuguaaugagauccgaugccuucuuuugaagacagcaacaguguacuuagauauaauaauaaauaaaauauuuuuaaaaaagaguuggaaggacuguuuucuuuccauccuuuucuccgggccuuuucuuuauaauaaauaaaugcuuuuauaaacacccuguuaauuuuuuuugacgaagaauuuuaaaaagcauuuauuagagaucuaaaacguguaagacacaugagcuguucauuggauuuucugaguauguuuucuuugccaccauaaaaucggccaaagauuucuugccugaaauagcagcagacgcacccauguaaugggagaucccucaacugccuguuucauucacugggugcuucagcuuucaaacugaagagaaaaccaccaccucacacuuagggcauccuaacuuuuuuuuuuaauucuuuuuuuuuaagauuuauuuauuacuauaucuaaguacacugcagcugucuucagaugcaccagaaaaggacgucagaucucauuacggauggaugugagccaccaugugggauuugaacucagggccuucuggaagaacaguuggugcucuuaaccacugagccaucucuacagucugggcauccuaacuucaaagucuuuauuuuccugggaaaggguaaucgcuuuaaaagagcucuuugcuugaguuuuuauaggaaagauggugccagucuauguugggauucuuuaucuagaaacacaaagaauccauugugguuuagcagcuacaguaaaacuggguagguguggggagggggugucccaguauggucuggggacuuuucuccaggaucuguguggagaccaccuuaccugggacuggaugcagaucacaaaggcgacaagucucacagaaugguugcuagcauuuugugucucacuaccuucagauaaaacuauuuuuagagaguucaauagggcuggaaagaugguucagcaguuaagagcaccagcugcucuuccaggggaccaaguucuccauucccagcacacauaugguagcucacuaccaucuguaccuccaguuccagggcauccaaugcauucuucugguuucugcuggcaccaggcacacacauaguaaacaugcaugcaaacauacauacgaacagacagacaaaacaugcauacacauaaauuaaaaauuuuaaaagaagguuaaauaaauugcucuuucauuguguguuccuggcauaaaaguugucuuucaaagccagguguggugguacaugccuauaaucccagcacccaagaaggacaaugagaucaagaguucaagaccagccuuauaccuaguauguucuuauuuauuugagacccuguguugcaucacucccuaaagucaucucuuacuugcaacucauuaaagccauuugacuuauggaaguagggacucggaugucuuuagaagauauuaauuuaaagcagagcaagaggaaaaucucauguuaucuggucauugcuuucuaacugggaucaagcuaaugugagugagggugaaucauuugauagagguuuuugcaaauuuauaucucuguuuguuuggucccuauuccucucagccuuucauggcucugcuagcuuccuucucugcuuuguugcagaguccagcaccucccacacaugaguacuggcuacuggaaucccagccagggugaaacauaugccuuauugauggcacaccaugagaaauuggggccuuaugaucaaguuucuccugcuaucaagaaacaaugcaagaagugauagacuggaugaaaaggcaugauuaauuucuaggccuagucuugacauugaacuucaaaauauuugauggacuuuauauuugcugugguagaggccucuauauauuuuuaaguuugauuugcguguguguuguacauauguguguaugagugccgugcauguguacacucguguguguacaugugugccauguguuugugugggagugcaugcauauguggagagucugugugugugugauguauguguguguauuaauguagugagugagugugcacguguguguguguguguguguguggguguaagagagggaggaaugaagugacaugccaugugcacaugaggaacugaaaggacaacugugugaaguugguucucucuuucuaucucugcuguguuucugggcaagcauuuuuaccacauaggcugucuugccagcccugaagacuaccauugaagauuuagcugaaagguagaaauuauaguauaauaacuaucauuucaauuuuuuuuaaacuuuuugaguaacuguuuaaaaauuuaaagauuuuuuuaacuuugauuucacuuuugucuugauuuaagauaucugucauccuaagccaucugucauucaaaucucgggcucugugaagacguugcuaauauguacauuaggaaacuggguaucccuucuaccacccagaaggcccugugcaaagagacagagaacaaagagacggaaagcaaagagauggagagcaaagcgaccuuccacuuugggaagcgccacucagguguagcuuauucaauucacaaauuuaauagguugcugauuuucuauguugccuuaaaauauucuuacauucuuuaagagaccauuuuauuaaauguauuaauuauaaggguuaaaaacaucaucugagagauaauuacuguguuuuaaauuguuuucuuugccaguagguguuuauuaguugaaauacagaaaaugucuaggaaaagugugggcuuuggauuuaauggucuuauugucaaaucuugauauucucucucucucucucccucucccucucucucucccucucccucccccacuuuuccccccucucucuuucuugacaggggacucuugcucuauagccuaaugugacuuugaacuugugauaacuucuuagccucagucuuaaguacugggauuguggguuucccccacaauggcccggcuugcugguuucuucauauguggcucuuaaucacaguuagcucgccucuccguuucuguuuucuuguuuguaaaacaagaaucggaacauaaagauuuacuuugaugagucuggcaggcuuaacgauggugacagcucacugcucugcaguuuugcugaucuuaucguggucacauuucuaggaggccaccuugauuuuuuuccccucugauaacauauaccaaauaguugucacauuucauauuuaaaaaugaaguugcugggaccacugucuuccccaucuguuugaguuagguaucauuuuuguguucucacaacuuaacaaaugggaagcaauuuacucuguggugcugcuugguaaaucacuuucucacuuucaagauauuuuucagucuuguggaugagaggucuugacaauagucauuaaagauaugauagcauuuuccacaagcacaaggacaugcgcccaugucucuuugcugagcucuggucuggguagacuaauuuugacauucuuuucuucuaugucuacccugaaguuucacuagaggaaguuacucccucccaguacuggaucagcuuaggccaaaguccaaacgcuaguguaugaaaaccaucuuggucaucuacucgucuaaagacacaguagaaugagcuaggugugagcuggcacuggguguaguaacacaccuguagugacagagguggcaggaggcaagagaaucaccguggguuugaggucugccuaggcucagagcaacacgcugcucaaaaauacacaacccccugcagcucagugggcagaacacuugccuagcaugggcagaagagccuggauuucaucgugagcacugcauaaaccaaugugguaauguacuagggaaguaguggccagaggaggaggucaaggucaggcuacugaggugauuguaaagcacuugccagggaauccugaagaccugacaucuauauucccagaacccaaagcugaauaaaagaacagacuuucaaaacuuauggcacauggacaacacacauacacacacacacacacacacacacacacacacaggugauggugauggugaugaugauaaugaugaugugaugauaauaaguuuaaaaacauauuuguuaagggugaugagauggcuaagugaauaauggaggagucugcucagaaggucuggugaucugagguugacccucuaaaccucuggagagacccaacgccauacaauuguccucugagcuccacauuugaaacuuggcauucaugaucacacauacuugucuugcacaaacagggacagacaaacaauuuguuguugucguuuuguguuugcuuguuuguuuugaaacaagguuuuucugagugguccuggcuguccuagaacucaaucuauggaccaagcaggccucaaacucagaaauucuccugccccugccucaugagugcuaggauuaaaggugugagcaccacugcccagcucacagauagauauuuuuuuaauuauuuauuuuaugugugugaguacaguguugcugucuucagacacacaagagggcaucagcucccauuacagaugguugugagcuaccaugagguugcuaggaauugaacuaaagaccucuaaaagagcagucagugcuguuaacugcugagccaucucuccauuccagauaaauacuuuaaaaaaaauuaacaacauaaagaagcccaaggucauuccaagguacauaucaaaccugggccaucuuggcauaccugggacuccaugguaaaacaacaagaacaacaaaaucaucuggcuguagguucagguagcuuccaugaaaccacuugagacccugaacuacaaaugauacucugguuaaggcauugccaaacaguuuaguuaaucaaguuaaaccaagucucagugaaaaaguaagagaaaaaagaaaaugacaagaacaucccaaugugaaguggccccgaauccucacuacacgugggcugcagggaagugggugggaaaagcauuuacauucagcuucucauuucccacccgaaauuggcucagugguuuuguuccaccagaccuugaagagacagguaugaaaguucacaccaaaaucccuagauucgggaagugaagaaguugaggcaggaggaucugggcugcauagaguuugagucccaguuacauagugaaagccuaugucaaacaaucccacuuuuccuguguugaaauccuaacccacaaggugacacuggcaggaggcaugaccuucugcacgucagugacuccugcgugcaggugaagaggaucaaugcucuuccugcuuggcuguccuaagccuuucaccuuguguauguagauaaaacagccuugcuguacaacuuagguauauacuauaauggcaacauaaaauggaguuaucauagacaguacgauccaagaaaguagguaauaauuguuuuaaaauccagcuggagggaaggcccagcauucggagugcuugcucuucuuauagccagccgacccagguucaguuccuagaaaccacauugguggcucacaaccacucaaaagcaccuuucuggggcauauaaacccauauggauaacauacucaauucauauaaaauuaaaugauauuuuuaaaauuaauuaaucaagccagacaagguggcacaucuaaucccagcucuugagaggcagaggcaggcagauuucugaguuugaggccagccuagucuacagagagaguuccaggacagcagggcuacacagagaaacccugucucaaaaaaagaagauuauaauaaugaggaggaggaggagaaagaggaaggaaggaaggaagggagggagggagggagggagggagggagggagggagggagggagggagggaagaaagaggauaucucagagaaaucucuucuaccuucuaaaaccacucugagcagauggccauguucaaggaagccauuucucacacugaaucuaucucaggaacaggcuggcucccucuagaacuauaggaaugcaauucugucauugauaaagaccaaaagguuguagacccaaguagacaaaagaaucuccuuaaaaauguggauucuuuaacaggccugguuguucgugcugguaacccgugcccuagggaaacugaagucaugggcugcauuguaggucuugugcaaacaaagggaguugggcgugguggcacauaccugaaucccagcacucaaguacagguacagcagguggagcucugcaaguuugaggacugcuuagugcacaccccuuguuccagggcauccagagagccagggagcagaggugggguguccgggggaaggggaagaaacaaugauaauaggaguuugacuucaggaccuacuuccacaaguuguccucugaccuucauacauaugcccugacaagcuccccugggugugcguauguacacaaucaauggauguaauaaaaaugauaacaagagcuuagaacuuccuugacuugucacagucugcacaaauggaacccacaauaacguucuucaggccagccacucuuacuucaaauggccauggcgcauuggcucauauuggccauuuggucacuaaauauaaugcugucauguggagcaggagagcagaggaagacagccuaguaauggucugggacaauuauugagcugugcacuauuuuauacauaggaaagguaaagaaauguuguacuuugcugccuuacuuuuguuuauuuugauucuuuuuuuuuuucuugguuuuucuagacaggguuucucuguauagcccuggcuguccuggaacugacucuguagaccaggcuggccucgaacucagaaauccaccugccucugccucccgagugcugggauuaaaggcaugcgccaccaugucccgcucuuauuuugauuuuugagccagaguugguuuguuuucuuuugucugcuuuuguuuugccuuguuuccuuuuuugagacagggucucauuaaguggaucugguucucuuggaacuugcagagauccaccugccucugccucccaaauucugggaauaaaggcaccgcacccagccuccugcuguaauauuugaaaugcuaacuuggccucccucccuugcucccacccuuccuuccuuccuuccuuccuuccuuccuuccuuccuuccuuccuuccuuuuuuccucccucccuuccuuuuuaauucuuggaauacuaagaacuccauugccacugagcuacauuuguugcuagcuuuccauucucacagagcuuucuugugaucucccaaguucucugaaagucagaagcacaauggcaacuggacuugccuggcucagaccucccaccuacuagugauguaaucuguacagugaagaaacgucugcuucaguaaguuauaguucuccucagucauaaugcuugcaauuauuccugauuuuuacaaaaaauaacaaguaguaccugggugugaugauacaauccuuuaaguccaggacuuagaagauagagaccaacagaucuucuaagauggaggccagccuggucuacauagcaaauuucagucugaccaggacuauauagugagacccagucuuaaaaaacagaauauuaaugggaccagccuugugugagucugcugcuuauaaucacaggcguugagaguugaagagaucaggacccugucaugcccuuaggacaguguucaacagcacuucauucucucuucaaugcugccugagacaagagaugucucauuuagggcugagcauucaacagucauuuauacucaucaguuugaccaguuuugaguuucuucaguagcagccauccacagcaaaugaaaucuccuuggccaaaguugauaacagcaauaaucuguaggcacaaacaaguauuuaaauggcaauuuggcaggcacauuguguucauuuagacaaaagaagaagaaaaaaagaaggaggaggaagaggaagaagaggagaaggaggagaaagagaagaaggggaagugauucccccacuagggccuacagcuuccccuacgugggcuuuugacccacuauaccaaaccugaacuuccaucuguggagcaggccucaccaccagucauaaguaauggguuacacuaauaguugucaugccacuauuauagcaauagauacgucuugccaggaauauugacaguguagcauuccagguccaagaccaaguuggaucaugggugacaaguuuccccuuaacuugcauagcaucugcaaaagcucaccagcagggaggaagcuucaagcuuaauaccagcuugauuucucugugucgugugaucgaagcacacaguccauucagcaauagggucuuacaauuuguucccauagcaacuaaccccagugguaauagugugucucauuuucaggccuccugggaucucccuggccagcgacuagugaggagauaccccacuccugauacuggaauuuuguguuuucuaaaugucuuuucccacacacucaugguacuuucaaucaucuuuuaaaugguuguuuuaaaguuuauaggcacaaaacaguuguaggauuugucucauucuguuugguaucaguuauauuuuacugaauguuauaaguguucucauuagaaugaaaauauucagcucuuuaagacuuggguagaggggcuggagagaugacucagcaguuaagagcacuaacugcucuucuucaagggguccugaguucaauucccaggaaccacacaguaauucccaucuguaauggaaccuguaaugcccucuccugguauauuugaagagagcaacaguguacucauauaaauaaaauaaauaaauauuaaaaaaaaaaagacuugggcagaaacaaaacugaaaagacccagaaagugggcagugguagcacaugccuuuaaucccagcacuugagaggcagaggcagaggcaggggcagaggcaggggcaggggcaggggcaggggcaggggcaggggcaggggcaggggcaggggcaggggcaggggcaggggcaggggcaggggcagguagaucucugaguuugaggccagccuggucuacagagugaguucuaggacagucggggcugcacagagaaacccugucuugaaaaaccaaaaaaaaaaaaaaaaaaaaaaccaaaccaaaccaaaccaaaccaaaaagcuggugagauggcucagcggguaagagcacccaacugcuuuucugaaagguccugaguucaaagcccagcaaccaaauggugacucaaaaaaaaaaaaagaccuggaaaguaagaaacucccaagucucaggaaggauuuagcugaaauuuucaagauucacaaggcuccucucuaaauuugaauaaucuguaguagcuguuaaagacaacagacuccccaaguggaggagcugccuagagaggcuaccccagcaguucagauacuugcaagucacacagggauaaagcuuugugguuuuuuuagagauggguuucucuauguagcccugucuguccuggaacucacucuguagaccaggcuggcuuaaaacucagaaauccaccugcuucugccucccaagugcugggauuauaaaggcgugcgccaccacugcccggcagggaugaagcuuuuaugagccaucacugaguuugagaugggccuuugguaacauagucaucacugagucaucugcuucuggaaguaaaccucacucagaugcagguaaauagucccagcugacucauuuguucaccaaguuggacggugagggaaucaugucuuugaucuuuucguuaguuccuuccuuaucuggaauuaguagacuuuugcucaugucucagaaaagucacucaacacccaaccauaaagcacgugugauaccugugcuuggcccuugcacccuguguaacuuagucucccacucucucuccucuaaguggguuugcaugucuuucaacagcuucucuacaucuguaaggcacugagagguuagcaucauaucaccuagguaaugaaagcuuccugcagagggugagcagguucacugaagugcugucgucuaucgcacuuagcaaaugcuacuugaucucaggagucaucaucugaagagauacuaaagaaaaauauaagucccacacagugaauauauauaaagaugggugugguggugcaugccuuuaaucccagcacucuagaggcagaggcagguggaucucugugaguuugaggcuaaccuggucuacaaaaugaauccaggauagccaggaccacacagagaagcccugucuagaaaaaccaacuccccacuacgcaccccccccccaaaacaaccggagcucuuugcuuggauccaucaccuuugucucagaagaucaauguuagauacagaggugugggugggaguuaacuuucucaguuagcucugugcuagccagucauuuucuaugucuaacuccuucacccuaagguguugucuccagggcaacacacgucuauccaccucugagaggcaagauggaacucauuccugcucugacaagcccagggccaagggaaagcuuucaccuagugcguugcacuagcguucucaagucggacaguccucccacacagauaacauugggcugaaaggacccugggcuagcccagucucuaacuccaauauaccuucaugcaggagaguaguacaggauuuucuggaggggauuacugcccacuccagaaacaagcaaaguccuucacccucccugcugucauuuuuuuuuuaacagauuuacuuacuuuuuuauuuauaugaguacaccggaagagggcauugggucccauuacaguugguugugagccaccaugugcuugcugggaauugaucucaggcagagcagucgagucagugcucuuaacugcugaaucauaucuccagccucucccgcugucuuuuauaccuucaacaaguuuuuccuugagcuuaaaagcauccuaggaucucacaagcacuacucuuggcccucuaccaguuaauagucccugaggaauuuagguuagacccaaacauuguuauguuuguuuuucacugacugcagacuccuuugucuauuuuuauuuuguuuuugucauuccagucuugaaugcuuuagcacaauagggaucugacauccaagucaaucuaaaucauugagauccaccagagccuuucucaccucauaaagauuaagucccaccuaggagcuccacaaagcuacuagcaagauggcucaguagguguggccacuggacaaaggcugcugacuuggguuugauuccaagaaagggaaacuacuucugcagguuguccuuugaccuccacaggugacaugggacauaugcacacacacacacaugcacagacacacacaugcacagacacaugcacacacauucacacaugcgcgcgcgcgcgcgcacacacacacacacacacacacacacacacacacgcaugcauacacacacacacaaucagcaaacaaauguaaaaauuuuuaaaauuugauggguauugcauuauaucuguauauaaauuuugauaguacaucauauuaauucugccagucuuggauuauggaaggucuuuccaauggucuggaucuucuucaauuuuguuuucaagauuuauuuuauuuauuuauuuuguguguguguaugugugugugugccccauaugugcucaagugcccauagaagccagaauaggggauuagauagaucccuuggagcuggaacuacaguggguggugagucgcugaugugggugcugggaacugaauucggguaccuucagagagcagaggagguucuccauuggugcgccaucacuccacccugaucuccuuugucgauguuuucaaguuuucauugcauccaucucucacuucuuugguuagguuuauuccagguuuucuuuuuuuuuuuccuauuguuucuuuuuuauaagagugcauuguuaguauauacagcuucuccuccucuucuuuuuuuguuuguuuguuuguuuguuugagacaggguuucucuguauagucuuggcuguccuggaaaucacucuguagaucaggcuggccuugaacucagaaauccgucuguaucugccucccaagugcugggauuaaaggcgugcaccaccacugcccagcuuucucuucuuuaauaaacacauauaucgacuauaucccgaaacuuuaauguguuuauuaaaucuaaggguuuucuaguagauucuauaggaugcuuuuuguuuguuuguuuugcuuugcuuuugagacagaguuccacuauguagaccaggccucauacucacagagaucugccuaccucucugccuccugagucugggauuaaaggcucacuucuccacacccagaaccuauagggucuuuuaaguagagaaucauaucugcaaauaaggacaauuuuucuuccguccuuauuuguaucauuccaugucccucuccugccuaauuucuguagcuaagacuuuaagcacuauauugaguaagagagugaagcucaaggugccaccuagacgaggacaacuauagcacucggccccuuucugggacaacucugaaggauaccgaugaagggaaauuuucacauggggcagaucuuuaaucauuccacauuuguacauuuuucuuggaagggaaaauagcuggaugugugauuguauacugauaugugguuguagacagugguuuggcuaggugaucagggaauggaaggaccaugauuggaaaauuggugagaaagacauuugaggaagaaaugcguggauaccucucuccaagugugucccaugugaaugcucaucaaaagaugacgucagcagaggagaaguucagugaucaagcagacaaggaagccuguucuaugggcagccagccucuuuucccagucauccauuuucucccagugggcccaugaucaaaguggccaugguggcagagauggagauuauacaugggcuugacgacauagacuuccaaucaccaguuggcuacaucugcaucugagugccagcucggccagcagcagagaccaacacagagcccaacugauacagcacaauuccccaggaugaccagccagugaccugguggcaaguugacuacccugggccacuuccaucauggaaagggaaguauuuugucuuuaguagaauagauacuuacucugauaaugaguuugccuuucagguacauagugccucuacugaaacgaccauccauggacugaccaaaugucuugcucacucuuaggauauuccacauagcaucguuucugaccaagaaagucacuucaaagaauuacaagccaaagaauuacaacaaugggcaugugcucauggaauccacugcucuuaccaugcaccucauaauuccaaaacaucuggcuugacagaacaguugaauagccucuuuaaggaacaguuacgggggggggggggcuggugagauggcucagugguuaagagcacugacugcucuuccagagguccugaguucaauucccagcaaccacaugguggcucacaaucaccuauaaggggaucugaugaccucuucuggccuguagauguauaagcagcagaacacucauacauuaaauaaaaagaaagaaacaauugcagguauaccaguuagguagcagcagccaggaguguggagcaggguucuucagaaagcagcauacgauuugaaucagcaucugauauaugguaugcuuucucccaaagccaggauucacaggccuagggaucaagguguggauaugggaaugguucccuaugucccauuaggggaugggucacccuaugacccaucaaaacaaguuuucccuucuguuccugugacuuguccucugauauccuagaauauuuugguuccagaguagggaaugcuucuuccagaagacaaagcaaaaauauucaauuauauuggaagcuucggacuccaauccuucccccccucccccgccacuuaagagacuuaaaaaaauaauaauaauaguguuagggaggcucauugauccagacuaccagaggagaacuagacuccuucuccaaaauggagguagagauuaugucuggaauacaggaaauccuuuagggcaugucuugaagcuaucaugucuugugaccaagagcaaugggaaauuguaacaacccaauucagucaggaugccaaagggcucagauccuucagcgaugagaauaugggucaguacuccagugaaggaacaaagagcugcugaggugcuugcugacuguggaggaaguacggaauggguggcagaaaugguagugauaaauaccagcugaggucacgugaccaguucaaaacugaagguuguaacugccaugagucuuucugccuuuuuuuuuuuuuuauuggaacacauuuguaaggcagggcacagugguguaagcuuucgauuucagcacucuggaaguggaggcaggaggguuucaugaauucaaggccagccuggucuacauacugaauuccaggucagucaaaacaacauagagagauucugucuuaaaaaauagcaaaacaaacaaacaaacaaaaacaaguuagacaaacagacaaaaaaaaaguuugugcacauuagcacaguaagcagacauuucuauuuucuguucucuagauguuuaucauguaauguaauaucaguugagguaguagcaguaguuuaguguuauaaaucuuuauuaucauauuuaaguuaugagacacuaaaacacuaagcauucuacaaggggcuuugccaccuauucuaaaaaaugcaauguguuuucaguuguuugugagguauucuccauguuaggcaggaugaugaucaugcuugguuucauuuggaaauucaacaugacuugaggggaucugauugggugccaaguugacaaggaguaauuugugauagcuaaucuugguuaucaauuugacuagcucuggaaucagguaaaacucaaccuacugggaacaccuguaagggacuuccuuggugagauuacaagaagcagaaagacucaccuucuggugucagcccagauaaaagaacaugaacaaaaaaaaucuuugcuugucugucugcuugccuuugcuuuuuuuuuuuuuuuaauuaaaaaaaauuuucgggcuggagagauggcucagugguuaaggccacugacugcuuuaccagaggcccugaguucaauucccagcuaccacauggugacucacaaccaucuguaaugggaccugaugcccucuucuggugagucugaagacagcuauaguguacucauguacauaaaauacaugaguugguugagagaucagcucaacccucaucagaagugcuucuucuuugcauggaugguaauuaacacagagguccacagcuggacaauagcgcagagagcaacuuuggaacacucaguccuaaaugggaugucuucaugaaaccucugaccucaaagcucagggucuaugcagaagaggaggaggaaggacuucagaaaauguccgaagugcuggguaacuccgaggaaaugggguuuuucaggcacagcaggacugguauauguaagaacugacagagauugugacagcacucacaggaccuccauagguucaaaccaaagucuaagcacuaagaaggggagguggacacaaugaccccaccccaaccaagaagcuauuuacaacugauuaacuguuaaucuacaucauuuguuaguauauuaauuaaugcuggaaaucaauacaguggcaauuauuccuuaaccagcuuccccccaaauaacuacacagagauguuuuaauauuucaaagccuuaggccuuaacugggcagacuuucaacuaacugaucuaaguuaacccgaccaccgaggcccauccagccaugagccuagcugugccuuccaggccugugaucacguccaucuccucccauaucuccuggcacaaggacuuuuuuuccuucuccuucccagaguuccuuucuccauucuaagaagucccaccuccacuuccugcccagcuaauuggccaucagauuuuuauuaaagccaaucagaggaugccuuaggcaggugagaaaggacagagacacaauuucacauagcguaccccaacagacugagccauuucucaagcuccuugccuucacucuuaacagcaaacucauagauccugcuguugcagcauuucuucaccaauauuagaaccaacuucuucuggcugaauaccaccagcaucaggaugcaggcaucccauaagcugucaacaccauauugagacuccuaguagccuugagacacaaguagccgugugaacugagcaacuacuagaugcccagccucucccaugugagauagcuauuauuggauuuccugagucguaucauguaagccaaucuaauaaauccuuuuuuaauauauauguucauccuaucagcucugcuccucuagaugacccuggcuaauacagcauccuugucucaguccucauuuuagaggaaauggucuuaguuugucuccuuuuauggguuauggguuuauuguagauagccuuuauuauuuugagguaugcuccauuuauuucuaaagucuccaggacuuuuaucgugaaggcacgcugaauuuucucaaaugccuuuuaggcaucaacagaugugauuaugugguuuuguucuaaaacuuuauuuaugugguauaauuacauuuauuaguuuaaauauauuaaaugaaucuugcaacuaugggaugaaguccccuugauguaugaucgucuauuguguuucugaauuugauuugcaagcguuucauugagaauuuuugcaucuauguucaucacagaaauuggucuauaguuuucuuuaacguuguuguugugcuuuuaccugguuuugauaucaaaauaauacuggcauuguagaacgaauuuggcagugcuucuucacuuuguauuuuguagagcaaguuaagaagaauuguuauuaaauuuuccugagaaguuugauaaaauucaguugugaaucuaccugguccugagcuuuucuuuauggucauagcuuugaucuccuugcuuauaacgaaucuguuuaagugugugaguggcuuucuuagguucucuguguggccuaugugugagcgagcuagaagaacauguguuuuagguuuuugcuuguuuguuuuauuuguuuuguuuuugaaauuaaagacucacaccaguccccaaauaccuggcgaauuagcuucuuucuuaacucugcagugaacaaaguucuucuaucuagcccagugaacugaccauuaagucuuggggcaccuccaaaauagcugacagacuagagaccauguaaagguuuaaagacucuacaaauuguguuaugugacacagaauugucagugccacccaaguuuccuucaugucccauaugacaacaucugauaaagaggcagaauggugccaggugugguggcucacaccuuuaaucccagcaccuaggagccagaucuuugaguucuaggccagccugguuuacagagcaaguuccugcauagccagggcuacaugaaggaaaaaagaaaucugacuucuuggccaguucugccacucaccagcugagucaccuugggcaaaucucagucaagcuuuguuuucuuuucagcacaaaauaaaggugucaguuaguuuaaauuuguugcaccgggcugaguuacaugaaacaguguguauuucagucucuccuuaaacuugcuauguagugcuucuaguuucuuuuaggcucccuaauaaaacacucugaccaaaggcugcuuggcaaggaaaggguuuguugggcugacacucccagguuagcguccaucaucaaaggcagucagggcaggaguuccagcaggaagcuagaggcaggaaccauggaggggcguuguucacuggguugcuguccaguuugcucagccagcucuuuucuacagagcaggcccaccugcccagggcauaguaccacagugagcugggccuuccuacaucaauuagcaaucaggaugaugccccacagaccuccucagaaggcagucugaucaagguaauuccuaaauugagauucccucuucugagccaacgcucuauugugucauguugauauucagaauuaacuagcacagcaucccagguuggcguuaacaguaagguucuuuuaccuugggcugguaaugugacucagcaaguaaagcuuggugcuugcugccaagccugaacaccuggaacccacuguggaaggggaaaaccaacuccccauaguuguucccugaccucuacacaugcacuguguccugcacaugcucauauucagacacgcguacaauacuccugccacacacacacacacacacaccacaauuaaaaaacacuaugcgccugccucagccuuauacaugauaggguuacauauuugcaccaccaagccuagucccaaauucccccucuauuuauaaagaauauagguguaucucuucucucuuucacauacguaucuaucuauccuugauauccauuucaacuugauuuaaaauacuugauuuggcauccauugaggcccugacccaucaggcccucuaggaacaauccugucuccucuuacccuaucuuucuucuuccuuguucuuauaccuaacauguauuaguuuuuaaaauucaauuuaucuuuaacggguacaugguaaccuaaaaguauacauauugaugugcugccuugacacacguguaucauguacuguuugucagguuaaacacagcugucuccuuuuuucuuuuuuuuuuuuuuuucgagacaggguuucucugcauagcccuggcuguccuagaacucacucuguagacuagguuggccucgaacucagaaauccgccugccucugccucucaagugcugggauuaaaggcgugcgccaccacugccaggccauagcuagcuccuuaaacacauuauuucuauauggugaaagcauucaaaauccuuuuguuaucuugcugaaguuuauagcauguggucacuaucugucaucaccauacugagugcaucaaacuucuuaguccuacguaauuguaaccuaguacccagagaucagccuuuuccccuuuaucuuccaguaccguccaggaaccuguuucaguuugccauaguaaagacugaacccaaggauugguccaugauggacaguuguuauauccuggucuauuuuauaguucuuacuuugagacaaggucucauucagcugccuagcaagccuuaaguuccuucuguuguccaggcaggauaauuaacuaacugcugaucauguaagacagugucugaaaacagaagauugcagauaucccucaaucuccaguccuauggccagcauuacuucacugccuacugccuauucuccauuuuuuacuuuaagagcuucaguuuucuugcaaaaccuucucuucuucauccugagugcugcuugcaagauugacccugcaucucuguuucagaaauuacuacuggaggggaggcuggaguuauauagcucagugguagaacacauucaagagguccuggauccaguucccaguacugaaaagaaaacacuaaguagcagacugguacaaucuuguauucaggauguagaaagacagccgggaguugaaagcuacauagugaucgaauauuaugccagccuggauuacuuagcaagacccugucugaggaaaaaaaagaagaagaagaagcaguugccggggaguccaugucucauucaguuuaagccaaugagaucaggccaggucuuuuuauggaccuaauguaagagggacacacuuuccaucaauguugccaaguugguaaaaggugagucugaagcuacuggucaccgucuggucuuucacaaggaaagaaucugccugggacaaaaggaaaggugaccugcgcagcugggggagaccaggcucugacugugucuuguauguagcgugggagucagcaaacagaaaggcaggcacgggcucugcugucacuguaggcagguagagggcuaacaggacacauaagcagagguuagugagcaaagguggacuuggucaagcaaggagaggcauguccauggaagugaugagagaaaaacagccccagaagggaggugacaagagccgucaauggcugaaccacuuggcacuuuugggggaaaucagcacuaacacagaguagauagccuuaucucaaacgcaucucaguugacgcagcucuuuaaagucccucacaaugaaguaugccagaguggguucagcugugaguaaugcuggucugauuaauugugacuccagcaaugacaacuuuuaauuaugugacgcaagccuugcagagugggggccagugcuucgcaaugcugugaggguucugagcucucucugucuugccauccucagacuuucuuuucuuuuccauugaaauuuucuaaaaaguuguugguauguauguauguauguauguauguauguauguauguauguuuguguaauguucucaugcacauguggaaauaagucaauuuuuuucuuuccauuguguagagauggaacucgggucaacaggcuuggccaucgcaccuuuaauugcugagccaucuugccagccccuguaugagaauccuuuaaaaugauuuuuacuuuuuuuuuuuuuuuuuaaaucucaugguauagaucacagagggcugcaagcaauccuaauuggggaauuuggugcagacuggagagcccacacucagccugagggacuuuucuuuucuuuuuuuuuuuuauuuaaucuuuuuuuuuuuaaauuagguauuuucuuauuuuacauuucaaaugcuaucccaaaagucccccauacccucccccaccccugauuuuuacuuuuauucauguauguguuguguguauauguauucauuaugucugugagugugagggugugugcauauaugccaauguauaugugugugaguguauauguaugcauguauuugugaaugugagugggccuguguguguuugucuguguguauuuaugaauguauucuguguguguguguguguguguguguguguguauaugcaugcaugaacauaccgugcuguccauguggaggucaaaggacaguuucacagacaggauuuuuaccuuucaccuuguggauucugggacucacacucagguugucaggaucagcagcaagcaccuugacccacuggccaucuugcuggccaagauuuucuuuugauacacauucucuaaagauauguuuuuguuaccuuuacauuguguauguguuugcaugugcaccuaaguccagaugccgaugaaagccaugaauccucuaaagcuggaguuacagguauuugugagcccucggauaucaguucugggaauugaacucuggucuuuucaucuuugagccaccuguccagccccauuaugcauauuucuaaaacagaagauaaaguuaaaggcuuuuuaagauguccagagccuuauucucauaauuuacaaacauguuacacaacagaaggacuuugcuauucuucguuuuauuagacagucuccuguaguccaugcugaccgugaauuuacuguauagucagagaugccuuuggacuccugaucuccugcuucuaccuccagagugcucagauuacagaugucuucuagaagauccuauuuaaguugugcaucuaacccagggcuuccugcauccuugccaccuaucaaaucagcuauauccucagccugauagaacauucuagauggagcuuagugaaggacaagauccuuagcauacagacaacacaccuggagucagaggagauguguuaacagcggucagaguagaggaacucggaaaggggaggauuuagagauaccaugcaacuagauuugaaaaugaagaaagagggcuagagauauggcuuaauugacaaaaagcacuugcuggucuuccaaaggacccagaucaaugaaguuuuaauuuaacucaacuauuauuuauugugaaccuauugguuaaaagcacagugcugaaaaacuguauaaaauuuucuuauuaaaauauuaaaaaggagcugugguuuugaaucuuccuaaugcuccagcccuuuaauacaguuucucauguuguggugacaccuccuagggucaggccuuguuugacgacagccucacuuggaaaucuccuugaguuggagacagaugguuagcagcugcgauguccuguguuugguuccgguauuuauaaaaagggggaggggccaguccugugugggcuacagaguaaguucaaagacgguuugggcaacucauuuagugagaccuuuccucuaaauaaaaagcacugggacugcgagauggcucagagguuaagagcacucugcuacuccuccagaggacucaguuuugauucccagcacugaaguggugucuuacaaccaucugugacaguagagacaauaaugacccuacccccaacccccauuuuuugguggcagcagagacuuuggugcugaauugaggcaaucuaucugggcagcauuuuucuuaccaagaaggagauaauuagugaaauaguugucuaaacaauaucuuauauuguuuaaaaucuaaugccugaggagucugauccccuaagcuauuaaagaaacacacccaucauuuuauucuuugguuguauguucccacuggggauuuaugcccaugcagguggcccaaguucaucacuuuuauuuuuuacugucaaguauaguuguggaucuggcucucaggggcuugagaagaaugucugucccucuagucuuaguguuuuuaguuguuccacauaugugaggauaagucaaaagccuuccuugaccauggugcuucacuugcuaguauggagguaacuuuuucucucuacagagucucuucuuuuuuuuuuuuuuuaaagauuuauuuauuuauuuauuauauguaaguacauuguagcugucuucagacacuccagaagagggggucagaucuuguuauagaugguugugagccaccaugugguugcugggauuugaacucuggaccuucggaagagcagucgggugcucuaacccacugagccaucucaccagccccagagucucuucuuuauggacuggaugcuggcuagcgcucaccagguagauagccaugguuuccccaaacaagagaacaggugacuccacacaguuacaggacauuuugagagauguuacaaguaggucuuuugagaccuacuugaccuuggagaacaagggggagaaguauucgugcuuuaaauccucugaccacauuaggauggucucuaagaauaguuauugaacauccagaaggucauuuacauuggucagguacuuuaaccacuguguaacauuuagguaaaauuugaguaaaagccaaacaaacuuuuauuagauacuuuuuuguuauuuagguuaguccuugucauguagaguagaucaagagaucaauaaucauugauuugagcagaggucugauaucaauguauuggacuuugauguucucccauaccuugcucagacccuuguaacuugcuuaagcuuuccagauuuucuauucuggaaaaacauccagccaccuugagauguaauaacauuagcaaaucaagaaucaacaagucuggccacggggaucuuuuccaagcugguacagcugaugucacagcaguggcuuggcuuggaagauagugcugaguaacaccagcuuaauaaaacuggauacauaaaaaauuaauacccccugauaagcuaccgggcuuggggaauucccagggaaaccucauagagaacacaagacagucuuuacacagcacauacagugauuuuaauauaacugggcguugguuuugaaagaguauaaguagcagacacagacagagcuuuagaucaugagauaaacaauagucacagacuucugaucauuggcuguuuuuguccuccuuugucugggucacagaaucaggcugaaucauuuugauucgggaaaaggcuuuggagaacauugugagacaaagcaugcuuaggucugaagugggaaggaaaaggccaaauuucaccuucagagucagcuucucagugauaucaaacagcaggagacaaugucgcacacucacagaagacauuauuccucuauaaaacugacgcuaguggucuauaccaaacuggagacucacuuauagcuguccuggugagucguauugauuaggaacgggcaucgacgagcuauucuuuaagaccuuaaacuuuauaaguuaaucgguggguggcaaugagcaaccaugaucaaauagaaguaucugccuuucccaauguccuacaugagacccugucuggauuugaguugaccaaugaguugaacacuugugucugcaauuagcuucugugugugucugcaaauggaggcagacagccugagaggccuaagggucucucuuuuucuuuaggcucuguuaaauugauucucugaaugaaagaggcuuugaauuccugcaaguaagcauuccauuggauaguggguccaugccuccugauaaauuggauuucugguuuuuugucuuuuugagacucugaggacauaauucucagagagcugagacaauuuuugagggaucuuggaauuaguuugccccaucugaagugagauggacgaagacagagaagucuuaggucaagguugcccuuucuccaucuuuaauuccuggucuacacggauggacacucuaaccuaucuacagggagcagcuagugcaggcagaggucagacuaaguagcaauuucugaacccauuuguggcuuagucccuggccaucucccaguuuucuccucuaguauuugauaacuacacaagcccugagagacaccagaagcccaucuaauaagucuguugagcucacgcuauguaauggugcugguaugcuucagucucucaugaucgagggaucaguaacagagcuggauaugaggcaagcaggcuccggauccuuagcuuagcauacagauugccaggggauaugcuaggggaagcucaggggccaagauuuaucuauuucauuuuagugccugucuaccuaccuauccagaaauccuccaaguauuaguucuuugcacaaaguucaagugaaauaauuaaaacacuuccaagagugaagaaccaggauacaguuauaacuagaacucagugucugacaucugggacucacucaugauguucugggauccgaagggccuggacaacuccacuucccuggguuugcccuccccaacacaaacaacucaucccauagacucaggcuagguccacucuauaucugcugcuguccuuggugguuaccucacuguccugguguuuucugcagcuuuuaugucacccaaacacagucgcacugugggagagacucuuaaugcauugccaaguucaucugcgaacaugagaggcaacuuuugcucucucuggacuacagcuucugugggcugacccugaggaaguauguacuggaagauucaccucagugaugcucgucuuuucuuaaucacagauuaucugucaggcccagugucuuagaguuucuauuacugugaugaaacaccaugaccaaaagcaacuuagggaggaaaggguuucuuuuaucuuacacuucucaggucacuaaaggaacuaaaggcaggaaccugggggcaggagcugaugcagaggucauggugaaaugcugcuuaccagcugguuccuuguggcuugcucaggauccuuucuuccuuccuuccuuccuuccuuccuuccuuccuuccuuccuuccuuccuucuuucuuuuuuaauauuuauuuauuaaauauaaguacacugcagcugucuucagacauaccagaagagggcgucagaucucauuacaggugguugugagccaccaugugguugcugggauuugaacucgggaccuuuggaagagcaguuagugcucuuacccguuaagccaucuugccagccccccccccccuuuuccaggguacuuucuuauaguacucaggaccacuagcucauugauggcacugccuaugaugagcaggacccucccacauuaaucaucagucaagaaaaugccccauagggugaaggguauaucauugagaagaaaagaagaaaaguagucauaguccuaaugauuauuaggacugaagggcucaugguaucuccuguagacaucugcaagaacacucuuggucucuaggauaacagcauccuucauccccuggauaugaccuggcuguccaucaugaccaggccuggaaggcugguguccaagguagaagagcagcaccagaagcaaugaaauuaauacaauaccaacccacucccuuuaacagugggaagccagaaccuagaagaagaaccccccaggugcucagagcacgccagccugacuucacaucccuucuuguucugaacuacagcagugaguaauuucugacacaccucuugcacgccacuguugcuucuggggcuaucaaagcgcguccuuuauugacaacacuuggaaggaauugugaaguucuuaggcagcacaaggaccugagcagcagcuucccaagcuucacccagcaagcaaccugucuaucuaacucucaguccacgccagaaucugauggcaucuguggagaguuacuuaggccaggcaugugaguagaaaaguaccauguggggcuuucucaagggcuguggaguaaagagaucccaauggguaagggcauagucuagaggaaccuucacugauagcuauccauuuuuguuuguuuguuuuuguuuucuuuugagacaugguuucucuguguagcccuggcuguccuggaacucacucuguagaccaggcuggccuugaacucagaaauuugccugccucugucucccaagugcugggauuaaaggcgugugccaccacgcucggcuauaacuauccauucuaagucaaaggagcuauaugggaacaucuuccagaucuuugacuuucuccuagcgcaucaucuggaggguuuacugagaugggcauugguacccauauucuauuucuaauuaguaaccaugaaagaagagagauucuguucagauuauuuccucucauugaugugagaucugacucuuuaauacccuguaaccucaauagaccccuaaucuuauaagacccaucauucagaaaagaaaguagacauuaccuuugaccuuuuaccccucaaauuuauaauguacaagcaagcacgacaagcacucagagugaaugauuuuacccauaaucuagagaauaugaagugcuguuuuuccuuggccuuuaugccacagcaacuugaaagggaaaacaaaucaugauggguaaagaugaaagcagacagcaaggaggagagaauagagaaaaacagacuugggggcgcugagcaacaagagcaggcacgagacccaguggagcccuaaucugcagcccuaagauaggugauccuugucucuagcuuuaucuggcagcaguuuaucuagcaccuagcucugggccacugcagauucaguauugggaaugaaauucauagccuuuuguguccuuaagaaaacauacucuccugagccccacccacaguccuacugauuauccuacucacaaccccucugauaaccccacaggcagugcucugaccguuaccuucucagcuuccccaucagccuggggaccucuagaacccaagguccccugcaaggccaaccgaguucuguacacacaauaggaccaugggagagucugggcuaugggaaaagggcaugcauggaaagaacauuugcaaagucagaacuuuuauucacccacagagcagccaaagaagccugugagguggggacugacuggauuuccaucgugcuagucauggucaggauaucccccucaauuggaaggggcccuuggaguacuggaugggucaugaccacuucugagucugucucuacucuucucagucagguauaugaacuugauuagaucuucuaaaaccccuggugagagauaagugaaacaugguggugggugacagugguggguggcaguggagguggugauaguggaaggugacaguggugggugacaguggagguggugacaguggagguggaugacaguagagggugacagugguggugaguggcaguggagggugacaguagugggugacagucgagguuggugacagugguggaugacaguggagguuggugacaguggugggugacaguggagcuggggugaccaagaaagagaagaucaaaccauggagacuaggaaagaaacaacuuuguaaguuugacauagggugugaugguuuuauaugcuugggccagggaguggcacuauucuuguuggaguaagugugucacugugagcuugggcuuaauacccucauccuagcugccuggaagucaauacucugccuacaaccuucagaugaagauguagaacacccagcuccuccugcaccaugccugcuuggaugcugcuguguuuccaucuugaugauaauggacugaaucucugagccuggaagccagccccaauuaaauauuguccuuguaagaguuaccuucaucaugaugucuguucacaucagugaagaacuaacuaaacacaggaaaagucagucuaggaguccaaaaugcuggcuuggccaagggguccucccugcuuucuccuuaaaguucccuuuagauaaccuccccuauaucaucccaacauuucuccuccaaaugcuuuaagcugccauuaggaaauauauuugcuuccuagucuaccucgaacuccuucagaaugagagaguauagaagaaauuguaggaaugucaacuggguaaaacaggacucaccucacaacacacaccuccagaaucucacagguguaucguuagcucagcagaaaggaggaagaccugaaagagaccuuuccuguauuuagugugaccaucaggguugcuucauugaagacuaaugggaagaacuugaaagaacagaaguguuuaggaugcaggaagccucggggugaguaguuccuuccuacucuuuaccgacagggagaaugugacacgaucaacaucuccagcuugugacuuucuggauggaaaaaucccguucacugucacucugcauggguaucugaguuagauggagaccguaccggaccaaacuucuggcaugccaagugaauuaaaagcagacaaguaaguagucccucuaagaaaauucucugacagguguuacugcugugguggggagggaaccgaaaaauguuuaaguugaacaagaucuuugcuuuuuugcuuuuggacucaucuguggacagcuucuuuuguguucaaaacuaccuaaauaaaaaaggcaaaaugagagugugccccugagguagggguguugcuguaagaacuuuaaauggaguuuaaacucagccugagcuauaaugugagguccuaucucaagcaagcaacaaagucacaaaugguuaggugguuguuuguuugucuguuuguuuuuuaaauaguuuuuaaaaaaguauucauuuauuuuauuuacaaguuugcuguagcuguuuucagacacaccagaagagggcaucagaucccauuacagaugguugugagccaccaugugguugcugggaauugaacucagugccucugaaagagcagcuacugcucuuaaccacugagccucccccaacccuucucccacccccaccccaccuuuuaaaaucucacuuugcaccucuggcuggccuccaaccugcaugggcacucugcugccaccucccaggagcugagauugcccagaccaccaagcccggcuccaaguauguuucucgguuuguuuguuuguuuguuuguuucaccagucagucugaauuuguuugugagaauacagacuaugauaucaacucuguuuggagcucuggccauuaacugcugucauaguccuaaagccugagagugaacugagaugacguggggguggagcuuuaacuagcuaugguugcuugcuuugguuuaaauaggauuuguaaucucacuuuaugggagacuguguuguuuuuccagcauguggcaguuaaguaagccacaggagcuaauggagcaaaggguguguucuccgaggaaugccaacaucgugccuuucuggagggacaacacauccuugggacuuuuauugaguaacauuuacucauccuaaaauauuuaagaguuauguacuuaaaagauacagagcauagacaugccggugcaggaaggguuugagucaguggauguucaauguagcaagugcagaugaacuuaacaugucuuggggacugaacugggaacggacucuucagccauaaaaugcacuuaacagucuauuuaauaguggugagguccuugaaaaugcaauauccaugcuaaucuugccuuuuuccaaaccacagaugaaaaauaggucacuuacuuggagccuucucuuucuauuuaaagugugacauuuaaucuauuuaaacaacuaccaaaacuuuauuaauuucaaguaagacaaacaugccgggaaaaguggagaacuuuauuaaaaacacaagaucuuccaaauuuuaguuugaauaucuuagcuaucagaauucaaagaaaaugugugugugugugugugugugugugugugugugugugugugugagagagagagagagagagagagagagagagagagagagagaaaaugaugaugaugauuucaaacaaaagaaggaccagagaaaagcaaucuagaaugaaaucaaaccuugaugggaaaauagcugaaaggaaccgaggaguucacaaaaguuagggagcaaggaugcgagaagggccuccaggguggaggugcagaagcaagagacucaaugugccagauuuugucucaaaaauguccccuccaagaaaggcuggggggaggaaguaagaaaagaaaggaaggaagagggcuggagagauggcucagugguuaagagcacugacugcucuuccagagguccugaguucaaaucccagcaaccaugugguggcucacaaccauuuguaauggggaucugaugcccuccucuggugugucugaaaacagugacaguguacucacauacaauaaauaaaucuugaaagagagagggggugguggagagaaagagaaagaaccaucaugguggguacauuccagaaaggcuuuccacgccucugaugcgucuaggguaaaaacaaacaaacaaacaaacaaacaaaaauacaaccuacuuuugagaagaguacacagcaaagaaacccaguucuucauuaaguccaggauuagcuuguuuguuugcccauuugaaacagggucucucucucucucucucucucucucucucucucucauaggauuucuuacucuguggcccuaccaugguaaccaguucaaaguaugcaagaaaugcagugacucuauuaaucucaaagauuaacugaagaaagggaagaccaccaucauggccaaauuaaaggaaguaauuaauuaaaguaagcuuucuuuuucuccauuaguguacacggcugacuccccuuaaaggcagauuaagagaucauccccggacaucagcaagguuauacaauuuuauauaucuguuagagguagcggguuuccaaauggguaauuuggcaggcaaauaggaggguuacaggaacaacauagucacaacaacaggugguuauaguaaccuuuugaaacaaagguaggguagcaagaugguuguaacaacuuuuugaaacaaaaauauuguugccauuuccuggaacagaaaguacagagccauuuguaguuucagguuccagguggggcauagcccaauccuugagguuuuaucauaaacagggaugaaccugguuugucuuuaccugaaggugacuuuaaggcucaagauggaggcaaggugguucauuaguuucuucuuucuaccuuuuuguggguuccagggccugaacuuggguuguuauugugucaagcauuuugccucuucaguuauuucccugccccagacucuuuguauaaauaaaauuucauuuccaaaccugacuuuauggacuagggagaugggcugaacaaguaagagaaccugcugccaaggucgauggcuugaguuugauccccagauccucaugucggaaggagaaagcugacucuguagacaacgccugccaguuauccucugaccuccaugcaugugcugugcuauguccacaaacacacagauagacauaugcacagcaaguaaguaaauguuaauuuacaagucauaaccuccagcccucuugauuugaaugauuuuaacauggaguuuuuacuaucucccuuggggacacuuuggguugaauaguucuuacuaacaguuugccuccuuuauauuuggcucaaauuuucauuuucaaagacaguuucagacaaguacccugacagcuguaagccaguggaucuggaugugugugcgacauaauagagugugacaguucacucaguuguaaaagacauuggagccgaagucauaaaacagcaucuguguuaucacaucaucuuuacacaccuaucugagcacugaccugacccuggaacuuauaucagaaauuauauauguuuauaguucuccaaaacuaucuuaggcugaguuguauaucauguauuuaaauucaaaacccagggcugagagagagagagagagagagagaggugcagauuuguggcacuccuuggagguuugggguccaugaaccagugaauacauuauauuuccacauuaaagaacuccuucucuuuguaaagauauaagcaccguucuauauuuuuaaagaacuuaaaaaagcagaguaauaggccagauguguaggcugggcaugguggugcacuccuuuaaucucagcacucaaaaggcagaaaaaggcagaacucugaguucaagaccagccuggucuacauaaugaguuccaccccuacauggacuacacagugagacugccucuuuugaaaacaaacaaaauguggcaaaauuuuaggauuuauuuauuuauuuaauguaggagcauauuuuauuuuuuaauuuauauuuauuuauaucucaaaugcugccucucucccagucccuuacccacagagacccucuccccuucuucucugagagggugacaccacuguguccccucauucuggggcaucaagucuuugucaggguaggugcauccucucccacugaggcuagacaaggcaauccuacugaggaaugaauaccaccacccagcuauaccuuuagggagagacuccacuccaguuuugggguggcccacaagauuuuauuaaacuuaaauuucuaucucaaauuuuaucuggaguucuuuauagcuuuauauuuuuucuaucuuauauauuucaaaaucuaaaugaauggguauaaaugaaauauaaaugaauguccugguaucauuuauacauuauauacauaguuucuuuuaugguucauauuauuuccuuacauacugagccaucucuccaucccuaagauguaggcuuggauuuuuuugaaaccuccuuuaauuaggguucuuuaauguuucaauauccauacuagcccacuaaccaaaagucugagagaaaugugacgaauaggacaaggggguuguggaccuguuuaaaaguaguucuauggggugauuccaaucuucauugucagcaauucagucuaauagaaaacaccaaacacgaaucaguagcagcugcucaauccagcagaaaccccaaggcuccaccgagucagcaaugagccaguggaaacagucuagaagcagccagaauaccacgagaaguuuuuuguguuucucucuacgaagucacugcaagagaagaucaucaaagacuagggaugauuugcacggugagcgaagacccgugaagcguugcaugguguagcaaugcaagagcguccucucaaugucugugggguucuacuuaaacucuuuccaaacaugaugugccacgucaaauaccuguuucagcaaaacuucacaugcccucucacgugucugcuucagcaauacauccucucacaagacagcuuccagaaaaacaucacaugacacaaucgaguuuccaaagaaaccaggaauuuccacaucaccaagcccagucauuuugauuuuaacauauuccuuugcuucuaccccuuugaauauccccauaguuuacuaugaaugacagcaguguucugcuauucccaaauaaacaucauuaucguuuagaaaacacuugguugacugauuuuucaauuuagguugauaucuuauuuucaacccuagugugaucauuuagauaagacaaaauaacuucuucauucuguuauuuagcagguuucaaaauaaagaguuugguuuuuucuuccauagguguucacuuuucccuuucucucucuuucuuucuuucuuucuuucuuucuuucuuucuuucuuucuuucuuucuuucuuucuuucuuucuuucucucuuucuuuuuuuuuuccagacaggguuucucuguguagcccuggcuguccuggaacucacucuguagaccaggcuggccucgaacucagaaauccgccugccucugccucccaagugccugcaccaccacugcccggcacuuuuccuuuucuuaaaaaggaaaaaaaaauucuuuuucuuuuaaaauauguguaugucuguguguaagugcacgugaauucagcugcccacagaggucauaagagggcauaagauccccaggagcugugguuacaagcaguuguaagcuccugacaggagccaggagccuagcucaggucuucugaaagagcagagaacuccugaccaccaaccuaucucuccagcucagcugaucauuuuguucaaagaaaaauaucacuggagaaugugauacgcuugucugaugugucuggauccauuguaaugcuugugcugacuccaacagccagcaacaguaucuucauuuucccccagugggaaggaguccagagcuucacacaccugaggcaaacacucuaccacugaccucugccgagaccguuugacaaagcccugcaaguauuugcuauauaacaaagguuccgaguuuaguuuucuuuauuucucuuucagaucugcaguccaguauuucucuaaggauccuuagauccuucaggacagaaaugguuuuguaagacuacagccuacaagcugaggaugcucacaucuguaggguugaacuugaauuccuuauuauucuagacagauuuaauuuuauuaguacuagggauucaacuuaggugcuagccaagcacucuacccugcugagcuuuauagaaccccagcccacccuccaccuuuuuuugagaaagaaaaggguuuauauguaaauccuggcuaacuugaacucacuagguagaccaugcuggccuggaacccauggagauccaauugccuuugucuccugaguguuaggguuuuaaaaagugugagucaccagagccugccuucuuuuuacuguguuuuguuuugguuuugguuuugguuuuuugucuuguugguuuuuguuuguuuguuuguuuguuuucaggccaggucucauuaaguugugcaaacuaauuuugaccuuacacucauucucuagcccaggauagucuugaguuuaugaucuucuugccucaguuucacaaauaacugggacuaugcuucaccuuuacaaccaggccagucggcuauuauuauuauuauuaggcauguugguacagguauguugacacauuuucuguuucuaauuacauaguaccguagacuaguacaaaggaaagcuauuagaaaaaaaaaaaaaggauuucuucuagcacgugguuauagagguauaagacuguaucugaugaucuuuauaucagggccagcagaguccuggggaaauacaggacauugaaugacaagagacaguaguguguguguguguguguguguguguguguguguguguguguauguguguguguguauguguguguguguauguauguauguauguguguguauauuuauacauguguacaugugcgugucuuuccuugucuccuuccuauuuuagggcucuaccacucagguucauucagguuuuauucggaugaacuuaucuaacucuagucacuuucauauauuuuuuuaaaauacucauuuuauuuauauguauacgugugcuuguguggcuaugugcaaguauguguggauaacugagaaggucagaacaaggucagauucuccuggaauuagaguuuuauagguaguugugagaugccugaugugggugcugggaacugaacucaaguccucuacaagagcagcagcugcucuuaucugcugagcuaucucuucaucccaacaguuucacuucucaacaucauaaugggauuaaguuucuaucccuuuagaauccacagugaugauuaaauuauagucuaaaauuccuuuggggacacacggaaaccagaugcaaaucauacguuaagaaaaacguuuucuuauguauuuuuuuccuuccucucucccucucuucccccucucuuucugucuuuucuuccucucugauuuaauaaaggaugcccuuagcucauauugauauuaaaccucuuuaacgucuuucccucuucacucauuuucccagaccaagaaucacugaccucagccagccauggcucaguagugcacgccugcaauccccacacuugagaggcgggggggaucaggaggaucaggaguucaagauaggccucggcuaccuagagauaaccuagacuacacaguacccggucucacaaacucaaagugggucggcaagaaaucaccaauggcagcauuuacacagcacagaaauaacuuucuuuuccuguuuuacacuucagaguagcaacuccagucaaccacacaaauaccaacaaacguuauuuuauuuauuuuaaacuagauuauuuuuccuugaggccuugugacuguagaucuucacugucuacuugauuaggcaauagacuugacaaagaauuaccaaggagacuuaccuccaguuuguggagggaagauccacucuaauguaggugguaccagcccaagggcuggggugcuagacugauauaaagagaagacagagaaagccagcugcgcacauuuuucccuuucucugcuuccugaucugcagagaugagagcagccucccacugacacaccugcaaguguuuuugcagccauguuuucucaucacuaugggcuguacccucaaaccaugaaccagaauaaagccuuccugaaguugcuuuugaccaguauuuuaucacagcaguuauaaaaguaacuaauaagggaaauugguaccacagaguggugucauugcaggaaugaaccugacuacaagguucuucauuugcauuuguaauuucagacuagagaaguccuguguuacacacaguauuuaguguccugauuugagcucagaagaccaggaugccaaggaaaaccaaacaguggcugcugggcuuaugagguuucagaggagagcaaagacuugugggaaauggaguagagauccuguuuuauuuuggcagucaacuuggcuacacaugcuuaugcccugacaaguugagagagguaaaauuuaacaucuguaguuguuaaauauauuuguauaauauagaaggaacauuacauuuugccaugagggcaagacucuacucauggaaggucccagacuguaaaaauguaaauuccucugaaagaaagagacuuccaaugacugagcaggccacccaccucaggucuuccaguuggagaacagucaucuagggaagugaaucuaggcuaauccagcgaggcacacgaaagguuacuccagcuguaguggaaggggauggaauacaucuuuagcuuccagcagaacuugagacgucaucuacaugguguuaauuucgcagacacgcaaaauauaagaguuacggaaccaucaguauuccagaaagaugccgaggcaaggcaacaucuggccaggucagacucccugagagaauaucaugagaguucacugagugagccugggaagggaaagccugaguugcaagagagacucuaggauauuucagauguuaggacugugggcuaugcacuuaggaaagcuaugggauagugcuagcucaagagagaagcugauugcauucaucuagaacuggaagggaagggcugcuuaaggcugucagaaaccagaugaugccacugcgagucccagaugcugaacauggaacugcaugauggguuucccuguugaguuuuuauuuugaucugauguuuucuugguuuguucccauuccucccauuuggaauguuuauccuaugcaauuugauacuggaaguauguaucuuacuauuuauuuuauuuuuaaagaugcauguauguauguauguauguauguauguauguauguauguauuauguauacaguauucugucccgaguguaugucugcaggccagaagaggauaccagaucucauuauagaugguuauguagccaccauguaguugcuggaaauugaacucaggaccucuggaagagcagccagugcuuguaaccucugaggcaucucucuauccccccucccccauuuuuuuauuuuaugggggcucacagcuaguaaauuauguugagcuuuagaaaagaaugccuugugggcuuuugagcagcacuggaacuguuaaaacuuugggagcuuuuagaaguggccuggauggaauuuugcauuaugagaugaauacaaugccucaaaggcgguggaggaaaguuucauuuuaaaaugauuugauugggugucaguugacaggugguggggcuaguuaaucuucauugccaacgucacuggauuuggcaggaccuuggagauguaccuggucgcaugucuguggggguggaagaggagauguuggugcaguguggccuuuccucuccagacauaacauauuuuucucacuaccauauagcccugccugcuggccuuuuaggagacuuggacaggaaccgaguugagacugagguaccguuuauugaaauuggucauuuuugagugugccacagccauugaaaccgguuccaagggaucuaaugcugccuucgcgccucuuuggccacuugcacuugaauggugcacauauagacauacacauauagacacacacacauagacacacacacauagacacacacacauagacacacacacauagacacacacacauagacacacacacauagacacacacauauagacacacacauauaggcacacacauauagacacacacauauaggcacacacauauaggcacacacauauagacacacacauauaggcacacacauauagacacacauauagacacacauauauagacacacauauagacacacacauauaggcacacacauauagacacacacauauaggcacacacauauagacacacacacauauaggcacacacauauaggcacacacauauaggcacacacauauaggcacacacauauaggcacacacauauagacacacauauagacacacauauauagacacacauauagacacacacauauaggcacacacauauagacacacacauauaggcacacacauauaggcacacacauauagacacacacauauaggcacacacauauagacacacacauauaggcacacacauauaggcacacacauauaggcacacacauauagacacacacauauaggcacacacauauaggcacacacauauagacacacacauauagacacaaaagcacaugcacagcgauaaaaauaaaauauuuauaaaauuacaaaaacaugagugccuagaaguugaggguaugagccaaugauagagcacuuucuagcauguuugguacagguuggauucccagccuggguuugaggacaguaaaacaccaggguaugccagggaugucagcauauuuacauauaucuguaaucauagcuacuuggaacucuaagaggaucaugaguucaaacccaccucaguuacauagugagucuacccaaacuacauaacaagauccuaucucaaaaagaaagggaaaagaaaagaaaagaaaagaaaaaaggaaaaccagaaaagcuaggcagagugguauaugcauuuaaucccaguacuuaggaagcagaggcaguggauuucuaggaguucaaggacagccuggucuacauagugaguuccagguuauccacagacaaugagacaacaucucaaaauuagucaauuaaaaggaaaaaguggggaugaguuagggauauagcauuuauuuauuuauuuauuuauuuauuuauuuauuuauuuauuuauuuauuuauuuauuuauuaacaggguuucucuguauagcccuggcuguccuggaacucacuuucuagaccaggcuagccuuugagcucagaaauccaccuggcucugccucccaaguacuggaauuaaaggccuucgccaccacugccuggcggauauagcaacuauaaaaguggguuucuauuuuuguagaaugugggagacccuuaacucaauuagcuuuauuaaugucagaucuacacaaagguauuccagauaugaaauuugccaacuuauuuauuuaaaaaaaccaaguaaaaaagccaaaauaagaauaaagaauguuauuuuagugggcuggaauguagcucagugguagauuacuucucuagaauacagacagucuuagguucagaccucaguaccaaagcugaggaagauuuguguguuuccagcagacucagcuacacaaagugagaguuuuguaggaagggguuaauaaugcucaccucgaauucuuccaagccacuuucaaggccaagugaacuguguacaaaagacuuuugucaaugccugcacgguacucgaggauguaguuaauucuaacucugcacuauuuaggugacuuaugcccuggagggggcacgggugugaugagacuuggcaguuuccgaaggaugggcaauggcaagcagaggucaacugaggaaacucuacugacagcaaaagagaaucuauuucaaggaacuauugugaacagaagaaugggucucaccagaaaucaggaugucugggaucugcauagaaagggcuugcuuucuuagugaauggaggagagacuaaaagcuacucuuaaaguaugacauguauacagacauuguggugcauccaauuucccagaauuuaggaaauggaagccggaggaggaucugaaguucaaaguuauccuagacuauauaacaagacugagaccagucugugccaugugaggcccuaucucaaaaaaaaagauaauuuguaugaggaaguuugaauuaaucacugagagagggcagaaaagaugguucaacagcucagagcacuggcugcucuuccagaggacccaugcucaguucucagcacccacauggcagcuuacagcugucuguagcuccagcucuagaggauccaacaccuucacacagacacacacgcaggcaaaacaccaauacauauaaaauacaaauauaaaucauugaaaaauaguuccaagaagauauguauuaacuaugguuuuaggcaacaaaauaucauagaccaagguguauaaauaacagaaauguauuuccuuaagauucuagaacauggcacuaggcuuguggaauaccaccguaguccuaaaacucugucucaaaaauacuagaagaguucuggaaucuugagauuccacaccaaaauguccacagggucuaucuaucuaucuaucuaucuaucuaucuaucuaucuaucuaucuaucuaucaaucauucauucauuccuacuugucuccuuucuuucaacuugcagacauaguauuauagagcccagacuagccucaaguuugaauagcuggauugaccuugaacucuugauccugcucuucccgcuucuccuacagagugcuagaauuauaugcauggcuaccagucccagcuuauucaguacucagaagagagcccaaggcuucgugaauggugggguaaccucucggccaaguaggcugcaccacuaucccugauuucuucuaagcccgucuccugagcucagaagugacuuucuccugucauuuuguauucucuacuguguacauaugugaggcuauauccaaugcuccuauucuauuuaaauuguacuucauuauuaucgaugugugugcugucccccuagguuaaugugucugagcauuuguuuuccaggugguggugcuguuuggagagguuguggagaggggcagccuugcuggaaaaagggcaaguuuuaagaguuuaacacuuugugauauuuccaguuccugucuguuuaugcaugugguccacagccuucuuacucuugccaccagccuagaaguguaagccaaauaaucucucuccauaaguuucuuuuggucaugguauuuuuuauuauagcaacagaaaacuagccaaaguguguguguguucucacgugcaugaggaaggaggucagagggcauuuugcaggagucaguucucucccaucauguguguccuggggaugaaacucagguccuuaggcuuggugaccagugccuuuacuugccgagcccuaagagacaguugauuaggaaaggggaagcaucggacauccaugggagaagaggcccuuggccuugggaaggcucaaugccccaguguaggagaaugccaggguggggaggugggaguggguggguggguggggcacccucauagaagcagggggagcgaggaugggauagagggucucuuggggggaggacugggagaggguauaacauuugaaauguaaauuaaaaaaauccaauaaaaaaaggaagggaaagcauuacucagaauagcuguacuagagaaaaggaugugcucaaagggcaucaacuguaagauucccucucccucaucccucucauucucuugcuuaaacuccucuuugagaaaaagccucuuccuacuucugugucucuugggugaguagcccacugaguuucauuaggguugcuuacaugaguauaagugagagauuauauauucuaaggcaacaaaaucuguagauacaucaccgaagaaagagacaaaccuccccuagcaacuguuaucugacaucagucucuuagggagaggugaagccucaugaaccaacauccccucuuccuaugaugagaugucugacaugcuaggucuuguucaggugaccacagcuguagugauuucauagcgcaacagcugugucaucuccuaagacaggcuuguguggcacacuucccuaucuuccagcucuuacagguuuuuguguccuuucuuucauaauguucccugagccucggagggacugauccagaugccccauuuaggucaagcaucccaccauuauucaauguuggcauuuugagcaguuauaggucucucucuguauuaaccgccagcagcugcaacagugucucugacaaaggcggagagcagcauuaaucuauggauuuaaaugugaguuuuagaagggggguuguggcuggcaagauugaucaguagguaaaggcauuuacuuccacugccaaggcugaugacuugaguucagcuccugggacucucaugauagaaggagagagcugucucccacaaguuguacacacacacacacacacacacacacacauacacacacacacacacacacacacacacacacacacacacacaguauaauaaaaauauuauagaagucaguagaacuauggggguaaaaucaguugcagaaguagcauuuuggcugaaggugacuggaaagagacaguaaagguuucagauaaccggaaucacacuucucucagaaggcugagccacagggccccuguaaaccaggcaauguuaugauuuggggaugaugaaaaaggagagaauaaggagaaagggaaaaugggaaaauguucuaguuagcuuucugauagugugaagaagcacugaccaaauaccauuuagaggaguaaaaucugacuggauauaaugauaaccaaauaucuuuucaauaucacuucugugugugugugugugugugugugugugugugugucugugugggagggugugugcaugugaguacaggugcucucaguggacagaggcauuggauccccuugcagcuguaguuacagguaguugcaagcugcccaguguuggggcugagacacaaacuccaguucucugcaaaggugugagcucuuaccugcugagcuaucuuuccagcccaaauaacaucuuaacuaagagugcuuaacuacauacauuucuuauuuugaaacuuuguuaaauaaaaguuuaaauugauaaaaacuuuuaaaaaccuguuuuuaaauaggaaaauauaugugucccaugcauguaaauaaacacaucugugugcagaugugugucuguguacguguggaggccagacaagugccacccuugccaccccacugcuuuuacugccccuacacuggauggaggucuuggugagcugugccuccuuccaagcuuccugcauugccuuggucaccucgguagagucauaauaauaagaucuaauaugauaaaguaggugucuuggggcuuaauacacaugugcugucagcccaaacugucuuacaucugcccagcguccccaccugcugcagggacugcaacuuccugucuuuuuaccucuuacauuuaucagacaagguugcucuugggucuaccccucuaccuuccauuauauaaaacagucccaccaucccuaacccucagucuugggcucugaagaggcaggccuaacucauguagggaucccaccugaugagaaggaagaccccacuuauuugaugagaccugucacuccuccugcaggagggauccccaacaccagcguguguugaucgccucauccucuuuccuucccccauucuuuccaaccacaguagucgugcaccugggagccugaccuggcagccaucuuuagcgccuguggugaugauguagacauggcaccuuuccucgggcugcuauuugaggucuccuccaggcugcagcaggaggucuuucccauuccucugcagcagaggugcacuaugggugcuaaugcucucucuccuucagcccacuucuuccagagucucuugccucguuccaguuccaaucuguuuauccuuuuggcuuagaaacaacucccaggcccauauuugggaaucuuuuaaaaaucucauuuauuuuuaccuaucaucuaucugucugccugccugccuaucuaucuaucuaucuaucuaucuaucuaucuaucuaucuaucuaucuaucuaucgucuaccuaguguuugcauguuugugcagaggauggcuuucuggagucaggucuuuuccuuccaccaugugguccuagggucugaacucaggcuucagggcaaugccuuuccuucucaaccgucacucuguucccauaguucagguuuuuaaugaaaaaccaugaaugcuccucaacguggguccuuccuggacuacaucccguacucucagcuauguuagcaggcagaaccugugcaauuaauucaucaucccucccugcugcugaguccaaggguauggauaccagccauccuuccagcaaggccagugucuucuacuccccucuuguuucaaaugacagccacauguuguucuauaucguaccucuugguuugggaaaccuaccaccccauggucauauugccucuacuguguguaguaaguuuuggggccaacugaaacuugcaaucaugcuuuccauagagauccauccuucagcccucaucugggaucccuaacaagcagcugaacaacagcucuuugugagggucccagcagcuucagcuacagcucuuggcauacccagccucccaguggcagcaccaggcagucagaacguaugggcaggaaaucacucugguuugacuuuggcacaccugucaccacccagccucaucugggaggagcccaggugcuuaggacguugcuacagucccagguucucacuuuagaaucgcugugagaaugucuggcccuggcaguguggcucaucauuuccccugugucacucccagcacacugguguuuaugagauccacagcuccccuaacacagggaacugggcuugccagacccacucaaagccucaaucugagagcaugcaacuucauagauggacugaaggggauggggacagugaugucauugcuguugucccgacacaucaacuguacaagggcuggagagugguugagcacugacugcucuuccagagguccugaauucaauucccaccaaccauaugguggcucacaaccaucuguaaugggauucgaugcugucuucuggugugucugaagacagcuacaguguacucauauaaauaaaauaaaauaaaauaaaauaaaauaaaauaaaauaaaauaaaugcuauacaaggagugaggacaguagacgacugccccccuccccaccauugacugcucacuaggcugacuagguccuggucaguguucuccaucccuggacccggcaggcugcccccacuuuauguagacacucucuuccccucacuauugccuuaacccuccccuuucaaacacauauguguguaaacuuuauguagacacucucuuccccucacuauugccuuaacccuccccuuucaaacacauaugugcguaaaaaccugguuauuucuaaucugucucuguucauguuucuucuuuacuuuuuuggcucaguugaggaagaaguaaucuuaucuuaauggcuaucugcuaagccagacuugucucugacuuggacaauauaguguauuuucuaguagacaguaugcuggucuacaauuuucagucuuggaucuaaguuccuggaccugaaacuuuuaauggcucuauuaaaauauaauuggcauauaaugaaccgccuaauacuucaaacacacaauuugauaaaaauugcuauaagcagauucuaaagcucucuuauuugaaaaugugcauacagauuggucacucacaacucuuuccgcgugcucacugauguagucucuuucucccuucccaugcucucucuauagcccaggagaguacugauuuugccauuacugugugauaucauuucuagaaauguaaaugaaucaacacaauuuuuccaaggccuuuucuuguguguggcucuuuucaccagaaagaaucauugugacccuggcccagguuuguggguggcacugauuuauuuugcuaaguaguauucugaguacaacauaaucuauucauucacauggcgaagggacuuguuauuauuuucaguuuuaaaaguaaaacugguuuaaaaauaauaacaauguaguaaaaggggaagcauacaaaugcaggagcaaaaaugacaacaaaaucccacaaaccaagcaacuaaccagaaacaaucacuaagacacuguauuagagcaucuucuggaaucugaaggguacacacacacacacacacacacacacacacuccucacucaucccucacauaagcacacauuuacaccuccacaaucacaaccccauacauuuacucaccccccuacacacacacacacacaaaacucacccccauacucaaacacaccucacacauacacauacacauacauucacaccuuucuuacucauacacaccauagauacacacacauauacauacauuuaccccucccccacagucauacacacuucacacauacauacucaccccacauacauucacacacagcccacacauacacacacacucauaccuccccccccaauaugugcacauucccacacacaugugcacacccccuacauguguacacacacauacauuuuccacguguacaugcauacucauauaccccacacauauauauagacauacauucacaccuuugucacucauacacacaccacauauacacacauucauaccacacacauucacacacacucaaaucccacacaguaacaugcagcccacauauacauacacccauacucccuaacucacacccccuacauguguacacacacacacuccccauguguacaugcaugcucacacaccccacaaagugcgugauaagacaguggaauagugaaaggaaacaugaggucacugagcgauaaucaguaagcagcccagagcugggcugugcagcuccuggccuggggaggggaaguggaaaccucauccagaagguaaaccagauggcccuggugagagucuggcaguccuauccacaggacaagccucaaaugucuuugggguuccugugacacagagaccuaccuuuuggcagaggucagcagaggagaggaugcucauuugccacuucugucccggagcccuccgugugggugccaguuugagagggaaccuauagacuaucccaagggccugauaacaagg

SEQ ID NO: 1995 - RNA, 2539 nt, Mus musculus
acguggaaagcaagauguaaaauuuauuuugugagcauaugccuggauacuuggauguaugcagaacuguacccucugugacagccccagggcgguuguuaggugggaaguaucauaggcuccucaguuuauucaauucauugaguuacuuacugugcacucagugcaguacauaguacauugcagguugaaaguacaaugagaaaaacagaacccaaaaguuauucuagugggacaaucagugaugcuagcauguaggaaacagacaacacaguguuuacuggucacacguggagacacaaaucuaaugagauuagaaugugguucuucagccgugagucccaguucugaugcucaguagccacacacgcuaauagccuccuagacuggagagugcagaaaaacauucuuguagaaaaguuguauucacaacauguucuagagaagccaguuacuacuuaguuaccauaaauguguacuuuuauuacugauuuugacacuuaauccaauaagaccuuguaauuuuauuuaaugugccucuaacuuuucaaguccagagaacuaugucuuauaauuuaccauaguacuagcucauugaaaauauucagugaauguaauuuuccauugaucauagaaaaaaaaucagacagguucuccugguuagucuagaauuuuauauuccauugggccuggguaaaggaaugccauuaccuuaaguagugauaucagguauuccuuguuagggccuuauucuucagugccuuguggcaugaagugagauagguagagggucugaggcuuggccacaacuaugguuucaggaaaggaaaacccagggcccuggaagccagcagccuccucagacagcaggagcucauggucuugccuugguuguguccacacagaagaugcccuuauacuuacacaguuuuagaagacauguccuccaaugacacuuccuagccuuggaggaaaaaaaauuauacuugccaggaagccauugcaugacuuugccagaccccugauuuucuugaaaacaguucaguacugaugucguggaguggaaccagagcacagcgggaaaagcagaaggaaggcagguguucccgugagugccguaaggaaggcugucuguugagcccuauguauguggggcaucuuacacugaaccaaagaacacuuucaugcugcaaagaggacuagguauuucccaucagauaugaaacauucauggagucccaagagaaaaaaugcacugaauaaaacaaugggaaugccauguuccauuucacaguguucuucaugcagaaaacccaagaagcaugugcaggagccuggacaggaacugcguacuaugguaggugagggcacuggaucugcugugcaaggcucccacagcagagcuuugugagaacccagguaaugccacccagaauuuucuuaaguagauuuuugcuguucuuuguuauguuuuagucaaucgcuuuaauucugguguacucaaauccaaauuuccaaucagaauuuaucuucauuauauugaaugaaccaugguaaagugugccuguaacacacaguuugaugcagggaauucuauagacagaaguuucuuuuaagagaaauaacuaacuugaaaaugaagucuaaaaacauuacauaacaagcaguuacauagacucaugaaucgaaggguauuuaucucagauguaagcauugguaccacuuucugugaacuaauuuauuuuccccccagaaaauccaucuccagggcuauuacaggagacaggaggacaagaggauggaacuacuguagugucauugucacuuugaaaaucuuugcagccaaauugaguugugugacuguaaugauggaucuuuaaaauuuuuuugccaaauuaauaauuuggaaacauacuagaaaauguaugucaaaaccgcauuguucucaaagugcacacuucaggaguuacuucuguauuugaaugcuguacauaguaacuguuggacaccuacugauucuuauuaauuauacaaccaacugacaaaaacuggugucaacucaggcacuuggugugacugcacaccccuccuggaugucuuuuaaauucauggcuucuuuuucccaugaauugcaacaucauacacauauccauguauucugcuaagcacauaaauacaaccugcucagucugagugauguuauuuguaaguuucagggaccauuugguauuggauuaccaguaguaugcucuucccuggggaagaauauauuucucucacucucagcauuccuugccuguaguucuuuguaaaggauugagcccuugugggcuuuccccaaccacaauagcaugcaucucuauugcugguguccuuguucagcucuuguuuagguagccauguuggucagacuauggguauagccucugauauuacuaggaaacaugguaucaacagcaaacucucugauccucuggcucuuuagaauuuuugcauccucuuugcaaugauucuggagccuuaagugugggaguuguuu

SEQ ID NO: 1996 - RNA, 2539 nt, Mus musculus
aaacaacucccacacuuaaggcuccagaaucauugcaaagaggaugcaaaaauucuaaagagccagaggaucagagaguuugcuguugauaccauguuuccuaguaauaucagaggcuauacccauagucugaccaacauggcuaccuaaacaagagcugaacaaggacaccagcaauagagaugcaugcuauugugguuggggaaagcccacaagggcucaauccuuuacaaagaacuacaggcaaggaaugcugagagugagagaaauauauucuuccccagggaagagcauacuacugguaauccaauaccaaauggucccugaaacuuacaaauaacaucacucagacugagcagguuguauuuaugugcuuagcagaauacauggauauguguaugauguugcaauucaugggaaaaagaagccaugaauuuaaaagacauccaggaggggugugcagucacaccaagugccugaguugacaccaguuuuugucaguugguuguauaauuaauaagaaucaguagguguccaacaguuacuauguacagcauucaaauacagaaguaacuccugaagugugcacuuugagaacaaugcgguuuugacauacauuuucuaguauguuuccaaauuauuaauuuggcaaaaaaauuuuaaagauccaucauuacagucacacaacucaauuuggcugcaaagauuuucaaagugacaaugacacuacaguaguuccauccucuuguccuccugucuccuguaauagcccuggagauggauuuucuggggggaaaauaaauuaguucacagaaagugguaccaaugcuuacaucugagauaaauacccuucgauucaugagucuauguaacugcuuguuauguaauguuuuuagacuucauuuucaaguuaguuauuucucuuaaaagaaacuucugucuauagaauucccugcaucaaacuguguguuacaggcacacuuuaccaugguucauucaauauaaugaagauaaauucugauuggaaauuuggauuugaguacaccagaauuaaagcgauugacuaaaacauaacaaagaacagcaaaaaucuacuuaagaaaauucuggguggcauuaccuggguucucacaaagcucugcugugggagccuugcacagcagauccagugcccucaccuaccauaguacgcaguuccuguccaggcuccugcacaugcuucuuggguuuucugcaugaagaacacugugaaauggaacauggcauucccauuguuuuauucagugcauuuuuucucuugggacuccaugaauguuucauaucugaugggaaauaccuaguccucuuugcagcaugaaaguguucuuugguucaguguaagaugccccacauacauagggcucaacagacagccuuccuuacggcacucacgggaacaccugccuuccuucugcuuuucccgcugugcucugguuccacuccacgacaucaguacugaacuguuuucaagaaaaucaggggucuggcaaagucaugcaauggcuuccuggcaaguauaauuuuuuuuccuccaaggcuaggaagugucauuggaggacaugucuucuaaaacuguguaaguauaagggcaucuucuguguggacacaaccaaggcaagaccaugagcuccugcugucugaggaggcugcuggcuuccagggcccuggguuuuccuuuccugaaaccauaguuguggccaagccucagacccucuaccuaucucacuucaugccacaaggcacugaagaauaaggcccuaacaaggaauaccugauaucacuacuuaagguaauggcauuccuuuacccaggcccaauggaauauaaaauucuagacuaaccaggagaaccugucugauuuuuuuucuaugaucaauggaaaauuacauucacugaauauuuucaaugagcuaguacuaugguaaauuauaagacauaguucucuggacuugaaaaguuagaggcacauuaaauaaaauuacaaggucuuauuggauuaagugucaaaaucaguaauaaaaguacacauuuaugguaacuaaguaguaacuggcuucucuagaacauguugugaauacaacuuuucuacaagaauguuuuucugcacucuccagucuaggaggcuauuagcguguguggcuacugagcaucagaacugggacucacggcugaagaaccacauucuaaucucauuagauuugugucuccacgugugaccaguaaacacuguguugucuguuuccuacaugcuagcaucacugauugucccacuagaauaacuuuuggguucuguuuuucucauuguacuuucaaccugcaauguacuauguacugcacugagugcacaguaaguaacucaaugaauugaauaaacugaggagccuaugauacuucccaccuaacaaccgcccuggggcugucacagaggguacaguucugcauacauccaaguauccaggcauaugcucacaaaauaaauuuuacaucuugcuuuccacgu

SEQ ID NO: 1997 - RNA, 2462 nt, Mus musculus
ggaaacagucuccgcgcgagaaagagccugaacguguucaaggaaauggugcagggagucuaaggccagaauccauuuagccccagccgcaugcagcgcacgacccuccucacuauuguggacaugccagccucgcaacagauaagcuacaaugccauggcuguucucucucggucaaugguccacaaaucucuggucggagcguuuggaaggugcucugccucuuauuuccgguggcggcgaggcgcaguugcuaugguaaucuaaaaaaggcggaggucuguccgguugcgccgagagguucgcggaucuacuaacgaaaauuggcugcucuucuugguuugugagcugaaauuagguagccaccaagccucucucuugcucugucgcucgcucugcucuucauugugcggccgccucucccaucugcuacguuuacuucuguguccuccuaagagccggugcaugccccgaaacacacaaggggaugcagcaucguggccagaggaguacaaaaaacggagagagcuugucugggauuaguugugacuguuucacggugcagcgacggugacuggauggcucucuguuuucauuuggcccuuuagacgccuuaggcgcuuuuaacaguuuauuuuuccugcuuauugugugccuaguuauuuauggagccguuugcuacaauauacucuccaggccccugucucagacuugggcuagaauuuuaaauaaaaggugguuuccgagcccuaggggugcaauuauauauuuauuuaagcuucaguuuggacugucuucacaggaagggaaagaauagaauucuggaacauuucuguccagggauuuucaugugagaauaaccccauuuggaaggagcacuugaagauccuuaaaaauguuuuuaaauugcuugcuguaagccgagugcuugcucuuccuuauuggaauaguuuucuuucccguuugugagauggcgcgcacgcauauguguuuaaaaccgauguuuaauuauggugauaccaauuugcaguaaccagacugugacaccacaucccuaugggguccuucuaaaucugguguaauaugaaagugucaggcaggcggucuguguauuauaaauaggguacuucauccaugauaagcgauuauuaucuuucuuucccaaguguaaaagaccuacauaauucaagaaggugccagugauuuaggccuccugaguaugaauccaaugaguccugaaggggacccuaccugugucaucuuauuguucaacuugaacuauucaauuuauuagauuggaauguauuuuuagaagucaacgcaggauaaagcaauguuggaagccauuagaccaccagaacaauuuugcccugcauaguagccuuuguucaauaaaccuucauucacauuaaaagaagaaaugacugagauuucacaaauuaccacugacugggugacaucucugucccucaauuucaucaucuguaaaauggacaaaaagugccuggucaguguagaaaggauuaaauaagacguuugauuguauauuaaugucuuaugagcagacaugcuguauagacacuaaauauuauuacuaguaaaggaacuuuauaaagcucaauguaaucgguggaacuucaaauauccagugauuugacaugagcuguauuauagaaaugugaaugaaaugauaguuaauccugcuauggggggauccaacugcaguugauuugcauuaaaaaaaaaaccucacuguuggggaauuucacuccauguauguuuucuuuagcauuuguguguccugaaguauucuguauguuucacauuugugaacuguuguaaucuuaacaacccugugaagucuccccugaagucuuauuuugagaugaugcauguaugcauuuucuuuguucugauucuuuuggauuaugcuacaucauuguucuuuaggauaucauuguauauuugagaaauuauauacaguguguauaucuauccaucuauaauuagaaaucaguuauuaaggacuuauucuacuuaacauuuaaguucauagagauguuauaauauuuaucuuuuuuauucuauauaugcaaacuuuaauacccuaguacgccaccccaugguggcacauuugcauuuuaggugauuuacaucgacgacuaaaguaaaaaaaaauucauucuuuucuagcagaauggccagcaacccuggaagugaugcagcuuuggguacucagaacccacugcuuucugggaguccucgaacaaagaaauucccacuaacugaacaggagguguuuuauaugaacuguagagccgccuacuuaacuaucuucaaaagcagcuuggaaaacauuauuucuaaagaucaacuuuaccuagguaaauuuuuugaaguugaacauuuucucuuauuuauuaaaguuaauagaaugaaaaguuugaauuaaaauuacauca

SEQ ID NO: 1998 - RNA, 969 nt, Mus musculus
gguggggucuccaguaccuccucacgccagcacauucuugcccaagacaucuaccugguaaggacucugaauguggaacaacuugaugucuacacuacaaaaugcaaauaaagaaaaacaggaaauagaaacucaucuuauagaaaacuauagacucuaccacuagcuguguuaggacuuuuacacaguugacaucugccuuuauagcucuaugcaaauucuaagcaaagaccaacaauuuugaaauagcaaugguuuauuuuuuggguuuuuuuuuguuuuguuuuuguuuuuguuuuuuuugagacaggguaucuccauuauguagcucugucuguccugggauucacucuguagacugcgguggacuggaacucagagagauccaccuacuugccucugccuucgcgugcugggauuaaaggaguugcuccaccauggcuggcugguuuugguuuugauuuuauuuuuguuuugcuauaguaugcaaacuguggucagaugagcagcagaaaugcuggacuuuuccuuuuucagguguuccuuacccccuauuuacugaggccugagggucaccaacgaagacaguacuaacucuuuguaaaucauuguaacauauggagcccagauguccauuuccucaaaugugacuauugcaguuaacugagucuucuaccaccagucucuggagcuaaagcaaaaccaacccugccccucaaacuucuuacugucaguuuucaauagacuaggaaagacguggguuacaaaacacuuaagaguugggcuguaaacuggauaguggugguguaugccuuuaaucucaauacucagggggcagagguggggcagauccaguucuauacagagaaauccugccaccaaaaaaaaaaaaaaaaaaaaaaagaguugggcuguaacuuuugucuguuccacgauauuuacccaacagcaauuaaguauaaaaggaaa

SEQ ID NO: 1999 - RNA, 114766 nt, Mus musculus
cagaguuggaggggcggggcgccggugcguuuuuagagcgcaggccgccgcagccgcggaguagccggcagccgcugacgcgccgcgggguccgcgcccagccucgcucguccuuucggugccucuccuuagccgcggguguccacgccggacccugcacggcaggcugaguugccugccagacuccugacccagaucgacccugcgccaaggagccgcgcggcccggcgcacacggaaguggugagugucccgguggggagguggagaccgccguggccagcucggggaccgugagaggggcgcggagccgggcggccgagcggccagggcggccggggcggggauuuccaggcggcggggcugccgggaggcgagggagggccgcuccgcuaacagcggcccgcuccgccgacauccuguuuauggccccgcggccugcgcgccgacggccucuggcgccgcaacagcccggaccgcaggacucgccgagggucguggcccgcguucaccccuggucagcucuugcgggggugggggacuuuugggguuugggucugcgugggggcgcgccccgggaacuccgaaccgcagcuugccggaauguagcaugauggagggccaugggugaagggaauggggagagacgacuauagguccuacccgaagggacccgauucaucgaaacugggaccagugucuguggcuccccaacuccuggcuccgguuccgcgcgaacgaacgcccccgucgacucagaagcaguaggcaccccucuggagacacucccaggcuccuaggaugaugaguguuuaugaagggaguucuuuagggagacuagaccagaggugugguuaucuccuggugccugugugcccccuucggagguguauccucugugauuucucgggaacuaggacugggcccuaauagucuuaauucauggcugugaccugucuucugccucugcuuggauacaucaguauccaugcuauuaaaauuccuccccagucauagagcucagucgcagguauuuacgguaguauaaaauuaccuuuacuucuuucagggaagaaggcauuaaaaacuugggccguuaaauaaguagaaugcugagacagauaaaauuaucuagucuuuggguguugccuuccccguuuaaaaagaaaauguuugaguuacgggugguguaaaaaacuuuuuucuuuuucuuuuuaaaugaacauuuugcauugauuaaauuuuuauaccuucccuuucuaaaaaccacauuuuguguugccuauugcuuuugcuuguggggacucugauguuuuccaaguacuggaauuuggggcuauguggagcaacuaugaucuuguucaaaaugucagucaguaguacccaaguugagagaucaugugugguuaccagguaaaaaauuagacuuggggcccugugugcaaagucauuucaucccuggcuucaguuuuccaacaucuaggggauacuuuuuuauugagugaucgguuuguucucuugugcaucauggugaagguuaauggagacugcaggccagcauuuagacaguucugguauaacaugcuuuauaaaauggaauaaaugccucuucuguauggauugagaucauguagaaagaaacagauacaucauccuagagggagugugaacauuacaaauaguaaucauaacuuaauucuaguaucauauuaacuugaacuguauuucaguuugucuacacugcuguacuuuuuaggggagggaguugcuuagauuuuuuuuguuauccuuuacagugaauacagcuaguucuguuucagucccauuucacagcacacaauuuacuggcuuugggaaaagauguuagaaagagaauaaauuagguauugguacaauagcaaauacauuuccuaacauauucuauuuuguuguaauuuaggcagguguuaguaucagucugucuuacccagaagaucauuaucuuucuggccacuugguagccacccuuuacagauuuaaggugcuaggaggaguuaggcuguaaaaauacuuuaauucggacaccugcuauaaaaagcuagugaaaaauauggaguuuugaggauaggguugcuuuuacgggaaugugcuugccuuaaauuacacaagggaacuuaaccucagggcuuuuaaaaaggacugugaggucugccaguuuggagagguuugacuuuaugaacgguagugauucgaaagaagacugacugauuucaacagcacauuaccagcuacagauuuuaauguugucugaagacaucauucuguuuauucugaauaauuuaaguaacacauauauuuguagagaaauacaaaugaagcaacuacguagaauauauguagauuuaaacucauuuuuauacagagaacacuauaaauaauuguacuaaucgaaaacaauuuacagcugagcaaaggucagacaggaucuguguuuucuagcugccagacuuucugugcuuucuuuuuucccacugaggacacauauucucuauauccuuaguauaauuuagugagaugauacacugcuagauuuacugucugagauguauacacacacacacacacacacacacacacacacacacacacacacacacacacacauauuuuuuucaagacaggguuucucuguguagcccuggcaguccuggcugaccaggcuggccuugaacucacaaaucugccugccucugccucccaagugcugggauuaaaggcgugugccaccauugccugucgagaugugcguauuuuuacaaagcauuuuuaaaaaaauaauuuuuacgaggcuggagagaugguucagugguuaauagcacuggcaacucuuuagaggacccagauuccguuuccaacaccccacaugguggucacaccugucugucacuccaguuccugggggaucugacacccucacgcagacauacaagcaggcaaaaacaccagugcacacaaaauaaaaaauaaaucauuaaaaaagaaaucacauaggacauuucaggaggacagggaaugggcuauuuaagcagaaucuagcugaacaagcaaccucugauguucucuaaugcacuguggcuuaauggacauggagccuugccauagagcagaggccgugaagaagucuugaugaaucuuucagacuggugguuaacagcuugguaaaauuucaugcugagggagacauugauauuuucugaggaguuugggaggguacaccuuguuggggaaggugguaucuaguggguagaggcuagauguauuguuaaacacucaguaaugcacaggacagcccuuccuauagcgaaguaugaccugggucaaaaugccacuagugcucaaaaggagagaugaugcuuaggggugccaggugagaaaagagauaccggggugcauguuguggcaagugauuucauucuuggccucggcuuuccuguucuagaaggaaaugaagacaccuagguuagauauuuauaaugcagucuugguggagaagccaggcaaggaaugcaagcaugaugugugaaaacccaaggacauacaaacgagagcugcugugaagaaacuucgugaaugaacuguuagacacagugcaagccagggaagaggcuaagcucaucugcugcaugucaagcagcagggaagagcuaauguugaggauucucuguguguguguguguguguguguguguguguguguguguguuuaugugaggggggacaacagcggggaggaggggauugauuuaguaugccuaguucucuggguagauuuuuuaguucccccucuuuuaaucacaaagauuauuuucacacgacaaggaagaaacucacuguagaaaaauuggaaaauguaaggaaguaguuaaguacaggaggagaaaaaauccucugugcucuguauugccuuucccauguuuccuuugagugugguggauauuggaagaaggcuuaccauagaagggagcuguuggugcuggagugggugaggguagugcugcuucauucuuugugcccuuuauucccccuuuucaagaauucggaccaugcuagauguaugugguacgcaucuguccuccaaguucuugggaggcugggguaggaggagcgcuuggauucuggaguuuggcaucagccucugggagagauagugagagauuuuuuuccuguguaaugcaagguacaaggacauugacucauuggugcuaauguauuugugccaagcuuugucuucagcccuucgauugccacuuccucugcuuuacucuucuuguccucagagagauaugccacucuagcuuccggucucaaaaccuuccugguaacacgguuagaaagagcugccgugcugaaaugccgguguuucagaggaaggagaagaacuccugugaaugcucuucuugccuuugagggacaugcacucuuuugccauuugaggcaauuggaaaggaucaaaccuuaaguucccuuuuguguugucuccacuuugucuucugaugugugggucuucacagcuggucccagcacaucauuccucagugcucugaguagaucccuuccucccaaggcaagaugcacauuaguaacaaaagaaggaaaccuucauuguuguuuugagacugggucuuccucuagcccgggguggucuggaacucaccuuguggccucaaacuugcgaucuuccugcuuuaaaccucccaaaugcugggguuagagauaggaacuaacagaaaauucauuuaaggguacucuggucagaagacagcugacacuuguugagauauuuuaaaucuagauaacugguuuacuuaacaaguguauucacaugauguuuuguuuauccaguuauuaaucaguaaguauugauugucugcuuacuaguaauagucauagagugaauaaguggagugaaguacauaggacucccuccccuuauugaguaugcagacugguagaaaaacuugaguguguucccaggucugguggugugguuauccaugcagaaugaguaagucccaucguguuguugcagaguguuccuacaaacuuucagaagacuccuuuguaaucuuaagauuacaguauagcuauaguuuuuaaaaauauauuacauaucaauucauacuuuuuaauauauacggacaucucucggugccugcuuagugcuuggcagaugacuaaaucacagcucauaugaaaauaagcuugguauacauagucuuuacagugcaaacgugaaaagugagccuacuggggccucucagagcuagaccugcucagagccuuuuucaaaugcuuuuuaaaaagagaugggguagacuugguagguggcugaguggguuaagugcuugcaguucaagcaugaggaccuggguuugaucuccagcacucaaaagacaggaugcaaugguacacgcuugcaaucccagugcuggggaggggaugcuggagcuugcugaccagccaagcuagccaaauaggugagcuccaggucugaguaagaaguacugucugucugucugucugugucuuuuuuuuuuuuuuucuucuugagacagggucuuauguagcccugacugaccuugaacucacagagaucuguuugucuccugggaugaagugcugggauuaaagguaauaugcuacuacuccuggcucuuagaacuguuuuugguuuguuuuugagauacugcccuaaaauaaaagguggguggcuccuaaggaacaccugagauugaccuaugauacacauguauguauauacacauacccccucauauaugacagucuguguacuucccacacagaaagaugggcgugggcuuuugcuccugagcucaaggaauacucuuguccuagccucccaaauagauguuauucagggcacacaucacucuccaauguuuuugaagaggcuucguuugaguagguccuugacgaguguuaguucccuuguucugagguaguaugggaugcuaagaggacauacagugugagcaaaggcaugaagcggaggugggcagguacagaagauggugagacacugguuugcauauccugaucagagccuagccuucucaggagagagccagaggugaggagagcuuguaagcagagacucuugcaucugaacaggaagaggucagggacuguggccucuggccagugguggaguagggaagaugagagcauuugagguuuuggggugaaaagagcagauggaagaacugugaggcacugugaauucuguacaggaucgacuucuaccuugguccacaccacccuuuccuucacccagcaccaaaaaugcuuuauuucaccaucauugaucaguucuugacucuaccaggaaacaggaaaugucuacagucaaacuagguggcaagaaguccauauaagcuuucccuaaaguacaguaaaacccauuugaaauuguguuuaaaguuaucaaguucucugaugaucuaacugauuuuuaagucaaucagugauuaaauacaaugauuaaaauccugaaagacagacauaguuagggaauauguacaaggagucacacccuggaggcccagggcugaguuuugucuuggugauugaggaguagcaggauaaggcacugugagaccaggaccagagcaaacagucagggacucuugaggggaccuagggugaacagugccacaauuugcaguugucacugugacccuacaguguggcagccggugcuuaccaguaaaggaagguauccagaagggcuugugucguggaacaugagugagaugaaggcgagaguguucagggcugcggcugcuugcuuaggggcuggcugcuguguaaguagggauaccagaacuucuccaggacagacucagagaaggguuuccuuagaaugaaaauuuagcaagggacccuuucuuuacugagagaauggguuaagaacaacuguuguaggagacccuugugccuagaacccaagcugaaggagacugacaggugguuuauuaaacuccaauagaaaagagaucuuuugauugcauuuuagcuuugcuuuucuuccuuuguuucuguaaagauuuauuuuuauugauguggaugugcauagcugugugaauguuuggcacugaacagguacccaaaaggacuagaagaggaauuccuggaacuggaguuacagggaguuugaacuaccugcugugggugcugggaacugaacucuggucuucuggaagugcucuuaacuggugagccaucucuccaacccaacaagugauggcuguugcuuauccacagagugggauagagacaauaucaacuucuaugacgauuugaggauugagagacuacuaaacauuuugaaauggugucaggcacauuucaaagguaauuucugagguaaaaccguucugauuguuuuauuuuuuuaacuuuucaaaaugauuggaguauaugcuuucggucaauuuuuaaaaagcucaaguuauauccauaauguuuaaaagaugguguggcauguccccagaagauaccaaacaaagaauaccuguuauauuguauuuuugaaagauuucuguuaagagaacauaauaauaauuuuaaaaaguuuuggugcuuaaccaaggcaguuuccauugagaugcuagaugaauuguuuuauuuuuuaauggaaaauuagaaaauuguuuuuauguaaccucuguaggagcuguccaagauauaauugggaggagcauacugggcaucccagaagaccgauauaaaggugcuguuuagcuuuuguuaaguccaugcuuauagccaguggugggcugcuggccaagagacgcaggcagaccuguuuauaaaaugaugucuuuagaguugugucagaauuaaacauuuuauaagggagauaaugcuccagggagcuuugcugccuaaagaaugauaggaauuuaaaggaacuuuaguuuguuguuuuccuuucuacaguuucugcuguguuaucuaucauacuuuccugaagcaagauuuacccaaagcagaaaauuauacagucuuuucuccuaaucauguguaugugcacauauagauauauguauaugucauucuuagugauguucuuguacaagcuuauugaauuuaaguauucauagagaaugauaggcugggcauaguaguguacaccuguaaucauagcacuuggcaaaugggggcaggaaggaggaggucagggucauugucagcuacagaaaguuugagcaggcccaggcugccugagacugucucaaaacagcaagcaagcaagcaagcaagcaaaaacaacccccucucucuuuggggagagaaagaaaaggauaaaagaacgagugguuggaacagcagucuugauaacauuuuuaaagaagauuuauuuauuacuaucuauguuauauguguuucacuucaugaguuuaugugcaccgugugugugcaggagucuacagaggccagaucuuguuauaugcuguugugagucauucuguuggcacugaauuauacccagggccucugaagagcagcccaguguuuuuaguugcugauccaggucuccagcccuacucuuauccaugugcuuugacagcaaaguacuuguagcugaguccuuucuucccauuuaagauugagaaagaaaaccccaaaucuggagggcagugggcaaaagaguggccaccugaaccugcaaaaagacugcguggagagauuuaaggaauaaacuuagauguaacauuuucagguauguuggauaaucagaggcuggucugacugcacagaguagaaauaagaauaauuuguaaugaaugcaacuaucauuuguuuuuaauaauauuguaaagggcuuaaggcuauuagaacugacaguucgccaauuaaccaugauuauaucugugggcuuguuuguuaauauaauuuucucugaccauggagagguuauaauuuauagcaauuuuuuuuaauuaguagaauuuaaaauaaucuuuuguguugguagguuguugguagagaggcacaggcagacuuguuugucaaaugaugucuuuagaguuugugcugguaguaucacacacacacacacacacacacuccacauacagagagcaagugcacaagugagugcaagagccgagccugcuaaauauguaucuuccuguggaaagucuuguuuuuaaagcugauuuuuggcucuacccaggaaggcaggcagaugcaauuugcauuauaaagauaauuuuuuuuuuuuuuggccacacuuagaauuuuuuuuaggacuuuuaggauuaacuuuuugcauaacuuagccuaaagagaguagcauaugcauugccuaaauuuuuauuuugcuugauuugguucagcuggagccacucuaaaauucuugcugaccacugaguuuguguuaccucuuugggaaacccagcugaugucugauguacuucuauaugcacagcuuguuaacugcuuguuuacagagaccuuccacucagggugcguggacauagaagggaggggucauagguucaacaggccugaacauagaugguaaguccucuugauguggcuuuaggaaguaggccacuucugaugcacuagcuggcacuaaagaaaugcucuuagguuuauauauagauagaucaugauaugugaagacaaggucggccugacucuauccuuuagguuucagcaguuaagcaguuacacaaguauuugugauguuuaugcuaagugucagaagagauguauaguugguucuaagacagagaugaagcuagaugaagggagugggaccuggguagugagucuuuuguacauuaagaucugaaugaugaaagaggcgaugcuuaagaguuuaaggaaguuuuuaugugugaagaugguucaguguguaaaggggcuugcugccugagguccugacaugguggaaggagagaacugacuucugcaagguguccacugacuuccacauguauuaucucguguguguguguguguguguguguguaaacacaaaguggaaguugagugaggaagauguuggauguuaacuucuggccaccauccacacugacagacauguacacacacauaaagacuuguggguagaaggaacagcauaugcaaagccucuaggguaggacggacauccuguacaauauacagagaggagaaggaagcuggggugugaucagacagggcauuauggucuguccauguuacuuugcagugguaacaaaggaaguugaagauucuaaacucagauggucauccucucuugaaaaaagaauaagaacuuaggacccccuucuuacuacugcuccgggggggggggcuccuuucuccacuuccucagucugcugccaaaugacucgaaaucuuucauuuccuuccacccacucaugguuuaacccuuugcaaaaagacggcuaucuucguacuccagauuggucccuugagaucaccagccaccuucagucacggucacauauccacaccuuuuuuucugcccuucuuauguaaaagcuccuuguuggcagaugccccugcccacugucuucuggugucuguggcguaguaaguccucuugucuugugucuguugucuuuuaggguagacauguuucccucuucugacuguuuccccuccccagugagguucuccucaaggcucgugguuuugugaaccauguagaugugcugcuuugccaguuauuucucuuucuuucccucucugugucuuaacuuuucccaacacugguagagcuauuucaccucuguucaagucacuggagacaagagguguaggcacuaguaacaagggcuuggggaggagggggagaaggcucagucccugaccugaggagcaaacauacuuagauguuaaacuugucaguaaguacugugagucuggcauguuggaaagcugagucgaguguauuagugaggaaacacagaaugugcaggggugggaaaugggccacaucucagaggaagugaugacauuggggcuagggccuagaaagugaguaugagaagccuggccuugcagagaucuggaggaagcugacaggaaagggagugcggaggugcagagaagcagcgccugcgcucccguucaggauaauuguguguaucaugccggaucuccuggcccggugucuuguugauaccucacauuuaagugcaccaaaacugaugccagcucuuucugacccauugucauacugauaguuucucugcuuuucuuaauaaugucuuccucagcuccagaggccacacaguauuuguuagaacugcuggcuucugucuuuguggcccuccagcagaccguggggcagcauguaaaccagccaugugaagguguuucacauuacaugugaacaaugaagucuauauuucuguuuguuuugaacauguaaaggccugucaguuuuugagguaccucccuugagguucugcauacccuucuagcuaaugcuguacuggccuuucagaugacaaaauuacuccugguuuucuggcuauaacucauuuuucaguuuuggcagagcagagagcucuaguauguuguauguuaacuuggucuuuggguguugacuuggaaacuucaugaauacagcaauguguguuggggcaaaauguuuuccaacuuucuaaagaggagugcugucuuuaagcuaaacaguacaagagugugugugugugcaugcaugagcauguauguaggcuagaaguuaucguucaggugucuucaagggccauuagcuuuuuuuucccccccaguuugagacugucucacugacuggcuaggcuggcgggcuucaccuuccugacauuacacacaugcagcaccgugcucccugacguuucacacaggcugcaucgugcucccugacagaggauaagcuuagguucucuuuccuguacaggaaguacuuuaccaccugagcuaucucaccagcuccagacucuuucagcuggaaaaauagcgcaaaaacaacaacaacaaaaaaaccaaaaaccaaaccaaaccaaaacaaaaaaacccaaaaccaauggaauaggagucaggcaacaccaaaggagaaggauuacugcagaauugugacucagauggaaguauggcuucugccgggugaaaaagggacauuuaacgagccuccuccgacauucacgagaggcagggaaggcugucgaaugacuuccuuuuuggcuguaaaucuuguuuacuuuccucagguuagagcuagagcgcucaugguuuuaagagaucaugaagacagccaacccaagcacauuuaguucugaguucauaggaacuguuuaauaaguacauuuaaaguuacuagcacacaugagguaagaauuggaagacaucagagugccucaggaaauagcucguuuucuauuuugacaguggaggggaaaaagaggguggcaaggaagugacuggccagggcuuuugugggccagggcuuuaguagguuguugcuguuguuugacccagcuuagccuugaacuuaugauucuccgccuuagcaucccaagugcugggauuauagcuaucuguuacagcaugcuugacaugucauugauacuugcugcucaugaaauagacacacauggaauuuguuaaauuaaauuuuuauuaaauuauauuauuauuacuauuauuauuauuauuugguuuuucaagacaggguuucucuguguaguuuuggcuguccuguaacucacuuuguagaccaggcuggccucaaacucagaaauccgccugccucugccucccaagugcugggacuaaaggcgugugccaccacguccagcaaauuauuuuuuaaaauuuauuagauuugauuauugaaguaguucaaaaaaggaugagaucuaaaacuuuuguaauuauguguuuauguguauggggucugugcugagauguggguguggaacccuuggaacugcaguuacagauggcuguugugagcacugggaccucuggaaaagcagcaagcucucuuaauugcugagucauuucuuuugcacugaggcugagauaguuuaugggcagaaggcuuugaggugauuuaaaagauuuuaggauucuuuaggccuugucuguuaauuuggauauuaauaacaaugguguccuauaaaagaggagcaauggagcuguugguuugggggagguguccugggugcacaguuugaaggacaggcugggugggcagugcugagccccaaaccacucccacguuacaucgaggaaugauuaguugguuucucucuuuuuuuaaaaaaacuauuuaaacauucuaauaaugacuaaaucuuaauaaagugcuucccuaauguugacuuuuacuugcucauugauauuauuguuaggcuaaaugaaaacaauuuacauacaucauaucacaaaaagauucuaucucaggcuuugucacuaaugaauauuauguaacuuuuguuacaggcuauauauacucuuuuuaaaaaucauuuuaaaaguucuauugcaauauagucuucauaaaagucauuuuaaguaucuuuauuugagguuuugcuuagauaaaauuaccuauuauuuaauauuuaagcagugucugcuauuuuguacuauguguuuaugugaaguggcaguuucagcacugaugauuuuaaaaaucaaaauauugaucaacuuugaaaaacauugaagauacuguguccuacaguaucaaauguucagccaguacuuaauuauugaugaaaaaugaucaagcaaaaauuugcuuuugucuuuaguaaaaaauaaauguuaauguauuaaggagcuauuuuuaaaauuucuuucugagcaugguagccuuuaaucccagcacuugggaggcagaaacaaacagaucuuugugaauucaaggccacccuggucuacauaguaucuuccaggguagccaggacuacacagugagaccuugucucaaaaagaaaaaaaauucuuuaugucuaauuauuagucaguguuugacuuauguaucugauuuuuaucccuauauguaccagauugugcagauuucugugugagaagagucauacauggaaaaagccuuuauaagaagccuugcccugugggcuggagggaagacucagugcuuaagagcacugucuauucuugcagaggacccaguucaguuuccagcaucuacauggaaacucaaaacuguguguagcuucaguucuaagggaucugacacuucuggccucugugggcaccguguacacagguaguguacauacauacguucaggcaaacacucuuaaaauaaaaauaaagucuuuaaaaagucuuuuuguucugggucuugccuagcauauacaagcaacaguuacccaguguaggaaacucuuuauuaagaacaguaacaauaaggaugggggaugugcuguggagauggcccaguugauaaagugcuugcucuggaagcaugacccauccucagcauccauguaaaaccuuggccugccaguagaugcuuuguaauccagugcuggggaaguagacggggggggggggggggggggggggaggcgcucacuggcuggacagccuaaccuagcuggcaagccuggcucaguacacacauauucuuuaccaccaccaaaguugacacuugaaacuugaccuuuggguuccacagacacguaugcacaugcgcuuguacaccacaccccuuuccucccaaacacccacgucugagguuugaaagcuccugacugauaugugcuuugguuucauucauuugagaacuaagggagcuugaguuuaggagaagaaacaauuucacacuucugaucccaaacucccuguuuucccauuguguccugguuuagggacaacacaccacucuguggagucaggccuguaaugcuguaaagcuguugaagucuuuuggggagccuccaguggcucacuugucucaguuguaccuuuggucauuguuguuucuggccauguuugaguuagaauuuaucuacccuaaccuguccuugcagggaauguuguugucagcaaauuuucaaggugggggcagccugaacagacuguucaauaaaguuauuuauggcugaaacccugaggcugaguuguguugacuaagacuuggaccugggcacagcuuccguuuccucuuuccuucugauagucuuuccuuugcuugauuuuuaaaaguuacaggcuaugcauuuaaaauaauuguaaccuuucuauauuguacaagaaagaugcauauuagucagucuucacugauauagguguauuugaucucuacugauaugacaguguucuuaaaauguuacuuuggauugguuucaggucauugcugucaucagugcauguuuuacaaguaguuaggguuuaauuauaauaguguguacucauuguuguuauccuuucagaggugccaggacaaaagcccagugcuugguacuuucuaggcagucccugggauuugccauacuguugaacuguagagaauagcaaauuuuccuuuuagaaaacuuaaaccuugaacccgugagauggcuuaacaugugaaaauacuugauucuaaugauggaaacugaugagcagaguucaccucuaggacucaagaugagaucacaccuacacgugugcauagcgugcaugaacacaccuacacguguguauagcaugcaugaaugaacacucuaucucccucucccugucacugucucaauaauacuaagaauuacuauuauuaaacuacuaauaaaauauauaagaaaacuuaggaacuaaguaaaaaaacucuuaagaccucccauucacagguuaacgguuuuguugaggucuuaguauuuaucauuuagucuuuguucuaugaaccuguacauuuaaauuuuuuucuuguguuuguuuuugagacaagaucucguuacauagcucuggcuguccuggaauucacuuuguaaaccaggcuggccaagaacuaacagaaaucugcuugccucugccucccaagugcugugauuaaaggcauuugccaacacacucacugaguuaaaaaacaaaacaaaacaaccccccccacaaacacacauuuucaaugagaccaugauaugcaguuguuuuuuaaaugugguuuucuuaccaggugauuucuuaccccuaccccacagucauaacuuuuguuuucacuguuauguaugaugcauuguuuuuauugcaggauggaccagaguuuacuaacuuaauucugcacugugggcucuguauauugcuugucugaccuauacuacaugcauaaccauuuauacauauauacauauauacauauauauuucugauuauuuccuuaggauacuauuagagguauuaacucagaguuuuuccaaauuuuaguuacaugaguuacaugcaugauuuaaaaagcacacauugauugugggcuauugauagaccagugguaaagugcuugucuagcaugugugaagcccuggguuggaacuugggagguggaaguaggagaacaaguucaaaggcaaccaccaguauguaaugaguuaaaagccaguuugggcuguagacucaguacacacacacacacacacacacacacucucucucucucucucucucuuucucucucucucaugcugagagauuucaugcuuguagagauuucaugcugagagagagagaaagcaccccaguaaaacaucauaaaucugcccaguuuugauuaauuuuuaauagaaauuacuuuacuuuuauguaugaaugcuuuguuuguauauaugucuuucacaauuuuuuuuuguaaaaauuauuuuauauguaugagugcuuuggcuguauuuugccugcaugauguguauuuuuaucagcucaugaccucaaacucauggcaucuuuuuaauuacuauauaugugugugugugcgcgugcaugcguguguguguguauaaauauauaaauaaauauaaccuacugaauccauucagaguugccuguauguuuuuagggcugaccacuugguauuggaaagccaauuaggauguucacuccugaggaaagacugauccucccucucucagcuguuauuaauugccuguaguucuucauguagagaugggucucugugagauuucccucaucuauguuggcaugacagcuggcauugucauuguucuggccuuguuuagccauccccucuuguagagauuuuauggguauagcuuuccugucauaucuagaagacagucauacacagacuugcugguucucugguucuuacaaucaucccacccccucuuccaagauguucccugagccucagaugugccccuggguaguggauguauccucuggagcugggaaccccaaggccaguugcucucugcauuuugacuaauuguggcuuucuguagugguccuaucugcaauaaggagaagcuucuuugauggggugagagcuuccugugggucuaaggaugggaacuuaaauugcaguuaggaguuuauacugguuuaggaaaguggcuguaguagguucucucacuagccauggguacaguaucagacgcauuccuaguuuugguguuaauugauugcucaggucuguuucugugaaauggaagcuaacuuaucuuuguaaagacuugugauaacaaguuuauagccacacucucuggggugugcaguucacuuggaguauuuugccccaggcacuuuguguggcuugauguuuugagccuuucagauucuagauaugaaagugguuugacauuaauuuauagcaggagagcuuccagagaucucugcacggucacagccagugagccuagccacauucaaugcugcuguucugugacuucauuguuagaauauuuccuguaacuugcaaaaauugguauuucuaguuauuucuauuuaaauguuuuauucaugacacauuucuuaacuauaaaguaugcaucuagauauucauugauuuuuuuuuucccccuuuaguaacaaagcaguauuuuaagcuaauauaaugguguuuuugccuaauggaaagaaagauuauguuaaauuugaaauugugcucccuaaauuauggaauggcauauuacuguuuggcagguaagauuauaaaaggugcuauggugagaaaauucuaguguaaggaccuguuucucagggaaacugauuuuccagaaguuugaugcccagcuugcuuuuuugcucuccuuugguguuuauuuugugaagcuggagccucuuaaagggacgggcaagaccuguggcuuccaggugugagggccuucuucuuagggaucuuggugacauuuguauuuccccuuuccuuuauuuccugccacagugagauuuuucuucaaaauguccugguaaagaacugacgagguucugguccucagggucagaagugccugcuggaggggucuugauaaggucucccugggugcuguaggggucuugauaaggucucccuggcaccaccuugcuguagguggacagugguugguuggaccugagucauauguuggagucagacaagacucuauaaucauuuuguuaauagaauaauugacacaagagguuucuagacaagcaaacucuauuaauguguaccauaucuugaccugguacuuuaaaguuuuuuuaaaaagaaacccugguaaaacauaacauaaaaauuggcgugcuaaccuuugaaaaguguuuguuguguaggaggucuccagaacuuuuaucuuggauauggaaacucuguaccugcuaacuaaacaguaacuguacauuuuucuccuccagccccagaauuccauuagguccuuucugcaccucauacaaauaaaccagggguacauauuagccauuauauaagugguguauuucauuuaaaugugaaauauguucucaaacuauuuucauauaggagaauuuccuucauuuucaagaaugaguaauagucuguugugcguaugugucuguuuuguuacuguucaucugcuugucuauagacggacauuuggguugcuuccaccugaaagcuguuuugaaugauguuucuaugaacauggguacaaauaugagaccuguuuucaaccguccugugaacugacaguuuuauagauaauucuaauuuagacaaguccaaaacuguaaucaucuuuucccuugaaaacuauccuuuaucuuaaauacacaaugauguucuuucguguguuuggccuuggccugccauggauacugggcaccagauuuugacuugcagucccuaaucauccugucaguucaugagucuguuuacucucaagauguucuuugaguaaaguguuucggaguugcaugagugccgauugcugugagguggcucuguuuauccucuuacaaucuggaacgaguacggaugauguguucacagccugagagguccuguagagaagaaguucauugacucagccauuuucaaaucugucuggcuauggaaccaucuuuuuaauuaacacacacuaauauauuaagguuaaaaggcagcuugaugugcuccugucuaccuucacuucauuuguugguucuuaguuugcuuuauuuauuaauuucuauugauugauuguaccgggaguggaccuguagccuccugugagcauucuaccccugaaccacaucccagucaccuaucuacacuucucccuucucuaugccuucucuacuauagcuuguugugcaaacuugaaaucagggauuuucagucuuuuuccauuuccuacucucuuuggcagucaguuggggaauagcauuccgaagacaaagugaaaccugugugguucugaaucacucauggcucugcaagaaguuugaucuuguguuucugacuagcaguaucaagugcagagacuugugaggugggaaauagcuuuuacucaccuggaaaauggggggaaacaggagaauccaccuucuagauuuguugugaguccuuguguuuaaagcaguaucugauauguguaugugcaccccuccccauaccccccaucagcauucccucuaauuaaugcuuuugguguucugaaggaggaaaauauagaaaacagaacuuuauuuauuaagauugaauugucaaagacuagaaaacaaaaaaccacaagaggaaacacuggaaggaagugagguuacacaugccuggcugacuuagaaguuuuuaauuuuuauugagucuuuaguauuuacuccagaaaguaucagcagucgagagugagaguuucagucauagcuacaggacuugggacaaguuacuauaauaucuugccagccaccacuugcuuauuuguagaaguggggcugguuagacuugcugggucuaauugaaaugcuaaaugagauagucugcagagcccagccuguuggcaggcaggcaggcaguaaaggccuuccaggcgagaagaggaucccugugugggcacugcucagcuccagugugucuucuuuugugagugguaaaucucccuuuaaggcuuccuccuguagcugguugugugugugugugcugguguguguguguguguuugugugugugcugguguguguguguguguuuucuuuagacuuagcuuauguguaugaauguuuugccuguaccugguguccauaaagguagaaagggaauuggauccucuggaucuagaguuaagaaugcuugugagcuauggugcuacugugcuaccgcguaggugcugagagcugaaucuagguccuuccucucucugcaagagcagccagcguucuuaaccacggaaccaucucuccaacaucuguuuuguuuuguuuuaguaugacuauaauucuuucucaguguagcacacugcuaccaauggguaaauuugggugguagccccaagacaacagcucuguuaaaacuaaguguuuggcaacauaugccuucuuucucucuuacccugaguuucacagaagggcucuucagcaggcucaugccccuccugaaguacuuugcuccaugaucacuuuccuaaaugccaagcuaggcucuuguuagauuccagaggauuucuagaggcagaaauguacagaaccauugcuuucuuucuugcccagcucuugggaaguuaugucuaagagcagcguuuccuuguacaguaggaauaagagcuaugccaacuuuccuaagaguucuuagguuuuacuguucagaggcaacugcuuuuccaggacuagggauggaaagccugccugccguacacacagacuucaugggcguagcggcuaggauuuaagagagaaaggcaggaagaucaauaguucuaguauuauaugcuguaauaaguucaggggcagccugguaauggcaaaugccuuuaaucccaguguuugggaggccaaggcagcugaaucucuugaguuugaggccaaccuguucuaccuagggagcuccaggccagccaagaauuguaccaccauauacuuuuuuuccuuucucaucucauuuuuuuuuuuuugaaaaauugagguaagaaaagcuuugaaaauauucacuguguucacagauuccuaaaauauuugguuggucaagaugaaacauugccauuuuaacuuuucauuucugucaucauuuagugugugugagaggaaaggguuucuaagagugcugugacauugccugucuaaagugcuucccuggauauaagagaugcauuuuuuuucagauguagauacaagguauagcaaauucuuggcucccuuaagcccuuagggaugaauuauuuugagaaaacuuaaguuuucuggauguugagaauuuguucuuuuuuuuuuuuuaaauauuuuuuauuauuacauauuuuccucaauuacacuuagaaugccaucccaaaagucccccauaccccccccccccacuucccuacccacccauucccauguuuuuggcccuggcauuccccuguacuggggcauauaaaguuugcaaguccaaugggccucucuuuccagugauggccgacuaggccaucuuuugauacauaugcagcuagagucaagagcucgggguacugguuaguucauaauguuguugcaccuacaggguugcagaucucuuuagcuccuuggauacuuucucuagcuccuccauugggggcccugugcuccauccaauagcugacugugagcaucuacuuauguguuugcuaggccccagccuagucucacaagagacaacuauaucaggguccuuucagcaaaaucuugcuaguguaugcaauggugucaucguuuggaggcuaauuaugggauggaucucuggauaugguagucucuagaugguccauccuuuugucucagcuccaaacuuuauaacuccuuccaugggugauuguuuccaauucuaagaaggggcaaaguguccacacuuuggucuucguucuucuucaguuucauguguuuugcaaauuguaucuuauaucucggguauacuaaguuucuggguuaauauccacuuaucagugaguacauaucauuugaguucuuuugugauuguguuaccucacucaggaugaugcccuccagguccaucuauuugccuaggaauuucauaaauucauucuuuuuaauagcugaguaguacuccauuguguaaauguaccacauuuuuuuguauccauuucucuguugaggggcaucuggguucuuuccagcuucuggcuauuauaaauaaggcugcuuugaacauaguggagcauguguccuugagaauuuguucuuauaauaaccauauuuuaaaaacucugagaaaguucaaacgugcauuugcuuuucuuucccacucauguuuuguccuucagguuggugaugcugagcucugugcucauggggacacagcaucgccacaacaggaagacuacccgugagugcugagcaggaagcaccaaaucccuccacacugcacuucauuuuccaggaagcugagaucgaaaaccuacuuauguaauagaaauucucuccagaauuggaugaguucuccauucacaugcauauguuccugcauacuugcucacauacgcaagugcauguguggcugacaacauacacacaugcauccacacauacacauguacacauacaggcaggguauuuauuccaccaugaagagcuauagccuagaauucuugugcuuucuauaguuuuucuguuaauuccauguuuucucagggcugguaguauguccgugugugggaccaguuccugaggacucuuaggcuugcuguguagccccagagagaaguacugauggugacaugagacacuugugacuguauguguagucucugaagccuuuccuuggugaauauguauuaucugugugcuccaaauucuguauugcaugccagcccguuuuuaaaggaguguuauugagucaccuuguuugggggaauacugccucauucuuucuccagguucagcuuuuauugauuugugacacauguacgucaaagcuauagugcuagguagauuuagaguacaauuuagaacucugugguuucuguggauucauuucaagcccuguauaggaauuauauuuuugaacauaaccuuguaaauaacaacaucuccuuugugcccagauccuguuaggcuugguuuaaucugugaaucucuaugcauugauaucuccguuuaaagaaaagggaaucaauguuuggauaaauuaaguaccuuguucauuuuguaaaugaguaauucuugccugacaugaaaacuuacgccuuuucauacacuaaaaacauacuaucugcuagcaucagacuggaaacuggugauguaagcuucugcaggaggcuucgcuggaagaguggagcugggaugcuuuucuccuugcugcacguugcucuucccagcugugccucaaucucuguguuuaugcuuuuacuuagaaccaccuggcucaagggcugacugcagcuugaauagugugccauggguacuagguaucuugaggguaaaguauauuaucaacuuucagguaauaauucuuugaacucaugagccagaagaauuucuagaagacggauggcugguagauuucuagcugaacaaucuauuuaacacuaaauuaauuauaacguuaagaauguauucccugguaaugggcaaaaagacaccguaguggugcucuuacaucagucagggcagagcagauggcaguccuuuguucauccuggcuugauaucuagcuugguggccacagcugucuuaugccuaggacucaucaaaucaaaucaaaucaaaucaaaucaaaucaaaucaaaucaaauccaggcagcacaaugcaggaggaggaaaacagacagagaccuauggacugcugacccacccacggacugcccacagcagcacaggagggccauagauaaccacuugccgccucgccaugcagcacagaugggggaucucaugcaaggggcccccagccauguggccagccuacagugggugccagcacagcguacaaguaugugguggucagguaggagagaaggagaaguugagcauuaggagaagagauggaacuggagacuggaggguagagaggaggagccuaaugugagccaccagcccugccaccuggagccauggugaaguccuagccuaagcugcugcugagggccaugucagggucaugacuacacagcagcagggggcggugucaauguccauggcucauaauagcacuagagaacauggggaugucccugguuggggcagcuucuaggaaucacauggauguugaggggcuguucauaacuugcccugccugacucuggaugcagcauacuggagagcuggcccuaccucucacuggcugcagcauucagaagaggggcuuugugccucaccccagaagcacagugaagcuggcccugguggugaugguggugguauguauguauguauguguaaguggugaccccuccacucaucugccauggggugacauugguguagagaugauugucaccccaucccccacuccccuaccucagucagucaggaaagccacuuauagggucaugagcaugggagagcuagaccuacaacucuguagcccucaccaacugcaacacucaggagagagggcccuguaacccuccuuggcggcacaguagugcuggcccuggucaggggggcacaggugacccagccugaggaugagggugugggugcaggguugaugucccccuaccaccaucuguggcaaucaggagaucuggcccuggggucuagagagcaggugagcugacccuguucuuugcagguuacagcacuuaggagaguggacccugcacuacuucugggcagcacaaucaagcuggcucugguggaggcggguauaggugagccacccccccccccagagugagaaugugggagaguuggcucuaccaugccacugucuggcaugagguggcaugggugcaggggugaugcccucucccucuugccaccuucaguagccaggagaucugucccuggggccaugagaguggaagaccuagcccugcccucucacuagcuauagcacucaagagagcaaguacugcacauugcauugccugggcaacacaauggagcuggcucugauggcaaagguaugguuggaccagccuagagggugugagagcaggagagcuugggagaauuggcuccccacacccugacugggcagcaugauagagcuggcuauggaggcguggugugggugagcuggccuuaagggcaugugaacaggaaagaugacucugccuccuguggaugguggcacugaauaacuuagcuagaacagugcuggagagcuugcccugguguggugaccugcucagccaccauccagacccagaucuacagaugugaauuggcccaucccauccaucuaucaucugcaaaugauugagaugcgugaaagggccaguccugcuguuccaaagcugcaggaucuccaucacacagggcaacaacaggauaaccaggaggaguccugauaaggauccaaugcugauagugucauagaagccaaagaucucaaaccagacucaugauucauacuaaugaauguguacaaaugaagauguguggacagagggauauacugggucacugugagauacuacagcuuccacaaugagguguuuucuaagcuguuguuguuugugugggcgcauuuguggauuuuacuuuuggugggagucugcaagggcacaugguggauacaaggggacagggagaugaguggggcuggggagcaugaggugaaacucacagauaauaaaacguuaaaaacagguugugugugcagaggcuuacaguucuguucuggggauucuaggaagccuaucguaagauggauacuguuaucucccucuacccaugucacguccuguguggacaugcaauccugagaagagagauuucagggaacauuugcuucccagguuguaugacaaauuuaaauuuauuuuuuggcagugaacucaacuuuaguugaaaaacucacaaguaugcaguuuuguguuaguuuuuuccgcugguagugguuuugaacuuuauaggugguucugggaaugggaaauaaaggaaauaaauagcucugaugucagaggaacaggaagaguaagaucaaguaggaacagccccagcaaauccaaaccaauuagcuuuauucauaauggauuaaagauaaucaaauauacaucucagaguccauaaaguuguucuugacuuuaaaaaaguaaugucuuguauuuucauauaucuaacugaauguaaaagaacugacuucucagaugugaaacagcauucguuuaauauauuuuguaggcugggcaugguggcauaugccuguaaccccaaacucgggaggccgaugcaggaagacugugaguugggauauguaaugaaacagacuuaaaacaaaucuauacacacaaaauuguacuuuguguuuuuuaucaaggaaaauaauuuaguguauaccgaagugaccugcagauggaccaucucaucuagagaauaccaggcuuccagugaauuguggcuaggccaguucucuucauccugaaggaucgaacccaauacugaaaaaaauuuacaacaaagcauuuugcaggauccuguacuuuuuuccuuggagagggggauuguuccaugagugauuugggauauaauuacugcucuaaugauagucugcugaugccuguaacacacauuuuaucuuuaaagucagaguuggaguuaauuggaguaucuuuuauuguagaaugaaucaguggcauuaagugacggagggugacauguucaagaagggcagcaauccaggccuaggaugagugcaggcuucccaagagagaaucacaaagaaaacuuuguuuugggcugggcugauggcucuggauaaagugcuugcugacauuugaguuccugaguccauguaaugguggcaugggagcgugugugucggucaucucacagugccuguggagagcugggcuguggaggcaggaaucucccuggaaccuugguauauguaauagguaggggaugaaccuuaaacccuaagaccaagaagacuuaaaccauaaacucugaaacaagccugucugaaacaagguggaaagugaagguugacaucugagguagccucaggcuucugcaccugcaccgugauacauguguacccacauucacacacaagugugcauacaggagcacaucauacgcaagggcaaaugaaagauuaaaaacaccuuugugcuaauaauuguagguuggcagaaaguugcuaagguguagagagaaagucuguucuagaguuaaacuugaacauaagcagaaaucucugaaguguuaagggcauuaggcuuauuaaaaaaaaaaaaaaaacaaaaccaacguaagauacucaaggaggugucugaaucauccuuuggaacuaguuucugaaaggcugcaggcguaaaugcaauaauagcuaaaauucagaugguagacugugaugugauuuguagaagggauuuuccuagaauccagagaugccacugggagguuccugugguguuuccccauaauaugguuuguccuuugaaugccugugagccucuugugggauguaggcucgguggugucagaguaacaggugguggccaggaaccagcauugcauuugaucagcuacccaaaauagcaaagguuacucaggcuucaugaggccccgaguccagccugggaugggagugucagccccagacugacgucaacccgaccuucucuuucugcaguguggaugguaugagccuaucuaggguuccaauuuaggaugugcugcucuacgugguuguucauaccaaucggguuuaaccuugugaaacuuccauuucuuuuauaaaaugucaaguaucagcaauuucauacaauuuagcuuugucauauuaagaauucuuaaaagguaaaguagcauuuucuaaggaaacuagcucucuaccucuuccucuaccucuucauuuacauaggagauggagcacucacauguguuaagugauuaagcaaccuaauaucuuuaugguccuaugggaauuucuccacucauucauuuacucauucauucaaguacuuauuuugagacccuguaacccaggcugucccagaaccgcuaucgguauaguucaggcugaccuugaacuugaaucccucccaaaugcugggauuacaaguguaacaccauaccugguuuucuccuuuucaaaaaccacagagcugccucuuacucucgcucuagucuccaagcugugauguucccagccuuucuguuagguccuuauguaguuacacuuuugagaagucuugggggucuugacagugacaugaggcgccucauuugacuggauggaaauaugaaccuacauaaaaaauguaaguauuuauguuuaugcucauggagaagccagagaaagauauggguauccuccucuauugcucucagucuuauuccuuuaagauaggaucuuugacaguuaggcuggccuagcuggcuggugagcucuuuagcucugccugucucugucuccuaguguuguacuuacaugcacagccaugucugguuuuuguuuguuuuauuuuuuacauggguucuggggauucaaaguuguguuccuauguuugcagagcaagcacuaucuugugagacaccuucuagccccuauuuuuuuuaaucuuaaauaucuagcauaguauauaugcucuuguaauuuuuuuuggaaauguguaguucagagcagagauagaaacuuauugagccuacugguaaaaauggguguucuugccuuggaagaggaagguugcugcuugcucucucauucugucuucugugugcuugaauccugucauguccaggauggaaagaagggaucugaagaugucucuaccagccucuuguugaucuccuuagauacuuguaaagaccaggccugguaggggcuuggugaauuggacaggcugagagguguucuugggccacugagucuuggccagaucuucuaauauccaggcacauggaccguguuuagguugucgcucaggguucugucagguuuauuuaagcaucauuuuuacucuauccccagcucccuaaccucagccucaaagauaccucagcucuugucagauucagaaaugcuggguagucugacugccacucggcugaguuggagggaaagacagucuguuggggaccugacuucgaauggguuacagccugucuuccugguuuuauccucugauaggcagaggauaaaggaaaaggucagaaaugaucuaugauacgucuuuucagcagucucccaggcgguuguuuagguuucggucauggggaacaggagacuggaaaccaguucacuguguguguguguguguggguguggguguggggguguggggguguggguguguggguguguggguggguggguguguggguguguggguguggguguguguggggggguguguguguguguggguguggguguguggguguguguguggguguguguguguguggguguguggguguggguguguggguguguggguggguggggcaggaugaaggauguuaggugcaucuucucauuuucauugccggagggaacagaguucacccccaugucagaugaggacagggggaucaguauaaccugugccuaggauuaaguugcuguuauaaauggaccauaaaacuccugcuagcuacuauagcuagugcugggaacacugggguuuguacuagucagucuucacucacugcugacaugacagucuaaguuacccacuuugaggaaagaaagaaauaggauacagccucugcauuaaguuggguaguggugauaugaauguguuugccacauuucugcagagacucagagaagagaguguccauguuuuauagguaacucuggagacuuacucuugcuauagacugauccuugauagauacauccuugaccugagcuccaucuuguuuugaaaugaaaaugccaacccuucccugcuagugguuuuuccuugcuguucuguggccucauuaugaugagucaccacagucacuguuugcaggaugccugccagauguucccagugugaacacacucugcgcuuuccugcuuggcuguucucuguggcucccuggcaggcccuugcuucccuccucaaaaagcaguggcacuguaaguggcuucacauauugugccauuuacugugcuguuugccaagcaaguuuuguaguugccaagcugaaggagauuugggaggggucucugagaauccaguaaccucuucagagcuggugaucaggagcagggacugcuuuugauuccccucucuucuccaugugcuuucugcuuucuaggaugcccccggccccuccauccccuguagccacuucuggguuuuagccagcaucuaccguucuucaugguguuuaggucauagucugugaguguccuaauuccagagggcuccuguauuuacaauucuuuagaguauauguauuucuacuauauucagaugaucucaagaggagaggagugugguaugugcauccuuuuauucauauucauccccccccccacacacacacaaugucuucaugagguccagauuagacucuggguucaaauuccugaagggaagcuaugccuuacacugacuugauugcacuguuuauaacauuagugauuauggggagguuggaauguuucaggcccagagccuacaguuugucuuuagucuccuuaaucagcauuuauugcucaccucuguuauaucugacccaacauccuugugacuugucaugugaaaccuuuugggauauauuaacagaucacaagcuucuaccaaccaaaaguuaaaaaugucaucggauaauaucugaggccuauagcagagauuucccuuuuggauacaaccagccuucuuagugugcguaccaauguauuuauuuauaacuuuguuaucuuuauuuaugacuuuguuacuguaaaaacuuaaugaaauuauuaccuaguuggaacauguaauuugggcuaaucaaaaucugugcgcuaugacuucaaagucaacuuucauuuauagcauuaauaugagaacuguguuauuugucaguagacugaaauaugcuaugugguccagcuggccuugaacucuugacccucuuguuucagccuccugauuauaggcauguccuaccugccaugcucagcuuccagcagcauccccuaggaaggaaauagauugcauuuugcaguacuagaaauacacuauucccauuuuaggcuaacuccauccugcaauggcaucagugacaagaagguccucagggcuagaguuaauccugcaggccuguguucaagcuccugugaggggccagcagcaucauacugcccaugucauugagggaggcugaggggagggccucagguagagaggugguguccccagcagugugcacguccucagaagucuccucacuucccuggagcccuacccagagaacggugcguccuguugaggcgaagacugcucagggcugagaacugcuguguucaggaacgguuuuccugagcuguagauuguucacaucugauaccuugaugcugacuuuuguugcucuagauagcuuccuggaaucuaagaauccagaaguucaaagccacucugaggaagggagcucuguguucugcuacaccaggaaaggggaggggguacauuuucuuagcugugggaauuucaagaagcuugguuucuuuguaucugaguuugcuuauuuauaggauugaaguaacagugguagcccuuuaugugucacugcguaaauguguaaaauguuuggcauggcuaauagugcaguuuuaauuauauuuauuugcauguaugcgcauacgugugugagugcucacacacaggaacaugcacucucacaaacaugagcaugcacgagcacacagucuuuauauuuuuccauggcugcaggcuguaucagcaauggcuuuugacuuuuagcagggauaaagagcuuugaguucaugguggaugugcuagcuaguuuuaugucaaccucacacaagcuaggguuaucugaaaggaaggacccucaauugagaaaaugccucuguaagauccaccuguugggcauuucuuaauuagugaucgauucccaacacauugugaguuuguggcucuggguucuauaagcaaucagacugagcaagccauuggggcaagccaguaagcagccccccuccauggccucugcaucagcuccugucuucugguuccuaugcugcuugaguuccugcucucacuuuauugcuuuugaugaugagcuguucuguggaauggagugaaauaaaccuuuuccuccccagguugcuuuugaucauggcgucucauccuaguauuaguaacccugacuaagguggacaugcucucuuauuuccuuuguguuacccucaggauguuaccgugggagaguagaguagucagaaguccucagagaugccuuggagauuguuugaugcuggacagaugauuucaccguuguauacauuuaaaaagcagaggagcauuaguuaauauuggaaguagcugagcagcuuguucugucucugcaucuucugcaagccuucagaauacacgcuggagggaagcuuagcaaacacguugccuguuguaguggcacguccagcuuaaguagcuuuuguuagcugcaaaaccagugagucaagcugaacacacuuagcuauguaaguagccuuggauuaaacuguuuaugaaucuugauuuuccuuuuuauaaagugaugugaugauguuuuccucagaguaguguuagugugaguaguagaugagauguaaagaaccuaucacacuugggaggaagaggcagguggaucucugugaguucgaggccagccuggucuacagagcuaguucuaggacagccaggcuacacagagaaacucugccucgaaagccaaaaacaaacaagcaaacaaaaaacuucccaaaacaacaaaaauauaucaguggauaacaaugugacuguauugcauaauagagcuaagacuguuguaaguguauugucuggauguuguuacccuucaaagucaguauccauuuagaaaguauuuagguugcuuuuagccugcuugccugccgccugccugccugucuuccugccugccugccuuccugccugccugccugucuuccugccugccugccuuccugccuuccugccuuccugccuucuuccuuucuuucuuuuuaaggcaggaggagagagaaagcagauucauacaguugaggggggaaggaaagggagaggggagagggagaagaagaaaaggaggagaaggagagggagagggagggagagagggagagaaggagagagaaauagagauugagagucacauccccagaaguugaguuaccugaugugggaagugaacucagguccucagcaagaguagcacgugcuccuaacuacugagucaucucaaggcccauguuuacagggauuuuuuuuuuuauccccauuaugaacaacacacaauaauacucaggcugcccaaucucuguguguuuuguguguucuuaggguacauuucugggaguaacagaagugccugauuuucgcccuuauuucauuaucagauucagauugucuccagguaaccuuucccucucccacagcggugggaauaggcagcugugggaggguaaggagaauguggacuuccugccaccugguaagcuaagaacaagggcuccuuaggcauuggcugagcucccagaggcaauggccuaggacauagccagucagccuugugccauauuggcugggugagguggauucuuguuucugcuuuguggguguagaagagguauggacuuggcugagucacacugaguuauaggucuaggugucuguuacagguaugggagccucacuguugacaagcagaaagggaauucaaaguuuuuguuaauuuguacuuauuuuuauugugugugcacagcauauacguggagauuagaggauagcuuucuagacuugguucuuccuuccaccaugggaucuggaacucaaucugcagaggugcuuuuaccuagugagccaucucaguaggcuuguuuguucuugguuaggcccucuuucaccaggaaauguauucuuugaagaguucaagugaauggggugggcagcuaguacaagcccaucuggaaaugccuuccucuaggaauguuaguaccugcagagaaccugcagaucagucgagucugauucuagaaaccaagagucuauuucaaacccaguggaacacaguguuaggucucaaagaaacucaggacaaauggguuaacugaggugccuauuaauauauauuaauauauaauauaacacuggccaccaagaccucagcaucccaaguaccuucuacagagcucuggcuccucuccaugcuccucacccauacccuaaaccuuuccagccuguugagcuuuguuucccuucccccacccuuuucccucuguaaccgggcuauuuuggccacaugcucuguuggcuccccucucuuguccuucucuuuccucuuuuucuuucacugucccccacccucacccccauugcccggucuauucugcuggccauguucagucuggacucuuccacaugccucuggcuguuugcucccucauaucuacacuaaauagcuucuccccaaccauacuuaggagugggcauauccccauuuucauuuacauaaaaccuaacgagcuucucaaugagauuaaguguguauacagucauagauuaggacucauaccuacugaaaauaaucaagaggucagugcaggggccuauaccaaaagcaguuggggugggcguacaggcagcagaauugugguaauaagcgcugaacuucggcuugaguucugagacuauguugugaguuuaguuuugguugcaguauaugagaggcugguuugcuuguguaaguaauugccuauaagaauaguuugauauuuaccuugugauuuuuauuuuuaaaggaugcucuuuauuuaaauugaccuagaugccugaaagauggauagguggaaucuuuugucucaaagaagaaucuuguuauuuagcgaaugcuucugguuugucucacaaaaugcaaaguggaugcuugugcaugcucacuccuuuauuauaguacagccuucaaaacaugcaucuguuguuguguaacuggcuacucucugggauaacagcacaaaccagcagaugugucugucugcuuggccugaccuuugauugaaugugcuacaaguauaugauauacuugcuggaacaauuuuaaaggaacgguacaggcuaaacuggaaaauaauagacacagccuccuuuagaaucagugauuuauuuaguauucagagauaagcuuagaaucauugagaauagcuuuguuuugcggguaaacaaaaagguugcauguagaauauuuuucccuauaaaacuuaauuuuguacaggcauauuuaauuugaaaauuugaaguauauauacuucagaaugaaauuugacugcuauagcaccuugaauccuuuagcuccucagaauacagguugaaaaaucuucauauuacugcugugcgugcaugugcgagcguucgagugccacaaaccuaagcuucucuaagacauuuuuuuuuccuuugcugaacauuugggacucccugaggagguagaaaggacacuugaguaacagccugcucuugguuuuugccuuugcucaucuuuagagcaugguuguaugaccuauucuagacaccaagaugcuggcuuuaagguaaauggccuugcugcaggcccucugguccccugugccuguguaggaaagagucucuagaguagaugggcagagauuaggaugaaaaugacaaucagucaaacacacaagagagguguugaaucugaaugcaaugcuccagucgagcaucagacuuuuauaauacagaauaaauugcagaacaaggcacauugaauuuuuccaggugcaaaaggagugacuucaaaaggaaccagauaaauguauaacacuagagauuaacacagaugcaaggggagugacuacaaagggaauuuguaggaaccagauaaauguuuacauuagagauuagcacuuucugccaggcaagaguuuuacacuuagaguuaauagccccaggguaguuaacucuugacacgccucaagaauaauguagugucacugaccccaaaauucucuaggccucguuaauucuuaucuauaucuggagacuguccauuuucaguauaguauacuaauuugcucuuggcaugaaauguagucuguaauaagaauuucuaucucagugagaauuuuagucucuaucuguaaacagcugaguaaaauggcaagugccuaauuguuuucugaauggguuaagcuccuugcugcuaucuggaaucuaagaacacugggaaaggcuuuagcuauguuagaauacaaucuuaaaaggcauuuacuauaaggugaugcuuaauagagugcacgugaaucuauacacuagauuaaugugguggaaauuugaauauaauggguuagggaaagagaugccauaacucugggaggaaaauuucccuggacucuuauccucaugaaacagcuuccaggcuuuucgccugacaaaccgauccaaacuggagaguuggcuuucgccagaauauccaggaggagaguccuagaaauucauuucucaugagcagcuuuucggcauuucugccucacaagcugacuccaccagagugcccugacaggccugagccuacacuucuggugguauuucuugaucugaaauuuuuuucauuacuuuuuagugcuucgaaacuuauccaggccugaacuuucagguuucucugcuuugacaggcaauaacaccuuaucugauaaacgagguggauuaaugagugcagugaacugaguacuggcuacuccucccuggguuaguguaucauuaguuucccugggauagaaugcgcuucucucaaauggauaguucagggguauuuggagcuuuacagaugagguuguagucuuacuaggcauccaguacaggaauuggguaacuaaggaccucaugaugucuuagaagggccacauguacagaaggcuguggugugaaagguggagaaggggccugaggaaagugugaacagagugcugugaaggcuccaaaaguagguucuuucuuucaugugagcagcuaggagcagcuugaguggacaagggaggacuugaagggaggagcagaagauugauaaagggcuccucuccugagccaggucauagguggacaaauaucagugugcugagaagcuggagcacagggaccaagccauuggcaauaucaaggaggcagaacaaaucaagcauguucaaggugauaggcuggggccagcacccaauaugccuggguaccuuuucauguaugaggccacugugggcaugguauacacagcuuaauuuaaagaccuaauuugugagcucucucaagccccugugcuucuggcugaggaaaaacaguuuuuuuuuguuuuuuauuauuauuauuaaucaauuuuaaaaaucugaugugcuuucugugugucugcccaccucuggaguuuacacacaggcaaaguauacuagagaaggugcuguugugacuacucugucagacaggcauuuuuauaggugccuacagauuuguaguaugggcuuggagcuagaucugggcucucugucucucuuuggacuaugagccuuggauuuaggucucguuuaguccccugcaaaguaggaauuagcaucuugccaugucauuuugggagucagguguguagcaauguaugccucaagucagaauaggugcucagguguugggaguagggacuccuggaugccaggguagagagcuuugcauccccaucagaagucucugaauuuauugauugucuucuccuuuauuacugagguuaggaagccuaaucaguuggcaggacucauugaagucauucugggauggauuuuaaagccauucccaagcucauagaaaccaugccacagaguguacuuuuguuuguuucauuaugaaauuaucauucaaaggccccuguugguacuaguucacucuggcuguacagucaugugcuugggcaaauauguggugacauauacuauauauccuuaucguaugcacggugauaguuuuguacagagaauuuacauugcuuucacagauuuucuugugcucuccgguccgucucuaccucccuuguguauuugcugauguggucuuggguguugguaauugggcaggaaugcuagcagccuguagagcucucugagugugagaggucaacacuucuguuuccugagcugagaaaagcuacccgccuuuugcuugaggguacugacuuugcaagaacuucucaguuucucagaucuacugaacaccuacuuagggaccaaguguucuaagguuacugcaagaguuuucuggcaacaagacucuggccuucugagauggcacagugacuguucugccaugccuugcuauugaugagaugagaggauccagacacugugaaggcugagcgagcaugcuuacagaaccuauagugcauagaccaucccugugaaaggaaugcuuuccgcuagcuuacaugacucucaaaugucuccucaaacauucuugcaaggaaaaauuccuguuuucauuuuucagagucuaauucuauuuuauauaaagcaauuuuugcaccauuuugguuuacuugaauauuccaggaauguuaacuauaugugagugaauauacucuuacacaauuucauguuacuuugcuugaauauuuuuguaaauaauugugguuuugucaccaaaaaggacaugccaggaucugucugcuuuauuacuauuauacucaugcuuauucuacuguugcugaaagugagagacucauuaugccuucuaauguacucaugacagagcagauaguuauauauuggaguacauauuccuaauacuuuuuguuaaauuccccuggauaccuaguuuuauugauuucuuugaaauuauaugccauauguauuuugcguaaauuuaauuuucauuucagggaaguaaaggggaggguaugagaaaauagaagcaggaguugagggaacauugggaaucauuaguauaauguacugacuguauuaguuuaaagcuguccaagugcuaagaaguaugugggaagagguuaagucaugaccuuugugaacuugacccuaaacuuauuugaaugaagagugcuucuuagcugaugcuuuuaaagguuuagaaauaaggacuaccuaaauggagguggagugcuuacaaugguuuugucacuauacuccaagccagagacucuccuuuguggcaauagguugucuuguggcugagccgaucugcuuuggagaggauuggagugcuuguguauggucugauaaguuaaaguuucuguuauuucuccagucaccgguuuuaccuuuucagaucucugcaguuccacucgugacguucuagaacugcuugcagucuugguguaauuuaacaccuucuuucuuggugaugguaaggguagaacccaguaccugcacauacuaggugaguuuucuaugcugagccacaccccuugccaaugagcuaaaauaacacaagugagcgagacuggaauuuagagacucaaaaagaaacuuuacccacaaggcuuuaaacugcugcaggugaucuugacaugggaaaguguuuaaugaaaugcugauuaugcugugugccauugcaggcugcaguuacuaggaguagguggaggaauagguguguugaggugggccugggggcaaggggggcacuguagaauaguguaaaagugcugugugugccuaccaggaguguccaugcuuccauugcccaagcaaugcuuugcauuccaaauuuacacuuagaguaguugauagguaucuuuaguucuguaccugauggagcuuucuucucugcuuggucuuuggcaauaguaagaugguagggagaugguacuggagauguggaagugugaguccacagagcucaagugcucuuggccacacugcccagaggaggcagaggaaguuuucccagauuggauugaugcuaacugccacuugugaacgucugucugucugucugucugucucucucucucucucucucucucuaucuaucuaucuaucuaucuaucuaucuaucuauauauauauauauuaugcacacgaguacacuguagcuguauugaugguuguaaaccaucaugugguugcugggaauuugaauucaaggaccucugcucacucuggucggcucugcucgcuccggccuaaagauuuaugaauugucuuguucaccuacauuuucuauaaaaaucacaagguagaccucaucugauccaagacuggcagauuuguuuuuaaagcuugacaaguagauuucugauugugauuuagugacuguggcuagaagguuccagaucugcuaggaacuuagcuacucacaguguuugacaagcauggcuacugaaagccuaacuaguacugaguguuuaaagaguggcaggaggggagaucuuccuaucucucagcuuuguuacuagucagcugugaaauugcuuguaaauugagauuaauagauaaguagccucuaugcuucugucugaggcuuuggaaauccccccauugugauuucuuguaaacuuggcuggauaaacugacaggggauuccagcuauuuauauauaauuaagaguaaggaaauaguaaauuuccaaauccccagcuacuguaaguuguagcugcuaaugagauagauggucaauucagugagaaauaccuugacccugcacauuagugguucuuaaguuguagguugugacccucuggagauugaaaggcccuuucacaggggaugccaaaggccaucugcauagcagauauuuacauuaccauccauaacaguagcaaaauuacaguuaugaauuagcaacgaaauaauuguaugauuggggggucaccacaacaugagaaacuauucgaaagucacagcgucaggaaggcugacagcccacuguagaggaacagucucguuaguuguucuugaggaccuaagcagggagaauauuuuaugguaagguuuugcuuuuauauuguauuuucuuagaaccaaccaaaugaggaaccucauugaggaaccucauaccaccuuuugauguuuagggaauuuuugugugugaaggggcugcugccagcugugucucuugagacgacuggaauaucucaggguuuaccucuggagagaaggcuuagagcagugcugccccuugcugcccguucagucuaauuaugugaucuucuuggcugcacugguuccuuaggauggagccaaggcuuucuacuugagggcagaugucaagaauugccuucuuaggcauggaacaggggcugcauuugguguccaguacaaaugggcaggcugcaucuuuuucugucugacaccucuguguaccccugguguuucuguuuggaucaucucucuguuuaggcuucuguuuugacugcugaggcugagaauggugauaggagggcugcauuggauuugggcauagagcugucacugcacuuuggccgaacugacuuucauuuuuccuuuuggaaagagacaggauuuuuucccuagacuugugugagaugggaacaaggaguggugacuuuuuaaagugaugacuugaucuuuucccuaccccaguuuucuccuaguuuuuuucuuauucccucccucugcccuauguuuggugucuguguaggaagaggguaugcauguguggaagucaaaaguuaauaucaggccgggugugguggcucacaccuuuaaucccaguacuugggaggcagaggcaggcagauuucugaguucaaggccagccuggucuacaaagugaguuccaggacagccagggcuauacagagaaacccugucucgaaaaaccaaaccaaacccaaacccaaacccaaacccacaacaaaaaaaaaacccaaacaaacaaacaaacaaacaaacaaaaguuaauaucaggcucucuucuccagucacuucuucaccuuauuuuuuuuagaaacagacucucacugagccuagaacacacuguuuuggcuagauuggcuggacugugagccuugugaucugucuguuuccauauccuacuucuguaguauagcugagccugacuuuuuaauguggguacuggagauuuaacucaggucccuucuuguacagucaucacuuuacccauuaacucaucuccccagccguugaauguuuuuugaggcaggcucucacauuauaggcuagacuagcuuugaauugaugguguagcuaugcuggcuugagccuuguaaucuuccaucucagucucccgagugcugggauuacagugguggggcacccuacucaacugugccaguuugguuuagcugauuguuucuuagaaggaaaccucucuagcaccccaggguacaaaggagauaagaaagggacagagaagucaaugugcuuuugaaaaauugaacuccuuaacuuaguaaaauaacaaaagaauuccaaaagguuaguuagguuuuaaccacucugcccccaagccauaacuuauuuucagaucacaaaccaguuuggucagaaguggacaggucucaccauuuaccugcugcuuaaccuugagucuccccggaugacgucaguacaguagcaucuuccuaagcacuguaacagguugaugggaaucaauuuaguuaaucgauguguagguacugcacagaugucagagucacacaagcuggaaggcuagcgaauguauuuucaggugucuggaaucuaagccaccugcuuauggagaugugagggaggcacauuuuggguuuuuuuuuuuuuuuuagauuuuuuuuuuauuagauauuuucuuuauuuacauuucaaauguuauccccuuuccuaguuuccucccugaaaauccccuaugcccuccccugcuccccaacccacccacucccacuuccuggcccuggcauuccccuguacuggggcauagagccuucacaggaccaagggccucuccucccauugauggcugacuaggccauccucugcuacauaugcagcuagagacaugagucccaccauguguuuucuuugauuggugguuuaguucuagggagcucuggggguacugguuaguuauuguugggagguacauuuuuaacuugaggccuuauaguucgaaggcagcuuuccuuacugcugaguccugggcugauuucuuggaguauagccagaacaagcuauacuuauuaagagcuuuggcagucuaugaggugggcuuccuggcagcagaagaugaaaugauaaaggagcgccucauuguauucagaugugugagucauauacauuuaugauuuacuuuaaaaaauuggacccauaauagaagugggcauagguucagcuugcccccccccccacuuuggaaguauucagguuaaagguuacuggacaugcuuaacuguuuuaaaacauaacauuaauaaaaggcuuuuacaacuaaaacugugccuaauuugaaaucaugucucuuaauuuucuuaccagcaggaaguuaagagagagacaggucugugugcugcucuggcaguuccucagaaauaaggauucggccucaugcacuucugaccuucagggaaugucauuguuguuuauucuguccacuaguuuuccaguggggaaaacugaggaucaggaggcuugucugaccuacccagagccagagucaacaggcacagacaaagucagaacuccuugggcacauccaccuugcccaggggacgggcucaccaagauccagugcuggacaagaagccgccucagccuucccccucaaucacuguuacacuuacauuacacuuacccauaaccugccucaguccauuucaaacuuggaaaugcuucucaaggauuauccuugauagcauaccucuuuuauugaaggguuuugcuuggcucagucaggaaacaucacaaugaauucuccauauggagcuagcuacuuuuuuucuuucaguuuauauccagcuuuauuuuuaauuaacuaugaagaauacucaccaagaacuuagaaaaaaaaugaaaagagcccuuaaaaaaauaguucccuggcaaauggguggaagggacugugcugagagaagagaauguucuccaugcuguggaugccauuuugucagugacaaagaugaggcacuucuggagcuccuccagccacaugcucagaggcucaacuguccucucacgugagaugauuaguguguaguauugguuuuaaagggagccuuggccaaggcuuaucauggaauccauggaguaaagcgcuggccuuuugugcucaucauagcuagcugggagaagauucacaggauuauaaaguccagcuccaaaggcagccagccagguuucaacauaugauucaucugcuguuacagugggcaauuuguauccauucugcaucuccuaaaacugcacauuuuccaggauaucaucugcaaacuguucagugucuccagccucuccaacacauaggauugagacucuuuucacuuauuuuaaagauauugucauuguucuucauuuggaugcuguugcugguagccacccuauuggagguugaugaggacauagguggagguuuggacaccggugaagcauuucaugguggcuggagguggaagacugcagguuccauagagauacacuuccugaucucauggugcaacuuuucuguuaaucauggacguccuuuuuuuagcaccuuuuuuuuccccagugcuccuccccccaucucuggaagaacaucccauuaagaacucuucugagacaguauaauaugucagauccuguccccauuuucuuaggagucauuugaagucuggaagaggaacaucauuaggaaaaguaaugguuuuuuuuuuguuuguuuguuuguuuuguuuuguuuuuguuucuguuuuucuguccucaguuuguuacaggaagcacacacugacugugaaagaggacaaacuggcaaagggaauucuugcucugucagaauuuagaagguugcuacuauuugaaaccaccuuuaaaggaacacacaguauuuuguagcuggagaggacaagguaauugguguugauguaugucuacuuaccagucccauugggucagagcuuuaaauauagcaucuuguuaaugucuuuguuuuuaugcuauuuucuuugagacaggcccucaccauguagcccaaacuggccuuggauucauaguccucccaccucaaccuucccagugcuagaauuacaagcugugcuacugucuucaguugggaggggguuuuuaaaauuugaaaaccaugucaacauacagaagauuacuugaaguauaacucuacaauuaaagaaaaauacccacauguccaccagucagauuuagaaaaaggauauugcugguaucuuaggaagucaccagguaucccacucuaucacauuuucuccaggauagcagccauaccuacccuuuucauuagucauuucuuuucuuaaguaagugcaagccccaguauauguaaggaaugggcugugugcccuugcuagacagaggcuccuagaacagcuucaugcccccgaugaaagucaguaccccugcaucugauuagauuggauguagaaaccuucuaaugagguagcuaugugagcagggcuucucagaguuugagggccuggaggacugaaacagcuguuuggaaugggagaaggugucaaggggaggggcagcucuucuuagcuuuuguccaacucuccaccauaaguaaagcagaauacuuuaguaagaugcucuucauagagucagagaguagacacggagagaaaacuagaguccugacucucuaagcuguuauaaagaaaagucuuguuuaguuacgaauguagcucagagccacccagaccuuugggccccugacacaugucuguagggaucuuguugaugacagcuuucaagaaaacauucuccuuaccccauucuuucacagggucuuguuuagcccaggcuggcagugaauucuugguccucugccucagccuccuaagugcugggaaugcauguguaccaccgugcuuggcuucaucucucucuugaacaccacugucugaaguguggacugguuauggugggcugugacuaacacagacccccaucuucaucucucucucucucuugaacaccacagucuuaauauggacuaacgguuauggcagauggcuaccacagcucccauccugagcucucuacucuaacccagcaauuccuggagccugucuugcuugguuauuucuuguguggacucugauugcuuauuaguuucuuggaaauuuuuuugagauauuucauaaauacugauugacucugccuuuuuauccgaaauuggugauuuggcugcguaugagcuuuuagguugggaaauuuuaccuugagaauuuugaggacccuggauggugguguccuuguuuucucugcagugcaguuguuuuaaggccucuuaaguauuuuaacgucuugaucgucagcguaugguaugcuccauucuucaucaggagauuacagacuuguuccuaguguucugugaaucucaggaaagcccggagcagggcugucuuccucucuuauaucagcccuuuccugcuggcuacuuuuggacuuguguucugggaaaugauucuugcuagucuuugcugaugauuuucauccuucugccaucucuugucuuucuuuuaggaacuaagaguugucaccaucuggacuaguccucuuuuuauuccuuucuugucucuuuucagacacaaacaauuaaggcuaaaccuugaccagacuuuucagcuaagcuuguaaaaauuaagguaugaucugugugcaccagaguguacaaacccaagugacugugcuguuuugagaguuguguacacaacagaacauuacaucaauuuagaaaguuccgaaaggccccuuucagucugccuuuuucauuuccguuuuuuuuuuuuuaagugguuguuuuguuuucugaaaugccacuuaagaaacuacucuucccuucuuggcaauuuuucuuuuuaucuauuugaacaguuucacauucucuguggagcacccccccccccccuuuuauacugugaguugccuuucucugucugcauuggcugcuuucuguaggcagcuguuuacuuuagcuguuugcuagggguggguguugagcuuguggcuguggcuucugaacuuugaacuucauuggugagacuggauugaacuauuagcuguuaguguucugaggucucuucuggugagauggugccauuacuccuguuucuagaguuggggaguggcugccacaucuuugagacuguaaugaggguguaguuugcagcacccagaguuuauguacagauguuugaugugcuagggggucccucuggcuugcuuggcaucucuagucuccauauccuucccagaaaauaugccuguagacucauuauucuuuagucacagcuacuagccacauagcaaccauuuggcuuuguuuguuuugguacuaaugguuagacucaaggcuuuguucaugcugaauaugugcuucaucauugagugacacccuuaacccucauaucauuuugaggugauugauauucacuaagucaguucuuugggccaguagccccacuuucagugcucaguggccagcuguuagacaggacaggugcagaacaguuuguuaucauggagaaguguacaggauagugcugcgcuaaaccuuugugagggcagaaggcuggaaacaggauucuucuccucagagguuuuuucucagccucuucucuacuugcuacuguguucuggugagugcacuccaggaaugcacgcugacaccuugaugcucgcuccguuggcuugguccucuguucugccaguaugagucuggacuucugugcucaugggcuaaguccuuuucccacacauccacuuucuuguccccaaaugcuagcugaaguuucuccugucuucuccugucaccaauuuguagauuugauccuuaaauaauaauuuaaaaagccuuacuuuauuuuacauaaauacuuugaguaggugcuucauuguagugggauuucagggacugauacuggacuggcguuuacucucacuuuaaccggggaucuugacucauugacucucagcucuacaaauaagguagagaugugcugcuauuuucaguuuucacugaagagacaggugaaaaaacugccucaaaaaaaucacaccaacaacugcuaagugggauacaaacuugcauaagauuuaccaagugggauucagacuuacauuaauuuaccaaguggaguacaaacuuacaugagaauuuguuugucuguuuguggccuagauuggucuuuaauagaauucagcgugcugcuucaaagucuagggggauuauagucuuguuuaguaucuuguguucggaaaagaccacuuaaauauuauaguuguguuuuaaagauauccaugcagauauuuuugcuuugcuaaaguccuuagugguucuuucucagagugucuguucucgcccaacuguuuaugucucgguuagucuaggacuuuaugccaguguccucccgcacagcugcugaagagucugacagcaggagcagucccuuguuuaauguaagccuuuauucccuaccucuaguuacugggcuggagcuguugccuaccuggcuuuaguuaaacuuuacuuuuuguaaagugaaucaugcuuaucuuugaaucucuagugccugccucaaugucugaggauuugcaaaugcuagggucaauuuaauuucuuagaaauuuguaaaaaguguguguguaugggggggggguugggaaaagggauaacauuugaaauguaaauaaauaaaauauccaauaagaaaaagaaaaagaaaacugucaacucaaagauuagcauuguaucuggaaucauuacuacauuaaaucaucauguagaauucaauuuuuauugaacccaaagcuuauuaugcuaacuguggaaaguauuuauucauacccaagucuguauaacuccuugccuaauaauaagacuucaguaaucucuaguuugcaugaaaaaggacaccuaguuuacuuaaauaaacagaagcaaaauuucuaaaaaauuuuuuguuaaaaggauuuauuuauuuugugcauaugaauauuuuugcucuuauguguggcuauguaccaugcgcaugccuggugcuuacagaaaucagaagaggucauugaguccccuagaacuggacuuacagaugguugugagccaccaugugagagcuaggaacagaacauggguccucuguaagaacagcaagugcuuuuaacugcugaaccaucuuuccagccccacauaauuucuuucuuuaaaaagauuuuugcuuauacuuugacaguuucauaaauauauacaguuaucuugaucauauccauacuccacuauccugucccucuuccccuguaucccuccucaucacauuucccugugucuccccugcccaccuucauaucauuuaaauauuuuuuauaacuuacugaguccacuuagugcucucugaaugugcucgggugcagggccaucuacuggaguauggguaaccugcuaagaacuuuuagccaaagaaaauugacuuuuucuucaacagccgccaucaacugucaauauugcucuucagcuagggguggggccuuaugagccccuaccccauucaugcuugaauguugccuggcuugauuuucugcagguaaucugaucucuuuuuuccugucuuaauaucuauuauuuuucuguucauaucagccccaugauauuuucuacuguggaaccuugucuaaucuauuuuuaucuagaauuacaagauugauucugcuuccauaacacuucaguucaagauaaaguaucaccuauccauaugugguaggcacauaaaaauuauucgacugaaacugagccuuaguguuaaguaaacucauggcaacagacuucccuuuuguugccuuugaaaucugacaugggcaggaguuccacuuuaagccuaauuucccagcacaacaauauuaucacccaucuuuacuuugaaguauuccauuauguggccacugcacuaauccaggauaucugagaggaagccugguuuuaccuuaugcaguggaauagcuaaaacguaggaaauacuugugaugcaggguuauuuuugaaacaguuucucaccaaucgcucaauuagggaagucccaaacuacaaucgggaacagucacuuuuccuacauuuucaaaggcugaagauuucauuuuucagaaggaccguccauugaguacaaagagcuguuacuauuguaggaaccaauucugcugccuuuuccugaugcuuauguucucuaccagucuaaagaaaauccaagagucuucugguucuucuuccguugagaccccaguagaugcuuuggcugccaugugcagcuggaguggaagccagccuucugaaagcagaaggacucaggguacuguagguuacuugguagauauuuagagaagaucuugagauauaggcucaucgccuuugucugccacuuccuagcaguaugaacuugggaaacuacuuuaaccuuucuuaaaacauaaaccguggguggggugagcacuucacagggcuagugcuguggucuagcucuuucaugcagagugauuaguccaggaaguacuaggcugguauuacccagccauucuaugguggguuguuugguuuugccugcaugcauguaugugcaccaagugcuucccugaugcccauggagaucagaggacagugcagauccccuggaacuggaguuauagguuuugggaauugaacccagguucucugcagaagcaacaagcgcucuuauaagcucugagucguguuucuagcccccagucuguaaaguuuuaguuacuguuuuuagcuuuaaacauagacuagcucagaagaugccggggugaguguugagcagacucugccuugcugcuuuguaauugcagagugcauguuccuaguuucuuaucaaugcuagaugcuucuaccuuucagaagaugggaaaggaaaucaauaggaagaaaucaugggagaccacagaggagaggaugguauaacuguggcugcuauacagcuguuaccuguauaucugccuucagaguuuugaacugguuagauuuuuuuuucaggauuaagggcucagaauuuccuagagagauacccuccccccccaccccccccccccgguuuuuuucgagacagaguuucucuguguagcccuggcuguccuggaacucacucuguagaccaggcuggccucuccugccucccaagugcuaggauuaaaggcaugugcuaccuggcuccuaaguuucuauccuuagagacccuaauuuaguagguauagaguaauuauuaaggaggaauacauguuuuuaaaaaguuccuaagauggggcugaagggauggcuuagugauuaagaggaucugaguucaguucccagaacccauauggcagcucacaacugucuguaacuugaagggguccaacacucucauauaggcuuaacugcaagcaaaacaauaauucacaugaaacaaaaguaaguaacucauaaaaaaguuaaaaaauguuccuaagagagucugaugguuuauuagauuugaggaucaucgauagccauucucuaaaauaucacuaaacacuuacuauuuaauguaaagaaauuuaacaguguuguaaucuuuauuuuagaagucagaagacagggguacauuauuauaaauucacugaaauggagagccuaaauucucuaaauuuaacuuuauuagcuauaauuuuaagcuggcucuacauuugugcuguuuuucaaaacuuuccuauguuuagauuauuuagaaggaaaaauaaagaaaauuauggaaaaaagcagucaaagacauaugucuagaaguagcuggugugguggcacaugacuguaagcuaagccuggcacaaaguggaaggaugaggcaggaaggucacccaugaacuugagacuagccugaucuguagacccugucucagaauaauacaacacauucauucguucucucuuucucucucucucucucccucucucucucuucucucucuucccucucucucucucucuacacacacacacacacacacacacacacacacguauaucaaauaaaaauccucagagcagacaacaaaaauugauauauaaacuuagcuauauuuucauuugaagccuuuaggaaaguauuuuuuccagaaauuuaaaagcugauugauguuauuguaaaagagaaagaaauucugucuguugucauugcuguugagcuggucuggguuauuagauuauuagauuaguuaauaaaagggcauuuggcaagggagcuagcaaaucugacuggagucuuagcuacaauaccauaauuuuuuguaaacuugggugaguuccuugacucaucucuuuggcaugcauuuucuauucuuuuugcuauauugugaguugaauauaagggccuuguacauacaagcaugcacuuggucaucacaauacaccgucagucccuggcacauacucucuuauguguaauagacaugguacuauuagccuuuauccuuugugaugacauaguagaacaguggaaagauacaugagguaaggguauaagugguggugagcagcuguauacccaugugucccuguuugccuaggcuuaugccuguggucggguguuacuaauaacaucucuuuuaacuguccuaucucagugugaaugaaaaauuuuaucuucucauaauuauugccacaauaggaagauuuuucuagccucauuauuuuagucucaaaucacucaucaaauauaacaguauuucuuagacgguuucuggcaguuuucuucaauuuuauguaugucucauuucuccuacuaaauugaugaguggaugggaauuguuucugugcuccugaauaauuuucuugauuugacgugacuuagguccauuaaaccuuaauuucccauuuuggcugguguguccagagaaagugccaagugcagaagagagggacagagauagagacauagagaaagagacggaggugggaaaagauggcggugagggggaacaugauugugagcugcauacucacaugagcaagugcugggguggggaaugaaugccuuuguggaggagaacuaagaacagggauacaguuuucaucucaugcuggugcccugauuacuaaaugcccaauauugauauuuuuaagugcucuauaaaucuccaagcauugaagaggccagcagaagcacugggagaucagauuucaggugcucuucuccuuacaaauauucuuuagaacuaagacuagaacauuuucacauucuucaaggagcagcacuccacacuagauggauagauggacaucuagauggauggauggguggguggguggguggauggauagauagauagauagauacauagauagaacaguucauugcaugugagcaugccacuuuuuuguuuuguuuuguuuuuuacccuugggaauuucagccaaauucauguuccaucuuuacugucucuggaaagcuauaaccugcauguaacuuuccaccagucuugacauccugauuuuugguuuuauaaauuuuguuguccuuagaugcuuuuuauaauguaucuucuuagcugggugguuuggcuucccuuuaauccuauuugugugucuguuccuuggguagaccuuugccagauuacuagaaaucucauuagucaucuaagucacagacaucaguuugaugauggagaauuugugaaucuucagcuagaugaagaaacccaauaucaaacugcuguggaagagucuuuucacgucaacaugugacgugcauagacaucucugccuccuugcaaccuacaagugucaucuuuaaggagaagacaugaagucacuguuuucaguaauuugcugugcauauuaauaaaaauaauucagucuacuguauuagguuuuuaauugaaaauaaaggugggccacccuaaaaaagauagauauuaaauuauaaauauuauauaaagagagcauugugguuuugacauuauuuugauauaauuauuugaaguauauaaaguagaaacuuugggguccucagaauuaaucaagacuauacauggcaacuuucaaaugaggcuuuugaugagguuuccugaauccuguaaucuugucugggaauucaguauauguuugccuuugggcuagacaauagcuacgucuaaucacacaacuucucuggauagaguuuauauuuauaaauacagcgugcgcuuaaugcugaccuuaacaaaacaugugcauguauauguauguguguguguuugcugugaaaauaugcacaagacuuagcauguacccuuccauuuuuaauagacuuagaauuugcccaauuaaaauuguucgaagagcauuuugcuaguauggagacuagguaagguaggacuccuaaccauuuuauccagaugugcaaacucaagccaacauagcugaugauccuuuacuagagaguggagccuugaguaauggaauagaaaccugacuuauucaacgcuccagcaguggaaugcauagacagcaacaguguaucuagucaugguaaauguuaguagaauaaccuuugucauguggagaucaguaagguuagcuaaaugcaagugccauuuugagagggucagggacaugagauugaagacaggaagcaugagccccuguuuggccucgacagagaauggguaagaauuguggauuaguaccuuuaaguuuugaccugaacaguacuuacuugacucuucuguauuccagcacuccuuagagaaggugggcauguuucaagugccugcauugcucuuccgguuaggggaucgauagaguccauuaccacuacccuuucuuuaccuauuuuaucuguggauagaugauaaaugccagauuccucugagcagguuucagguuccaacugagaaaaaucuguucuagaaggauuuaggcugagaauagugaagaaaacuucauaauucuacauaaauaagcaaaugcgauguuggugugagcagaaucuugcuagcuucuuuuguaguccuuaucccccggcaugguucuuuauuaaaagcaucuuuuaauagaugaucguguaugcgugugugugugugugugcgugugugugugugugugugugugagagagagagagagagagagagagagagagagagacuuuuauauuugaugucacucgagguaacugucuuuucaggaacucaauucucuaaaaucaaaaagcucucaaaaugacagggcugggaguguuuucuaacacacuuugcauguauguucauauuacauuugaaaagugcaaaauucuuuggcacccuggauauuuccuaaauccuuuuugcuccagaucugauaaaagcugacagguuuauaacaacacuacagcaguuugauacuuuccuacagaacuuauuuuagccuuuucacuuucuggucauuguuccuuuuuagagcaccagcaggacuguaugaagacauuucuauacaauggauacauaugucucugccucuaaaaugccugcuccuaucccuacauucugauuuuucuguucuggauuggguagaugaauccaaucaugcuccaaucagugauagccuaucucuaguuugucucuuugguuuugugaaauaggcuggucuggaauuuacagcaucacccaagcuagaauggaaauccucuugcuuuugccucucaguugucacagcuaccaccauuggucacuacgauuaaucuaacccucccuacccccaagauucacuuaucucucugugucuguguuuauguguacauuuguggagaccagaaaagagagucagauauccccuuuugucacuuucugccuguuuuauugaagcaggauuucucccugaaccuggggcuuagauuuuucugggauaagcuggaagcaagcaagccccagaaaucuuucugucucugacuuccuuggagcugggguuauacgcauaugcaggauggccugcuuauguguaugcuagaaccugaagccuggcacucaugcuuacacagcaagugugcuuaacuauugaacugucucuucagucuuccaaccucucuuucuuuaaaauaagauuuucccuggagcuggagauguggcucaaaaguuaagagcauuugcaguucuugcagacaacccaaguuugauccccagcacugacuuggaguccuacaaccaucuguaauuccagcuccagaagauaaaacaccuucuucugauuuccucacgcaccagacacacacuugaugcagaaucugaugcggacaaauacacauguaaaauauaaauaaauaaaccuaagaaucagauugcuuuugaaaagaaaaauuuccccaaacaaaccugguuguaaagguuacuggggaggcugagguccuugucccauggaugucccacuccuuugcagcauuuccucuuggccagagcagaagacuuaacagaagaaagcguuugaauuugucuacuugccagggugguaaaggaaaccacaagcacagaaugaaagaaaggagcagccuauaccccucucuuucaaagucaggggcagcaugcacaguggaagcagagaucuggguucaggaccaacauuuucuguugucuauucugagucagcauucacacagucuuucccgugugcuguuuauugaguguucauucauauuugucaagacugugccagacacagcaguuacaacaaauccaaccgucacggcuccugccauuuuggugcuucuacugagacuggagacugagugaggauacuuaguuucuguagcggugagaauuguugacugugggauacauuugaagcuaauacugauaaaauuaauaacaguucauacaugggaugugaugccauagcugugucaagacacagcugggaguuuguucaaacaauguggugaacacuggcgucugagacggugacugcuguuaaggagagaagugguguuggugugaacgcuaagcugagauguugaaaagguaguuggauguuugagaucagaguguugagagaaguaguuuuugcaucaucaagcuggauaugauggcuuugguuuucagugaagacagagagaaggugaaggugcaagucugagccuuaggccaacagugucugggacugggaagagaggaggcucccacuugaacacuugacugaacuggagacaccagaaccugacuuuucuccccuucaaauuauaacaguuguuucuugcuaaauuauauccacaaacauaggaaggcuguguguagaaaugauuuuuccacuugaaauuucuccugaaucuguuuugugauauugugugagaguuguagguuugauaacuagcagacguuuucaguauggacuuuguucaacaccgaggaauguggauggggacugggaagguugagaacuguaacagugucauacuauacagugcuguguguuuccaaugggaugguguuucagugugaguaaauacaaugcagaaggaucugugaccuuugucacugugagcaagauuguuguauucaagaaaauguauaugaagauaaauauauuugcaagauauauguguauuaguuauggauugcauagaguugguagcauguuuuuaugaauagauacaugcuaaggcucccaaaucccuaaaugcuguuagaacuugccauuuccccacucagcucuuccccucucugccauccucuggcucuggaaaccaggcaggguuuccugaaaagugggcucuguucugggaagacgcuguggcucacugccagugugucauauaacucagccaaucccauggugaaaagacaagacauguagagagauugggguagagacaggaaaaucaaguaggccaaaggagaaaacuaaaaucuaugcuaauggaagcugagaucauuugggaggggcuccuggaagguccucauucccugggcacuuagugucucuuuccuugugcuucugccuuuaugcccccccugcucucagcauaacuucaaagauuuguccuaaggaguuggacuacugaguaacagauaaaugucaccuucccuaggcauuuaauucuagaacauuuacgagaaguaacaauacaaaaacuuccauuuugccugcuuuugaagucugcucugauaguauugaaguauuagauuugaacuccugccucugucuguaucauuuuaggauguguuaugugaacaaguacagguuaggggggaggaaagagaugauggaugucaucucugaaaucugugcuuugucauguacccaggagauaagacccucucugaugaacuuuaggaauuuaaaugcaagaggguacagagaccaucugauagacucuuucaacuacccauuccaucaaagaagaggucccuagcauugugguacauaccugugguccuagcacucaggaagcugaggcugaggcaggaggguugaaaauuugaggccaguuuauguuaaagaaugauacucuugugucauuuccccaucuuuagaaaagagggcucuugagaaagaauuuggcagaaguugaauacucacauccaugugaugucaaaugcuugugacucuugcuguuaagaauuauuuaacucuguuuaacucauuaguuuuuuuuaauauuuuuuauuacauauuuuccucaauuacauuuccaaugcuaucccaaaagucccccauacccucccuucccuacccacccauucccauuuuuuuggcccuggcguuccccuguacuggggcauauacaguuuguguguccaaugggccucucuuuccagugauggccgacuaggccaucuuuugauacauaugcagcuagagucaagagcuccgggguacugguuaguucauaauguuguuccaccuauaggguugcagaucccuuuagcuccuugggugcuuucucuagcuccuccauuaguuuuuauuuauuuauauuuauuuauuuuacuauugauucucucccuccucucuuucugucucucugucucugucugucucucugucucucugucucucugucucucugucucucugucucucugucucucucucucucucucucugcacugugcccuaggacaaacaccacugcauugaauugugaagaguuccagcaaauguggcuugggaugauucuuugguuaagucauuucauguaaauuaagcuugauauuuuacuuuuuuauggucuguguccucauuuguaauaugaguagguagaaugaauuagucacuaaugucaccaauagcuaugacauuuucugccucugauuuacuaauuacaccaaccuuuaaaaaguguuuccauaugaaaggcuuuauuuuucuuacuccuuuuuuaucuaguuuagugccugccauguaaaaucauuucaguaaauguugaacaaauacauaccucaaggguucaggacaugggaccagugaacuguguuugcaggugguaaaguaaaagugaucuugucugugcucucaaggagcuuuccugggaaaccgggaugcuccaugaagaaagcacagaugagauuuugaaccgugaucaucuaugggauaguucugggcaagaucuuugcuccaagucaggugugcagauuagaacaaaagugguugcccuaaauaacuuuuacaagaagugucaguuagggucaccauacaguccucuuuuuccuaccaauggcuuuauaauacagccaacauggagaaacaagauaauguuuuuaguuuauagacaaaagaggcuuggagacuuaggguuuguguccaaguugacauaaccugugaaugaaaagccacaauuaggcugcacuucugugauucuaaaccaugagacuuucuggcccccaucaugccuuacuccuuucuucauccauucaugcgaaaagcuggccugaaacucaugaugcacuuacuucagccuccuaggaugggguuacaggcaugagucacuauaccuagacaacuuuuuucuuuuguuuuguuaugguauaucauauuaaggugaacccaggggaugcaucaugucuacucaaagaacuggucuuucuggaauagguuuccauaucagugggggaccauauuccucuaguguuuuuguguguaccaaaaugagcauaaaauuaucaaucuaaacacuguauguuguacaugauguguguaagucauuggcauuaagccauguaauccuucuagacuuacuucaucauaaaauggucaaccuuuauuccccauuguccaaauccuaugggugccccaaaacuuagcucugaauuugacuacucuaaauaauuaauuuaaagaguuuaaauaagucuaauauuagacuuauuucucuuagacucccaugauuuuguaccauauuaccugaauuuuauuauuuugcagcaugucauacuguguauccacccaucuccugguuaucugcugacagacauuuaccguuucugccucuucagagccuggccucuuagugaaauccugucucaagauagaaacuuguuuaaggggagggagggcugaugauguagcucagugguagaguacuugucuaguacuucugaggcccuaugcucaguacucaauaaugcuauauauaaugcaucuggcugcauuuauugauuuuugcauuugucuguggacacaaacaguugagcugauguugcucuuugguauucucuuagagaaaugcucagaaguagacgugccuuuauuggaauuuauuuugguggcaucauggaaguucugauuuuauuuaggggccuggguuuguagcacacacuugccaaucuguccacagcuggauuauguggaacacugcuucagugagguuucagaagucaucauaccuggcugggcacucaucagagacccugauaggugaugaaaccuguuacauacuccuggaacagaacgacagggucggaauggcagcuagagccccauuaguugcaacuucacucuccccaguucugcucaagugaaauuggucagaucccaaggugaagaccugagaaggucugagagggauucugagccaacaaaggcagauacaauuucacucaacauaaguuuuguacacacagccauauucagagaucugaaaagauugcaugucuguuuguuaucagagcauugaauucuggguaggaagguuaggucugggugagccgcacuacugaguaguagauguccuguccucugacuucugacucuguguuaggagaaugugugguaaaaguaauucacuuacuccuaggagcagccucccgagcaugcauaucugggcugcaggaucaguggagguugagucaccagcuguggaaugcugucuuagacugucugucagugaagccccaacccugcccuucagucaggaccaaagcugugggaaaguucugacucauucacauuuacacuugacucacagaaaaccucuagcgucucauuuuauuuuauccaaccaaauguuuugugugugccugcaugcgugcgugcgugcgugcgugcgugcgugcaugugcacauugugagugaaauauacaaaugauauuugagguuauuugcugagcucacuuuuguugucucuggauauuuacuccagagcuggugccaggguuggguggggguugugggguaggggagcucucagcaugguagugcaacggaugugcaucuguuagugaagugaugcuuggaaggacgcaugccauuuucaucagucuucaagaauccugugcauguacuuucccugcuaccuucugagucccugcccucacacagcacguguaugcauacaggauuugcuugugcugaaggggguugcauguucucaggagauggaucuguaggaaaaaggccaauuccuuagugggcacuugggcuccucuggaaccugggccagacuucucccuuaguuuugucugaucucuguauacuucuguucagccucagucaggguuuuaugcuuugccauucugucuucuuguucucuuccuaguuuucuuguuuagaguauuucccauaaucagcuuguauucucacauuucuugugucuucccaucccuaaaggcuccauucauguucuauccacuuccuuugcaguggucagagcauugcauucuuuccaugggccagguauuuugccagacauaucugucugccauauauaucuguuaucugucuaucacuuaccuaucuaucaucuguauuuaucuucuacagaauuaaaaaauaaacuaaacacuuaggauuauccuuauugcaagagaaaauucauuugcagaaaauuaaaagcugcuugaaccaagguguuaagguucuucuuguccugaccaaauuccccauguugguuccccucagaauuuuuggguuugacuguuagcaccuucugugcucacugacagcauucucuuuggucuuggucagguguguuguacauuuggcaaucagucacugugccucauuaggagguguggcuuugaugacuauuuuacuguguucuguucuucccacuaagcugcaugcagacuuuaccugaugacucugcguuuguguuauuuaaagaggugcaggagucagugagguauuucucuagcuauauuaacccaguuaggcauuuauacccuaccauaauguuuucuucaaaccauccauccucguccucuuuuuauacuuugauuccauagaaaauacagaccagacacacuguggcugggguuuguaucauuuuccugccuuguccuucacccucaaccaaaaagcagaaaaaguaaauggaauagccagucaauugaaggguuaucuguuagauagaccaagguuuuugaccagagugauagauguaggcaugcuguagaccuauguggaaccucaccacaagaucucaaagugucucauuaaguuaauuuuaccucaggacagaugccucuggguaccuuuucuaguuaagaaauaauuaaugacuucuaauuauaccacuugccacccagaacucacaacucacccauaguuccuguugacagccacacacuagacugcucucccuuuuccaguggaaagaugguugaaguauggucaaauuuuugaccagaugcaagguaaauaacauagaguuugagcuugucaaguucugucaagacucacugggaagugugaccauauguggaaauacaccacagguaaggauaggggcaauuggcagaacuucaaaugggucuccagccuugagauguaguuucuagcgcucuggggaaccaugguugacccuagaagguaacuaucuaggaggggacacuagugaagacggaguucucuuguguucaggcccuacccagaaaguuauguugcagugucuuuagcuuccuagugugggugaagaacaauuaggugagcuccagaggaaguguggcuugcuguuuuauacucagcugggcagaugcacauauuaaauaaagaugggaauagggaaaaauuuacucuuuguaauuuuguugaguauuuuauacuagugauuuucaaacuguagauccuuguuccuuaguggaaugugaaaucuauuuucagucuucagcauuuuaaaagaauauuagauggaagaaaauaggguagcauugaaacuagugaauggcacccagugaggguuagacucuuuuuccuuuuugcauuuuuggauugcagucucacugcagauauaaagagugaacuugcagcugugcugaaggaaauggguauggaguagggaagagaaggguggucucagcucuaccggcugcugcaguaggcuggagccuugaggugcucuguauggcaccagugccaucugcucagagcugugacugcaguuaguuuaagaccugugugugugugugugugugugugugugugugugugugugugugugugugugguggauguguuugcuuugacuggguggaacccuggguuugaucuccagccuggaagaagaaagaaguguaaccauaaauauugaucauaauuucuugacugagaaaugcuggggucccuggagggaaauuuuuuucuuccauuuucucugacuuucuuauuuaaaucuuauuuugaggcagcagccaacuuauguuagaucgcaguagaugugcuggggacuuucccagcuccucaucugucugaauugcuugcggggucuccuagguggucuuccacaaggcugcagggcugagguagucuucccuucuggguacugaguguucagggaaccaugcaggaagcagagugcccagcuggugguguugaugagccaugguuguggugccagcagugggggccguccccucacucucauucucccccuaccuacuaagaagugacagguuuguaccugagaaugccaaguggucaaagugugguuuccuucaggcaaagccaagggcuuugacggcaagcaagguucugugaccuuguuuucaugacauuguugaaauaacauuaguaaaaauuugucaacuuguggcacaauauacuuucccauauuugcuuugcccucuccccuguguauggacuugcacauuuguuugcacauguacauguguguguaguccagaggccaacuucaggcaucauuuucccuaggcugugcagugagcaccauggguuccucucugcccuucuccugugcuugccuggaagcugggcacuaccgugcuguuccaugggugcuggaaaucugaacggagcuccucgcgcuuaugcagaagauacuuccauugguagggagcccuagagcccauccaguacuuuuucaccuugcagaacuugagucuugagauccuagaagguuugcucaaaacuaggcaagaccuggccauuugucucuccgggacaggcuggcgcagaguuuuuugcagccuucccuguuuuuccguaauauccacuccuuccaguuuuuuccuaugugcuccuuccccaucuuccugguccaggcugaugccaugcugggcguccuuucuuuucuucccgcucuuuuccagaacaguuguacaccuaucuccccuucucaguuuugauguuuccaggcugggagcugcuccucucccaggugacauccaagcccaagccuuacacugugccuucuugacgacacacucccuacugccaguucuuggcauccuacuaaguguuccuccagauagugaggcuccuguuuguuuuaauagcuggaaguaagccucaaggcuuuggugaacaugcuguguucccuguuugucuuuggaucucuugcagccugcaucuuuuccaggaggaauccagcaaggcauuggacaaggaggugugcuacuuacuggcaguugaucccuggaaugucguaagccaggccuuuucauguguugaaggaacugugaauccucaauauugucaaagauuugaaagccucuacuagggacagaauguguaaauaaaugcuaggcuuuauuguuaugggacagaugcuucaaguacuuuagauaagugucuaggaagugcugagugagaccagguaucuguccaucgucucccuuccaccccucccccagcaccauuuagagacauggccucauuauguaauccaggcuuggcacuugccuuggaguucuggcugccuucaaccucaugguuauucugcccccucuuccuaagugcugggaugacaggcugugcugccaagccuggcccugcuuccccuuucugcuuauccacuucugccaccauaguuuugaccucgaggagaacuguggagauggcuucucuaaaucuuaucauggccucuuuaauaacauuauagauacauuaaugcuaauuaguuuaaaagagggaaaguaaagcaaaauggagcugcccagcaucuugaugcaguguggcuuuuaggaagacacuuacugacuuuaauuaaacaaaguacuguuugcucugucagagaccuccucuuugacuaaagcagguucuuugggaacaaggcagagccgacccauugacuuggcauugaucauuugcucaucccuagaaguuuauuguaaaugaagcagcauuuacuguugugugguauuccuggaaucgcugcuauaguuagaaguaagugauucugugugacaggaauggcauagagaaaagcuauaauucugacucguugacagggaaaaaugcaaguuuuguauuuauauuaugucauucucuuggcuagaauccagcagcuuuacgguuucuugcugagcucucagcagaauguuacccaucucgaaacgaagugcuggggucucgggagagacagagaaagucuuucuguaaugcuguggguaggaggcacuggucgugcaacuggaagacagcagaugguuuuccuggccugugugugugaagaccuuaagaaaguuccauguccaggcaagguaggccuguguugaggaagcagaacacugcuauuccucuaggguggcugccaugcuggaggggugggcuggagcauagucaggguggggcaguuaaugacuuugcagcucccguuuguuugcuacagggccuugcuguacagaacagguuaaccucaaacuuacuuuguagccuaugcuagucuggaauuugugagccuccaagccuccugggugcuagauuauaggccugugccagcacacccagcuugauggguucuuuuugacaguaccuuuagaagacuugcaaugacaucaguguccgagguggaugcuagauugaaaacuacuaaacagccagagaagacagggugguggcgacugaaggaaagggcaagguccuugaguccggagcugcacauuaggacugcugucccucauacugauuagcccaacauagcucagacuuccuacagauugaaguuccagugguuuacucugucauaauuugugaagucacuuugugcauauuggggcuccuccuugaccagaacuguauccauaaccauaaucagaugaacagaaauuauggucaaaaucaaagguuuccugagaguugaauucuguuuugugauauuuagcuccugccgguccugugaaauaaauccuauuuuuaucucuucacuuguacugugaauauugaggauguuaaguaacuugccagggaagccagauucaagucauucaggucacuagaacuccagccuuuguacuuaaccuucagcagacuauuccucagugugggaccaggauucuguuuauucugcguucuucccagcaggcucccagccuggaguauucgaaauuauauauauguauuuuuucauuuucucugaauuugucaacauuguauugcuauuuucugcuuuagaaagguuuuugauuccuuaaaauaacucacuguagguuagaucuuaucuuuuugaaagucaguauuuacaacagacuggacucuaacucaaagaggcaucugccucccaagugcugggguuaaaaggcaucuaccauggcaccuggaaagauagucucugcaguggaaaucaccuaggacaugcaguguuuuguuuagauuuuuauccuugauuuaguuaugacucagucuuuuugcuagacaaagcuggcauuggccuuuggcucggguacacuugaugauagcguucuggagcauuagaacugucuaguucacuuucuguuuugccuuccaucuaaaauucaguagucucuguaucccuuauacaaauauuaaaacuucaggagcuauguggauugucauauagaaggugcuggaacuuugccuguuuggaagugguuuugaguuggcuguguuuagacucacaaaacuguuuuguuuguuuuacuuguccaucagucagaaacuaucagagauacugccacauacauaagacggugauaaagaaucgagaagucuguagaaugucucugauuucuguccugcauaaaccaacaaaguaacucucuaccacugaaugacggcuauuuuucuuuuacaucuuugcuuguauaauaggcagacaagcucacugcuuuucaccuagacacuauggguugcucaucuuuauugguuccauuuucuaagcuugacaauuauuugaaguucucaguaaagugugucuuuuaaaugacauucuaugauuacugcuggcccguguuuuuggcacagcagauguucucuuguagugagaaacuugacuugguuuuugaagccaaugaaugauuuuacuccuuuucugcuuucucuacaagugaccagguaaaucagagucuggcuuauuuuugaaauguuucuuggaugaagccauuguacaaauguaacaccaaaaugacuugucaucaugaauaggggcagccauccuuucuugaaaguagauccauagugcuaugcuugaguugcuuaguguaggucugagcaugcuuuuuaaaugcugugugacuuauuuuuuauuauuagaaugucaguucucuaagaguucauuguauuaauucagcaugcaaaaugccagaguaaaauuguguacugucuaagaauccuguagcuaaccuuguuucucagaguucagauugucuuacaaaucugagcuacagcacuggaggucagcuugaagaugagauacacuaguauugcuguuucagauggugcuuucuggauagugcuguuugcagcagauauugaagaaugguaaacacguuugccaugguuauagguugucauggcauccugguuguaggagcagauuaguaaguacuaaaagugucuaugcaguagcccccauagaaggaaccuuggccuggugggaccaguaaaaucucuucugcucuaaagggcucuaagucuaugagccuuuccugguuuagaacaaguuucuuuguguuugaaagcagaguuccgugccugguaaaggcaugcagcugugcccuuagcaaguuuugcucaugcccagugugaaaaggaauaauguaggcuuccccagacgagcguucucacugccagccuuugcacacgcugaugcuucugcucagacugccuucaccugcuggugcuuucaacuuuccucucucacucucuucccaaccaucacauuucaguucuguauuccugcuucccugagccccaggcuguaucacacuguguaugcugucugucugucugucugucuguccgucugucugucugucucugucuuguucuacuguucugcaggugauaagcuccacaugggcagggaccaacuugcucuuuuccuaguuaguucauuuuacgauauggaaagccaugcaaaguggauggaagacuucuaacuguggcuuuugaagcccugguucugcacaaagcacagacuuaucauuuagugauuuuccagugucacaugaaacaguguaucuacuaguagucuucaagcacuuguccuguauugucauuuuuuuuaaagguaaaggaaaacugacuuguuauuucaguauuuuugaagguacuuguauccuaguugccaaacagaaguugucauaucaaaauuuacacacaaaauuuccugcuuggccuauugguuauuacuuuuuaaaaacuuauuuuauguuuuguggcuagaauauuuugcuugaguauauguuuaagcaucauguguuuaccuucagauccccaggaacuagaguuguggaugguuaugugacacauguggaugcugcugugcacugugcagguccucugcaagaacaaauguucuuaagugcugaaccaucucucuagcucccaccaucaauaauuuuuacuaaagccucagccaaugcaggaaggauucuucuacuaucucuagccuaucagcaaaugagugggaggaacacaacagguccugugguacucucuugcuuuuggguuuuuguucauguuguuucccguggugaugauguaagaugauggagacugcugcuaaccacuuucaucucuugcuuccuugcucaucccugccuugugcuggccagagcuguacuuuucuacaagcagauucugauaaaaauguucuaacuaauaaauagaagccaacuuugaguccauccacugacagcugcuguuggaaagacccuuuguagggaugagcuccuuuggugucugcacuggcacuccuggcaucgggagagaggcguagauggcugcucagaggacagggcacucuacaccuggaagcaaaagugcugccuuccuuucuugacucugccuucccagugucucucuuagucauugccugccccuuucuucuaaaugcacuuuccuacacguaugggcucugcuguuuccuuagugaaaauaccuucuuauuuuuaaaucuaauaaccucugauuugauuuauuuuugucucuagaucagcucugaaugggcuuuggaagguaaagaagaaaauccagucugcuuucagggacacuggacaaccgaauaaaugcagguaugcacauuuccuucuuuuauucuuuuaggcagggccuuacuuggaaguccauacucuaugaacuuaagauccucccaucucagccuaccuaguauagagauuauggcuauacuauugcaccuggccuuaaaccgugacacccagccuguagaacugucuguguucugaccugacugucugucuaaucuguauauuauucauucccaguguuggauaugcuaguuuaaacauuucuucacugcaaaaauccaggaaguaaagugaaguucucuuguaaccucuccaggacagcuauacuguuaccagggucucaucuguucuucuagguuucaaugcacguuguuacucucaggccccaguacaccuguugugcucuuucacugaagucauccagugcuggucauguaccuuuaugacuacaguuccagcagcuggagagauaccuuguauaguagacccucuccugucagaaguuaucacugggcauuuucuugcuguugcucauagcacuaucuacaaagaaucucuaagacagagauuucuuuugccuuacacugugaagcaggcuuaaaacacuguugauuuucaucuugguuuuucagugugaucaagugcugggcuuuuucaccuacuguaggguaagucauuagcuuagucuucagaccgauuucaagaagauucugguuuuuagauuacuugggauauuauaaauuaaaauugaauaccuggauggugucccuuuuaaauuaucucgcuuccuaaccccacgacagcugauagacuaagcaaauggauuuggugcugagaguuacgacaggauaugcuguguaggacuccucaugucuggggaguuccuuguauccucucccaagugcccacuguaggcaagccucucuguuucauacuggguauaaaagauaaauacagcuguuaugcucagagauucucacacacacgcgcacacgcacacacacacacacacacacacacacacccacacacagguguggcuagugugauuacuuugggagcacaggagagauagcaucagcuuaaggguacaacuggggcccagugaagcaaucuugauggaagugcuagugugggcagcuuucugaagauugaacuuugccaugaaggguaagaggcaaguguauuucacuaguggaaucauuauaugcagagauggcacagggggaagaauggguggugugaagagacaggauaccugguggcuuggguuucaagcaucuagaagugagaggagauggggugaggggccagccaaucaggaguguguagauaaugaguaacuagcagaaggucugaucuguguuacugagauaacacuugggcacucaagugaagcugaggcuggcaggcaggaaggaaauacuuuggggacaggaaaauggcugggaggucauugguguugcaagggcugcaaggauaugugggguuccccuugcucucuuccuccguugcccuuggcuggacucaauguccaggacugcuacuuuaguccuggcccacuuguuuugagggccuugugagguuuuccugcaaagagcuuaccugugggucuuuccuugcaugagaugcuugucuuccugcuucccuccagugacagggaccugucccuagucaucaacuuucauggcccuuccaugugauuuauagugccugagugguagucgcuuuguguacagugccucagaugacgacaagaacgaacgccgagaccggaaagacuaauucuuucuguugguugcuuauaaguuacaugaccccaggagaggcagcaauauucaguccuuuaacaucagugacuccagaggagagcuuccaacuacaacuaguaugcaaauacagaagauaauucaaauccugcuuaagauuauucugacuguugagaauauggucuggcuacuuaguuacugugcauaacuaauuauuucuaugguuucaucucuuauaagucuggucucaguauucagaaaggaaaagccuaggaguucucauccagucucacagaugccugcuugcuuuccuccauagcaaacagcacauggaaugacuacauugucugcucuuccuucccgacaguaucuaaauauaaaagaggacugcaaugccauggcguucugugcuaaaaugaggagcuucaagaagacugaggugaagcagguggucccugagccuggaguggaggugacuuucuaucuguuggacagggagccccuccgccugggcagcggagaguauacagccgaggagcugugcaucagggccgcccaggagugcagugaguacuggcagcagggcugggaggcugcacugggacacugggagaagcacauguggagccucuccucuuuuuauuucugcugagagcaaggugugaguucuggaagccaggguccugccuuguuuccuaauccuggaccuucacuucucacugaaacguguauuucucccuuaucauuaacaagacagcuguggaauaccaaggaaugacccuugccuucuguaaggcucagucuugugggacaggcucauguuauaguucaggauguucuagaacucaguaaauagcccaggcuggccucaaagcuguauuccuccugauaccgacuggguacugggauuacaaguauuuaccaucacacucagccaaagcucuguucucuguucucucacagcucuauaauugagaugccaucagcacuagcugagguucugugcaaauguguaucaauucaguaguucuguuuccuaaccuaucgcugaacauucagauuccuugaguuuggcccggucuccucuuacuuggucccuucugccacuuugaagugagaauuuuaggguugccccauggcuuggucuugcuacauugugaaaaggacacaauucuuuuaaaagugagauugguuuauaaaaaugcauuauguuugaaaaaugccaugaugacaccuuuguauacuaaccuaaaaauuaauuuuuaaaaaaagugaggcuugcuuuacuuaaaguuagcccauugcuaaugugagagaucaaaguaccuaacaaaauaaaucuccuuucgucauccuccagcauggaggugcaugguguucacccaccucauuuuauauggaaaguaaaguaaagccaaagcgccauaaaacggccaccuaucucacacaugaguuuacucaaguccauuggaauauacauguaggacagguggguuauaguggcaaacuguauuccaauaaagccguuuggaaaggauuguuguagaucuacuuaucgugaugagguuaacuugcugugaugcugcagagccugggccaugcucugccuaggccuuuagcuuugagagcaacauugugggaauguuguagucaguuuaagauccugcuaguaacauagcuugucuggaggccucauuuacuucccgauacacaucauucugccuaacgugcuuuacacaccagaacaccaacagaagggucuuuauguuacaggggaagaauaugguaggcucuuacuacccuaguacugcuacauggcauuaaauggacagagcucuguguaaugugggaaaaggaggccguauuuuuaaguaacucucacuagacgguaguuuguuaggaucugacaguagagauauauguuccucagaccaguguguagagaauagaugguaagucuucuguuaauuugaaaauacauaaacacugaaugucacagacuuuuauagcucucauuggugauugcaguaagugguauggggcagugcgcuuuccuuuacacucucaccuaacucucggaaaguuuuucuuguagcuuucguuguuuggcuccugauaggcccagaagcaaggcaucuauuuccuaaucugucuuccccaccaggcugguuauuauuaaaggagcacagaguguagugggaaggcggaacacuguugggccagcuuuguuaagaauucuuccugcuaguuaauaugaauaaauacauuauaauguagagaguacuuaaguguguuuaaauauuaaccauaauacauuuuaaucacugacaaagucacuguguuuauuuauucuaauauguaguuuguaugguggccagaaacaacuuugcauauauaauguauagucacacugucagaauuguuuaaaauuguagggaacagguugaggaauuccuaccuuccucagaugucuguucccuugcugugauuuaaaaggggcacaucagauggaaucugugggccucugagauagcccuuuuuucuuuuaauccaaguuugguaagacugcuguaaugagaacuguaucauuuuauuuuuaaaugucuuuaauuugguuugccaggagccaccguacaugcuccuagggagcugugauucuugauuaacaugauuaaaauccccugagugaacauagcugagaguugcaucugcgcugagaggaugcaggugacagagauuguuucuggaugagagaauuccuuaucguuguguguugcucuuugggaacagauggccaagugcaucugccuguaacuuagccauguccuuucuucucagguaucucuccucucugucacaaccucuucgcccuguacgaugagagcaccaagcucugguacgcuccgaaccgaaucaucacuguggaugacaaaacgucucuccggcuccacuaccgcaugagguauagcacagagagcuggugccagaggguuccucgcucguguuaccuggggcaguguuuggccggggccccagucacuuaggaagaaguaguagaguuacuuuauuuguuugcuucucauucaagaagggacaccuuccguguugcagugcgauucagagugaauuugaucaccucucacguuuuauagacaugauaugaagauuguuuuagauagaguucaagccuucuagcaguuuuccacgcggugagucaugguuguagguuuaacauaauggguuauaaccagcacuugaaaaacaauagaaagaaagaaacaagaacuaaacacacacacacccuccuaguauucuaaggucauuguauuuuaaaacuucugaggugugaaauauauaugcauauacuaaguugugauauaaaaauguuuccuacuaaaggcuguggcuaagaagcaucuguaugucaccugaagagguaacagaaauaagugcucagcccuccucucagggaguggugcuuugauccacuccugacaacauuggacucucguugcucuuauccuucguguucugaugagcaguucacuuuucucccacaccagagauuuuguuaaaugucccaaggucacguagacggcuggugcuuccauucauauacacacuuuugacuuuguaaguguauugaggaaauguugugggaaugaaaccauuuuagauggcagugaagcacaagcuaauauaugcuuagccaugaagcuuguaaguaggcuaggcccuuucugaaaagaaccuugagcuguguaaauaugguuaaggcaguagaucaccucagacacuaagaaggugccaggucacccuagaaacaccuuccagaaucuccagggucuccagaguacuccaucugucgccuucguuaaguguuggcuguguagcaccaugccagucugagaggcugaauucucuucuggcacucaucuaagcucucaccuuguggggaagcugugugcccugugagauucugaccuggcuauagagggcccuucagcccucccagcugagccuucucacuauauuaguuucuuuuucucacgcugaucuuacuucccacagccuggggcuaguucugugaucaaaacugugagguggaggugcagcuagaaacuuagacagggacaugcccuugaggucuaauucuuucccaguaggcuuuuuuuuuuuuuaauacuuagaucacaguccaguauggcugcauuuagcauuuacaaaagacguaagcuugccugacucaaugcucccauuauuccagaggaaacugauggacuccaaugagaaggauuuggugugcaguuccacaccuaguaaacagucuugguagugcggcaggggcuugucuucauggcuacauguggcguucagcugcucaccauucuguuagcugcuaggaagugcgcagacuucaguucugucaccuggacuuuaccccugccagugugcuuuaacaggauauugcuuuguuaccacagccucuuugaagcuggggaaagauaccacccucagugcagacauuugugguggaacagucuacaaagagcuugagagcugguacucuaaccacggaagaagugcaguaagaaaacaagucuagugacugucacagggccaucccagcucuauuuuagucaugccuuucucuuuucacuuaaugauguggaugguuguuuaugauguacguuaauauaagacagccauauucuuuacuuguauucaaggaaaaauaaaaccacaagugacaaucaccgacuucaguaaaauucuguagaaacuuaaacuucucaucagguccagaguuuaaauguaaaccaagaauguguacucaucucuagugucucucuggaacugucagguucuauauggcugguguguugcucucuccuuccuuccuuccccaucauccugaaagggugugugugcucuguggaugccacacucacucacucccacuccguuuuaacuauuaucguauuaucaggacuuacguauacaaaguucaguaagcagcaugguguuauguuggagcuggccuagucagugaagugcuugcgagggccuggguuugggucccacccagcaccaauauacaaagccagacaugguggccuaguuuugcuuuauuagcaauuacgguuuuaauauugguaaucaucuuuuauuuuuaagucuggaacaguucacagaugugugugucgcccuugcacuggauccaugcuuaucucuguaucguuccaauuuuacuauuugugcugacaaagcaagcaccccacccccaagcguauccuaggcaacuuggcuagccuugaacuuucagucuuccugcagaagccuuccaaauuacuggaauuguaagcaccaccacugaaccuggcuuuccauguaaagauccuagauggauguggaaggaguguguaugggcuggauugguucagagagcagcugucuucagugcuucucucagcaagcuugcagggaacugccaugcugaucaugaugcuguggcccucacaugcuuuuuaucuaccagaauguaccuggccuaugugcucugcagucagggcccugguugaaccuuuguagcuggccaggugggucauucccuuccugcuuaugggaagaguggagcuucacugacuccuuucugcugugccccguucuugugaagaguauacuauagggcccaggcccacauaagcaugucacugcacuggugggcccuaccaauugaaaucuggucuccuagaacauacauggaacuuaaggggauaguuuaccaucugcuuuggagaccugguguaguuugugcagcuugugguuguuucugcauucaagacacugauagucagucucccaguuccuuucaugagcuacagagaagacaggcuguacacaaucauggaaagcuacaacacuguuuuuuaccauuaaaguaauaguuccauccugcccugcccauguugacccuacuccuugaguuuguuguuuaucuguaaacuggcaucacagacaaacaacaagcaccugcucuguggcucuggggauuuggugcugagcuagacagcuguggccugcugucagggagcucuuacuuugcccacacuguuucaaaauguaccuguuuguuuccuagcuaauucagccagucaucuuguucuugcagaagcaucuugccucauccacuuaccuguuugccaucuguguucuagagccaagcauguccaaccuguagccugcagguugugugcaucccaggauaauuaugaggguaguucaacaaacuuguagaugauaauguuauauugcaauaucaaaagguuggaauucugguauggcauucauuauccuggacaaguuaccuauuaaacaugguguuaagggcucaccguauuaucaggcguccaugaaaugcucauguuuuauuucuaaucacauuaaacugagcuuaagucaagcugugaaauguaacucuugacagauauuuauagaggaaaagagauguggggcuugugaacagugcaguguaguucugcuugugacaugugucccacuuccuguuguuuuguauuauuguggggcagggaacucagagggcagaggcuaugcccgagagcccucuguguccuuuucuggcucuguuguugucgucagacuuucauagcagcucuuuagggugggaguuguucauugcuucucagugaaauggcugcuuuucugucaacuuacuggcauauuugggagagagccccagacagagccgagucuguagccugaaagacagcuggaccacuuugguucagccacucucagacagcuuagaacccauucugucuccccaacagguagcaggccaaaggauuagugagugaggcuuggaggguuaggucaccucaccucagugagcuugaguuuuucucaucugcauagaggaaacgaugaagucugccugcagguuuugcuguuaggaguagguggauagaggggaaagugcugcucucuuuuagcgggucuccacaccugaugauuuuguguuucauuuuugaagcuuugcucaucguaaaauacaucaccaauucaguaacagccaucugagacccgagaaacacuacuauauuaguguugauuguaggacagagcuugauuucagaagugguaggaccacaauggagagagcucaggccgggcagcccagcagaacuagagaugugaaggagcagcuagcuguagguggcaggugguguuuucaccuaggaagguauggaagacauuauguaggucagcagaauuguacugugaccaccaggacaucauuuuauccuccugucccaagagaggugcugagguacauugugacagcacacuuggaagagagagaagggauguugccucagggugaugagaguugagggugcaaggcuggugucuucaguuuccucagggcaguucagcuucagcaagggcuacucuagauagauaccucucccagaugagcaguccagggacuccuccaccacauuugacauuuuuauacugucuuuuagguucuacuuuaccaacuggcacggaaccaaugacaacgaacagucuguauggcgacauucuccaaagaagcagaaaaacggcuaugagaagaaaaggguuccagaagcaaccccacuccuugaugccaguucacuggaguaucuguuugcacagguagggagcuugagcuaggagaucuaaaguuugugaggagugugaggccugguggggcucagagucccugugcaguugugcuuaguggcacuuuauggccuguucucagaugcccaggugacugggaaggccguaggcuccuagcuaugggccuuccacaccaguuacuuucuuuccacugcuuucuaccacuuugcuuaucagcuguauucuacaugagagggcacagaguagcuuuugaagggaagugagguagcagccaggccaagagaggcuggaggugccuggaauugcauugcuucgggauagcuagcauguuugaugcaauguuuccugauuucaaugucaauuuucuauuaccccauguauacugcauuuggaaauaccauaaugcccauguuauuuauaaaccgcaucuuuauucaucuuauuuucaucuuccuucucauuuuuuagauauccauuauaaauagugaucuggcuggacauggugauguguaccuuuauagucagaggcagaacuauagcaaaguugaggccagccuggucuguauacacauacacacacacacauacacacacacacacacacacacacacacacagggccaugguuauugugagaucuugucccagaucgacucaucuuuaauggcuucauaucaauucauugauguaacaucaaguuacacagguguccgugucuuguuugcuuucugcgguuguauuugucaagacccuggguacuuggacgaaacaauaugguuucugugugcccccauuauauccucaagugagacaaaaagaaacagugaguuuguaaauaucacauagauagugcacagaaaaucaugagggucaggcauuccaucucagacuugugaagugccguaaucucagcacuuuaaagacucagguggugaguuugaagucagccuggguuacacagugagacugacuuaaacaaaaaagagcagaaagggacagacuuuagugauagagccuguggagcggcuugaacugggagaacucaggaagaaaggaggagauugcccugcuucaaggauggcuccauccuugcuuuagagucucaccuucaggagacucagugucaguuacuugagguuagagcgcucacagucagguucucccuccucuuccaagaucucagcauccaucagaguucuugcuccuccaguacuguugguauaaauucuuguucuuucucaaaacuuuguggaaauggccagugaccuugcuuuaaccugaaagaaaaaaccuccuacuauggacagaaagaacuucagccuaucucaccccuaagaaaacaaagcaaaacaguaaugugaaacugagaagugcuuucaggggaagugagucaguagaagccacucugccagaugcgcucuugccuggauagaaagcagcugggaagcucagccuccucggcgugggaaugccuagcagagaguggugggcugugggaguguugaggaaaggcgcccugagucaggaucgggcucgccuuuuuuuuuuuuuuuuuuuuuuuuuuuuuugcaagcaucuaacauuagugcuuccuguuucucuucuucagagcggaccggauguugugcucaguuagauuccuccccuagugggacucugacagggcuguugugaggacuaaggugaaguaaaggaacaacucccaugucuggcagggagggagcuuagcggcuagggagugugagccugcacugcccaucauugcucugagcaaggcuagcuguggguacugguucuaguccaguuuuacauacuuuauuuuauuuuuuguuuguuuguaaaguccccauugguuuguggaaugcuauguuccucgcuccaucugugagauagugugcucucauggcguucuucuguacuagaaaugugaauaacacauacggaacaaacuaaugguuugugguaaugaugcucuguggaauguaacuccuuccccugucuccaaacccauaauaguacauauuuaugaaauuaaugcugucagcccgugucaccugccuugcaguugagaccuaauagucacaguguuuaggcauuguuaauuuagaggccccaugaagggggggggggggcgcugugaaucuguguucuucaccagcaccuugacagguacucaguaaauacucacuaaaugaauggaugaaugaaugaaugaaugaagucaucuaggagaacauauucuuagcugccuugugcuccacuugagugggaacagccuugauccuggagacacacugaugcuucucuuugcuggguggcauuuuggccagcucuucucucuaggucagcaugguggcuccugaagcuuagguggugacucaguuuuucucuucucugcucccaagggacaguaugauuugaucaaaugccuggcucccauucgggaccccaagacggagcaagacggacaugauauugaaaaugagugccugggcauggcgguccuggccaucucccacuaugccaugaugaagaagaugcaguugccggaacuucccaaagacaucagguacgccuuccugaugauccgagucgguuguaggcaccugguacugauuugggacauuguuuuugaagcacagucuugcuguguguagcucaggcuagccucaaacucauguucuuccuuccucaaguaccuccaaguacugagauuacaggcauguuccaccucaccuaacuguaaugcuauuuuauaugcuuucauauaucuuguuuggcugcugcacuguuuuucugacaucucuuugcaugaaucaaaucuuugaauauuugugcuaaguagcacauugaacauuauggcuugauaugcuuuaugcuaacugauaaucucagaaaugugaacuagagugaaauauccaggcagaugagugaucugcauguccuccaugcuuccugucuuucccauggugauacugcugccuguuggaacugccuucuuuaaucugcacucuggucugggagcuguuacuucugauaggcgggacggucaguuauuuguuucagaaaauuuuauauaaguguggguugagauuaauauuuugucugcucagucuaucucugaaauugaaucaucuuuccacucaccaaugagcugugagauagcacaagcugcgccgguggcacaugacuuggucccagcccuugggaggcagaggcagaggcagaggcagagacagaggcuggacgaucucuugaguuugaggccaccugguccacacaggaaguucuaagacagccaggauuacauaaugagacugugucucaaauaaaaaaaaauaauaaaaaagggcugaaaagaaaagacaaucccauuuuaaagagcuuauuuacaaaggauacagcacaaugccagagcugugucucacaugcuugagcuccucguuccuuccgcaguaccacagaacgggguucacccccagguccaccgcuccaguaugaaaggagaguuuaugagagugguaugcacaugucaugaggugaucuccuuuucucuuuguguugucaguauccagucgcuccucaggcaggggauuagacauuuuccaggucacuuuuaugugaccuucacuccuuguguuuuauuuuuucagguggcuuaaguugacaacuauccuguaauucuauuauauuacuuuuaagagaaaaacuguacuauuugcuaaagauuggucugagaauucacaguaugccucaguauuguuauagggauucuuugggccaguuuaccuuugcuugucccaguggacaaaauauagaaagaacuaaaguaagcccuugcucuuucagggguauuaguccuggucuuuuucagacuaucuccugccuguuagcacggcguguguugagaucugauugcuagagagccugggacaaguaacgaagcuuggggaacuugcacagucacaugggagauacuguuuguaucugacauuugugaguuuuuaaucaucuucauaagaaauuauauaauuuuuagcgaacaggaugcagacaggcaggcagcguagaauguguuaaucuccagaggagauuaaggcacagcuugaugcuuuucagaacauucuaacucacccugaagcaauucucucuaugacugaggauagccuugaacuccugguccucuuaccucuaccccagcuccccagugcuaggauuacagaugugaacaugaucccagugcucaguuuacccgugcauaugaguguucuaaugugcacagagcccuaaacuagcaagcagaaaucuagaugacucagcuuuuuugucuccguugugccaggggcuccaguucuccugacauuuguggaacucgugaugccaugcacgcucucugucaggauugugucuuaucucuucacagccauuuauauccgugguccucagggaauagucacuguuuucucguuugccuaaacauacaaggaaagucauagaggcagacuucuaaucauuucuugcuaaccuguauauauaaaaauuauuuucuuuuagcuacaagcgauauauuccagaaacauugaauaaauccaucagacagaggaaccuucuuaccaggaugcgaauaaauaauguuuucaaggauuucuugaaggaauuuaacaacaagaccaucugugacagcagugugucuacacaugaccugaaggugaaauaccuggcuaccuuggaaacuuugacaaaacauuauggagcugaaauauuugagacuucuaugcuacugauuucaucagaaaaugaauugagucgaugccauucgaaugacaguggcaauguucucuaugaggucauggugacuggaaaucucgggauccaguggcggcagaaaccaaauguaagugggugugggugucugaucuaaaaaagagaauauccagggucaucaagggaaugugcuguugagccugucagaaucuuaaccucaccucguaggcuacauuaaaucaacucagcuggaggccacucaucucucaucacucacaacacaacuguggcacaguugaggcaggaaaugaaucuaggcaggcuuugacgucaugaaauagauaacuccuuuguguuaugaagcuugauugaguguuuuauuguacuggggaucgaaucaagggccaugagggccaugagcaugcugcagaccccucccgcacuuuuacuuguaauuacagugcugggaaucaaaucuagggccugaugauuaggcaagugaucugcugcugagugacaucugcagcccuuugucuuugucaaaugagguaauaacaugaguugaaaucuaaggaggcauguuuaaauuucagcuacacuccuuguauuuaaauggccuuaggaggguuauucuacccaaguaggugcaugggacucaucugucaaauggagauacuguugucucuuaguaccuggaugcagguauuggucaggauucuguguagggaccaaaaucugccuaugcucaggucucauagguaaugauacaguauuuuuaugcaaccuguacauccuucuguauacacuuguuuuuuccagguugccuuauaauaccuaacauuauguaaaugcuacauaaauacuuacacugcacuauuuggggaauaaugacaauaaaagagucuguggaacauacaaaauauuacaggccugacauuuugcucauuggcuguugaaucugugcacacacacuuggaggacguggaacccaagaaaucaauuggcugacugcaguuacuauaucugauucauaugguuguucagagagcuagaugguguguugacaccaaaccuggcuaauaauaacaacuguugucugaauuacuguagcugcauaguuauuacuacaaguaauauuaaauauaagauuaauuuucuccuccugcuuuauucucaugcuaaaauaacaauaccaaguuaccaaguacuuucugcauaguaauuaacauauagauaggcaugugucuaaucucaugaagagugacauuaaaaguugauauuuuauggcugggaaaugguggcucagagaugucagggaguuaauguggaagcugucaugcagagcucaugcuagucagcuagauaacuuugugcacguauguacucuuuagggugucaguuguugagaugaguuccuaucaucucuugaagccucacuuaggcacuagucuaaagugaaaacauggguagcaggaggagcuuggguuuugaccauuugauguauuugggaagaucugcugucuggcugggcacagucagucuggaguugaggaggccugcggcugguacacauccauuaagcccucuccggcaucagcaugcacacuauaaaucaugcaccgugcucaucaaggacucuuggagaaccaaaucccaggauucucugguguuuguaagcccaugauucccugcauuucucugacuucaggcaugcuggcuuucucuucuuugggccuuugcccuauaugaaauugcuagaagcacugaccuuuugccaacagaaaaugagaaagcuaacuaaauccugucacuuuuguuaucuuaucagguuguuccuguugaaaaggaaaaaaauaaacugaagcggaaaaaacuggaauauaauaaacacaagaaggaugaugagagaaacaaacuccgggaagaguggaacaauuuuuccuauuucccugaaaucacccacauuguaauaaaggagucuguggucagcauuaacaaacaggacaacaaaaacaugguaagcucgcucgagaccugcccagacuggaugugcuggugagagacuauguggcacaugauuuccagaguuugcuguccccaguuaaagcuccuuugauggucccuuugaagccagaagucucauugccagccccuuucagugucugcuccagaguuccacuggcacaucccaggugcuuggcucuuacagauguccauccgcuuuaggguuuguugaccacauaaagacauuucagugucaguauuuaguuuauaaaauaagugaguggugggccagagagaugacccagcaguuaagaguaauugcuauucuuccagaagaccccaguuugcaagccagcauacauguccugugacucaaaaccauuuguaacuccagcucuaggaaauaugaugccuucuucuggccacugugggcacuugcacauguauggcaggcacauauacauuaaaaaguggauaagaaggagaaagaauuagaucaguucuuucuuuauuguaccauguugaugugguaguuggaggccuguccuggauaagagccucuguuuguggcccuccccuggcccugguaccuuauuucuucccuucaguugcuucugcugaucuaauuccucccagacuccaccucccuagauggucucuaccucucuggauucucuuaagagcauagauccacuauacaaccagacccacauucccaaucccagaaauuaccagcugcccauuugucaaggagcaaauagugggggaagagaagggacucuacaaggacaaggucccagaaagcccugugcaugcaugcacuaggacccuagagcaaagcuggauccagcaccuggccucuuugcacugucugucugucugucugucuaucuaucuaucuaucuaucuaucuaauuuuuuuucuguuccuucugucuuucugauguuugggccacucuugugugucauagaucuuuuccugaaguuuauuacuauaggcucuguccauucccaggcaguuucauacuguuaaccauaacuuaaccucugaucuuaaaaggaaaagauggagcccacagaggugugccugcugagcuggguagaaggaagucgcacugggcucaugaguaggccacagagcagccccaguggugucaggcucacccaggggcucgaggacagcagagaggguguuaucucgcuuugucuuuucugguaucacuugaggacacagcuuagacaagcaggccagcuuggcagggaaagugguaacucuuccaaguaaacauguuuuugucgugggaagucaccccugauaacacguguugaggccaggcuagugugacagccaugccuacaaagugaaggccaucagcaccagggaaaucuuguuuugcuuaaaacaaugacagaaagauaaugcacagcgcaaggggagagcccagugaggcagcacagagggccacucuccccugugcagaggcugccuuucugacaaccuccuagaaaucaguuugacagccuauggcaaaaaucuugaaaauauuucuguggguuccauuuaggaacccagugaacauguuuuccggaaacuaugagguacagacaguggcuuaugaauaagaguauucaugucaggucucugaguucaaagccagccuggacuauagaguaaguuccaggauagccagggcuacaugaagaaauccugucuugaaaaaccaaaaaacaaaccaacaaaagggguuuauuucaacagcauuugcagucaaaguacuacaaacaaccuggguauaaaauagaaggcuacucuuaacaacuuuccaggugucagcuguuuaauuaccauguuaacucggugguggcagaggucaucccuauuuuacagaggcacagagguuaagugaccuguuaaagacacaaauuguugguuaaacaauuugaaauugccaguaguugcccauuuugaccuauaaaacaucgaguugaauauguuugagccugguagcagguggggaugcugugaacuugaagaggcugguuacagagccugcgguucacacugugccucucuauagauccgcccuuugagcagguaguacuuggcuacuggucuuucaugaaagcaggaugccagcguguuaccaagucuugcuuugaucucuccaucucucacacacuucucaggcuucugcuaucaagaaaccaaggugcuuguaugccagguggggucugauucagcccgccaccccccugcucuagagcauuugaaauuugcuuuucaaagguaucugaaggucgaugccagccaguggagugaaguaauugugguguguuuucucucaccaggaacucaagcucucuucucgagaggaagccuuguccuuugugucccugguggauggcuacuuccggcucacugcagaugcccaccauuaccucuguacugauguggcucccccacugauuguccacaauauacagaacggcugccacgguccaaucugguugguuccagaauuuucucaauuaccuuuggugugaaaagagcccagguuuuagagguagaaaguccccuuagcucugcauguggccaguuguugaggguggggugaguggccauacacuuggaggcugucuucuuugugaaguaugcuacuugagcccccaccagcccuuccugucauuuccugccauggcucuuagagcaugccucaacuacucccuuaauuugaucucugcuucucauagauuaaccccuucacuucuccaaagccaacuccuacucuguccaauacugagcacuugaagggagacaggaaugcagaucuuuaaaucuuaagaaugguccucaucuguauuccacgugacagguuuagcccccuucuacccaucaugcucugugcccuuugggcaucaagacucacugcauuugggaauacagaggaacauaaaguguguucucuaauacucuuuuacucaccacugagguauuuauucugcuugucaucaauuaagcucgcagugaaggaagugaacccaacugccccaacgggccaagugugggacuccacucaauccuuagcuacucuuacuuccuaguauuaagguacacuuuaugguaagauguggagacaugucuuuguagauuuugugacaguaaagcagaccucuguguguugggugcaguaggugaguuuuuuuccuagaaauuggaagcucuggaugucucaaacuccuucucaccacgugcuucauaccacgccagagaggaccuuaggagccaggcaggugacaggguguggcugggugucccuggcagcuuguguucuaugguuugagccucuguccuugccuacuucucucuccagcacagaauaugccaucaauaagcugcggcaggaagggagugaagaggggauguacgugcugagguggagcugcaccgacuuugacaacauucuuaugacugucaccugcuuugaaaagucugaggucaguggggacauagaugugggccaggggaugcagcuacaagguaucuguucacuaccacccagcccaggaacugugggagaaaggaacaccagggucucucucugagcaagucucugguagucuggaaagaauauccuaccugauaggacacucaauagcacgacucuguauucuuccuaugucugguccucccucccucccuccuuccuucccucccugucgcccuuccuccuuuucuuccuccucuucuuuccucuccccuccuuccuucccucuucuccuuuucuuccuccuucccuucucuucucuuuucucuccggagaaggacuguaaccuuagaagguagaaugugaccagaaaaccgccauuccaucaggcacaugugaacuuuagcuuaauuaucuagagugacuuacucuauagccaguggcagaaucaucaaaccuagaacuguguuugccuguggcauucucugguguaggcuaaugucaaagagccaccucgucaacauggccuguuucccccagcaacagcuuugggcauuuuaacauaaauugcuuucccaaagugucugcugcauaaacagccagaugcagcuccaaacgauugcugauucauggucccugcagugccuuuucuauucacgcaacauuuuagaaugcuuaaaagguuuuagagaauuuuagaagaugucgagggugagguuuuguuuguugugggguugggcuuuucuugguguguuuguuuguuuguuuguuuguuuugagacaggauuucucuguguagcucuggcugucccugaucucauaauguagacuaaguuggccuugugcucacagagaucaguggccucugccucuugagugcuaagguugaaggaauguuccaccagguccagugaggguggugaguuuuauguuagucuacauuaaaucuaccagcaauagugagacucacccagacuggaaaacugaguugaaagaaccuguugauggaggcaaagcaucagacacaggagacaaguguuaagagagccccgaggacugggcucugucaaaguggaaggaggaagucacauaaggaacccagugcugccagauguacuggguaaaguuccaggaguguuccugaacagccagaccucagggcugccuugggcuugguggcuuccuguuuucacuuacuggucagucuuuggaggaaguuuauuaguaugcauggcuguaagguagccccgccuucugagguagacucagagcaacauccuagucagucagguugccuggggaaaggacagucacaaagaggauuguugauuguacaugcagcuaaagagaacuuacagaggccauaugauagagguggugcuguuccauugucuggguuuguaggaugcauuaaccuuguggacacggaugucuuaaaugucaugucccaguuuuuacuauaaagacaucuuucuggcucucacucuuuauauuuuuuuucuuuguauaagaagagccauggaagaaagcuucucggacagguuuuuguggugcuggaauuauggccuggauggacagccagcucccagcucccagcucccagcucccagugugugugcuucuccuugggcugguucauagugugugagggcucacucugaaagaguuccgagugaauuuaaccuucacaguucuuauuucauacauacacugguuaaucuuuauaaaguacuaaugguuuuuuucuuauaaaaauaucauauauuaauuauacauaauaauggguuuauuauauuuucauucauguguggguauauguauguauguguguguguauauauauauauauauauauauauauauguaauaugauccuuauucaacccccaugauccuugcccacucuaacuccugccagucucuucucagaaaguccuucuuccguugucaugucuuuuuuuuuuuuuuuuuuuuuuugaugaccaaaugauuuuaauuaggauugcucauaggaacacaagauccauccuagcagcuauaccacuaaagacaaugucucuuccucccccagcagcuauuaacuguauuaaccucaucaggagggauggaagccuccuaaucccuuccuccccuccaugauaaaauguuaaccggcccagucuuauccugauaucacaaucacugagaguucaagagugcaggagccguggugugccaggaaaaggcucucuaacacuccaccccuuccuccuucgcacauucuuuuugcccuucuucuaccuuguucuacaagaggaggugauauagauacccauuuaggguucaguuuucaauaauugaucauucuaaaaugugugaagguuuugguuuuuuucuuuaaacaaaaguccuaugacuuuugcaacaauccugugacauuuuuucacgaccuucaucucacaggucaaaacgcagaugaccuuucuguagcuguaagcucuccauaugugacgugcuggccccuuuuuacuuuccggguacuauuucauuauugacuuacugcuugguuggcuuguugaugaaguuuauugggggauauuuuuagacauacaguuucuacaccuucuugcucagugaccccuaauauuacauugccugaucccauuguaaacaugguuguuuuuguggauggcagguauuggguggccagaagcaguucaagaacuuucagauugagguacagaagggccgcuacagccugcauggcucuauggaccacuuucccagccugcgagaccucaugaaccaccucaagaagcagauccugcgcacggacaacauaagcuuugugcugaaacgaugcugucagccuaagccucgagguuugucucuguuagagccaagcuguguuccucuggguuguccuuugccaguugugaugcuuuacccaugugggccaaaggaugcuaucugaguucaagaaacuguaguccuagguguuuuucucuaagcucugucucaggucuguccccaugucacaucucaucucuagugccaguguugucuguauaacauacaccucuccucagugccccagugagacugcagaagagucugcucaggauuaauaagcacagauuucuuuguucuuugaguaaaguggcuugacaacucaguuugguuuauguauguuucuggcacaucugagggcuaaggaacuguguuauaacagugggaagucccaggcccuggucacugaggguguguagaucacugagaccaccucaguaguugaugggugauagauaacauacccuagggugaaaagagagagaaacaguccaaaucucugaguccugagcagauguugagcguaguguuggguuaugagagggaggugccaguuuggcaaaggccugcccaguagagcugaugcaggaccagugugguaggccagggcaggagcuguagggagcuucaagaggaccacugugaaguagagaaggacaggagaaauggaacugaggagaacagauuggcugccauaccaagggacugcagccuucuccugcagucagagggcuauagaaggagcaggaacuaaaacccaggcaagggcccagggacucaccugguuuugguuaagcucugaaagaagcauggcuaauguccaugagguagacuccuugccucagaaugugagugugaaaggaugcuuuggggguuaccuggccagaggccuccucucacagaaugaaauuagucucauggaaaguacgguaacuuggggucaggucucaccccagauacuggauccucauauauuggaguuuuuguuucugcaccccaacaugcugucuugccuuugcuggaucuguccuuggaagucuuaagaccuugaagagaaggcagcacacaagcucuugacacuagccuuggagcaggcccuuugagacuauauuguucuuuaagggauuaccuuugaguaaggaacagguagaaagggcuuggguuuucuagaaguacuagugauuaaauccagggccucaugcacauaagucaaguguuuacccaaguguuucugcugagcuacacuucuagcccagggcuuugaguuuacaaugugugaauuauauuuuagucucagcaaaaggcaaguuccugaauuuggugaaagaggaagguuguguucuuguugaucagauaggguuaccugccagccucagaguaacugcagccuuuguuuucaugcuagccagugugccacaaagggcgaaaacacaccugccucuuggccaugaaaccucagagcuccuuagggcuuuaaagcccaauggucuuauuuuuuacaugaccucccuucugguguuaaaagaagaucuaacuucccuagggaucaugguccccgggagaagacagcauccacggaauugagaaggccaggggcuaggaugugcuuuacuugaagguugcugauacagaccucugauguagcuaccaccucuaacagcagagacuggaagccaguagcuuuggagggaagagugggggaacagcguugaauacuuggguggcuuuucccgaggcucuucugaaacggagcacugagagugccuucugucuacuuuucucacuugcuuuagaacucugaaggucugaguuuucacucacugcucugugauucaugggaagccuagaaugcacaccagaucuugugcaggacugucccauugggugauaauauuugagcagcuuccacuguagcaguaccuacuacuuucaaaguaguguagugacuaucuuauuguuuauuguuuuuuuuuuuuccacauaggaaguugguuucagggauauucagugaauugcucaaggcuucacagcugauggcaucagcaguaguauaguagugacagugaauaauaacaauggcuacugacaucuuagugaguguuuggucugccuguuugaaggccuuccauguuguagaccauuuaauuaucagaagaauucaggaugcuuggccaagacuccaagugaacaaagauuggagauuugaacacccugucugaccugaauacacugauauguccuccccauuccaucuucauaugcuuugcauaggaauagguacuguggucagcuaucucugggacacaggguaucucaucugaggggagggagagaaagcugaggagcccaguguggaucguccucguauuaguucucagaaccugcaaauuagagaagagcuaaaaucaggaauguguaacacaaagagugucguuacagguugcucaauuucucugcacuuguaacuaggguucccagagccagauacucugaucuagguuuuacacugcaguauacaucgcuuuguggaauagagaaaaggcagggaaaagccaggaagccagacagaagcauaugauagauaaguaagcccuuggucaggcccagcacucaggcccacacaccacugaacaugugucaguaccuauucccuggggccuccucaggaugggcaggugugaugcugauuuccacuuaguugcuccuuguagaagaugucugcauucugaugcacaaggcuggaacgcucugguggaagacuaagguggugguugaucaugacgacaguggcugccaguagugaagccuuuacugcauacuaaagaaagcucuucugggcauggucucaucuguuucacuuagcaaccugaggagggcacagcuuucuugaacgaaacauccuuaugauggugaaauggcucccucucucacaggucaaguguagugcagguccccacacagauaaccaagccugagccacucuagacucauccuacucucugauucccagauggucggccaccagccucugucugcccucgugccaccagucaaauagccucauuguauuugacuccuuucccuccucaagauggcuguacagagccuuuuuauuuaaauuguauuuucccaggcuagcaucaaaagagaaccgugcaaggaaugggcucagaaaaaaggagcacccagaugacugaagccaguuucugguacuuagauuuguaccccaggaaagucagacuagagcugugccuggaugcucugugaagccuuccucucuggcuuagcaagcucugugguuagguugcugagucucuuugagccuuuguucugaucuagaguacagauaaggauguugacaauuccugucucuugagcuuaggcagaggaguuaacaguuucuuauagaacuguacccagcauagagaaaacagaacauaugaauguaaacaaaaaaaagaccauaugaaugaaaacagaacaaaagaagauuugaggggcccuuauuguacucauguaaccaguguuguaaccuauugcuuagcaguuuauuuacacuagucuguguguggguucugugaacugugccuuggaauuucuacagaguuuugggaacuuucuuaucagaauccaagaauuagaacucccaugugagaacucauugucaucccgugcaagaaaguggaacagggagaucaucugugaguugucacuuccccagugguacugguccagcuaaaggaaguacacgguguguucagggacuaugucaggucuaccugauucccagaggauucuguacuaugucugaauuuggaaggcagcuuacaaaggauaaauuccuuagauccuauguaacccaggccuggcagaccuggucaugcauuguguuugcuguuuaucuuaguaaaguuugggaaauggccuacuccuaagccacaugugagguucuagcuucauuagcaagauuucuaggauccuauucuaaguugcuuuucccuuucaucugcauauagcuuguacuuuccuuuuucacagaguucccuagccucaaggcaucuguguuccucauucaguucaccccuggugcuuccuacauuuaacaaagucuuguugggaacugggaaauagagugcuugccuagcaugcacgagccugguaacuugucgagcauucguuauguucuaggcuguaggcauagagcagaacaugaaacagacaugguccccggcuucuugagacugacuuuugucauuuguuuuauuauucuuuuggagacagccuaagcuauucuccaacucacuguuugcucucaggugcugagauuauaggcaugugccaucauaccugaccauuucccaaaggagccuucccucaccucagauccugcugugugaacccuggcuaaaucauagcucuccaugugcucucugacuccuguugacucugucauuagccugugagcuccuggaggguaugaauuaagcauuuacccgauacagacuuguucaugauguaacuagcaaacccuuguguuggguaagccccauggcucagcacacaaugcuagccaugccagugcagaaugcugcuuaaaauucucugaucuuuucacagaaaucuccaaucugcucguagccacuaagaaagcccaggaguggcagccugucuacuccaugagccagcugagcuuugaucggauccuuaagaaagauauuauacaaguaaguccccacuaagggucuuuguccaacuuugguccugacaccccauaggggagcccccuagagauuuaaguguguguguggguaaagucugcuuuggggauauucuaguggaaagagaacaacgagguaaggccacgcaagcccaccuuucauuuuacccagucuugcuguuggccuuccccugagagacuaauccuugauggacuuggaugaggagguguggacuaccugggguagaggaaugggaucacuaacaugucaguagagguuggucucaauggagucuccaccccacagagugcuguguaauagugcucaguccugcuuuuucagaagggacuucugaaaggaauagagagaagaacaaagacuacagggcagggcagaacaagagcuggcuucagaaaggggacccuuggggagcucagagcauugccccagccuuccugggauagccuuugcuacccagaauauucagacuaagccagacccacagaggcgcuuacacaucugcggguaguugccacccucaguagcaugugugguuauguaaaaucuagucuuggaagggcagaacucauuuccuagggaaggacacuaaagcagaggcccagaagaugagucaccaaggcucugcucggacagagagaacuguguugauggaugcugacguggacauuggucuuuguggguucuguuaccuagcccuuggaauuaagucuucuucuagaggagaguaauugucuuaaaagcauaugccuuuuauggaacguucugggaaugcagcuucccauaaugcugauggaucaccucaugacagaugcagcucuaaugaauaguugcaggacuuugccagaguacagcagauagggaggauaaauggccacucugcugugacagauaacaaguggugguauuuguguaaauuaauauacccgauuaacaguggugucucuuucuguagggaacaggcuuccuagauaucgaccacaauccauuuucuauguuugcaagagcuuccauaagagcuccugucuacaagcuuuguggggcuaauguuagcagcucaauauuauuauguuuuaugaaucacauuuugauuuucaaauauuagaaauuaaaaaugagaaauauugaaacucaguuccggaaggguccuuagaaacagaucguucugugcaugggcuuauccgucuggugguaccgucaccuuccuucacgugaggaaaaacccagcgcagcccucagcuugggcugaugcagacaugauugaugcuuuucaaguggcuugugcauguccuggugaugggugcugccaagugguggggcagggagugggggaguggagcauguacugaaaggcucugaaacggaacacacaggcugagcagucaaguuccugcacacugugugucuauagcagaagccuuuauaccuaagcuccuuacucgauucacuacauugcgacgcaggugucauuaggacuccauuuacagagacuaggcuaagaucaagcaccaugaaggaaugcaucuuaguugaaggccaggaagcaucagagcgagaggaugaaggcuccuuuacuuuuccuccagccugagaguagagaugccaucuggcagaguacucccauaagucucucuggagagcuggcuguuagauacuguucacagguuugugauagacugcagcugggcuacaggggacuauugagauggagaacaagcugcuuuucaggagcaggguugcaacuaggucaaggaaaugucagugcugugcaugcccaggagcuuuguguuuuucuaggcaccugaugaggacuguaugggaugcccuggccccaucccacuguguucaguaucccauugaaaacucagcccugaccugagccaucaugaaggcaugguggaagagacggcuuucugcuuccuuccucagggugagcaccuuggcagaggcacaagaacacauaucuauucugggacccugcuggacuacaaggaugaggaaggaauugcugaagagaagaagauaaaagugauccucaaaguccuagaccccagccaccgggacaucucucuggcaagugugcuccuucucuggagcugggggagugaguuggcuggggaaaccucugugcuuuuuggccauguauucccagccuugucuuucagaguuccucccuucagugcugucuuagccagacuggcugugugggaguagugaggggagaaugauggugaggagggagcagccuccuguaccuguccugugcccuucccugcuaccaaaagcccuuguguaaugcugugggucucuggaaaaagcugaguggucucgcacucugaggggguuucccaggcucccacauaguuggcaacacgaauguccaaaggagucaaaugacuugaccaggaauucuuagacuuuuagagaggacaaacacuaaguguggagcaggaaguguggcugccugcuuguuguaacauaguaguaggccuuguauuucacagcauuuagaugagaguaagguggaccuaguggcugugggaacauugggagggagcuuaucccaccagccuuacucagcauuguuggauuuucuaaauaaaucccaugccuuaguuagagucgcccagaggucgaggcauguccgugacaccagacagccaggagaacaguauucaagugugggaggugacaguggugagguagcuucugggauucacugaaggauggucccuuagcaguucagguaugagccuacacaucucuuuguucuuuuuucccacaggccuucuuugaggcugcuagcaugaugagacagguuucccacaaacauauaguguaccucuacggcguguguguccgagauguggaaaguaaguuuguucuuccuuggcccuugcuggggugcuggguggguacuaugcagacgccuuggguuuuuugccuucuguuuauaggagaaaucggggucauuuguggaggucagugguggcucugguucaguuucccucuuuaacauuucgcucuugccacucugggcccaagugugcagacgugaggcagucuagagggcuggaggaaggugaugcgugugaaccugacugagcuggggauaaccugcugaagagacuccugccagcucaccuguucugaaccucugcucugaauccccauagggauguccaggaaagagagagagguuuauauuguuuuaaaccccagcucuuugaucuccaaacucuguagugcugacuacucuuguguucguucacaugggagacauguauuggagggaaguucuguccuaugggcaggcuuaacuucgugcugcaguguauggggcuaucuauaauguagcagugguaaaggccagcguucugaagcuuugugccaaggccuucuaugccuuguuuaacaaaucacccuuguccuaaggucccugggagagguaaguauugcuguuugcacauaaacagaugcagucuuuuaaggugagagagaauuuccucuagauagacagcagguuccagagguggcuguuucugugucugcagauaucaugguggaagaguuuguggagggggggccguuggaucucuucaugcaccggaaaagugaugcgcuuacuacccccuggaaguucaagguugccaaacagcuggccagugcccugaguuacuugguaagaauguuuuuguguagauccccauuaggaccuagaguguucucuuggggcuagggagagugggcaugaagggguugcaggugagggguauugguaagcagguagaagggaaccugcuucccuggugccagguuccaggcagaaggaaagaguucuguguguggguacuguaguguaggcuuuccuaugacucuugccuagaggaaaaugauaucauguuggagacugacuguauuauacagcuccaggaggaggcgcaggacugcuuuaguuugcuauucugaggauaaaacacaaaaacuaacuugaggaggaaaagugguauuuagcuuacauauguauuauugagggaagccaaggcaggaauuggaacacagaccacagaggaaagcugcuuacuggcuuguuuccuuggggcugcuugguguuucuaauacuuggcuggugguggugcacaguggcacagcaaccagcaauuaggaagaugcccccacagacaugcccacaggccaaccugguggacgcaauccuuaguugagguucucacuucccugcugugacagucaagauaagcuauuauuuaguacacugaaugaauacaggaaaaacacuguguccauuagagcuaacaaugugggcacacauaccaugggccagcugcugcagguuuuacauagucuaaugugcacagagucugugaggcaugcucugccauuaucucuguuuugcugaccaaggaauagagauaucucaagcagaauucauggguggaccaggcuguggggucugcuguggcuggaguggagaaagcugaccuguggggccaggguugugggcagaaacagaggguguggacagagaagacaaggcugccuuacuacauagacccuuuuuauucuacaggaagauaaagaccugguucauggaaaugugugcacuaaaaaccuccuucuggcccgugagggcauugacagugacauuggcccguucaucaagcuuagugacccuggcaucccagucucugugcugaccaggcaagguaugugucugguccccaguuuccaucccccuuccaucuccaccaucuccuucuccacuaggcauugaccaccagcaacaagaagagcugugcugugcugugcugggccucccuuuagaaagggauccagcagacaggugcacaguugcugcugcugugcccuggguaggcuguaguacagagggaggguagaauccaacggccuagucaacacuuucuaguccuugugguaaaggggcugugucaauggugcuggcauagcacagcguccauuggagacauggugaaauggucgauugguguugggcagaagccagauguccuggaucuuccccugcugucuucuggagccuggcuguagccauugggcaguuuggaaguuagcacauuaccuuuaaucaagagacugcagagauugucacccuugcaggagguuaaguuaugucaaguuaucagcucgagaaggagcagcagccccuggagccaagaccugaagcuaaugcuucccaggcugcgcucagccucagggaccuggucuauuaaagcugcugcuaccuucaguguugaguuuaguaacuuagcaaucauguaguaagagaguagaaacugugacagagaauaagcccugaaauagcccuaaauacccacuauuuagagggagagcaggagucuuuuguucuuuggagccugauuuguggguaucauguagcaaucauucaguaauccuugagcagacaccccugucaagggucuugaccuuggugaaucauugaugauucuaguguaagcagagaggccuggaauccagugaugcccacaauccagaguagauuugggggugagaccuaguucaggaaaguuguuugugcuucaugaggcuguuguaggccucugagguagcuauggcagggcacuggugcauagcugugcaggacagguuaagagguuugggaagguuaagugggcuugaguccgaugcuaggcucaugagccacacugcugaucgcuuuccuugauaacuaggagguugcucuguggagguaacugcauuacucaaagacauuuccaggggacauggcagaagcuucuuugagauugcuggcucugaccuugguuagaagaagccagaaacugaagccugagagauuaucaggagaaagagauauguggcugcuuuuuaaauuuuaacuuuaaauauguucuucuguccucuugaaaagaaggaauacacuuaaaguuaacauuaacaguguggaacauagaauaggauguguguagguagccgccugccucugcacgcuggacuuccuccccacucgucccuuuuucuuucccuggccuuuguucagacacuugcucuuccgugcuuucucugucuauggcguucugcuguuuuugacaccagguuuuaaaagauggcuccucugggguagcucgugggguagccuuugugcuggccuugaucagaccaccuagguugcuguguguuggacucaccauaggacuuccguggccaggaauuaugcaggcugcaggcccacccuuguagcugcagaggcaguauuuugcauauuagguggucccaggagcuggccuauaggugggucuguugucuuuccccagagugcauagagcgaauccccuggaucgcuccugaguguguugaagacuccaagaaccugaguguggcugcugacaaguggagcuuuggaaccacgcucugggaaaucugcuacaacggagagauuccucucaaagacaagacccucauugaggugagcacuuguuuccagacugagguggacaagaucucagaugcucaugggccugugagcuuggucgucuuacacuuguaaguaaccuucagccucggcuccauaaaacgggaauaaauaaugacuccucugucgaguccuuaggaagguagacaggcauugcacagcugcaguauaaaaacgaggcuuuaaaugaguggagcuccugguguguacugacugcccuagacaggacugaggcuugggccuuccccugaggacugcuaaggcuugcagaggguuaagcucagaaaugaaagauauaaauauuuuuuaaacggucauaacugugccauuccugacugacugcuaugacuuuggccuggugaacauguaguuuuuaauuuacuguugugugagcacuuccucgugggaacuuagugaguuaauuggcgcguccagcgcugacuuccuuccguagcucacuuacugugguauuuacaguuugcucugucuuuguaggguaagcauggcucgugugguuuguuucugagcagugugguaauuggaauuagugggugagugaggaggaucaggaaggcugcugcucguugccacacaauuccagagaagcugccgggcuucccuagaacacagcaccuugggagugggaggugcuaccguuucuccuugaaucugggauaugucacuaucacgacugcuuuccucauacuggaaagaggccacugaaaccccacauugaggacauuugccuuuuggcagagacacuggggauugaaguagggauuggcaguuguuucugaagguguagagucgaaggucugaggguggguaccuggucucccaaucgucauucuuuuuuacagaaagagagguuuuaugaaagccgcugcaggccugugacuccaucuugcaaggagcuagcugaccucaugacucgcugcaugaacuaugaccccaaccagagacccuucuuccgagccaucaugagggacauuaacaagcuggaggagcagagugagucuggccagccagucccagccucagagacugcuggggcagggaggguggcaguccugguuacugcuuggaggcuaaucuguuuccuugucucuucacuuagauccagacauuguuucagaaaagcagccaacaacagagguggaccccacucacuuugaaaagcgguuccugaagaggauucgugacuugggagaggcaaguuacacuugggcucuagccucugucugcauggacagcugccauauuccccuuuguccuucgucagaggcuuuaagagaagcaccuuaaugcccuuugucaagggacacuugaccaugccaaguuagguguaccugcaugugaaugacugcauaaauacccaggaccugggacagcuuccucaaguaccuugacuuuucucugugcuguagaggagggccaagcauagauguagacuaaacgggagcaucucuaacucugacucuuccaagauuauacugugauuccuuacauaaggagagugccaagauaugagucacggguuuuccuuugaguagcagcuggugugaccacgggaguuccuggguugguguuuucauauagauagacucucagacgcucacuuaacaucaugacuguacuggacuaacagcaucuguacugggcauuuucacacucguccgucauccuccuacugauaaguggcauauuugggauuugaagcuccccugugcaaaugcucuuuugagcccugcuagccuguccuauagcauggaccugugacuaugaaagaaugccucagcuguccuccgaaugcagagguggccucauugcuggagaguacacugucuuagaaacugggauugauggguaaaguggucccuuagucaccagcugcuuucuuagucuucgcucaguagcagaggucauugagucaagugaggaugagcugagccgagaggagucaggagaucagaccgaggugaugcuuguggccgugagagacagccugagaacaaggcauuuccucagcggaucuagcuugucugggcaucucugauagcauggacauauuccuuccagggucacuuugggaagguugagcucugcagauaugauccugagggagacaacacaggggagcagguagcugucaagucccugaagccugagaguggagguaaccacauagcugaucugaagaaggagauagagaucuuacggaaccucuaccaugagaacauugugaaguacaaaggaaucugcauggaagacgguauguugugcacacuggacugugggauaaagguccaguggcucucuggguccuaagggcauuugcugguaggcaguccgcagcuucaucuuuaccagcuccugugggcugucagacauucaggucucacaacaacaagguccuuaccaacugcaggccuccugggaggcuucucccagccgcaggaugugaacuuugucuuucagauucacguauaaugcugggaagcaucccagauagccacacuugugccauaaggaaguuaaacuacucacccccauuccucuucugaucuagugcuaccuaaggccuucugcucuguccuuauugaagcuaagguagcaaauaguacuuaguagucacauuuacuaauacuguaccuuaucugcaaggcagucaugcaugugcuuuaaaacuaguaauaagaggguauggacuaugauuuuaaaacugaucgcuugucuagagauucacaaagcacuaggacugcaguacccugaugaggcaggaccuggggcuauggacuccuguuuaucacugaagugucugugccugugguaggcucuucuuccccaugcuucgggggcuaggcugaccuuccacccccaggcccugucuacagagccccaugcucauccucucugcagccucaucugaugcuacuuucuccuaaauaggaggcaaugguaucaagcucaucauggaguuucugccuucgggaagccuaaaggaguaucugccaaagaauaagaacaaaaucaaccucaaacagcagcuaaaauaugccauccagauuuguaagguaaaaacaccaaacagaaagaaacagccuguuuuuuuuaaaaaaguaggcauucuguccuggggaaaugguuaguaauuagaccucagcgggagccuguaauaaaugaaccguguuuuuaacucugcaccauuugcaugaaaugugagcaguggacuuuacuuggaccuuuuuuuuuuuuuuaauuguuuaauuuuauaacaaaaacuguuagugauauggggaugaaauggcuuuuuuuccuaauugugcuguggaagauaaaaaaaacacaaccugaagugacuuuuucagugggucugaccuacugcucuuaggggaaggacuguggguuaucaacagcacauuuaccuucgcaaugggccugagccacacuuuucucuuaggggauggacuacuuggguucucggcaauacguucaccgggacuuagcagcaagaaauguccuuguugagagugagcaucaagugaagaucggagacuuugguuuaaccaaagcaauugaaaccgauaaggaguacuacacagucaaggacgaccgggacagcccaguguucugguauguaaaccagcucggccgugcuuuguagcuuagcauugucuugaaggcucuugaagcugugcuugggugcguaucagcugcucugagcuuuuggagaaugggagagucuggccaucaucacuucagccucuguagcuucaugugagcaagccacacccaccacaguucucauagcugugagcagguggaagaggcuggcucguucuuaauacauccguguagaagcccuggagggaucgcagggccacagguacacauugccauagucguggagauccugcaagagggauagauacuuggcuagguuuuaggaaccacuaguuaccguaguuagcgagccacgcccugaccaucauugucucucaguugggaacaccuuccuggggaaagcugccuguguacccugaugccucucaugcagacauggggcccucuccaccagcaaagccuauccagagucuuccuuccucguuuaaaaacggagugguuuugaggcccuugauugugccagugaauccugaauuaugggugaggcagccaacuuaguguggcaguggcacaggcuucaggcauggguuugaaaggcugugugugauuggguaaaagcugaagggaagggggcauggcuggagcucugcuguucugcugacagagauaagagggaacugaaagcacgugugucauugggaagugcuguagggguggcugagucagagcaucaggacuugaccagaguugaaggacacaaagucuguacugaaggucaccauggagaggaacaagaaaggaacaagggaaucggggucagcugcuucaguagcccaggaaggacagguugggacaguaggaaguggauuugucugaggaguguucaggaaaccaguucugggaugccuagacaccugguaugggcauuugggcaucacucaccaaaauagugaugccagagagggugcugacuccuggcuuacagggauauaacuuggggcucaucuucaggggacuguccccucucuaaaagaauguucccugggacacgaggaacacagauaucucguuuaagggcaaguaagauguugcugugagccucuggacugcugucccgugugcugugugcacuguggcagcaugaauggccagagucccucagaggcacgugacuuacauucucaagaacagggaaguggcuuuccugaggcacucuuuuuuuuuuuuuuugggaggaacaaaaggcucacucccugcuuuccuuucagguacgcuccggaauguuuaauccaguguaaauuuuauaucgccucugaugucuggucuuuuggagugacacugcacgagcugcucacuuacugugacucagauuuuagucccauggccguaaguguuaacugcuaccucuugucagugugccacauggagaggguuacagcaugcuaucucacauggucuggcaaaguuugccuucacaagugcagaauucaguaagacgacucagguuuuuagggugagggucaucacaagagagaaugauacacuuugagcauugccguagggguuuuguuuucauacgacugacagcugugguugguccccucagaugugcuguuauggaccaauccuugagagcgcaaauaaggguuuuagauuuucauuugaaguuauggaagagaaaagcuuuguugcuuuaauuucuucuuacuucugaaagcaucaccuuaauuuuguuugguuuuauuuuacauaguuguuccugaaaaugauaggcccaacucauggccagaugacagugacacggcuugugaauacucugaaagaaggaaagcgucugccauguccacccaacuguccugaugagguagcuguguccccuucaugggaagggaacugcauuuugaaugucuuuacagcuugccuuauccagcaugggaggggaauaacagaaccgaaggccuuacacuggcuacaguguuggcucuugcuuaagaguacucgcuauucuuucugagguccuagguuccauuuacagcauccacuuggguaagacaugagagaaaucccuccugcgggggaugauaugcugcucaagcaaggcuccucucagggagcuguggccuccauaccgugcaugucugccuucccagaagagcacaugugaugaggucuuaccauugccugaagacauuuaccccacucacuagcauuuucaguuuucuagauucuaaacuggaucaagccuccauagauacucaggacugucuggucagaggcaggugcagugguggugaaggggguaggcagauuaguaacuuuccugccccucucacagggucacaauagugaccuggauuuuguugaaaaucaguuaaccugugaguuaaacaaaugauaauaccauuuaugaacuauuauuuucugcauuuuaaguugcucaaauacucaguuguuuagucuuguuaaaggacagcaguuucuagcguauucuugauaauuuuguguuuuugaauguguggaugcuuauggaugccagagacugagggaugugucugcuugguugccccggcuuuguuugcugaggcagggucucccuggaguuagucccucuggcuuugcgaggcuggccagucugccuuacagcugcuacccacgccucgccuuuaaacugugugucaugcucugaacuuuaaguuacacucguggggcaaguacgugauccaccaagccaacuuuccagccucuuauuguucuuuuagaaucucucaaaucugauauuauucauacuguucuugcuuuuauuuuucauagguuuaucagcuuaugagaaaaugcugggaauuccaaccaucuaaccggacaacuuuucagaaccuuauugaaggauuugaagcacuuuuaaaauaagaagcaugaacaacauuuaaauucccauuuaucaaauccuucucucccaagccauuuaaaaacguuuuuuaagugaaaaguuuguauucugccucuaaaguuccucaacaaauacucgaguuacacauaugcauaugucacacugucacucaguguguggauaugccuaugucacacugucacucaguguguggaacuuucucuuuaaagguguaacaucuuaaauuuggugaugaauagugacaaccaaaagacuagauugugccuaagcacuccuucuggaacaaccgaaugaucagcugcauagcaaaggacugugccgcuggcauauugaucucagauaaaaacuuguggacuuggcugacacucucccuugcccugaaaucucaaugucuauucagugauaguacaagcacguagauaccacuuaguauacuauuguuucuauuaaaaaaaaaaaaaaaaaggucuguuccugcuaccuuuuaggacugaaguuuuaagcacugguacccacuguggggcaaaccugugcugcaggagggagccuggcauacacacucugcauguuacuucuugagaacuagaccugugugccuguguuuuccugaacagcugcuuucugucaggcagacuccucugaccuggaugcggucacauccaccuuuaagauugucagugcauacuccuuccugacgauccccuggggcaagcugccgacaguggcguaaacaggagacaucacccuauacugcgaaacuacagaaaggaagacagcuuggcccagcgggcugaaguucagaauucacuagguaguuguuguugguugacuuggagguagcuggguaaucaacagcuuucacuuuagauucaaugugaaccgcagaguuacucaugaccaagagucuggcaaacucauuaaugcuguuuaauacuuguuugauauuuuuucaccuuuugagcccuuuucccaaagaauucaauaucaguuuaguagcaacaguacaguugccauuuaaauugguuuaguugcuguauaucaccauagccccuguuuacgucaaaccugugucucgcucuauaugcacuuuguuuacucuuuauacaauaaacauacuaaagacuucacaugcauaugccuuuuaauauuaagcuugcaucuugaaaagcauuucaaaccauuagcugacacagaaaacuaacagcguagacuuugggggguugguuguaaugaccuuguacuaacaucacuugauuugcauuucugucuuguaauaacgggcacaggcuggcauaguggaggacccacauggaaugugaagugucucuaaguucccuccacugcuuccuccucacacugcagcucccagauagcagucucuagccuccacuauucugugacuuagagcugcagccagaggcaggaggugcagggucagagcacaccauuagucaucugcugggaccucgugcuggucaucaccuauaggaagcgugucuaggacggucuuccuuucauuuuuuagcugucauuuuuucaaugaaagcugguauaugcaauaaauuaggccagguaaaauucauuauaaaacauguaacauauguaccaguuuuagauuuuauaauuaaugcuggagagcauuaucagucaaaaaugauaaguccuccaaauaagguuuuuuaaugaucugaucuaggaucauugagauccuacacuucaucaguuguagucucuuaacaaugaacacauagaaauuucuagauggaaaaagguugcucacuuaauaccaagaucuucggcaaagggugaagucaaaagucagacaaauaaagacaaguguucuuucagaagugaauuggauuaagcggccauuuccuuucagcuuaacaacuaccaaagagugaguaaauaaccagagugagguagagccuguuagcucagaacugccccacgcuguccacggccucccucaggaagggcugugugcacugcucugcuggggcucggcccugucuagggacgagaccuucacugcuguaugcuaugagacggcagggaaacccuggcuccuugcuaugcacaucucccauaagauaaaaagaauagggagacagacuaagggcaagagaguaaacgccccugccauugcaggcucugugguucucgaggcuacucaguucccauugugacacaaaaguaacuacauaauauguaaaugagcaagccucacuguguucccaacaucaucuuggggacauugaaacugcaguuucauguuguaaguccuccccuacccccagacguuuagaaauguccucacuugauucacaggcagcacaaagcuaggugguggacuacauguggcccuaguguguauucugcuaacccuuguauuauguacaaaaguuacuuuuccugaaauacuuuguuuuccgcaaaagguguauaugguaaaugauacuccggaagugaagcaucugaagucacaucacuuucacucugccacuggguuggucuuauguggcuuuguagagcuaauggaggcugcaugaugagcaucuguugucaccacugggugguacugccacccuugcaguuugaggaaagacuacagaugagacuauuuuuaggggagaguaagguaaaugcacauuggcuuauacgaaauucauucuaaggcuaaggaaacaacaguuucccaguuauugcuucagacuuuauauaugaugucaaaauuguucccaggcccgaaacaaggacuauuggaaugcugacucuccugugagcggaguccuuaucacguggauuaagacacaucuaaugcuaguggaaaugcccucgaccagugguguuucuuauugcuagguggguauuuggcugaucugccugcugcaugacaguuccuucugggaagucagacacccguauagaaaggauauggcuagugugaaugaaguuaaggcagcgaugagcagc

SEQ ID NO: 2000 - RNA, 3388 nt, Mus musculus
aauuguuuaauuuuauaacaaaaacuguuagugauauggggaugaaauggcuuuuuuuccuaauugugcuguggaagauaaaaaaaacacaaccugaagugacuuuuucagugggucugaccuacugcucuuaggggaaggacuguggguuaucaacagcacauuuaccuucgcaaugggccugagccacacuuuucucuuaggggauggacuacuuggguucucggcaauacguucaccgggacuuagcagcaagaaauguccuuguugagagugagcaucaagugaagaucggagacuuugguuuaaccaaagcaauugaaaccgauaaggaguacuacacagucaaggacgaccgggacagcccaguguucugguauguaaaccagcucggccgugcuuuguagcuuagcauugucuugaaggcucuugaagcugugcuugggugcguaucagcugcucugagcuuuuggagaaugggagagucuggccaucaucacuucagccucuguagcuucaugugagcaagccacacccaccacaguucucauagcugugagcagguggaagaggcuggcucguucuuaauacauccguguagaagcccuggagggaucgcagggccacagguacacauugccauagucguggagauccugcaagagggauagauacuuggcuagguuuuaggaaccacuaguuaccguaguuagcgagccacgcccugaccaucauugucucucaguugggaacaccuuccuggggaaagcugccuguguacccugaugccucucaugcagacauggggcccucuccaccagcaaagccuauccagagucuuccuuccucguuuaaaaacggagugguuuugaggcccuugauugugccagugaauccugaauuaugggugaggcagccaacuuaguguggcaguggcacaggcuucaggcauggguuugaaaggcugugugugauuggguaaaagcugaagggaagggggcauggcuggagcucugcuguucugcugacagagauaagagggaacugaaagcacgugugucauugggaagugcuguagggguggcugagucagagcaucaggacuugaccagaguugaaggacacaaagucuguacugaaggucaccauggagaggaacaagaaaggaacaagggaaucggggucagcugcuucaguagcccaggaaggacagguugggacaguaggaaguggauuugucugaggaguguucaggaaaccaguucugggaugccuagacaccugguaugggcauuugggcaucacucaccaaaauagugaugccagagagggugcugacuccuggcuuacagggauauaacuuggggcucaucuucaggggacuguccccucucuaaaagaauguucccugggacacgaggaacacagauaucucguuuaagggcaaguaagauguugcugugagccucuggacugcugucccgugugcugugugcacuguggcagcaugaauggccagagucccucagaggcacgugacuuacauucucaagaacagggaaguggcuuuccugaggcacucuuuuuuuuuuuuuuugggaggaacaaaaggcucacucccugcuuuccuuucagguacgcuccggaauguuuaauccaguguaaauuuuauaucgccucugaugucuggucuuuuggagugacacugcacgagcugcucacuuacugugacucagauuuuagucccauggccguaaguguuaacugcuaccucuugucagugugccacauggagaggguuacagcaugcuaucucacauggucuggcaaaguuugccuucacaagugcagaauucaguaagacgacucagguuuuuagggugagggucaucacaagagagaaugauacacuuugagcauugccguagggguuuuguuuucauacgacugacagcugugguugguccccucagaugugcuguuauggaccaauccuugagagcgcaaauaaggguuuuagauuuucauuugaaguuauggaagagaaaagcuuuguugcuuuaauuucuucuuacuucugaaagcaucaccuuaauuuuguuugguuuuauuuuacauaguuguuccugaaaaugauaggcccaacucauggccagaugacagugacacggcuugugaauacucugaaagaaggaaagcgucugccauguccacccaacuguccugaugagguagcuguguccccuucaugggaagggaacugcauuuugaaugucuuuacagcuugccuuauccagcaugggaggggaauaacagaaccgaaggccuuacacuggcuacaguguuggcucuugcuuaagaguacucgcuauucuuucugagguccuagguuccauuuacagcauccacuuggguaagacaugagagaaaucccuccugcgggggaugauaugcugcucaagcaaggcuccucucagggagcuguggccuccauaccgugcaugucugccuucccagaagagcacaugugaugaggucuuaccauugccugaagacauuuaccccacucacuagcauuuucaguuuucuagauucuaaacuggaucaagccuccauagauacucaggacugucuggucagaggcaggugcagugguggugaaggggguaggcagauuaguaacuuuccugccccucucacagggucacaauagugaccuggauuuuguugaaaaucaguuaaccugugaguuaaacaaaugauaauaccauuuaugaacuauuauuuucugcauuuuaaguugcucaaauacucaguuguuuagucuuguuaaaggacagcaguuucuagcguauucuugauaauuuuguguuuuugaauguguggaugcuuauggaugccagagacugagggaugugucugcuugguugccccggcuuuguuugcugaggcagggucucccuggaguuagucccucuggcuuugcgaggcuggccagucugccuuacagcugcuacccacgccucgccuuuaaacugugugucaugcucugaacuuuaaguuacacucguggggcaaguacgugauccaccaagccaacuuuccagccucuuauuguucuuuuagaaucucucaaaucugauauuauucauacuguucuugcuuuuauuuuucauagguuuaucagcuuaugagaaaaugcugggaauuccaaccaucuaaccggacaacuuuucagaaccuuauugaaggauuugaagcacuuuuaaaauaagaagcaugaacaacauuuaaauucccauuuaucaaauccuucucucccaagccauuuaaaaacguuuuuuaagugaaaaguuuguauucugccucuaaaguuccucaacaaaua

SEQ ID NO: 2001 - RNA, 4099 nt, Mus musculus
guuuggaaguuagcacauuaccuuuaaucaagagacugcagagauugucacccuugcaggagguuaaguuaugucaaguuaucagcucgagaaggagcagcagccccuggagccaagaccugaagcuaaugcuucccaggcugcgcucagccucagggaccuggucuauuaaagcugcugcuaccuucaguguugaguuuaguaacuuagcaaucauguaguaagagaguagaaacugugacagagaauaagcccugaaauagcccuaaauacccacuauuuagagggagagcaggagucuuuuguucuuuggagccugauuuguggguaucauguagcaaucauucaguaauccuugagcagacaccccugucaagggucuugaccuuggugaaucauugaugauucuaguguaagcagagaggccuggaauccagugaugcccacaauccagaguagauuugggggugagaccuaguucaggaaaguuguuugugcuucaugaggcuguuguaggccucugagguagcuauggcagggcacuggugcauagcugugcaggacagguuaagagguuugggaagguuaagugggcuugaguccgaugcuaggcucaugagccacacugcugaucgcuuuccuugauaacuaggagguugcucuguggagguaacugcauuacucaaagacauuuccaggggacauggcagaagcuucuuugagauugcuggcucugaccuugguuagaagaagccagaaacugaagccugagagauuaucaggagaaagagauauguggcugcuuuuuaaauuuuaacuuuaaauauguucuucuguccucuugaaaagaaggaauacacuuaaaguuaacauuaacaguguggaacauagaauaggauguguguagguagccgccugccucugcacgcuggacuuccuccccacucgucccuuuuucuuucccuggccuuuguucagacacuugcucuuccgugcuuucucugucuauggcguucugcuguuuuugacaccagguuuuaaaagauggcuccucugggguagcucgugggguagccuuugugcuggccuugaucagaccaccuagguugcuguguguuggacucaccauaggacuuccguggccaggaauuaugcaggcugcaggcccacccuuguagcugcagaggcaguauuuugcauauuagguggucccaggagcuggccuauaggugggucuguugucuuuccccagagugcauagagcgaauccccuggaucgcuccugaguguguugaagacuccaagaaccugaguguggcugcugacaaguggagcuuuggaaccacgcucugggaaaucugcuacaacggagagauuccucucaaagacaagacccucauugaggugagcacuuguuuccagacugagguggacaagaucucagaugcucaugggccugugagcuuggucgucuuacacuuguaaguaaccuucagccucggcuccauaaaacgggaauaaauaaugacuccucugucgaguccuuaggaagguagacaggcauugcacagcugcaguauaaaaacgaggcuuuaaaugaguggagcuccugguguguacugacugcccuagacaggacugaggcuugggccuuccccugaggacugcuaaggcuugcagaggguuaagcucagaaaugaaagauauaaauauuuuuuaaacggucauaacugugccauuccugacugacugcuaugacuuuggccuggugaacauguaguuuuuaauuuacuguugugugagcacuuccucgugggaacuuagugaguuaauuggcgcguccagcgcugacuuccuuccguagcucacuuacugugguauuuacaguuugcucugucuuuguaggguaagcauggcucgugugguuuguuucugagcagugugguaauuggaauuagugggugagugaggaggaucaggaaggcugcugcucguugccacacaauuccagagaagcugccgggcuucccuagaacacagcaccuugggagugggaggugcuaccguuucuccuugaaucugggauaugucacuaucacgacugcuuuccucauacuggaaagaggccacugaaaccccacauugaggacauuugccuuuuggcagagacacuggggauugaaguagggauuggcaguuguuucugaagguguagagucgaaggucugaggguggguaccuggucucccaaucgucauucuuuuuuacagaaagagagguuuuaugaaagccgcugcaggccugugacuccaucuugcaaggagcuagcugaccucaugacucgcugcaugaacuaugaccccaaccagagacccuucuuccgagccaucaugagggacauuaacaagcuggaggagcagagugagucuggccagccagucccagccucagagacugcuggggcagggaggguggcaguccugguuacugcuuggaggcuaaucuguuuccuugucucuucacuuagauccagacauuguuucagaaaagcagccaacaacagagguggaccccacucacuuugaaaagcgguuccugaagaggauucgugacuugggagaggcaaguuacacuugggcucuagccucugucugcauggacagcugccauauuccccuuuguccuucgucagaggcuuuaagagaagcaccuuaaugcccuuugucaagggacacuugaccaugccaaguuagguguaccugcaugugaaugacugcauaaauacccaggaccugggacagcuuccucaaguaccuugacuuuucucugugcuguagaggagggccaagcauagauguagacuaaacgggagcaucucuaacucugacucuuccaagauuauacugugauuccuuacauaaggagagugccaagauaugagucacggguuuuccuuugaguagcagcuggugugaccacgggaguuccuggguugguguuuucauauagauagacucucagacgcucacuuaacaucaugacuguacuggacuaacagcaucuguacugggcauuuucacacucguccgucauccuccuacugauaaguggcauauuugggauuugaagcuccccugugcaaaugcucuuuugagcccugcuagccuguccuauagcauggaccugugacuaugaaagaaugccucagcuguccuccgaaugcagagguggccucauugcuggagaguacacugucuuagaaacugggauugauggguaaaguggucccuuagucaccagcugcuuucuuagucuucgcucaguagcagaggucauugagucaagugaggaugagcugagccgagaggagucaggagaucagaccgaggugaugcuuguggccgugagagacagccugagaacaaggcauuuccucagcggaucuagcuugucugggcaucucugauagcauggacauauuccuuccagggucacuuugggaagguugagcucugcagauaugauccugagggagacaacacaggggagcagguagcugucaagucccugaagccugagaguggagguaaccacauagcugaucugaagaaggagauagagaucuuacggaaccucuaccaugagaacauugugaaguacaaaggaaucugcauggaagacgguauguugugcacacuggacugugggauaaagguccaguggcucucuggguccuaagggcauuugcugguaggcaguccgcagcuucaucuuuaccagcuccugugggcugucagacauucaggucucacaacaacaagguccuuaccaacugcaggccuccugggaggcuucucccagccgcaggaugugaacuuugucuuucagauucacguauaaugcugggaagcaucccagauagccacacuugugccauaaggaaguuaaacuacucacccccauuccucuucugaucuagugcuaccuaaggccuucugcucuguccuuauugaagcuaagguagcaaauaguacuuaguagucacauuuacuaauacuguaccuuaucugcaaggcagucaugcaugugcuuuaaaacu

SEQ ID NO: 2002 - RNA, 11153 nt, Mus musculus
uugacauagaauguagccuguaguaaaagauuucuaucucagugagacuuuuagucucuaucuacagacagcugaguaaaugacagauguuuauauuguuuuaugaugggacuaauuaguuacugaauagguuaagcuccuugcugcuaucugaaaucuaagaacacuggaaaaaggcuuuagcuauguuagaauacaaucuuaaaaggcauuuacuauaagguaauacuauauagagugcacguggaucuauacacuagacuaaugugagaauggaaaaauuaauuuuaugguuuauauagauuagggagaaaaugccaggccccugggaagggaguuuccuugaaacucuuugcuucaugaacuagcuuuccagcuuucgcuuugucaagcugacuccaccagagucccuggcagguggagaaaggaaagaagugagagagagagagagaguaacugguaaagagacgggguggcucccggcgccugguuuuccuccucuguccugguagagaagugaguacugaaaacuaagacacuaaguggacaugucaacauaugcuaaaagucauauauggcuuugcucuccuggcccaucuggguccuugccauugguuaaguucaaaugggcaugacucuuuacauguaagucauggcuucaguuccuuuaccacguagaaaggaucccagacauacauguuagucuaggaagaggugauaggaccuuguuuaaguuuggagccuaaaacacauauuccaugcaauugccugggccccacacuagacugugacccaaaagugucaccaacugugguacucacuggcuuguguauucaaaguccuuaggagggaugagugacagagagaaaugugauaaauccuggguucucuaagagccucacucucuacuccaauuauaugucaugcacaugccguugugugcaugcauggaggagccagagguuaaccucaaguguuacuccucaggagccguccaccuuguuuucucaguaugcuuggagauucggugaggcuggcuggcgaggaagcgccggggaucuaccugucucugauuuucagcacugaaggauuacacucacacauuaccauggccagauuuucacacugaggcugggccugaacucagguccuuguacuuacacaagcacacgcgugacagagcugucuucacagaccccacucaugguacuuuuuaaggugaugugggcugaagacacauccucuauuaagguucuagaucuucaugcaaccaugauacuggcugguaucucuaacuucagaucucugaagcugaucugugcugucauguagaguggucuuauuuacuuaauagaauaaaauaauauuuucauguagaggugacauuccauaacauuuuuuuuuugaaaaagccaugucacuauccauuccuuaaucagauauaauuuuauucauaugcauugauacugucugacacauaaugccauucccuguuuaacucugaccacccaacagugaaggaccaaaugcaaagcugucaauuaaguuacuuuuuuuguuuauaaaauggaucguuucucuccguuugagauauguugauuuguccuuaggacuuucuuagugucaaucuucccagacaugaaagguuccacagacccuguuuguccucagcauaaccgucuucauacccugugcaagcugcuacauuguuuugcuccuuguuaccaaauggagccuggaagaguggugaacacaggagcggugugaagugugucugguccugucccgguguccugcuucccaugccuuucgccugcugugaugagacuucucgggaggaaggcaagauggcugccauccuucaguuaucacaguacuguaccuuuagaauggacagcaucagcacugugauaacugagccagggcagccugucagucaccguguccgucagugacgucacccccuucgaaggugccccucggagugaaggacugaaagaugcacuucuggauggaggcaaaaagcagaagaaaagaggucauuugaugagggugaagcaguaaagaccaauugaacuacaguaaaggaaaggugaacacaucucucucucucucucucucucucucucucucucucacacacacacacacacacacacacacacaaauggaguaagcacaagugaacuuucuuucugguuauaugcacaucuuacauuucucaguaugucucuauguucacagaccgcauccccccaaucucacaccuaugcaccaaguguuuauuccaggaagguuaaguuucaagcccuuucuuagagccaggcuuguuggcgccagccuuuaucccagcacucagaaggcaaaggcaggcugaucucugugaguucugugagacacgguuccauaaccagacaccagagggugcuucacagcugccugagagucaauacuuuucuguuuguuucuucauuuaauuuuuauaaaauccuacggaguuaacaaugaauuguucucaaacccauccaaaaaggaauuauggaacuagguucagcaacaugauagcacuuuacagauugaagaaacaaaacgaaacucagggcaggaagucggagagggauccgaucaagaaccauaaacgugcaugaaauugucacagaauaacuucaaaaguacaugugcaugugcauacacacauguacacacaacacacagcugcugaggucacuuagcaguuaagaguguagacugcucuuauagagaaccugggucccauuuccagaauccaaacaguggcuuacaaccaucucuaauucuagauccagaggaucugaugcugucuuucugcacccugggggcacugcacacacacacacacacacacacacacacacacaugcacacacgcacagcacacagacauacacgcagacaaaacacucaaauccauaaaauaaaaauaaagccagugagguggugcacaccuuuaaucccagcacucaagaggcagaggcaggaagaagucugugagcuuggguccagccuagucuacauagcaagcuacaggacagccaggaauacauaaacauccugucucaaaaaacuaaaaaacaaaaaucuuuuuuaaaaaaguguaaaaaaaacccacagaaacccugggacauucugugauuugcccaagaucuuauaacuaagcaacucagguccaaauuaguuucuguagacauuggaucuuccuucucuccccugcucaucucaucacuguccaggauauucaguugauaacacucacaaacauuacugaguguuuuguacggagaucugguuuccuaguaacccagaccaugaaacagaaacuaaugguuuguacuuucagaaguaauuccccccaaaucagucuugcugcucuagacucugaacagucacguugcugacccgcugggcggugcucacccacgccaugcucucacugugguuuaugccaguucuacagguaaaaucgugugaggcuagaaaucuuugggaugacuuuuacauaauaauaaucaauauauuacuaacauauuuauuaauaaaaucacuaacauaggguguaguuauuaauauacaauauaaccauuaccacacauuaucuauuauaguagguauaauagauaauaaauuauuaaugcaauaauuaaaauaauaauaauaauggauacaggguuucucucuguggccuggcuguccuggaacuugcuauagaucaggcuggccucaaacucacagaucuaucugccccugccuucuaaaugcuaggacuaaaggcaugcaccaccacugccaugcuggaaugugucuuuuaaaaaaggcaacacaacaucacuuucauuauuaguagcuguaccuuugagacauacccuaaaguuacuucagagaggaguccuguuuuuaauaaaagguacaaaaaagggcugggcaugguggcgcaugccuuuagucccacuagggaagcugaggcagguggaucucugugccuucuaggcuacccugggagguguuuaaaaaggucuguaagaucagaaugucaacauaagaauaccaacguuuuaaaaccaugauucauuccauuuucccaugucagucacaucucaaacaauuucagcaugagcagagcuugacaaguauuugaaaaauaaugguguuuucaauuagucauuugcucaauuucaaagacucacuauaugcagaucagacauuaacucugccucaaauaagucagauaggcgaaucaauucuuuagaucaggagucaaaaaccagaauagcacaaugaauguagcucagcaaguaacucuauguacuacaaaacugaccuucaucuuuagaaaagugauaaccaaaugaaauaaucuaccucacagaaauuaaaaacaaccucuccaaagugcaaagauagcuaaaaguuaaggcgucauuggcaaguagggcuuagcaaacugauguaauacauauuugaggcacaagguggcagugaagauugaaagaaagaacgagcuggugcccacaacucuugauuccuggaaaugguugcacguuuucacccaaaucauacgcaggucaugugaacaaagcuaguuugauuguuacaaaagaaaaaaguuuggagaucugaguaaccaaaaaguauaaaaauacuaaugcuuaguuucuccugaccacagaaucuucuccaucuauggaaacacacuugaauuccagcguuccagaggcagaggcaggcagauuucugaguuugaggccagccuggccuacagagugaguuccaggacagccacggcuacagagaaacccugucuugaaaaaccaaaccaaacuaacaccaacaccaacaaaagacaaaacagccagacauagugggccgugccuauucaaucccagcacuguggaagcauuauggcugcguugaguuccaagucagccugagcuagagggugaauucuaggccaaccuuaaauauagggagacccugucuuaaaaacaagcaaacagacaaacaaaaaacaagacaagacaaaacaaaacaaaacaaaaaaacccaaaguuuaaaaacaaaacaacaaaaaaagaaccaauuucuucguaauuacuucuccgaaaaauuucuuaaaauccaaguccuucagggacagugcugugccauauaccuugcuccugagugacacagaauacaaaugaucugacugaagguacacugugcuccugccaacugcaagcuaaaaaauuaacauaugaccugaagccauuaaacugccuauguguuacauaacuggaggcaugggaaguugcccauaagccagaacuguuugaagacugcugcuggcuaauuuaaauccccaacuccuuuaacuugaaaaccauaaaccagcugacugacaauauuaaauaguauggcaguguccuggcagcaggggucuccacauccgcacuugccuggccaggagccucaguggugcaugcagugugcaccuugcugcaaacucggcuauauuacacuuuaagaaacuaaaugugccaaagacuuguggaaaacccuggaaaagguugcagauugguuuguuguuuuuuguuuucccucuuccuugaggagaaagaccgguuaaaagucaaggcaacacguucuguucaaagccagcccugacauucaaacacagccagcaccaagacgcgcacaucacugucccauccacuucgggcacuggccucgaaaauguucaggcugcacagcagcaggcccauguagaugagaucaaaccagcauccuuccagagaagacauguacaaagucccacaggcagggggcuggagagauggcuccgugaguaaaacugcuucuuucaaaggcugaugccuggaguuccauccccggagaccuacaugaugcaagagaggacagacuuccacaacuuccacacaagugccauggcucgcucucacacacacacacacacacacacacacacacaaauuuaauugaguaaaaacaauaaaaaacaggcuuuguuccucaagcucaugauuuucguccaaaaauguccaagagacagaaaucugauuguuccauaugcucucuuuuaaaagccuucccuuuuaauccauguagcucagugugaauguaguuagccuggcuacucaaguuacuuuacuuucugacucugcucuggauugcauuuuauacccagaauuuugacuuuauaguuuacucacaaguaauuuccacuccguguuuaccucuauagaauaugcuuuuacaguaaucaaaaacaccccaguugaggcugugugcacuggcacacacugguaaucccugcccuugggaggcuaagaaaaagaacugcuuuguuugaagccuguuugggcuacgcauuaaguuugaggccagccuaugcuacagagcaagagcccaucauucauucucauauauauauauauauauauauauauauauauauauauauauauauauauauaugaaugauugggaagauggcuaaguaguuaggagcacuugcugcucuuccagaggaccuggguucaauucccagcacugacaaggcagcucauaacggucuguaaucccaggggaucugaugcccuuuucuagcacgguacacugauaagcaugcaggcaaaacacccuauucacauaaaaauaaaaauaaagguuaaaaagaaucuuuggaagacuuacccaaaauaacaauaaaaacaaccagucaaccaaguaguuucuuacaaaguuacucauuacaaauaggaaaaaaauauuaauuguagcuggccaugaucccagcacugggagguuacugcgggaagaucugguguuuaaggguagccugggcuacauaacaaaaaguuaacuucagacugaucaccaccacuagccaucccuaaaacuucugaugguuuuucuguuagccuacaguguccuauuuacugacgcacugccauuuaaauauugagucuuagguuuugaaaaucccuaaugcacaguuaaaagggauaauaccaaagauuuaauguugaucuccaauucacacccuuuggcuagaccauaaauauaaucacacaccacuucucugcagggucccccauucucauuacuagccuuauucgugugaaauaaacguguuucuacuggcaaggcaugccacggugacaugucacucacugagcggggauaacugcacagccuggcacuguguguaguuaauaaccagucaacucucucuaaagucacacaauguucuuuucaugucccuucucagcacaucucagccauguccaaaaguucagcaaacacuggcucuucauuucucugguuaucaauaagauugucuauuugauuucuuucuuugcaguauauuggacaguuugucauuuauaaaauaaggauaguacacacaggaggcagaggcagguugauuucugaguuugaugccagccugguuuauguagugaauuucaggccagccaggguuacauaaugagacccugucucaagaaacaaacaaaugccuucccagugccauuacugaauuucuuuagacaaaacaaaucccccuaaagcaguauuccucauugcugcuguguuauaguuuugggagggucaggaguuggcaauccugagcucuaaaggagaugaaauuaaaagaaaauacaaaauaaaugaagguaauagaagacuggcaacauugucaccaugugucacaacugcugccacgucaccuaguguuuucagauacauuguuacugccaggagacguuuaaacaagcagcuguugggagguaccuuaguuuucccaaauuucccacaagccacugcuacccccuuaaauuuuuuuucacauuuuguuaguuugguuuuaaccuccugaaaagcagacauuaggaguucugggacagaggaauaguuccauguggugggauuccucagucuuuagaccaggcuggccucgaacucagaaaucuaccugccuaugccucccaagugcugggaucaaagguguaugccaccacugccuggcuauagacacauuuuuaaaaacugaaauuagcugggcuuaguggugcgcaccuuuagucccagcacucagaaagcagagggaauaagaucuauaggaguucaaggccaaccugaucuaaaaagugaguuccaggacagcuagggcaacacagagaaacccugucuuaaaaauccaaaaggaaaacaaaaccuuuaccccacuaagcuaaaauuaguaagugacauauuauaaaccuguauuucuuuucuauacugccuucaaaaagccacuguauuuauacuuaaaacauaucuugauuccaguucuuaauuuucaagagauauuuaaucuguauuuagauucaacaguguguauauauauauguguguguguguguauauauguguguguguguguguguguguguguaugcaugcuaauguuuguuucccaaacaguuaaguuuccaauaccugagucauuuauggauucuaaaaguuaaaugaguuucaaacuugaucucaucagccucuuuaguuuagauggcuggagccuaggguugcuaggggcuacaguaguagcugguacagacuauucugucagucacuuagauuuuuuuaaaccugaauccggauacaagcccuuaacccacugagcagcaagucuugcugccguauacaccaacuguuccaguauguucuuuuucuacaauacauugcaaagcagcuguuucuggaaagucggcucgguaaggagaaagguguuaucucaaaucaggggcauagccagccaagcuuaguggcacacaccuuuaauccuagagacaggugaucucugaguuccaggcuagccuggucuauggagagagggggaggggagagaggagagaggagaguggagagaggagagcgagagagcgagagagcgagagagagagagagagagagagagagagagagagggagagagagagaaagagagagagaaagagagagagagagagagagagagagagagcacaccacacagagaacaaccaggguuaauuuccaaggaaaaggggagaaaccuugacacuggagcuucuuugucuaggacauuagucacccugugaaaguuacaauuauuguuuacacuaagccucucaacuuucagagaacagcugccgcugcauccuaagacucacucuucuucaaguaccccuuccuagcuucugucuaccaggcugaucuaccaggguugcagaucauaauccacgagucccacuuuauacauacaaagaccugcuacuguuuacaugccaacacauaugaauaauaaacaccacaccucaguuaucauucaugagccucaguauuccagacuaccucgagaaaagcauuuacuaacacuauagcuuucucuucccuuucacgcugggucacagcucacuuuguucccccagccgcugauuucaaaguugaucucgugaaggaacuggauuccuaagguaguuaguucuauuuugagccuucuuccuguucugaagcuaaaguuggaagggcuuaguggugaugucauggaagggagaagugccuuuuuucagaagggucucuucuggcaauucccaggacacauagguggugaacgaucccccucucaccaucccucaccucuccuucccucuggagucccaguuagucacuagccaggaagaaaaucaacucuaauaacaggcaaucacacuugcauauuuuauauuccaaacauaauaaaugaaaagacagagaaaaaaauugccuaguucuaggaaagggguggggguggcuaucucuccccauccacucucuccaauauaaggccaggaggagcaaaaggcacugcagaaaacagcuguuaggaagaauucaggaggcuccgggaggagaaugcuacggggguuuuggaaaccggaacuugaggacacccccccccaaauccuuucuucuucccucccucuuggaagagacuuggggcugggugugccuucugcuuugagaagcauuuggcucgguagaaaggcaaggggccagggugcggcccacagggaauaaaagcuuaggccuggcucugggcuaaguuuagugggagauagaggagaccggagaagugcaggucugaguggaagaccuacuguggaauuaaaaaaaaaaaaaacccucacuaggggcagggcgggagacaccucucuuuuucaacuuaaacucaacaguucauugccggugggaagaagggugaagaaagagacaaauuuuaacguaaacugugaauugcaacuucuggggacuagagagggcugacguaccaacgcuaucagcaggugaaaagaagcgccuuuuaccaauucuggggugucgaggucuggccaagcucuggugggcagggcacugucuggcuucuuagcucaccucgccuccaaagcgggaagaagcauagguguggucuuucuccaggaagguggcagcuggcuucgcggggcaagggaaaggauuccucaccgggaaggcggggaggagccccggggucagcugcggccaggagccggggucuucgccaaguccccucccccuccugaaaaccgaccuggacuaggaucgauuacagcaacacccucucgccuucccaauaauuucgcaaauaauaguaauaagcccagccccucuggcgcacguuuaaaacaaacaagcaaacaaacaaaaacccagagcccugagcgguggaaacaaacaggugaguccagggagaagcgggaaagagugggggauaagagggggggcguucccaaacguaaggggaaacagagguucucccaaccucucuccauuuuccuucccccugccccccaagagucugcgugacaggcuagguaccgcaaagcccacucugacagccuucccgcagcccgcgcccccgccugccuacccuaggcucccguguccaggcuucggggaccgcgcggcgcucgcccgcaccccggcccgccaccgccgccgcggggacuccgcucuuccucucuccgccuccuccucgcagacuccucccgccggauccgucauguaaacaacaucccggcucuauuuccagcggccgc

SEQ ID NO: 2003 - RNA, 48448 nt, Mus musculus
aauggugcguacauauuccaagccuuccuccaucgguaccuguaaagguugcauaauaaaaucacacagccuagaauuggacacaggguaggcgcucaacaaguuguguuuuuccuuccccuugacaauagaccggguccccaggcgguuccuuucucucugggcgucuucaucuccguucgcccccgcagccucagccuggcuccggacacgccgggaggggagaggagggggcgcggcggcgguagcguggagccggcucccggcuuacguaagaagcagcgagucccgcgcggccagcccggcagaggcggcgccgcccagcgggauccgggcuaagucuggccgcgcuccuuuccaccgaggugugugucuccccggcugcucgggacggaggugggccccuccaguugcaggcagcggccacuguggggggaagcgacagucaccgagaagcgcccggagagcugcucccacucugcccacgugcggggaccggcaggggcuucccggaguugcgcgccuggacugggcagcagggaaggacucgggugggucugacugaccucugaccccagagggccgagcuugcaggccgggggaugggaguggggguggggugggggcugcgacgguucaccggagcggccggggcccgaggagguggcggagggcggggccgaggggcggggcagucuuuaaagccucuccuuuccccuguagggguggcaggcgaguccccgcgugcggagggugucgaggcaggggcugcugggcaaagugcgcgggcugccguccuggccaccgccaaagccauggcuuccaaacuccugcgcgcggucauccucgggccgcccggcucuggcaagggcaccguuugcgaaaggaucgcccagaacuuuggccuccagcaucucuccagcggccacuuguugcgggagaaccucaagaccggcacgggugaggagcuaaggcggggggagugaggguagagacgagucuggcggguuggucgggccgggagcagggcggucgcgggcucggguccccucggcgccggcgcccugcccccgcccgcgugugcccgugcgggcuuguacgugccgcggcgcaugcagccggccgccagccugcccgcccgcccgcgcugcuuaaccgcgcccgggggaggccgaggcugcucggcagcgccucggacugcacuggccgcacgcgcgugggaagggacccugcacggcaggccgagggaaacgcgagccucucggcggggacccuaacuggccucucgugccgccugccgaaagccgagccccuggguucccaguugugguccuucucaaccgcgggucgccuucccccgcgaggagacgagcaccgcgccgcccaccugugggagucgcggccgcuggcgcucugggacucugcggcucgcucccccacggccucucgcgcgcgcuccagccuggagcuaagugcugcguggcggugaaaggccuguggucggugcaggcggccgcgacgaacugucccugcuaacccccccccccccuccucaagcccagcuuggccgccugcagacccggagacuuguucugaaagauugcauuuugagugcagcuuugcugcaaguggccuuuugagguugucccuuggcggaugcggugaaguugggggucuagaucgccccaucacuuagucuugcaagugucucccuucuccccucuuccucgguuccaaagaaggugaguuauccgcgugcuacuguggggcgcagaccauccugggaugcugaugaguguuaauuagcaaaccccuuaugaaauguguugcccauaagauccuucccuauuucuguucucauuugugugcacggugguuauggcuuguuauggguuaauuguuaauaaaucugcauuucagaagcaccuaggaucaugaacagguggguggaggacaauguuggaaagcgauuaaaagcaaccucuugaagcaucugaaaagcuacuuauuauacccugaagcagguugcaaagaccagccuuuauuuggacaaucagggguacuuucccucauaugugugucagagauagaagcguuugugcguaccgggucuucuaauaaucuaggcagguaccgcaccauggagcgacauucaaaaccgguuuuaaauuagaauuuaaaaucuuauuuauuuguuauuugagugugguacuagcuuugugcacggggagcuccccgugucaagugccuuuauucauacuuugauccaccucaccugcccauagauuugagauaguuacuguaucaguacacuccacuccccagugagauccauuuucucugucgaccuucaugccuguaugaacgcucgggaagcacuguacucuugagcuccauacaggcgguccccuccucucucauggucuuucagcauuuggaauacaguuugggagggggggcaauacaguuggagggguugugcaugggguuggggcucucccaguaaggcuauagagaaagauagcugagucaagguaguuuaauacccagcacauuuccuaacauccucugcaguuccuucuggaauggaaaguuuuacacugaaccucuggcuugacuauaggcauuuuucuuuaauaauaauaguaauuauucaucaucaucaccaucaaagggagucaggcuagcugccuuuauuggguaggcugucuggcuucacucaaaggccaugcacuugauuuugaagucaccauuuacuuccauauaguuggcggccaucaugcugaggcaguuggggagucugguagccuaauggucaggcgagccuguugaggggauucggaucuccgcgaugcuucucucagguuggagaaggaagcugucucccaggcucuccugcgcuugcugucaaacaggagggcaaugacuucuguuaucauuguacaacuagaccuggauccuggaacuagcuuuguaggucaggcuggucucaaacucugagaucccucugccucugccuccugaaugcugaguuuaaaggccugugcuucccucuacacauggcucuaagauaagagauagcuuauuuuucuacuuaggaguuuggaaagcuuuuuauuuggcugucuuuuguucuccccccccccuauuuuuuuaaaggcuaauuuauuauuuuacagguauggauauugcaucucuaugcgaaccacguucaugccugguacccauagugaucaaaagagggcaucagaucccaugaaacuggaguuacaaaugauugacauguggguccugggcgccugaucaagguccuuuugagcaccuagugcucuuaaccacugagccaccccuccagcaaccaucauuauuuuaauuuucuuuuuaucccccccccccccgcccucccccccgcacccuuuuugguuucucaaaacuauuucucuguagcccuggcuggccugaaacucacuuuguagaccagacuggccucagucaaacuccugccucugccucccaaguguugcgauuaaagccuuacaccaccaucaccugaaauguuucuauucuuuuaaaugccuuuauuccucaacccuuuucucucauaguaaaauuaaaugcuuuuuaaaaucaccuuuucuuuccuuccgcccccuugaacuaauaaaaaacuugaccagggaaaaacuagaaaugaaagacuuccguuuguuuugaaauuggcucguuccaaguggacuugggugcaacgucacugaaugccucuagagaucuaagugaggggcuguaauauaaacaaggacacauucuucacuuucuuucugucaccugggguuugcuuuuaaccuucuagggaagccaagaaacuuucugagcccacaguagguccacaucuguuuuuuuuuuuuuuuuuuuuuugcuuuuuguuuuuuuugagacaggguuucucuguguagcccuggcuguccuggaacucacucuguagaccaggcuggccucgaacucagaaauccgccugccucugccucccgagugcugggauuaaaggcgugcgccaccacgcccggcuguagguccacaucugaaggcgaugaugaggcccagcaaaacccagucaguggaaucucggugacaauuuaaauuggaaaguagcucaggccaucugcugcagccuggcucucaacugcauggcuugccuccugcagccacagucuggcaaaaagcugcucugcaggaaaggguccaucugaccucacugcucugcaggguccgucuccuuccucugcacuuacuaugcugauggcaucagcuguuuguugaauauagccaaaggaagacugauggcuggcugccucaucugcuguguuugugugccugaugugggggauaauaaagaaaagaauguacguauguuauaccuuuucuuuugagacaagucugugugaaccaccacgguggccuuugauuuuccuaggugcuggauuagaggccaggaggagcaacuuaaugaauguugugccucuuacugcaccuucuccuuacagcacauucuaccucugaaacugggcuccaccaaacuguaaugcaccacaagggguucauguugucaggauuaaggguacaaguccagucagaaauugugucuuguaccagaaguuaccuagccugcuucaguuagcguaguacuuacaaaggacuugagacuagcuuccugauaguuguuuuucccuuggccuuucuuagguugccuggagcuguacaggcugaggcuuaucaaauaccuuaugugagggcccgcccccgggucuucagcuuguauuuucuuagcacacacugugaagaaauaggaagacuugccuuaacucucaaggagcugggccguacauucucucagaggggauauuaugcucucucuaccccugcucacguguguguguguguguguguguguguguguguguguguguguguguguaagcaauugugcauagauguacacacaaagcugguaagcuuuagaacauaucccauggggcuggagagagggcucagagcacugcuguccuuccagaggacccagguucaauucccagcaccuccauggcaggucacaacugccaguaacuccaguucuaggacaucuggcacccucauauagaugcacauguagguaaaacuccagugcuuauaaaauaaaaguuuagaauguaucccauaaaaaauugcaauuuggggugggaauguagcucgguaggguguuugcccaacagugacaaaguccuggugguuagaguccuagcauugcaugggugucuggugguacaccccuguaauguuaggacaaggaagguugaagucucuaggucuggauuaacagggcuaguaagaaaaaaaaaugugcccagaaggaacuacaaccccccgccccccaagaacucugguauuuugugauagcuuucuuugcuaaguuuuaucugaaggauaugaagauccgguuuuaguguuaggcaggcagugguauuagaaaaccaggcaccuuuuaauacuggagucuagugucucacggguaggagaauuggagagguuccauuuggaagcaagcaucuuggacuugacuaaagaaaagauguucaagaaggaaccuguuucugcucuuaauuaauauuaacugcagcucuugccaggguguugcagauggacugacuagcauuuuaaaugaggcugugagcugauccucucugaaaagaugaccucguucaaagggcucaggcuuuuggguacucauuaaguauaaaugcacaccuuauguaagagugaauuuuuccaagaauugaggauagagggguuuggagaccuuagucagaguucaggauuacaucuaaagcaacuuuaaaugguuaaccuucucugguuuauccagggucuuggcucauuccaagauuucuaagguaugcuacauucuuguuuccuccuuguuuggcaagacucaggaggcccaggucucuugggcuauggaacuagugcaguugguauccugccuaguaugcaggaagcccuuggcuugaucccuugcucuguguauacagacauuuggguauagccuugguuuuggggaaucuaaaaaaaaaaaaaaaaaaaccaaaaaacggcuuuugccaggacuugaucuucugagccgucucucaaacccccaaaccccacucacuggucuugaacgucugaucuugcugcagccuccugggugcuggcacuguaggcagggccaccacuccaugguuuauauguugcuugggauuaaagccagagcuagcucugcacgcuaggcaagcugugggccagcugaggucuauuuaaauuguuuccauagguuauuuucauaagcaaauaacucaguagaauuuacauugacagugucaucaccuaauuugcagacauucucuaaauaccacugacuugucugcgaauguauuuccuguucuaagagccaauguaguagugcacagugcauggagucauuaagucuucuuugucaccuguaaucucgcuuuaauuuccccuuuccuuuaugaguuuaaguuuguuguuuuugguuuuaauuguuucacaacuugguuuuuugagacugggucuuuuauagcccauucuggcuuugaacuguggauccuucugccuuagccucuagaaugcucagauuauaggugugugccaucuugccugccuuucagaccuggcuccggucccuaauaucuggcuuugugguagaacgcaagguugucuuuggcuucuugaguuugugcugcaguguuugaaggcugaagucacacagauaaguaguugaaggaggaucucauggacucuggagacaucuccuggaugcucagauauccucaggcugugcucuggagacccaugaauuuaacuaguuuucuguugcugggaauugggguuagagucuccugguagacaggcagggagcagugaauggugucuugcagugaguguucugacccgggcaguguggcucuuaggguacacagcagugagaugagguugguuuucugaagggcugcucagcuucaggagagccaggaagcaagcaaggagucacagaacugcaugccucgcuccugagaccacagggggaaugaugguuuuuguaguguuuaagagggggugggauuggggaacacuuuuuuuuuuuuaaguagggucuugcucuguagcccaaguuggccuauaacucacaauguggucuaggauggccucaaacucuagucuugcugcaucagugucgugaguauugggaagccaugccuggcccaggaacacuuuaaacaguuacuaucaucuaaacaauugcuaucaucgacugcaugcgucccugcuaguguguguguguguguguguguguguguguguguguuugcaugcccaccuguguguaggucagaacaacuaucaagaguuauuuuuuucccaccuuccaacuuuauguggguucuggggaucaaacugagguagucagacuuguguggcaggugcuuacccacugagcuaccuugcuagccauuuccggggagcacuuuugagggaguguguccuaccuagucaggguugcugugcugccgaagcaccaugaccaaaagcaacuuggggaggacaggguugguucauuuggcuuccacagcgcuuuugaucuuuucaucagaggaggucugcacaggaacucaagcagggcaggaaccugguggcgggagcugaugcagaggccaggagugcugcuuacugccuugcucagcccgcccuuuauagaacccaggaccaucaucccagggacccuacccgcaaugggcugggcucuuccacaucaauuacuaauuaaauguccuccuggcuuguccacagccagaucuuauggaggcauuuucucagcugaggcuuccucugcuccagggacucuagcuuaugucaaggugacauagaacuggccagcccaagguguuucuugaacugaauuugacaagugacaccaguugucaggugaggagaugagcuuaauuguuauaacauaccuggggacucccucuagagcuguuguccacuaguguucauggacacaccuuauagaccagguuauauucuacugucuuuauuaauaccugcacuguuaaagcaaaggguuauuuuaccuuuacgggguucugcacuugcuaauccuaagcauuacagcugagcuacacccagaucuaaggcagguugcugcauuugcuccacgccccuugcccucagcuccuagucuuuguuuuuaagauacacauaaaagucgugugucaggggcuggaaagggccccacagggaagaguacaaacgacuuuuguagaggacccaaguuugauucccuagcacgcguggacaguucacagcugcucuuaauuuuagcucuggaggaucugaaaccugccauaggguacuucucacgcacauuucaaaucuuuuaaauucguacaguguaggguguucuuuuuuuuuuuuuuuucucuuuuuaauuuuauuuuuauauuuauuuuugagacagggcuggcugucuuggaacuagucuguagaccaaucuggucccaaacucagauuugccucuugucucccuaguccugggaauaaaggugugcaccaccacugcccagcaauacagugcaguuuauggcauuuugaacuuucuagaguucaagugauggcaaauaaucaugaaauugugguuugaaugguuaggauagacaguuuaugaagguauuucggccaccuauuugccaaacaaauuauuaaacgcugucauuuuguuauucuguauugcuucaugugugacuuguagacaugcaaguguuauuuuccuuaugaaguuuuuuugagcuuuccccaugggucagaccagacauucaaacaugggcuuccuuugagcaaacugacuuuuuuuuaaaagcauaaguagugauagacagguuuuaggguuacucucugcaccucccccuccccgcccccauuuaguucuguuuggccuuucagacacgguacagaaggucucauuugugcagccccaagagguccauuuuggaugguugauguuacauuuuaacagccucaccucuaaaccugacaacuuuuauacuagagaaauggccuggcagcaggcauuaguuuagugugaaaauacugcggcauuaguccugaucaucagauucugaagaagcuaacgauuaauuauuuucuagacuuaguacuuuaauaaacauauaauuuuuuuuauuugcaccacugaccaggguguuuuguaauucuugguguuugguccuaaguuugcagggaguuuaacaucugccagggccugggcuggcucuuuucuuccuguuauaauuuaccugccuaucuauguacaaaguagcaguucuuguuauauaauucuaaaauaagcaaauguccccagggguugagcaacuugcccuuccuaggucagacagcuagagaaacucauucaagccuggggcucgucuucagcucggaucacguucuuuaucgcgugcuaccuucugacaacgcuggaggaucuaguagaauguguuucccucaaguuuguaaucgaugggccuccauugacugcauuuuuguuuuuguugauauucagucuuacugcauagcuuuggucagcuugaaauugucuauaucccagguugucuuggacauuagauugauucuucuaccacucaccugguuagaaaugccauuuugagacaguaucuuaaccuguuugccugcuaacacaaaauguuucacacuguaguuuaaagcaacagaaauuuacuucaacauuucuuggagcaagcagacagaaauaggaucuugcuaugugguccuuacuggccuggccuguaacucaauguguagcccaggguggcugugaacuggauccugccccagccucuuaccaugcucaaaucauggguaugugucauguugccuggccauuucauacguaucugaaagcuggcagguuccagguacaaggcacugugaggaucugugauucugggcuggcuuucugagcacugcucauaugcuaaagggaugaagggggagggcuaaaugcugcuuaaagcuuuuuauugcugcuauuuuugaaaauuuauuauauauauuuguguggggugguugugcacucggagguggaggucagaggacaguuuauaggagucaguucugcugugugggugugggugucagggguugagcaauaauaggucaucagacuuaguggcaagugccuuucccuucugagccaucaugcugacugccugcccuuuuguuuuugacauugucugaccauggagacccagguaaguuuuagucacuuauccuccugccucagcuucgcacugagugcugggauuacaggccaugacaccaugcccaaauucuaaguuguuucucuccccccugauauuguaacuaaacuauauaguuauacuuacaaacuauaacugagcaguccucggaccuuuugcaauaggcaaggcaaccccauucuccagggagcccgugagcuaauaccuuuagaagucucaccuuuaaaaguugucauuggcaauucucuuaaaucuuaggugcaggagacacuuuggacaagcacagcagguggcagaagcucauggcagcuuagcucuccaaaagugugucgaggugcagaaaaguugggauggcaggguggcacauacuccaaaugcuaguucgcaggaggcugaggcaggaggauugagaauuuaaggccaguuugggcuguuguuccaggaaacaaguuugguaagacuagagauuuguagauuuuuuucuuuccagaagcucucuacccuugaaacauuugaaauacuucuaugaggaagguagcaccaccuccauccccaaaaggaccagcuaggucuaaaauagaccaucugcgggguugggguagacaugagucuucgcuguaacagugugagguuugcaauauugcgggagcccacuguuccaucauuaggcauuugaaucaguuuugugccagcgcuaggcauggggaggcaugcaugcaaaccuuguucuuugaccauuuugaacuuauggcuuaugaugguucauguuguaggugucucaugauguuccagugaggucuggugcugugugcgugcguguguggguggaguuuugaagucaaugacccggugggcuggggacauugcucagccuuaacuuuccccuggaaugccuaaugccuuucauuuucugaaucuguuuucagccuuggcuuugaagcuuuuugcacaguucccaccacagguggcacuuuucugggacuucuucauaccaucuguaucuuaguucauuuucuucucccaguaacggguuuccuuugguuguuaauaaugacuucagucauagucucucaccauuuaaauaguaaguuaauuaauagcaguugaguucagagguuuuagacauaccagagcaaagugucauuucuuauguuuuauuuuuuagauuuauuuacuuuuauuuauaugaguacauuguagcugucuucagacacacaccagaagaguccaucggaucccauuacggaugguugugagccaccaugugagaauugaacucagacaccucuggaagagcagucagugcucuuaaccacugagccaucucuccugccccauuuauuauguuuuauauccuguguuaaguaugccaggaagauagcauaccacagugaugacuggucacuggaaggucacuacauccgagaugggcaagcauuguaccauaguggggucagguugaagacaggucuuacugagaugcuugaucuaagcuccaaguggaggaaggaucugcuguucaaacauuggcagguagaguaaacuuaaaauggagaagagagaggaucguggcccacuccaugagaugcauggagugaguaagcuuaagguuugguaggucagauugucguuagaagaaauucauuucuguugcugcuguuaauauauaaaccagcuuuacugagauaaaauugucccuuuaaaaauguuuaaauaaagggucagguagaugguucaauagauaaaagugcuugccaugccagcuugauggugacuugagcucaguuccuggaacccaggaccccgggugagaggcuggaugugauggcuggcuugcaucuuuaauuccagcgaccuacaggcagguggcaaacucgccuggaagcuccuggggcuguuguaagcacgugcacaagaagcaagagagacccugccucaaaacaagauggccacagagacucugacauccacacacuucccagugacccacaccacagaacgaaaauacuguacugucaagcuaagugugguggcacaggcuacacucccaacuucagaggcagaggcagaggcagaggcagaagggugggagugaguuccaggccagccugguuuacaaugggaggucucgguugauguaauuuaauuuaguaagacuguuuccaaauaaagaguuggcggcauggcucaguaagcuugucuagcauguaggugaggccggccucugucugcucuuuaccgaacaaucuacagaagucagcugaacaugggauccuacaucuguaaucucagcauuugggaggccgaggcaagaagauuaugaguucaaggcgaacaugacuaugagaccccuucuuugaaacaagcaucaacaaaacccaaaacaagucaacaucaaaaacccaaaagaaaauugccuccagagauguacacaagccacauaguauucaguguauuuuacaguggcgaugccacucagugccuagucauaauguuuuccugaucucagaaaguugcugaccaauagcagguagcccauacccaucugcaucucgucucuggcagucauugaguaccuccuguguguucuggccuuagaucugccucugccuucacaaugcuggccuugcucuguuuuacauucuuaccagcaguuaggacccacuacacaauggaaguuuugucugaauuuuguuuuuuugccuccccagugcuuaugacuuuaucuacacuagaaaacccaucaguucagaucuuuuccuauguuaaaauggguucauuugguucuuauuuuggauauuagucuucuuaaagagaguggcuguuacuucuuaguuagaauagccaguguagauugaauaugaggucuaguuccaaguuuuuucuuaagcgagcgguaaccauggguaacuaagauauauccuccauaguuagauaacaacauucuuuuauuuuccaaaggaagguugcuuuuggcuugguaucaacuccaguccuuuaguuuuaggaaaaugaagucugcagcuuggaggaaguacaaaaucucuuuuccacugaguuuuguuuuggguuuccagaguucuuagggacuaaacaguccgcauaacaaugaaccugguaaguuguaaguauucacuuucuuaaaugucuuagaauuggaagggauuuugggucauucugcccaaguggccauuuuacacuugcuuccuccugcggcugauagcucuccccccaggcaucuuccauggcuguauaggucugaucauugggagauuuuccccucauacagagaugccauccacuugucuagcuucugucuucagugucacacaaauugcauccacuggcucuaaagauacugaaaauaguuucaaggcaccucuuugccaacuuaaguggucucuuuuccugagaaaaauagccuaguuucuuacacuguugauuuugagauuauauaucuagaccuaccuaccuaccuaccuuccuuccuuccuuccuuccuuccuuccuuccuuccucccucccucccucccucccucccucccucccucccucccuuccuaucaugcgugugcucgccuguguguugugugcccaugugaguguguuguguguguguucuguguagccuguagaaaagcuaugcuuuugauuuugaaucagucaauuuauuaagaauguuguagcaagugaaggaauaaauaauaaguuacaaagaaguagcagacaggaaacaacaucagaucaggagcucacguaugggagcacaggcagacaguggagcauuuccaccagaugguacuauugucuauuccguggaaaaguggcuacacugggaagucagugguucagcuuccccaggcagcuggcuggacacacaucucugcuggaugcaugucuaagucccugacuugauggugcuagcucugcaagcucugauuugggcugcaccaggcaucuucacugggacugaguaugaacacuugaucugaugcuguuaucuguccacuaacuugcuaauuauuccuuugcauauguguguuugugcaugugugcccaugugagugccccagugugaguguguauguuuguaugccucaagugugugcacuuaccaggggucaacuuuggguguguugcucaagaccuauucagauguuuuuguuuugcuuuucuuuaagacagggucucacugggaucuggggcucaucaguugacuaggcuggcuagccagugaaccuccgcaauccaggugucucucuuccucgggcugugauugcaagcacgugcuaccacgacaagcuuuuuauguguauuggacuugaguugaagcccucaugcucacagagcuaucuuaucuacuuagcuuguagauuccuccccuccccuccccuccccucuucucuucuuuucuuuuguuuaguuuuuaagucaaggucuuacuauguugaccagguaaagcugugccuuuucuuuauugagacaugguuugacuguguagacugggacucccuaugcagccuacggugccuggccuugaacagcuacugucacaaauaugaaaugugugccacuauacccugcuagauuuuaaaaaacaaaaaccaaccauuuuacuaugacuccauuuugauggccagcaucaccaccaguggcuaaaugggaccauuuuagcuguucagggcuguuguauucuacuuucucucaauuuucaugcuauuucagguaucgugaagaugcuucugcccuguguagccuugugaaacccucugaauaaccagugugguggcucacauuugcaaucauguacucaggaugcagagauugaaggaucagugcaagacaaguccagccuagucugcaaagugugucccaggccugcccaagauggaugcuagugagcugcugucucccuccccuucucccugcuaaagcuuguaggauucgagucaugagauaccagcgauagcuacucuagggugcucauaucgucuacccuuugauucagggccucuuugccaggucaagaguuuaggaugauuguguagaauugaugacaagaaaugcugggugcagggugucuuccagucaaaugcaguuuaaauguugggggcuuugaucaaugcauuaacaacagauuauaacuagcccagaguuaucugcaauuguuaguuuacuuggauugugucccauguauuacaugcauuauuucucauuuugguauguguaugugcuuguguguuugaacccaucuaugugucuggaagccagaagucagccuugggugucauuaauaacuucaggcuucaucaucuuauuuuaagacuuaauuuuucuaauaugaguauauuuauguaugagcacuguauguauacauggggccuuuagaggucagaagagaugcuggaucuucuguaacaaauuauaggcaguaaaccaccauauggguggguucugggaaugcaacccagguccucugcaagagcaaccagugcccucgaccacugaguuuucucuagaucuccccuuuuuugagauagggucucacuuucuugaaacuccucaauuaagcuaaguuugcuggugauggagcuccaggaauccuccugucucccuagugcugggauugcaaauacaagccaccauggugacuuucugguauuacugaacuauguauuaagcaaaguuccccaagcuugcauggcaagcacuuuacuauugacugagcugucucccagcccuguaguguuagcuuucuaaacucccaaacuauguuuagguuagcuguuuaguagaacucucauugguacccaccucagcucuguaccauugggugaagaggccaaccuuggcucacuuacagauggagugaugguagagcuuccuuggaggcuuaagaguguugacagggcuguaauuguuaguuuaguaauuguuagcaaggcaagucaggcacuguuuauggggaugugagagaaaccgagaaaucuuaauaauguacaucauucaaaaaauuaaaucucugggcuggagagauggcucagugguuaagagcacugucugcucuuccagagguccugaguucaauucccagcagccacaugguggcucacaaccaucuguaaugagaucugauggccucuucuggcaugcaggcauauaugcagauagagcacucauauguauauauaaaaagaucuuuuaagaaaguuaaaucucuguuaaugugagcuuucaugugggugcugggacugcaucccgauucucuggaagaguacuguugagcagugucuccagccguauuuuuccuuuucuuuagauuucauuuuuuuuucuuuauguaugugcauguguggguaccuucaggggucagaagagagguuacuggaucccauguagcugguguuaccggcagucaugaauugccccauguggacacugagaccuggucuuuggucccucuaggagagggaaaggaucuuaacuacugagcuaccucccugggcucucaauaaacuuuaaaaaaaauuauaauuuuuuaaaaaaaaucauguguauauguauguguaggugucuauguggguaugugcacaugagugcaagugcccaagguuagaaggucccuuggagcuggaguuaacaggcagcugugaucugccugacaagagagcugggagcugagcuuggguccucuguaagagcaguacuugcucuuaacugcugagcugucucuucaucuauggagagugccaguguaguggcuccugucuguaaucccagcacuuaggaagcugaagcaggacugcugugagcuaagaguccaacucagacuauauaauaauauauuccaggacaguuuaggcuccagaguuauaccuugccuuaggaaggaaggaaggaaggaaggaaggaaggagggaaggaaggaaggaaggaaggaaggaaggaaggaaggaaggaaggaagccuccaacaauauaaguaguuuuaauauagcagugaacaaaacaccaauguuuuugucuauguuuuugagagaggucuuguuggcaagccaggcuggggcacauggaaggaggaggaggcggcuguucacaguuacacugcugguauccagcauggacgcaggucagggccagaaauccucggugucagcccacagggcagguagcugguucuguagggugcacacauugcacccagcucaaaaugccaguuugaggugaaggccccggcacuugagaggcuuagucaaaaggggaauggagaguuuaggggcagccuggguugugaagccaugcauggcucuucuguggaggucagagagcaacuuuggaagggcuuuccuucaugugggacucuggggcaaggaccuucccccacugagucaccuucaaggcucuagaagacccaacagacuugagaauugaguugaagaagcacaaguuagguccuguuuugaguuagaauuuuuguagcuuuuuauuuuagcuuuuggcauuucuuucagcauugaaaaauauuucaauaaaugcgccugcugagugugcaucuggcaucgguagcgggcccaguuauuacagaagcucaugauagccggaaguuugagauaaaccugaacucaaggucuguguaugggcuauggagugaauuuuucacacacacacacacacacacacacacacacacacacacacacacccugccauggacaguuguaaugggucccaucauuacuguuuguuuggcuaguuagguuaaggcaggaggcucugacucucccuuguccuguauuagauagaagugcuuugaaugucauugcagugcugacugcucuggcuggugugcagaggagcuauagccaagcccagccugcugcugccugagacugcucuccccacucugcugugacugugaaaggcagccgcagaugguggaccagcucuggcugggacugcuguuggcggcaggaugcucuagggauggaagccaggaacucgcuggagcuggcaaguggcguuucugggccuuaagagaauauuuuuguccuucugguucugcugcuguuuuaccuuuuauuguuguggaaauaguccucuguagcucaguuuggacuggaacucgcuguguagccuaggcuagcuccgaaccccagccucagucacugugacuggcacuuucaguuaucucuucaauuugucugguggugagcggauacugaaaagccagaaguuguaaaaacagcuccuuaacacucugcuaugaaagguccaaggguuaggaagugcacaccaggagucuguuagaguucaucaugguccucugaggaccucuccccacucacugugacaaguucuugcuguagagaccaggcuggcauggaacucgccuuucugcuuuagcuucccaagaugcuaagauuguaggugugcacuaccaugcccaaccuuauaauuucaaagcacacauuuauuuuacugauaucuacacagaaucguaaguguaguugcuuuuaggaguucauacaaaagacaaagaguggaaaagacuaaauaucaccaaagugggcuuaaaacuguugucguuuauuuucugguucuagcugcuuugcuugcauauauaucugcaccaaggcaggaagaggacguuggauucucuagaacuggaguuacaaaaguuagugagcuucuagcggggugcugggaagugaaccugaaucuucgggaaagcauccaguguuguuaaccacggagccauauauuuagccuccuaauaaccuugugugcacaguugcacaugcaugugcaugccagggcauauguagagaucagaggacagugugugggacucgcuugacauuuuaagcaaagcgcagcaccuauuuguauugagguggagugacuuugacacaacuuaguuucauuggcugcuuucuucacuugcugccguggcuggugagggcuguauccugccuggguuucgguccucucuggaggcucuuagauguccugguuuuuauaacgagaaagggagggaagucacuguugcaaauaugucacucucuccgugcacucuuuggagagcagcccgggcauuucugaccugugugccugugguguuuuucuccuuucucuggcagcggaauaagugugaauguuuugaagugucucuaaaauuagucuccuugguagcgcauucaacuucagguaugcgcuauuugaaauagcaguguggguuugaagaccagaggcuuuagaguaaacauauggguugaaaucaaggggcuggugcccuguaggcuccuugaugaaugagggaagcaccuggggugucuaggugaucuaacaccuguggaauauaaauaaccaugggaauggauugucccuccagagagcaggauggcaguuaauugcuucuuuaauuuuauuucauggacauggauguguuucugcauguauguauguauguauguaugugccacuugcaugccuguuccugugaaaaccagaagaguaaccacagcuuagcucuuaggagacagaaagcaaaccguguguccaggauuaggaagagauuacucuuacaggcgagcaugcauguagccaagacacuugggcauccuggucuuccuccucguaggaaggcuucacuuaaugaaacaaacaacaacaacaaaauacagaaaugaaaggggaaaaagaagauguuauguuauguuaucaggcauaacaaaaauagguuuuuauguaaaacauuuuaauuuuuggguucaaaaggggagaggggagggguaggaucuugcuauguagcccaggcuggccucgcuuguaacccaccugccuuacugucccuaguguagggauuauagguguaugccaccaugcucagauaauaccuguuuguuucaaaaaucaaauaguagccuuccccauaguugagacaauuacuggucagucuuuagauuuugcuuuuauaauuuauuuuaaaggcuauuuauuuauuuguuuauuuaucugugugacugacuguaugccauaugugugggugccugcagcagccagaagaggacaucagauccccuggaguggaauuauuugagguaccugacauggguucuggggucugaauccagguccucugcaugggcagcaacagccuuuaacuguggagcuauuucuccagccccagauccuuagcucuuagugacuacugcuguugcugaagggugacugacugcagguuggccugucagugugccacagggcccuccguggcuaaggaaauccuguggaaagucuugacaucaggucuugcuccccuucccagccuguuuugggagggugugugcugggcacauuuuuaguucucugucagguuaugagaaaaacugaaggacggagaggggagaagucaugucugagcagccgagacagcuugugccaccugugcagaggcggggagaacaguggcucuucgagcugauccacagccaaggcgcuugcugcucagggguggcucgacagccuucugccaugaccagggucagaugaaaaaugaaauuccucuguucucugaauggggguagucacuggacugggaucagguuucagggaugcugucccaucuuugcagagaaagagccccaggaaggaagaaaguauaaaagcccacuccucuggaccgcggugccugguguggguuccagaacagauuugcagcgugagccuguacacuugcuucaguacucugagccugauaguccucaaguucuggccgacuuccaaagcacuuacccuuaucuguuuccuugugggcuucugcugcccguuuuucuuggcugccugagaggcagcacgugguacuccaccagauguucgugguguguuuuaugaaugcacauguucagguacagagccaagaaaauacucaggauguagaugucugcauuugugugccuaaugaaacucuaucaucuuuuuaugauuuauuauguuuuuaaaagugaguguuugcucugcucuuuaaaccaauaauugaugugcuaugggaggaggcugugugugugugugugugugugugugugugugugugaagagggcuuuggaauuaaggcauuugugagauuacugugggugcugggaucuaaacucuaguccucacgauugcccagcaaguacucuuagcugcuuagccaucccuguagucccagugaguuaccuuuucaguuacuuccuuaaagaaaugaggacaggaauagaguugagacaugaaaccaggcagucuggcuauaaaauguauguucuuuaucauuacacuagacucagaauuuucuucauaguuacuaguagcaaauugucuuugugguacuaaggaaggaaagccugugccugauucagcaaggcugacugaagcuugaauccugaaagucugaaaagacgcauuugagcuaaguaccacagugacuuauggaauuuuugcaauaauuucuaccucuaaaggacuugggcuuguuuguuugccuugcuuauuuuugacacagggucuuauucuguggucaggcuguccuuaaacucaugaugauccuccugccgcaaccuugugaaugguggaaguggaggugagucacuccacgcccaaccugagaacguguguguguguguguguguguguguguguguguguguguguguguguguguauguguguaaugcacgagccugcucaugugugcggcuucauggaggcgucaucaggaaucuuccuugauuucuagacaccuuuauugaggcaggcuucucaauuaaacccagaacuugcugauggggucuaggcuagccaaaaaucuacagggaugccuugucucuauuuucugagcucuauaguuacgggcuggccaccacauaugucgguucuugggaucugaacucugauucucacaacugcauggcaagcacuuuauccacgaagcccauagucuuggacauuuuuuuuuuuuccaaagucaggguuuccuguagcccugacuagccugaggcucuguagugaaguauguccuugaguuuuugguugaucuccuacguccacccuccaagcugggacuaaagguguguauguacugccgugcugguuuacauagcgcagggggauggaacucggggcaggcucuacacgccaggcaagcauccuacagaugcagccacaugcucaguccuugacaccuuuaugucugugugcugcaaagcgguuuuugggaugaaugugggugacauuucgcagguguggucccccuuguuuugugagucagacccucucccuaggaccuaggcuggucauugaaguaaacugacuggaucacaagcucuggagauccucccguugccuccuuccucagcacugagauuacaaucacguguuaccuugcuuggcuuuuuaugugggugagcaccacugaacuuaccucuucggccuguuguuauuugugguugguucugugugcaccuguguacuguggaggucagaaacaguuuguauguauggauccccuccaccacaggucaggcuuagcaguaaagcccuuuacccaagauuuucuaaaauauauuuuucuaaagcuuucacauguguguguguguguguguguguaauuuuuuucucccccucuugaccgucuucucuaagacuuuuaaaguguuuuuaguuuuuucagacagggucucacaauguugccuuggcuagccguaggcuuagauuuuucaaaaccuacuuuuauuaggguucuuuagcacuccaaccucucuucuagccccgauacccagagguaggggaaagaaagguuaguaagaaaugggguguggaccuguuuagaggaaguucucuggggagaucccaguguuugcugucaggauauucagaagaaacuguggggcccugccgaguuagugcgagucuguggaagcggcaagaagcaaccagaguaucaugggaaguucuuuggugaauuacucucuaugaagucaugacaagcuaagaccagcuacguggugcaaggugaaccauugccaaagccuggucacucugucuguggggucaucuuuauauucuuucuagacaucacagguccucuuacaugucuguaugauaggacacaacugaaucuccaaagaaaucaggaauuuucauuucagugaccuggaacuuagcuauguagaccaggcuagccuggaacucagagauccuccacccucugccuccuggcugcuggaauugaagguguuuaucaccaugccuggcucacguguuuucuuuagcaaaguaauaugaaggcuaaacaguucauaggaggacucgguauuuucaaguaagugccugaauagucugcagagagcaagaacuagucuuugggaucacaaagcuacaguuuagggaugaucaggccucuuaagccugugcguguuggaacuaccauguuuuguuaucagaauuugcagaggggaugcuacuaaggggagccuaguuucuucuaguuuugucccuuucacauugcauuuggugcuuacagggugugcagccuugagaaggaauuggucccuugccaggaucuuucuucagcggcauugaauggguacagaauguuugucuuuagugauccagcuaggcaucacaggaaguugcuguaugguggacauuugacuagcuuauccucugaauccaguuuguucucagucagaacaaagaggcagacagacaggcagaucacacacacacacacacacacacacacagagagagagagagagagagagagagagagagagagagagagagagagggagggagggagggagggagggagggaggaggggguguuauuaucuagcccaagauauagaacauuacugguaaaaaauaguaccuuuaaaauaccugcuucccauccuccucuugacagccacugcccuauaucuuauagccuuaauuucccauauaguguuguaauauguaacccauuguuaaaauaauuuugucugcuuucaacuuuuguauaacuggucagauucuuuaagaagaaaaacauacaccuuccuuauauuaggauuuugucaauauaaggcaggugggcauuguauuacuuuucuauugcugugauaaacgucaugaccaaggcagcuuauaggaggaagaguuuauuguagcuuauaguuccauugagauaagaguccauggcaggaaggcuuggcaguaagccaugggcgugguagcaggaacgggggugggguggggugggguggggugggggggugggggggugggguggggcugagaacugacauccucaaucacaggcccagagcagagagcagacuggaaggaagcaggcaggcaagccuuuguacguguaaugcccauccccugugacaucacuccgucaacaaggcucuaucgccuaaaucuccccaagucacaccaccuagugugucgggguggugguggcaugguacaugcccuccugcaugugggaggccagaggacaccaugagggaaucuguucucuccacuguauagauccugggcaucucucagguugucaggcuuagugguuuuacugguggcaccaucuugccagucuuuuugagacagguagccuuagguagccuggaacccccacucuguaccaggcugaccuugaacuugaacuuguagcauucuaauuuugacucacaaguauuaggguuaaaggugugugcuacuacaucuggucuuuguaauuuaauuccaguaauuacugacuuuuuuuuuuuccccaaugguagaaauugcuguuacauuuugcuguugaaagcuuuaagcuuugagucaggccaaguggucccuggugcaggguccggcaucuagcacaucccagaucagugaguucuuaguggaaucacagccacaagaccagcaaccauauccgguccuagacaguaccaagugucccuacgcagcaccuucccuagaaagaggcauuuucuuuucauuuuacagaugcucacaaugggcucugcaagcugcccauuugcagcuggcuggcuggcauauuugaccacagcaaucuacuaguugcuuccaugaaugugcacaacuguaaaaccucaaacaaaugugagcuaacagaacucagaagcaugaauuuuggaacgaugacccaguuggcugaagcucuguagauaucaguuuaaaauuuuagccagaaaaguggaacacguuuguaauccugacacauaggaggcuggagcacauggauuucaagauagaggccacucuguguaacuuagagauaccccauuucuaucuggcaucacccuccccuguguggagggagggagggaaggagagaaagggagggaggaagggaaggagagaaugaaugaaugaaugaaugaauguaauaguguguguauucaaucuuuggacuucuugggaauuuggauaauaaaacaugcuggcauuaguuuuuuaaauggggacuuuuucuucuaaguaaccuggccagggcaaguacgagccaguuuugggggugaccuguuuuaugacaaggugcucuguucuagaggacuuucuucaugggcuaauccugauggcugugggucuucguggcagguagagguugagagcuaugucaugucaggacaguggacauguugcugucauccugcaggggugggggccacagcugccugaaaucuuuggggcccuaugcugcacuugaacccuucucucagucacauaguggggugagugccuucccugggguuauuuuaagcuugcuuugaaucaagccaagggacacucucaagggacagaugaagggcaucuuccugugcuucugcuuccugcaucaagccugggaccccaucagccuccuuugcuugugccaugccauucugcuucagugucacugccuugcucugugacauccaccugcuuaguuaaugcucugcuaugccacugaagucuuuugcuuuccauggagugccaugacuacauuuugagucgguaccaggccccccaaucuaaguaacuggucuuggguuugggggugaccuuucuaaagcuacuuuaaaggccaugcccuccguauguagcccccugucuuaugggugugccuuccaccugugagucuugaggauucucauguaugcugagugcccccaucacacaaagugucuucucacuucuuuccucugggccuguggauggccagguguguaagaugcucagugaucuugcacuugucuguaugugagccucugggcucacccccagcacugcuaggaucaacacaccuguuggccuuauagcuggccacuuguucuggucauucucagugacuggauccuuugagugagauguuaugugggauaugagauaacagcucagggucuuaggcaacccagcaggucuccacgggaaugguugagccuucuccagucuuccggcccuguucucgucauuguccauuguccuggugaccuccagugcuucuaagccuuuugugucccaccucccuccuuauuucaaucuuaaccauuccuuuucuuguauuugugcuugugauaucucaaagaguugcuuuuuauaaucuccuaggcguuuaaaagcaaugccucauaguaaaaaccaauauuaaauaaagcacuauaauaguuaccuucauccaaugcuacgcucuccugucaagucagcuggacaagccaaaaggcuuaaaagucacucaugacgcaaaagaguuucaaggaagcucuccuccuggagucuaguguucucuacccauacauuaauuuuucauucccgcguucuauuaccacguuagucuaguguauggauccacgugcucucuuucaguauuuuccuauuauaagugcuuuuuaaaauugaauucugacauggcuaaagccuucugccaguguuccaacaguccuagaauguccuugaccaagaucaagggcuuggaauucaguaagauuauaaaagcuaagucauucccuuacacaggaauuuaccaucacuaaggaagaaggaaguuucagaccaaaggagaaaccagaauagaacuauagcgaaguuacacccauacgaacguauuuacaauggccuaaggggaagguggacuauacaagagacuaaaauaggaacuauggcaagggcacgaagcccuugacccuggcuucuaagauuagugaaucuuagguggagcccuuguugaucccagcuguuaucaaugaauucuaucccaggugguucccauuagaccuuuuguguuugcauuccucuguuuuaugguuaccucaauuguaccuugcgaauuuguccacccaacuuccuuauuguccucugcauaaaaagucugaugcucgauucgaaaauuacacucagauuccgcacgaccucuccugugugugucuguuugucauucauccacgcuuugcccacccgugucaaguaaucaguuccacgcagacacagggaccaagagggucugcggcaauccaaacuuuguuacugugccauggaugaugaaccagaaggcuaaacugccaagaguguauuaaauucuuuuccucucauauuuuggaaaacagaucucauguagcccaguuuagccuacagcuugcuaauuggacuucuggucguccucacuccaucucagugcuggaauuauaggcuugugccaaugcagucaucuuugaagccuucuugaguguuucuuuuuccucucuuuaacagaaguuggugacguggcaaaacaguaccuagaaaaaggucuuuugguuccagaucacgugaucacacgccuaaugaugucagaacuggagacucggagugcccagcacuggcuguuagauggugagugggugaugggcaggcuggacuuggccacccuugguugcucucauaauguuuuuacaguuuauuagcuguuccuuuccccaacccuaucauugauuuaauaugauaauuuggcaccguggagccucuuaguuuucuaucugcugacccuuacugugaaagcuuugaccaagggaggccugucauugccuugguucacaauucggggaugaacucacacuggguauaccauguuaaacuaggaggcuucuucaucauuggcauugcaauugaguuaucuuguuuuuccagagaucaacagagauagggugucuaaaaaagucuauauugacuacauaggaaaugguuauaaaaaugguagccucgguggagggcaugcaucuuaucucugcacuugaggggcugaggcagggaauuacagcaagcuguaagucagccuggacuauaauacauacuaggccacugauaacagaguggggccuuggugggacaguguagugcgcugcauauuuaugauccagccauuccauucugaauuucugccagggcugugucuucaaggaccccauuuuuggcaaauaguuuaaaaguuuguuucuuguuuuaagguuuaucuaucucagcaaaguagaaaucuguguaaagaaauguuuuuuaaaaagcugcaaauuuauaagagaaaacauuuuuuuucccucaaggacacaaccuuuuacugaugaaagaguuggauuaguauuuuuuaaaaaggugaguuggcucuggacagauggcccagugguuagcaguugcuggucuugcagguucacugcgaagcacgguagcucacaugaauccaacuccgauucuagguguuccaguccuuucuggccuuccugggcaccaggcauguacaugguauacaugugaacaugcaagaggacacauucacacacauaaaauauaauggacaugccccuggugaaaaauguguggauuaaaaaaaauaugcauuugaggggagggggauuggguaaauacagagucagugcagugggauucaaaaaagacaaaggaaguccuuuuuuuugugugugugcguguuguucaacuuuuuuuuuuuuguuuuuuuuuuuuuguuuuuuuucaagacaggguuucucuguguagcccuggcugucuuggaacucuuuguagaccaggcuggccuugagaucagaaaucugccugccucugcuucccagugcugggauuaaagguguccacgccaccgcccggcauuacucaacuucugugucacugaccaaacagccaagggaagcauuuuaauggagaaagacuuaaaauaccuuuaagaguuucguuauggacuuuuguacauaaauguuuugaucauauuuacucuucgucuguugucccacuccagcugacccucuccacccccacccccgcuucccaacucuuuuguaugugcccgggugcguuccauuaaggagcaugggugagggcaacuuaaccaccagcugcuccacugaggaaaaugucucuuccuucuggagcagucuguauaacugccucagagaggggcagagccugugauccuccccaggacagaacgccgaugggcccggucuaggcaggucaaaagugcaaaggccgugccaugccuagcucuuaggcuccucccccuauuucaguuaggauuuccacugugaucucaaacaccaugaccaaaggcaucuuggggaggaaaggguuuauuuccuuacauuuccacgucacaguucaucauagaaggcaggcaggcuagcaaccugaaggcaggagcugaugcagaggccaugcuuggucugccuucuuguagcaucuaggaccaucagcccaggagugguaccauccucagugggcugggcccucugacaucaaucacuaauuaagaaaaugauccacaggcuugcuugccuaaagcccaaucuuaauggaggcaguuucucaauugagguuccuucuucaauucaggugaucuggcuugugucaaguuuccauaaauagccagcaccuacccgcuuuuccgugguguuuucugaaccuuggugugugagguugugaguguggguggguugguaacacagauguccuguuuagggaugaacacugaagagccacuuauccuuagcacuuugaacaguuaacagcuucuccuuaaacagucacccauggcaaacagaagcgucuuugaccagaccggaugccaguacuaaucuguggucguaaacguaaauauuuagaagucaguuugucaggcacaucauguccccuuagcaaagcagcagcaaucgcuuuuccacugggcuguugaacaagguuacaguauuagaugugaauucccucuguagauuggaccucaaauccaaucagaaagcaguugguuacuacccguguaacagucgucccacuaugauuaguuggcacaguuugcccaacaaguuacaugcaggggucacaguugaaugacccccuuccccaaauuggcguucuaagugugaccacuauucauuucccaaauauuuuuuuguguauuagaaaugaccucugauuuugcuaauaccugucaguaauuccuuuaaacgugcuuaaguuaaggccucgugccguguaaaauaaaauuuguguacuuuuaagagaucauucgcuuauuaaacuccuuagaagagguggcuaauggguauugcggacagccagacugcuccuggcugugcauccuuagguagaucacucaccuuaccuguuugugcauuugacucauggcggaggauggcguaggaaggaguuuaggaugaaccgacugacuggaugaaaaugcuuaggagagcaaugcuuaaguaaaugagguuuugcugguauucgucggcugguguauagggccugaauauuuagguuacuacaugaaguaugaaguucaaaaauagcuugaaaaaauguggucuagcugaguugcagaggcacguaugggcuggguuauguccuuccucgcuugcguuucuuagcuguucuccgucuuuuacaucacaggacuguucuuagugaagugcgucagucucccaacugacuuagucuccccccucucaccccccgucucucuuccggaaagcccaucuggacauuuucaguuuugauuuuucuucaaagcucuggagccuguccauuuggcacagugaggguguaaggaccucccgguccccaccuucugcuuuagaagccuuaugucacaggcacaugcuugugcuccgcggaggaugcgccuguugagugugcuagaggugauuggaugugcaaaggccugucuuagaagggauccugcaugacagaugacucaucgucucgguccauauggcuuuggagaagcauccugcuaaccguggguggaagucagugcuguggaugcgagccaagggaacagcaagucggucagagagaugcugugugcuccgacugggccggcuccauccuuguuaaaauguucaucucugucugcuuccacagcacuuagaugggaaacaccuauuuuauuuuguucucuuuuugagguagagucuccuuaaauagcucagaugacuucacucucacaguaaucgucuuccuuagcgccccgcccccaaaugcugggauuacagaugugagccaccaugguagauuuucaaaauauuuuaauuuggugcauuggucagcuuucauugcucuaacacuaaguagaguagugaauaaacaaaaaguuguauuuaguuugacguuguagagguuguguuaguuacuuuccuguugcuguggugagauaccacaaccaaaagcaguucuuggaagaaugaguuaguuugugcuagggcuuuagaguccauaauaccagggaagacauggcagcaggcagcuggggcaggaagcagaaagaucaccccuacaaugucagacacagagcaagacagcaaacuggaagugugccuaggcauccuauauaucugucaccuucccaagcagcaucaccagcuggggaccaaguguuucaaugcccgggguguggagaacagcuauuacucaaaccacaaggucagacagcagcauagcgagcgucccauugacugcaucuuaucaugguaggcugcgucuuaguaagggcacacacacaagugcuuccuguugugauucaggaagccagaguggguagggugccuuguuccuugaugcugugcacauuucaugggaauuagcuagaauccuccaggaccauguuaauccuuuccaagaaagguucaccacccuccaucucuagaaaggucacguaaucccaagcauugucucgcugguaacuaagucucagcacauagaucguugggggaugugcacagcucauauccaaaucauagcauuaguuuuccugggggggaaaaauagcauccuugcauuuuggaaaauaauuuuuaagcuuuuugauucaagauaaagauaacuugaagguuuuguagacaguuuucacuggcaccauuuugcuugauuuuauguugccuuuggcauauaaguauauaaaauagguacacaaugcuugugagagugauuauucaucaagcuaauguuccugauacaaaagcuaacuacuggaguuugaccccuuggaguuagugguggagagcagaacucaguccuguaaguuguccucugaccaucacaggcauacauacccauuucugccuccucccccaaauaaguaacugcaauauaacauucuaaaauaggcuuacagacaacacuugcugguaauaaucaacuguucauucaugagacagggacuauguaguguuggagcucucucuaccaggcuggccucuaucuaacucacagagauccuccugccucugcccacugagugcuaggauuaaagacaugucacaccacgcacagcaucauuacgguucuuauaagaaccgaaacacugcagcugguuuugguggcacacuugacagacggucaguucugugccagccuuaggaauaugaaacuaucuuucucccucuccuuccacauuugauccagggucucauggagcuuaggcuguccuaaaacacacuauauagcugagggagacugaaucccaauuccaguagccauacgccugccaucaucugccuugagcacaguggccuccucuguguaaagacugcaagacugcagcaaggucaccauugcuugcuuggauuccuuagacacuugauuuugaauucagaaacuuuuuuuuuuuuuuuuuuugcagccccacaaucaguuacauauggguugagacucacauuuuaagaagcuggaaucguauuaagggggcuguauugcguugugaguaccagcucacugggucuuucugaagggauuucuguuuauuuguuuguagucacuuugcugcuaaagccaggcuauuugcauuugcagucuugccuggcaugcuuguuuuccuggagggugaucucagaccugaggcauccuggugugccugccgccugcccacccaccuagcccucggaaggagaugcgcguccagacacuggaccagggguccuugggcugaggcuuucacagugcauuugcggcguuguuuucaguugguuagacuggguuugccaucgcucucucucucucucucugcauuuucuaauuccuuuuccaggcugaccucugaggagagcugcuccccacugcacagcagaugucuacugggaacgagcaguacccucacuguuccaucacaccuuguagggaaugcucggagcuucucccgcugcccuugugauugugugugacucugggugcuugauagacccguuuaggugacugaggaguugcuggaagguaaaauagaaaaauuguaugagugcuaccccaccauguguuccauaagaugguucugcauguuucugaaguauaugaagucgguauguaguugauuuugcacuugacagugaaggagaaagcaauggguuuaggagggcuaugacagagagaguuccagugauacagaugaccauguuugccacucagaccuuggugacuucauuguagucccuggaacucccacggacaugugugggagcacuggagugugaacaugcaagaacacaugugcacacacacacauaaguguuagaagcauacuuaagcucuccgacauagcagggguggaaggugaugccaacuuguuagaugaggugacaucguguucaggggauaaauaggcuuguguuagaauagucucugucacacuccuagaggaucagaauacagugcaaguuguuugacaguuuuucugucccuaacggcacuuaaacgaacaugguuacgccagugugaugaugcacauuucauauccucugcccuuggugcagaggcagguagaucucuaugaggucauacacggcaaguuccaggccauccugggauacauggugaaaccaucucuuuaaaguuuaggucauauuuuuuuuguauuccuuuuucuauauauauauauauauuuucuuuuuuguacuuagcauguagaacuugauagaguugucuccuguguguuugguuuuccugagggauuagugguauuuguuuucuguugccgugauaaaaugccaugaucaagagcaaguuaaggaagaagggguuuauuuuagcuuucaguuccaaauugaccgagcucaucauggugaggaaggcaugucauggcggggaagcuggaggccagcugaucacauuucaucugcauguaggugagggagggagaggaggguaagucucaaaggcugucccugggaacaggcuaacugccacaaggcucugccuccuaaaguucuauaaccucccccaaaaaacugccaguuugggaccaaguguucaaacacuugaaucuuuggggaaccuuucucaugcaaaucauggugaccagauaaugcuauugggcuugguugcccacccucaugguuauuuuuauagccagguagccaugauacuauccccagauggguaaaucuuucaguuugguuauuaaaaucaaucacauuuuugggggguguguauguuauuuuuuucaagagaggguuucucugggcagcccuggcuggccuggaacugagucuguagaccaggcuggccucaaacuuagaucugcuugccccugcuuucugagugcugauacuaaagguaugaucaagccaagaccuguuugauucuaccuuuuaaguuuuuaaauuuauuucuuaaauuuauguauauguuuaagugucugccaccuaugagcauguacccgaggaagucagugaugugccaucuaacgugggcacuaggaacugaacucugauccuaggaagaacaagugcucucaacuguggaaccgucucuuugguccccaagauucuacuuucuaacaaggucauuaaauaucuugauauucuugagaaaucaucuuauuuccauuuaaguagugugcuaagggaaagcccagagcuucacauggugucuaguuccauugaaaccggcuaaugguuuucuaaauagcaguaauuggugaguuacagccaauggggacauaaaaucacauuuugauaccuggcuuggauccaccuaacccccuugagauaggcccuccuguauccuaggauggcuuccaauucccuagacaguagagacuggcuaauccugcuucuaccucuugagcgcugggauuacagacaucuccaucccagucaguccacgugaugcgggggaagugcucauccgcacgcucuaucccgggcacucgucuaguugccuaggccagccuccacugcccugccuucccagccuucccaguagcugauacgggucugugugcuuaacauuuaaaaaucaggcuuguucuagacauucagaaggucucugcauuuccuguguccugucaugcacuuccuaacaaggcuacuaguagacauggccaaauccuaggcauauguuacuguuauuaauaucaauaucacuugugcuguggcauucuuuucucuuggaguuuuuugagacagccucauguagcccagacuggcuuuugauucccuaauguagccaaggauggcuuuaaacuccugaucuuguaccuccugggguucuaggacgagcaucaugucugguucauucuuaugucagaauuacaugacaccguguuuguugcauacuugauuucucagugcccuugcucccuucucuccaguaggcagacacuguguucauagcuggauugucaggguuuaccauaguacuccacauggcuucugaauaaacauuguccauuucagaaagaccucaccuuuaaccaguggcugagcccucacagggugcuuguccagcuauuuuccuuagugcagaccugaauggaccuguggugaaauccuuugggucccuuuguguugagauacaguggucccaguuuccccccaauuugucuaugcacagagaacaaagagaauucuuacauacggcuucgcaggugguagcuccugcuuccacacaaggggccucuucccucacaggggaggagguacaguaugggaaugcugugccuuaagaagcaguggggccagauagaugauggcucaguucuugagaacugaggaucccacacucucaagacagcucccaaccaucuaugacaccaggguauccuagaccucguacagccucugcaggcauuagccaugugugcgaugcacauaagugcacaccagcaagacauauacagaauaucucacgcaaauaaguagaagaccaaggaguagauuggaagagcccuuccuggaagaccucaggagagcucgguguagacguucucccaagaguuucccuuuauucgcuaaggucacuuugaagagucagacuuagacuuuugguauuuugaaacagggucucauaaccaggccggcuucacgacauagaacccugagccuccugcgucugugugcuuguuaucagcacaaaccuagacauuccugagaggaggggaucucaacugagugauggccagugggggugucugugugggcauccucuugguuguugaucgaugugggggagggcccggcccgcugugggcggucccauucuugggcaaguaguccugggaaguguaagaaagacagcugagugugggccugggagcaagccaguaagcagcacuccaugguucuugccuguguaucugcuugagaucuugucugacuucucucaggaauggacucuuacgggaacaugucagccaaauaacgcuuuccacccuaaguuguuaaaguuacuuuugcacuaaguugcuuuaaaaagugaaccaggacccuccuaugugcugggaacagguuugugcuacccugucuagcucacaauuuuugaauuuugaaagccuggaucaugucugucaguucaucaucacuaacucauaagcucuuacgggcggggccccuuguuacacaucucucguauuucauuuacaucauguucuagagcagugggucucaaccuuccuaaugcugugacacuuuaacacaauuccucgugcuguggugaccccagccauaaaauuauuuuguugauacuuucuuccuguuauuuugcuacuguuaugaaucguacuauaaauaucugcuaugcagcugccgaagggguugugacccaaggguugagaaccacugucuagagaacccaggacacugcagugaguguccaaggggugaggagcucuagagcaccugguacagaaggggacauagaggccacagcucuuaccaagaugccacuuacucucuucauugucuuagugaagguggaaugagauggauucagagguuagaaccauguacggggaaacaaggaacagucgcauacgggcagagagcagggccuaugagaugcaugcucguuacaauuccuuuuccuuugcuacuaaggacucugggcugguacacacucccucacuggggaugccugggugaaugccaccugccuccagccauagcuacucccuguggcucaugaccaggagccgcaucuuaucuuuuaacuggacacccacagucggaauggucagaagugaccauaggcaggaaguggcuucucacaaggugccaacuggggcagacaugugaggcuguugccuuacagagcugcaagguuacauucacuuagcuaagcagagggccuguucuucgugagcguggggcagcugacucugacucugcaccucccggugaaugcucuccaaauuagaaagccagaugcacccugcuuccauugcccugcuccgagcacagcuuugcugaggccuccccucgagucgcucuccucagacucguguggugguucagaggaccagaugaagccacuucucacuguacaucagaaauccuugaggaucugcggcagaccugcugaugcugcgguuaguggcgcagugugguggauucagaaagguuucggcuuuccaccucgaggcugaaugaacuaggcgacagcaugcuuucuagauuggauuaauggccauguggugauggguguggaaggauaagguagacaauuccuguaaggcuggaauuaucaggagaaaggagcuucaguuggccaaaugccuccaugagauccagcuguaaggcauuuucucaauuagugaucaaggguagaagggccccuuguggguggugccaucccugggcagguagucuuggguucuauaagaaagcaggcugagcaagccaggggaagcaagccaguaagucccaucccuccauggccucugcaucagcuccugcuuccugaccugcuugaguucuaguccugacuuccuucagugaugcacagugguauggaaguguaagcugaauaaacccuuuccuccccaacuugcuucuuggucaugauguuugugcaggaauagaaacccugacuaagacugguggguauugaguuuggucuucacucugcugggauauuuaaccauacaguagguaacuagcauacugccacccuguucuucaggauacucauuuaccaauaauucucucucccucucccugauacuaucucugaaacuggccuuuauucuguagucacacuagccuaaaauucacagcaguccuccugucucagcuccucccaaauguugauuacagggucaacuuccaguuguaaaaaucucuuauuaguggagaaguuguaaaugcugccaccuguugaccaaaugugcaugugcauccaacccacuuucagcaucccuacccaggcggcaucucccuguguucugggcacuuacccaggucucaggggcugucagcaaccuaguuuagugggauaaguaccacucuggguuggcagucugucuugggucaccguugugaugaguaguagccucuacagucagauucauauuuucugucucucucucuccaucuuucuccuuccugcugucucccccucccuuauguguaugcacaugcgcacaugcaagggcugagguuggaauccagagucuucuauccccccucuugcugagccucucuccauguccccagaaaugacuccuuugacuuagacguggguuuguuuauucaaagauuuucauagaucauguuuuaaccuggaauuuauaugaggaauucuuuucaugagcagauauccuaacgguucaaucauuguuccaagaacuugaaucccacucaauuucaaggauaaaccucuaaaagggaacuuggaucaacagauaauggagacuagcuguauaggucagaaaagcaaaaugccuacguuucuuuaacaucucccuucagucuguaugauagcucauucauauagauguucuugauugauaggccuuuauacaguacuccugccaguguguucauuucaaaaauaugugugccagcaguggcuaaagggccggcucaccauacuuucccuggcagugugcuuggcagccuacagugcuagaauuacaucggaaugacuugugcucaacccagccugaggaguacaccacccaccacucuugggauccaggccuuaagacuucagcugggccuaaagcugaggcuaagaagcauauuuuuuaaaaucuugaaagucguuaaacggcacugccaacuuuucaaagccucaugaucaaaguggcagccuguucuucaggaccuacgaaaacagcucagauaucuucagaggcucagacuauguucagggcuuuaggaugcugcaccuacccugacaacacuguucaaggccugucgcuucuaaccaugguuucuauaaugagugggugugagcuuggcaagccaaggcucccugucccacuucagcuucugugacugagucuccuccuuauaccuuauuauugaagaagaaaguggcagugcauaugagcucagaucuauaucuugucauuuuuccacauuuagaaaacuggacagaccuguaaauuuugcagcaaccagauaguuucugaaggacuagcuacuuuugaaaucaggcuuaacuuguagcccugacuggccuggaacuugcuauauagaccaggcuaacaaacaaaccuccuccuuccagugcugggauuaaugguguaugauacaacauucacucaggcuuaaaucuuuuaggcuaaccuuccuuuuucuuuucuucccuuucuuuuucuuuuugagacagggucucacuuauuucccaagauggccuggaauucacaacucuccugauguagccucccaaauaauggaagcaugaguguuugcuccugacauauuucaaguguaccauauggauuucuuagguuacauguuacauaaaguguagguaaaggugucuauugauucaggauuucaaggccuauauuuacuugugguaacuggagaauaaauaacaggcuauaagagcuauagggacccagaaaggagucuguacucucucuugagcagaagagaaaauagggacaauacagcuugcccaacaacacaaggggagugguuaacaggcuggguuagugguuuuucaguucagugcagucuguuuugaucaugugacuccuuagaccaagcauagaagcugggcuauaaaagaguauacagagguaguuacagagucccuauuaaauccuuuuggacuauauagauuucauuauucccagacuuacaguugauuuuucuguuuguuuguuuggcccuuaggauucccgaggacauuaguacaggcagaagcccuggacggaaucugugauguggaccuaguaaucaguuugaauauuccuuuugagacacuuaaagaucgucugagccgacgguggauucacccuucuagcgggagggucuauaaccuggacuucaacccaccucaagugcagguaagauacaccaugcuggauagaggacaggaguaugaggugucuggagguggggggcauaaaaaagcauuggccaaacagcauaggaaaagaguuuacauucaguagccaccauaguggagaaagcuaggacuagaaagcuuaacaagacagggcauugcuggugaccugggaaaagugucgcucuccuuguuauuucauuaaacuguaggugaucauugauugauugauugauugauugagacagaccucuaucugauuaguccucagacucagaaugcugggaagaccccuuuuaaagccaaaugacaguguacaguuuaaaaaggacuaaaguuuacauuucuguucggcaacuguugugaagauggcccgagcaagugaaaaaagugugugguuucagggauuagagugaccaaaacaaauaaaaacuaguguucagcuauaagacuuuguaagaccugggcaauagcugcaggaucuucgauuacagaguugggagaaaggacaaacaugguguugucucugcucuucaguacugggguucagaaucccugggccuuguguacauuccucaagaauccuaccauugaaguggaccuccaccccacucccugcuguaggugcccaacucagacucacagugcucuagcuuuggucucccaaaugccugggauuaugggugugcgccccgugccugcucagacuacuucugaccagcgucuuguuagguucucccucuggcugucugaugacugacugaacuaaugcaggagcccaguugguggcucuuggacuggaguaggugacgugguaccuugaguauaggugaagcaguaaaugauugcagggaccuaagcuggugucaccccugcugguugcuguugugccaauaaugcccuuaaugaugucaguucaugugugaugugucccuuuuuuuuuuuuuucuuucuuucucuuaauugaucuguuaguucauucaaucuuucauucguucuugguuucacuguguuggcuagacugguccuagccuucugaguggcugggugagcaggagcgugccgcucaaguguaacccaagguacagugauaggaaaaccaauagggagagaagaaaggaguuugaaaauccagucaggaaagcagaaaccuaucucacagaagcugaucgauucuuacaauacccaaaaagcucuucuuacuggcaugcuacauuccaaaggcuggcucccccugaaagaacauauaauuaccauuacauguggaagugaauagccuguucuaccagccauuggugucuucccaggacagagugaagcugcugcccuagagccacucuacuucuggaaacggugcuguguuugcugauacuccaaagugagugcuaagcacuguggcucucaggucaggcacugccucuccucuccuuucacaccaacacagcgccugugauaaugguguuuauuauuaugaaauaucagugugaaucccaaagcccccagcugcagcaggauuucagugagaccccagaguucuucccuaggcugucuuugccagauucaugucugcagcuuuccccagagaggacagcugugggguagggagcagaguuccgaugcugcugcugugcuuggcaggcagccaugcuuccuagaggauugaaaguaugggaaaggagaucuguuuauauagccugacuugucuggaacuauauagaucagguuggccuugaacucacagacagaaacaccugcuucugccucugcugacauuagaaugcuugucucugaugguccuagauauuaguaucauggcuauuuugaccuuaggacaugucauuaauuucagagacugaacuagaguuuuguuguuguccuuacauuacaguuauuuguuuguacauaugaaugugcacacgugugggugccaccacgcagguauggaggacuccggucaauuugcagggcucaauucccagcacauagcagcucacaacuuucuccagcuccagagguucugacuccauuauacaggcacacaugcaagcaaaacaccaaugcacauaaaauaaauaaaucuuaaauaucauuugugggauguauuuauaaguaugugaauaguuaagauuuaaugccuuuucaggacauggggucacaagaagcccaaggcccauugcauaugugguuggaguucacuuugaucacaugggaaccagaaagaccuuggcaaugcccaguaacgguugaccacguuaauuggcuuuucugguaauuuaggggauugaugacaucacuggugagccacuuguccaacaggaagaugauaaaccugaagcaguugcugccaggcuaagacgguacaaggaugcggcaaaaccagucaucgaacuguacaagugaguaugugugugucucaguauauucauaagaaagagcuuggugaugggaagagcacuggaccaaggcuaaguguaaaggcucguuccucccagaagguagacgaagugguggagagguauauaggagguaaagucuguugugcuuauuccggaacuaguagaacaugaggaccuaagucuaguuaucuaucuguaaaauuguccagacuucucuccuuuggugggugggguuggcaguugauaauugagguuccaugaauguuauccaggugucccaucacagcuccagacccuuguuuuccuauuuaaucggcucagauauuuugauauucauuuguauaaauaagugauucagauagacuaggcuuggcuggaaaauuauaaauagccuaggagaugguacccgcuuuugaccuuggaucuuugccuauccugaugcgauguuaagcaaccuaaauguguuuauuuggcuugucuuuuaggagccguggagugcuccaccaguuuucugggacggagacuaacagaaucuggccuuauguuuacacacuuuucuccaacaagaucacaccuauucaauccaaagaagccuacugagccugccaugggaagaaccaagaagacguggucgcccacucgaucacacgugucgucuuggugaccuggcccaguuagaagccagcugagauagcuugcagcaucuuuucuaguuucagugaugaaguaaugaggaaacucuaguagguagaaggaauucaggaggaaggaaacccuccucugccuuugaaaggggcucugcgggugcaucacgcccuucacaggaacgaguauagacuggaucuccaccaguguugagccacgugcuagcuaucagagccuuuuugcaugcaguggugggcucuuugguuuaucccaccuuccacaggcuaugaaaccacagcgcuguaugccugagcacuugaagggcugugguccuggcuuguccauugccauaugcucugacaaguugacgcuaauugcacucggugguugcuuuucuccaaugacugucucucccuggcucucagacauccucguuucuguugucugaaucuucucgucugcuugcucccuucucaggcuauucagucucaugauggcuucugcauuuaccccucgaauuuccuuuauacaaacugagaaguaggugacuggguucagucuuuuccuucuuccuaggcacugauccagguagaaggcuuacuugguuaaacagcugcucuaucuugagcccacucuguaccuuuuauuguuuaaaaaaagauccccccaaagucuucaggguucucaaaaaacaagggaaaugcuuacuuauggaaaaguggggugauuguaucuucuauguagaaguaguaguaauuguauggaaaucacuggacuaaugagaugguugggugcaagaaaagaugaauauugaacaugcugcuaaauauuaacgcugucaguguuuuucuucugugagugacuaaccagacggcgagaggucagaaaagggagcaagccucugaggcuuggagcaucuugcacuagcuauacacagcaccugcacugaguaagacagcuuuacuguuguggggaugcagaguccuuuuguuuguuuucuuccuauuccaaagaugcagucuauagguggucauaaaguccagaaaugaagauacuaaggucuuaucagucauugugugucaagaaagcauuugugaagacuuuccuuccuggaucucagacuugcuggccaccuuguuacaauuuuuauucuuuucugggaagaacagggaaauuucuucccacugccuuaaaaagguguccugcaccugccuguccccaggagguggucuuuuauuacugguggugacuuagugugacaucucauagucuguguggggucaggguauggggugggcuuagcacuuuaguggauugagacauuauuccauucugaaggugucguguguucugugcuccugagucugucugccuuccuguacuaccuggacucccaugguuccucucagucguuuuuuucaugugcauguucugcggcugccuuaguggagaugcaggccagcauucccacucguguucucaguacagagaaguaagcuuccagagugcagcugcacggggcaggugaccaucugggcagugucgugaugcagagcaccuuggaagcuuacaucuggaugucacuugguagggguugggugauaaaagcccaggcuuccuggaggggcaggucgggagugggaaacccugagauuauucccaggaaccaagggaaguagggaguuaaagggauucaggguaauucaagagagguaggaaaacuucaaacuuuucuuccccucuuguggagucuggggagaacaauagggugugagcagcuccuugccugcacacugcuguuucucuaugcaguucaagcucaguagacuacgguagccccagugggacaccaggcucagaagagcagcaaggggcaaagacaucuuuuccaaagucuugggugauuucaugucuauggguguaaagguguuuucugcagcaggcuuggcugauuuuguggaaauggucauaaauacugaccgugucuugacaaaggugcaauggaagcagcaucuuugccuucucaggcgacacauggccaagagucugggugcucucugagguucugacuuuacauucauggacuccccguucagcuugcaucccacaggccucaugggaaaggcugcauguuuauuccuccaguauuuaugacaaaaaaggugcuaugaaggaggcccucugaguaaagugcgcacucuccggaccuuuauaagcauuguggugaaucuucccaggcacaaccaauauuuccuauaaacaagaguccaggauaugaagucuugcccaggcucuucauaugaguaaacacuaaagcuaugauucagucccagguuuuccugcuucugaaacccuuggccuuuuacaggauguuauuugucugucuugaccuaagcaaccuggggccaugagccugcuuaggucugcuuguggccucagggagaguggcugcgugaggcuauuucuuuuuaugcucuuugccuaagcaaaaggaguucccagacacaagacguuaaggcaggcuggguuuagaccaggucaaucugccucaauucuaggcgucaggaagccauaugaaagcugacaucuacugaaacauuaaaauuaaccauaacgguuacccuuauuuuugguguggcaaacugcacaauucuugccagaacaaaugccaucaacugccucagggcacuccuugguuugacuguucuuuaugugguugggugugagggagacaggaagccauugcccaggacuccauccugacucccucuagugacagacaggaagcacagugucuuuuaauaaaaggcuccuguuuaaaaccuuugcagggaguaccgcaccuucucucugggauuugggaaaagggaagaaaaauugaaaaccccaggcucuguguggacugcaagaaaugguagagcucaaggcuucucuagucuuaugagaacuuguacuacugaauuugcgaauuuuguuuuuuugagcuggaccgaucucugggggacgacguugagcuaggauggcauuucacugugaucccccaaguucaagccagucuuuaacucaguguuggcuuaaguuucccuggagcuggcacgucagcuuuucuucagugacaguugguguuccucuugauuuggguauaugugcuuaguucagagucuguucuguaucugcuauccuaacuauucauuguauucauugauuuuuguuuuguuuuguuaccuugcuugaagauugauuuguauugaauuugauagaaauaaauguuuuuuccgcuuaauaugugauggaauuucauaaaugcauuauucucuguuuugcuguuuauacccuguaaagcuucacaggcucucucugauuuguaccacuugggaguucuucuguuauccacaguugucgauaaucugcaaaaagaggcaaacaguguaacaaccuacacaaaguaaugauggugaagcaaacaugccucggguucuguuuguuuucccacuguaucguugcuauguccuugugcccuccuguucccugcuugccccguccuuuaccuguuaaacccggagcccuuugcgagguugucugcugaacuggggcuguaagaaguuccuaagugcccuuucagaagaaaccugagagaaugaaggcauagcccuuuucccaacccugguauggccgccucaucuauggggccuuccauagcugaaacccacugaaagcaaguucuaaacucacguguccagg

SEQ ID NO: 2004 - RNA, 149161 nt, Mus musculus
aauaaaccccaaaugugguugugcuuuuguuguugcucaggguacaagacaggcaagccuggauuccugagcaugccacgguucgagacuuguagcuuuuaucugccgccacuugagacuuuaauuuugaucaccuggugaagccuuuaucugauauuuaugacuguaaaaauggcgauuuuauaauuuggcgggcauacaaaaaaauguauguuuaauuucuaacauguugauccagugagacagaguuagcauuguggagggcuuggaaaccguccuuucagcgagcuaagaucucugggcagacgauuuaccucugggagcuucgacccuauauagcucugugaugugagauaggaucgaggcuuacccccgguucccgggguuccccagggacccgggcuacugcggaccgcgcacagauuucucugcagcaaagggcgcguauccgugaccgcgcacaccuguucgugcccggggucccgcggguccggccgccacgcgcgggcuguaucgccucgccacaagcuccuccccuguggccgcguccacccgccgguggccaggcacaggcaaacgcacggcgacagcguuggcggcgacccugggcccuggcggcggcgggaaggggcgggcgcaccaaugggcgcgaccgaggccggaggcacuaagagccggaggcugcugucggugcugcggcgguggcgcgcggaucagcggcugcggaggaugcgaucggcucuccggggugagugugcgcgcggugggcaccggggcgggcacuggggguauuggggagcagcgguuacugagacacuccucagaagccaagaccuagguccccagacucaggcaggauaggggccggucccggugcgcucccuucccccgcguccggucggccggcuugguucugccuugggggaaaauccugggagacacgcgacagaaucuuacgcagguuggcuccccuccucgaccccauaccuggcccagccccugcagugcgguaccuuugggacauugauacgaugccccaggcucccuuccacuucuccccaucugcacccagcccaauccccuuuccaaccuguaggcucucggagcuuccagguuacuccgaagugccgccgcaaggaacugcuuuucagguacaaggcaccccccuguccuuaccggggccucuauuuaucauggucuggauucauuucauucuuuuuuuuuuuuuuuuuuuuuuuuuugcagcucuucccucuguuaggauccgaagggaacaagauaggcacgugagaccauuucuagugaaucaggccgauauuacaccccuaaugccacccaucccuggggaaacgggcugguagaagaagucgcagguguguggagaaggcuugaggcacagccccaggggagccccagacagguugaguuacuucuguaagcugggaacgcggucugcucgccagaacagccgcauggcuuccaggagcucagcgaggggaaagugagaguuguagggcaaggauugaggccugggaggaagagucgacauuuuaucuccgugagaaggaaggcuucugaguagggaaggacaugaucuacuggcuugugguuucuuagccagcaguggccaugcccuaauuucgcagcuuggcggacugccacccaaacgcugucucuccggaagucuuuccugccaccuguaaccucuucguuagggauucaucccgugcagggcauuuaugucugucugucugucugguauuacagaucacaccuaccccagcucuuuuugccuuuucuaccaggugaagggcgagguagggguguggggugugugugugugugugugugugugugugugugugugugugucuguccuuuuugucuguuuccgucaucuaaagauccuucuucugugaggcugacaugccuugauuucuaagauggccgacagaucuagaccugaagcagauuccaacagagccccacgguggcauagucaucccuaccuccuaccucguugcuuaagauaaucauuaaauauuaaauaaauaauagaguuaauaacuauaacaugcugacacagaguagggaguauaacauuugacaaaaaugaauaaucuugcaaguauuuaauguugcagacaugagcuuuuguggguaguaaagagacccuuucagucugucauugccaccuugcuggcuccuaaaguuuguguaucuacuuuaauuaacgugaacauaaaacuuccuccuuauauugaccaagaucugcugcugacacccagcaggcuagggacggucagcucuuuucucuagguugcugagucuggggauggcaacagguauucuuucagagacaauuccauauacaucaugugaaucuggguaggaagaaauggauaguuuuauagugcuaaaaaccaguuagcuuuauaauuuuaaaacuagcuguagccuuaccuuuagucccagcacuugggaggcagaggcagggggaucuuugugaguuagagagcagcuuggucuacauagugaauucuagaacaucaaagguuauauagugagacccugucucaagaaagacacaaacaaacaaacaaacaaacaaacaagcauaguucuguacugaacgcccagcauccuuggcucuguucccggggcccaucuugugguucauucacggcuucucaggcuaugcauuauuccuguacauuucucuacuacucauuucucuuuucauucccuaaacaucuugggaauaagacuauuauguaugacuauuaauuauacuuacuagauuaauugaaacaaaaucuugcucaaauuuuuacuuauuuauuuuuuucugagacaugguuucucuaucuagcuuuggcugaccuggaacucuccagaucagaacucacagagacccugcuaccucucccuccggagaggugcugggauuaaaggugggagcuaccauggcacuuagcuuuugaaaaaaguccugggaagaaggguacauauuacuuauucccuucauuuaauauuugaggagauaaaucaagagauacuacaugacuugccggaggccuccuagcagguaaauaccuaacuuaggcauggcuaucuguagacgucccccucugccacaucucccagcacagaaccgacauguucccacauacugauggaggggagagguaagaugagcuaccacccaaugauagaaauccauagcucgguuuuaucugguucuguaaagugugaucugauuuuuuuuuuuccacaugacaucacuaucacuugaacaccucaagccacauucucugaugguagucaggcuacaauuuuagucugcugcuaaugaguggcacacaaugagacagugugaacuuggccaggagcccuuaaacuuccuaaaacucagcuauuuuaucaucagcaaaaagagaaugcuaauucuuauggccuuguagcagugcuaauuaauguuugccuagcauacagagccucagaaaaggcuaguuaucauuuuuaugaauauuaguacagaucuuacaccucaaacauggguagucauggggcugaaaaguccagaaagcugugagaaagaccauaacuuugagucgucuuuggggcagcugaaucuucuggaacagcuagguccuguagcaacauccugcuaaccaaaaaaacaaacaaacaaaaacaaaaacaaacaaaaacaaaaacaaaacaacaacaacaaaaaaccuauagguaagaaagaagaauguggcuucuaggaacucuuggcaucuuuuacugcaugcugcuuuuucagagaacuggaguuugguuccuagaaccaugucacgacugccuguaaauuccaggggauccaauaccagcuccuagccucugugaacgcccacucccauacccauauauacauuuaauacaaacaaaaucuuaaaacacauguacuuugaguaucuauaauuguauuuacaauguaaauacuuggacaaucaugagauaaaaggcuauaugcuuuuguuguuguuuggucuuaaaggcucuuacccccuugaugucugaagcuuuaugcuaauuuauuucugccaguggcgaucaaaauuucuugauuccuuucuguguucugcuaggcauuuuuguuuacaauuacggaaguuuauucuuugacaauuucauacaaguauauacuccauucuaacaguguuagacauuuuaaugcuuaccuacuugauguguauaaacgaugcuucaggcccuuuuguugcuuuuuguuuuuggagacaggaucucauguaccucgggcuggcuuugaacuccugacccuccuacucgacaucccaaauacuguauauaggcaugaugccaguaggcaugcauggccgugacaaccauggccaccauggucauuugucuuugaaaaaauugaguuccuuugauaaauaguagaucuaaguaucuuuccagaaacacuggcugcucagaugagccucugugaggacuugguaccauccuucccucccuuuuauguggugguuugucucuuucuucuucucucuuuauagggauucuuuaaauauucuggguucuaaucaguugcuugguuuagauuuaauuguguaguauuuuuguuuucuucgaguucugggaucaaauucaaggcuucuccaugaaugggaauaugaucaaacugugcagaguggaaauuaacccuugcauuguauccguccuuuccagagaaugaguuuuuuaaucauaccucaaaguuguuaaguguagaaaagggacccuccagaggguagauguauuucuguaaccagaaaacuucucuggcccuugggaguacucucaucagcccugaguuccucucauaagagaucgccucacccugcuggugccugagauaugcucuuccugggaagacacagcuggaaccagcucggucuguaccagcagauauuguuuuuuaggacaagaagagagcagaacacaugccaguuaaucgcuagcuuggcuucuuguuucuaacaguguguucuuuuucucuuuuaaacacauucgauggagguaaugguuacuggaauuaaacaagauugcaaauauaaaaggaguuuaggggcugagcagauggcucaucgaggaaaguguuuacugaauaaagaggaagacaauacuuuagauccugagcacccauguaagaacugggugugacaggccauaucugucacccuagcucuugagcacaccugcauguacauguauuuaucacacacacacacacacacacacacacacacacacacacacacacacacucauucaugcauguacauacaaacauaaaauacaagauaguuggcccugacaaguagccaccacuuugccugagagacagaagucacugacuaauggcuucaggcccaauuccuucuccugacacacacauugcguacaggcacauaacugacggagauucuccaaauuagccuccagaucuguaucggcaguuccuagaugugcaaauaccccacacgacuuuagacucaccaagucagaaacucuagaggcagagcccugacgucuguccuuuagcaagccaugaaguaaccucaguacaagcuaacauucgucaaacuggccugcgaguggacaagggcucuuguccagugugcaccuaagcuucagcucuucauuugccagcuuguggcaugaguaaguuaccagguauuucugggggucaagcucacagcaauacaggaggaugguaggauguagcccuuucuuugcagggcugcugugaaugucaugaaguagccugacucugcugcuacuugucugugcagcuucuggcaaauuaccuugccuuuuacucucauugagauuguaacauauauguaguaaugugugccagcuaaacagugcacacauaugucugucuaucuaucuaucuaucuaucuaucuaucuaucuaucuaucuaucuaucuaucuaucuaucuaaucuaucaacuauauuuaaguguguguguguguguguguguguguguguguguguguguguguguguguguguauguguauguuaggggaggacuuucuuucaggcauuggcuccuccucccacuuuguugagucgggguuucucuuguuguuccucuagaccagcuugccacagagggucuaggagacugucuugucacuggccuuguaagaaugcucagauuaccgauggauucuagugcaucuaguuuuuuuuuuguggguuuggagcugugauucucaaccucccuaaugcuaugacccuuuaauacaguuccuuguguuguagugacccccacaaccaaaacaauuauuuccauugcuacuucauaacuguaauugcuacuguuaugaaucauaauauaaacauaugguaugugagaugucugauaugugaccccugugaaagggucauucagcuaccaguggguuugugacccacauguugagagcugcugguuuagggacucaaaugccaguccucaggcuuacacugccagcccuuguuuccacugagcucucuuccuggccuacacuaccuuguuuuauggucuucauuuuaugaauaagaaaaaaaaucagagcaagguugaauaaugcuuugcagugacauuaacugguacccuaggauucaaucccaggcagcuugaggugagcacgcuugcauuaaagccacugcuuuggcaaaugagaucuucagcaaauuuacacaaaugacaguaaaaguuaaccccuuggcaagugguaggcauuccacagguuaguuuccuuccucuugucugguagcuuggcuuccugguaauucugccuuccucguagucaccugccugcccccuucugugguucgucuccgaguacacuugguugcacauccccacagcucagcgugacuuuucucucuccauuuuaccucuuuagcugccauuugggugcucagagcaaaccaaacagauuuagcuggguggagaaagacaagugugguacuucugagaugcugucucuccuucaucucagcaggcaugugacucagaaguggcuucuaacaagagagggacugugcagaacugcagaggggcuugguggcaaguggaguugccagacccauucccuagacccaguuauugagacagagcgucacgccaugacuggcuacuuagaauggacuuuguuacaagucuauuugaagcuuggggucagagacaucaguuaguggaaagauccaaggcuucggucuguuuguucuuguuccuaaacgaggcagggucuugagucucugugaggcaggacaagacuucugagagcuugccuggcucuggcuaaaauggccugaggaucagagaucuaagguuuugguaaauauggugucacaagggaauguuaaaccccuuuccauuuaauaagaccuucaaaucucauuccuccugauuuuaagcaagagaaagacguguuacccauguacaguggcucaggccuguaguuccaguguuuaggauucugagaugagaggacugcugaaucuggggccccaccuuuuuuguuguuguuguuuuguuuuuuuguuuuuugagacaggguuucucuguguagcccuggcuguccuggaacucacucuguagaccaggcuggccucgaacucggaaguccaccuaccuuugccucccaaguacuggaaucugggggcccaucuuuaaaaagggggaggagauaaaaccugcacuuggguggcucaaccagaggauugcaaguuugagguuagccugggaauauaguaagacuuugucucaaaaauguaauaaacuggggugugucacauagcucagcggaugaaggcccuugcuguguaagccuaaccucuugaguuccauuccuggaaucaugagaagauggaugccaagaauagacuccacagaauugugcucuuaccuccacgugaucaagugucauggcaugugugaguucucuguuugucugucugucuuucaugcauguucucucucuccugcacaugauaaauaaaauauaaaaacaaacaaaggacuaguuaagggaagguagaguuagacacauguaagaaauguuaacaaaaugugcaugguuaagaggcucacugcacaguuuacucaacuucuuugcaugcuugcaaccguuccaaaacaguguuagguaacauguagguauuugcagagauggucacacuuuuaaaaaaaaguuccuuccuuugacauaugaauggaagcccuccucccacccucuacuacuucauaucuuguacuccuucccugaaacaaauucagcgugagugaguucagccagccagugggcaacuccucuuuauaccacaggcuuugucuccuuccugggguauaauccucacaauaacccuacaaacuaauuacuauuuuccauaguuuaaugaggaaagccgaggcucagagggcugacucagguaaucauauuaaccuuauagcacugagggugaccuuccuuccugguauugugccauacucuuuguguuugaagccacugggccucacccagccuuaggagaugguccuauuauuaccuuuauccuacacaguuggagcagaaacaagaaugcgucccaacuuucucuagggaucaguaaauggcacagcucguauuuggacccagucuauucugccucagagcccuuuugcccccucuauucaaagccaguccuggcaucuguuugccugauuugguaacuggaggccgcaggcuccugaagauagaacacauuguccaccacuguggaauauuauugaaugaaagggcggggcagggggucugcagcaucucagccccccgaagugcuccuucugggcacgguuugauuuaguccuuggaggaggaaauacccaguuuuuuguuuuugguuuguuuuguuuguuuuuuguuuuuguaugggccugaggcucauaaaaugaauguuaaggagcuauaacaaacccauuuaugauaaucagcuuuuuggcacuauuaacaaagugugugagauaacuuacagagggaaaagauuuuuuaaaaguauuuugacauuuauuacaaaugaaugccuguguguaggugaaacucagaggacgaauuuggggaguuggcucucaccuuccaucagguggguuccaagcuugaacuccaguuguaugguuuggcauuaaguguccuugccucugagccauuucacuggcuugggaaaugcuuuguuuucacuucuguuccuaauaggguugacacauugcuuugggucaguggugagcagcauauuauugggggaucacacagcaaagcaaaaccaguuaaucuuguggccagaaccgugaaaggggaagggguuacagucccacaaucuccuuugagacuauauucucaguggccgaaagacccccaaggguacccuaucucuuaaaagauuuaccaucccccacacagcccugcuuuggaaccaagccuuaaucucuggggcaucuagaaggcaggcaagaucucggccuuucucauugacucuccccucgcuggcccccagcuucuaaugaacagaaagguguuaugcauugcuaaggaguaaugggacccaaaaccaaaugcuuaaacauuuccaaauucucagggagucuucagauuuaaauggcuaaaaauccacucgggaaccucuaguguccaaggcaacuuccucuuuguggccauacuuggcucaaggcugcagcaaugagcagaugaacacuuaaaauugucaccuuauaagugugcccaagcggcuagccucacagugacagagugcuugguuuaccaaguucugcaucucuucucucccuucaucuucccagcagccugguacacacucagggcaggcgaugcgcuccuguuuguaggcggggaaaugauucuugagagguuggccccacaccacucaguuuguaauggcagaggggucuuuagcaucuuacccaccacaucaucuucugugucaauacuguauuuaaauagcaaguuccaggggugaaagcaacaaaggauuuccuucuguugguuuucuugcaacauggguucuguacuucauuagcguuaaucucucuggagaucaguuuuuccagucugucauggaaacaaacaaaucaaccaaucagccacuagcgaggggaaaucuaguagagaauguugugaggguuuagaaaugaagaaaauuggggcuggagagauggaucaguggcuaagagcacugacugcuccuuccagagguuuuugaguucaacucccagcaacuacaugguggcucacaaccaucuauaaugggaucugaugcccucuucuggugugccugaagacagcuacaguguacucauauacauaaaauaaaugaauaaaucuuaaaaaaagaaaugaaaaaauuauuuuuauuuuucaaaacugauucugauguauauggguguugugcuugaauauauaucuguguaucaugugcaugucuggugcccauggaagccagaagagggcacuagauccccagggauuggaauuauagacaguuguaaacuguggagugguagcugggaauccaaccugaauccucaggaagagcagcuaguacucuuaaccacugagccaccuuucuagccccuuucuuuuauuuuuaaagauuuauuuacuuaaaaauuaagacuuaaauuuacauaaaaaguuauugauuuuuguguacaugugucuugugguguauguauagagggcggagaacuuuuuuuuuuuuuuuuuuuuuuuugagugguucucucugcuauguagguaccagggauugaguucaggugacagagucaggcuugguggcaagcaccuuuacauagugagccaucucacuagaccugaaaaagcaguuuacagucuuuuuucuuugagggcgggcaggagauaaagagcugcaaggcaaugccagggccaagcuuugaauaugcuaggcaaguauuguaccaucagccacgcuccagccccaauguuaaguaaggauguuuagaagacuaugauaaugccgacccauuuucaguaaguuagaugucaucucauuuggccaccgugucuaaaaauggcacuuguuaguuaccucauugucaugugccguuauuccucacaguguuugccgcccauuaugguuucauauugcuugucugaaugcucucaccuaaagguaaaaauuguuaugagggcagggacuugucugcucuuauccucuggaguuccaacagguaaaacaauaccugccaaaaaugacuguuuguugaguaagugacagaggaagggugugauguacccggguuacagaaugauacaaaauucugugcgaaaagaaugacuaaaagguuugcuggaaacuuccuugccucucaguagaggggucuacugaucuggcuuccucauaccugguccuggcugagucacugacacaggcuggugugcaaagcuuccuugcuuaucagcuuauaucuuggugaagcagcauuaggaaccuauguccucgaaguagacaugggccacuguagggcacccacugccucuguguggugccauugagaacagagcuggggguccguuccuguacacugcuccaucugcaggauguagagcugugccugacccacccagaguuuuuguugaguaaaugaagcagcgaagaguacaaagaggacgcucaggguucuucauccuucccaaagucacuugaaaauaaguccagaccacagcgcagcccuucccagagcaacgugaaccaagucucucuggaagcaagaagaaacuaagcaguuggauccucacuccaaggaaggaagaagggcaaaccuaggcuccagauccgguuccaugccauguuuuggaagucguguuuacgucugccuucauccucaucccuuccgcuucagcauaagcaaaauuauaacccugcacgcugacuuguaugcuauuaucauagccuggcugcuccugcguugagggacuucgcccccgggaucgcugacugucugugaaugacaaauccaaagucagggguugcagagucagccggacuugccugcucucgugcagcagcgggagaaaacagaaugaaagauucugaaaauaaagguaaggggcugacaucagaggggcggcugguagacgcuugggggagaugucacgacgugaaugugcuuaguuugugcugauggcuggcugcuuugauuacugauguaucuucguaauuuuuaguuauguaauauauguccucuuuaagugacuguuuucuaaauaccaugucauucaguuuuccauuuuuuuugcguuacuaaaaauauauuuuuauucuuuauuuaaucuuggccaaguacacauaucucacaguuuucuuuauaaucgcuuccagaauuuugauacuuuuauuuugggaguguuuauaauuguuaauuauuaaaauguacgguuucagccaauuauuggaauagcuggagaucgugguucuuaaaacaguucggguuuucuagagaggcauugacugagaauauccagaugaacguucguucaucuucuuugggagggcucagcagggagucguagucgcugaccuucagaacuguuuaccuugcacagggauguucuguugcaaacucccccugcuccccgccccccaccccucacugccuuuaaaaaaagaaaaaaaaaaaaaaacccaccagcaugaauucuguuggaggggagggcaaggacagaaacagauugacgugaaagccccccaaccaaggacucuggaggauuucgggguucaccgccggggcccugggaaauuucugccgcagcggggggaggggcaacagcccccagcucgccccagcacacacgugguucagggucgcacuucuuucugcauccuugauucucuagauccuggugccugccgaggggccgacaucuccgcagccuggagcucaggccgugcuucuccgcagcugcucaguuugcucgcgccgccgaagcuuccuggggccuugugguuuccccuuggcagggcaggugcgcaggugcaggccgguggugccaggugaccgcucgucccagccccugccugccugcaugccccguagcagguguggccuuccccacaggagucugaccucugguuguuaaaagauuucuaccuggugauggacagcgguauaugcacccauaaacacccgagcaaagagugaucaugagucuuuuacagugugauggaugccaggggcgaggcuggcuuuccagucuaccagaagcaacgcagugucuuaauggauccgggguuucucugaucgcgccuuaaaagugacuggguggggccugggguuguuggcaccaucagcucagaggcuuuggacccuucacauucacgcauugagccaugugguuuuggugcuuaaauuuuaauuaagcaguuccagggaggaagaaacagcugugugaggccgggcugaaagcauagaggacaguucucuucugucuccuagccagccgccacucauggacaaauaacuccuauguggccaaacuauucaaaaucaguuuccgaagagggcacuuccuugcuguuugcaggggcuagagaaaggguuaaugcagaaagaggggaaaaaugccuauuugucaagucaugcuaggccauggacauggcuuagaaacaauuaaagcugucugaaucacaggcucaggcccggcucauuuaagcuucaggucuacugaccuuuuuaaugggagcugguauuuggaauuuuuguauugcucuguguuggaaagagccgcgggcugucaauccaaacaggcagguucugacuuguucagccaucucuccuuagaaaccgggacaagacuguugauuuucuugggucucaguuuaucuccugaauggcgugauauuagaugacauuaaugcuuuuucagaucgugagggauuuggguauaucgggagcaacauuucagacaggcacaguagaaaaaaguucaucuuagaaacuauugaacguaugugaguaacuuguuuuugaagcuguugguaugugcagacaugugggcuguauucuguuaucaagacuauguucuuugaguccuaaccaaaacacaccgaagaaugaugaaacaagccauaacagguuucauuuugaaagagucugugaaaugcaagcauacaugugcauccaaccauauaugugcuauugaaagaaagaugaagucagcaauugcccucugauuuacaaagaugucugagaauccaaacaggucacgaguuaauguauaucuaggguccccugagaggcuuucaggccaauuucuugcugugcugggagaugugucuauguugaggaguggauaagagugugugugauaucauguaugaggugcauguaugugcacacagacacgagaaugcauucagagagaguaugaacacguccaccagaccaggagagcuauuuuugggaagcaaagcaccaguuguugaccugaauaugaaauaaauguacaaaaaaaaaaaaaaaaaaagcugaaaaggacugcuaaaaaaaauuaccaaaauggagggauuuuuuuuggaagucauuucuuguaacggcuaacagaggaaccaggugaaauugcaagaggugauggaggugguuggcgcuuaguauguuggcaaagagaacuugaacuugaaugagcuacugucucacgacugguguucaggaaaugguggauugugguuuaauaacugccuuccuuucuguaaccuguucucaguacaucucggacagcccagugagguuauuaacuaugagaggcaauuuuuaucucuuaugccucuuuuauaacuuuaucucaaaaugcuuugcaaauaagaaaaaggccuguguguuagacaauuaagauacuugaaugaguuaacuaaauauuggcgagcauggcuacaaguuuuaguaauaaacguccuagagccuauuuuaugaucaacgacggugugacaaguugucugucagguugauuauguauuguuccaguaguacaggggaauacuuccugugcaguguaagaguaguggaauuguauucaaacccagacuguucaccccagaaaccacuucucagguaggcagacaacucacgccauaaaauucgcuuuaaaauaaaauugcaugggggcuggagagaugacuuagcaguuaaaugcaucuguuguucucguagaggaugugcggucaguucucagcacccacgucagacaggccaaacugucuauaacuccagcucuaggggaccugaugcuccccccgaccucuucagucaccauacauccccacauguuuacauaaauaaauaauaacuauaauauaaagauuaaaauugccuauauuaauauuagaauuaauuuaucuuguauaaaacagggaaauaugaaccccagaaaauaaaauaacgacuuuugacuaauuuucuaguuuguuugaaacauagacacaguagaguuugugaauuaccaauaggucauagagauaugaaagaacaagagaggagaauuugaaaaauuauuauuauuauuauuauugcaaauaaaaggcagagaagggguuggggaaucuaguccagugguagagcacuuggcuagcaaguacaaggcccgggcuucaguccucagcucggggagggcaugggggggggggggagacuaacaaaaagucagagaaaauauuucucuuccagugcuucuguauuuugagagauuuuauuuacuauuuacaaacaugacauucugugagcagaugagggauguggcuaauguuuggaugugugagagcagggguuugagcguggucuguguuauagggaccugcaugauuuugcuagaagacacugcaaaaugagaugaguugaacaaggucagacggagacuuuuaggccucacauauuaaaucuggcuucuauucuucagugaaaaaaaaaauaggugaaaaaaauguuaguuuuuguuucccuuaaccagcaugacuccuuugauaucuucggagcaaacacauauuucaaggugauuuuuuuguuuuuguuuuuuuuuuuuuuugucauggcugcuuuugccugguuggguuggugagaugguauuuuugcaggaaagaucuguaaauaucaugugauuucucaggcaggggucuagggcuugcucaugccagugguuaucaauggaaacugaaucugcacuggaaaccugcaagucagcuuucgguuugguaguguucaccggcagaaagaagcuagagcuguuugaguuagcuugugugaccuguaacuuugaaauguuuuuguugaagaggugagacucuuuauaguuuuuccagccuagaauguauguuggucuuauauacauaguuaaauguccaggacuaacuggaugugaugaugcacaccuuuaauccuaguacucaagagacagaggcaggcagagcucuaaguuuuaagucagccugaucuacaaagugaguucuagaauagccaaaacuacucagagaaaccuugucuugaaaauacuucccccuccccaaaauucccaggauuaaaaagugcuaucaaaucuaagaaaguuuauaacauaauuuuguucccuucaaaaacuuaucuaaugcaauauugguauuuugcaagguaaugggaagaaguugcaacacaauuuauccuucuuauucagucuacauacagaugcaaauaccucgcuacaauguaacaugguucugccugaguguuucuacauuacaauaaauauauuuuauuauuaauguuauauuuaauuucugcuugguguauguacuugguuagcuacauuauaacauaguucugucugagugcucacacacugcaaugcauauacuuucuuauuaaugucuuauuuaauuuuugcauuaugccuaugcauguguggauauguggaggccagcacagguuguccggugguuuccuccauugcucgcagccuuccugcucugagcuaggguuucucacugaaccagaagcucaacauuuuugcuaaguuggcuggcuagugagcucucaagaucuuauugucuccagcccccgcaccccccccccaaccagugccgagguuauaggcacuuacaauuaugcccagcuuuuuuacauggguccuggggauuugaacucagguccucacgcuugcagagcaaguacucuuacucaccaagccuaaguauuuuccagucccccugaauauuuugguuucuuuuugugcagugcuggaaagcaagcccaugcuaucugcuaagcaugcgaagcaaacacugcuaucugcacuucucauucuuuuaaagacuuauuuauuuauuguauguauaggagugcucuagcugcauguauaccugcaugccagaagagggagacaucagaucacauuauagaugguugugagucacuaugucacagggauuugaacucaggaccucuggaagaacagucaaugcucuuaaccacagagccaucucgccaacccacacuucucauucuugaccuuccuauuucagagagguuugaaucaauguuaaaaacuuuggaacaauauauauucaauccuguaauuuuggugccuuuuaaaaaaagauggagacacuguauaacuguuuguaauugaaauugagcugagcaaaacauacccuauuuuucuuuuucuuucaccuuugagauaaggucuuaugaugugugcagcuuacacuggccuugaacuugguuugucccuggcuggucuuagacaugauucucuuagcucagucuccugagugcugagguuaugagcgaaugccaucaugucuagcagagacacggggacaucauggauguaaaccugcuggaaagugaugccaugggguuauugauucucuuugccacugaagcuggcacuuggaauuucuguuuuugaguuguucguuaggauacacaaaugugaugcauuuuuagaucuugguuuuauuuugaugaucuugcuaaaugcacuuaauaauuugaauaguuuuuagauuugaaagaauuuccuacauugacaguuuucucuaauuaagacacuuuuauuuccuuguuuccaauucuuacacauuuuuaaccuucucuuacuuaagcauugacuaggaugucucuuaaaaugaugaaagaggggccggcaccacggcucaguauaaaggcccuugcugccaagcuugauggccugguuugacucuugggacccacgugauagaaggagagaacacauuuucauuugaagcuguaauucucccuuugagccuggcuguuauagaugcugcaaguauugugucauaauuaauuuuuuauaaacuauuuaauaacuuccauuacaucuuuuuuuuuuaauccagagggucauauagaagugcacuucauuaccaggcaaccgagugguucugucuaguuauuucuuugcuauugacuucuaguuucuuucuacuguaguaagaggaaggacuguggauauaguucuuuuuagaaaaaaaauuugaguuuuuucuacuguauauaugguugucuuacauauuuuuuuaguguguauauacuuuguaugcacuuuaaaauaauaugcacacuaacguugccuaguuuagcuauguugguuauuucauuuuuuucuuaaaaugcaaagauuuauuuuuauguauguguauguaucugugugagugaaugccauguguguccaggugccccuggagacaaaguguccauuagaucuccuggagcuggacuuacaggguugugagcugauguggguacugggaacugcacuugaccuuuggaagggcaggaugcucuuuuaacucugagccaccuuugcucacuucuuugagauagagucuuguucuguagcccaggcuaggcuagaacccacuguguagcccaggcuguccuuggacucauagcagucgucgugucucagcuuccccaguugggauugccggcaugagacgccuuggccugccugccuuggcauuucucucugguguugccauaaagccuggcccagaacuugcuguauagcccaagcuggccuugaagugauaucaguucuucugccucugucuccugguuguuaggaucacaguugggagcugacauucucaucuugucuuugccuuuugaagguagugccacuggguguguguaauucugggagaggacaagaauggcacguauuguggaggcugagcugggagagaagccagaaguucaaaacuggccugggaaacagugagacccugagucaaaacaacacccacacucacacaacccccaaaccaaaccaccaacaaauccuaagcuggcagaugucuuaaauuuuuauacauauaaaauauauaaaauguauauauguauauaaguuuauaauauguauaaaauauaaaaauacauaaaauugaggguuguuuuuuguuuuuuuguuuuuuuguuuuuuuuuuuuuuuucuguuuuguuuuuuccagacaggguuucucuguguagcccuggcuguccuggaacucacucuguagaccaggcuggccucgaacuccgaaauccacccgccucugccucucaagugcugggauuaaaggcguucgccaacacugccuugcaaaauugaauuuuuauuggcacacugacauuauacauagcauuagggcuccaaggguuuaugaucaagcuagaaguugucguauagacuauauccacaaaucuuugccagcacccaacgugcauuuuucggguuuccuauuuucagugcuguguguuauguuaacuggacccuggagcuuccucucaugucuggucauuuacuugggucauucuuugagcauuugugcaccuaacuccuuucagcacaaauacauguuccgguggcucuugaaucaccaggagaguaagucagccuacucacgugacuuagagcugaaaggcggugaucgaugguaugcggucguggagaccgcggaaagccuuuucauguuuucuauuaaaauuaggccaagaaacaaacuggcacuuccugucagucucuuuugaugugcgucccuacuucacuucgaguagggaaaaugugccacggagggacccucgggugccacaguguguaagugcggucaguuuguggacguacauugagcugauccuguguuguguucacuuuucaguacauauguuacacuccugauaaaaauuauaaaagugggcccuuugauaugaaaugucuccccccgcccccaauauugagguagguuucacucuguagcccugacuggccuagaacucagauauguuuaccggugcugugauugugaaacugagccaucauuccugaugaugucaagcauucuagaaaagcgccagggacaaggaaagcuugaggacggcugauccaggcgagccuugucguaugaacgagauuacuagggaguaacggaacccgggaacugcgcaugucucggagcccacggucaggccuucugauucucacucuuuauacuuuuaaauucgcugaucagagagugggggaccagaggauguucucaaauucguaaagcauccgcaugagucagcaccuuccuccuuuuugcgguuccaucuuguccucauucucuucccaggcauuuaaaaacagauacuuuuaucucaaacugcaccuuugaggccuuuuaaaaauuacccccuuagaaucauuugaucucucacacacauacgcagucgagagagagagagagagagagagagagagagagagagagagagagagagagagagagagagggcuuugugccugugaaaucuguuccucucugggccauuuuuaguauggggcugcauuguuuaaauuuagaagccuuuuccaaguugaggggguggugguaguuugcagaaauugaacccggcuaugacuccugcugcugcaagauaaaugggaaggaaaaucugggaacugguuuuaggagagggccaagaaagggacuuaggaacuugccuuaaugucacaaaaguaguguggcacuggccuuuaaucccuguacccaggaagcaggugcagggggagcugaguuagaggcaagaggccagccuggacuacgugacagguuucaggaaaaccagggcuacacagagacaugcugucuuacaacaaacccuguugccuguugagaauauaguuacaguaucuuuuuugcuuggaagcccagacuuuaaaauuaaaacauaaauauuuaaacauuaaccaauuauaaauaauuacuaaaauguuagcauucaacauuguuaguauuaauauuaacgucaagauacuaaaauauaguuauguauaugcacacauauguaggcauauccauauaccaccuucuguuaacuuucagucacugugacaagauagcugagaacaaucaccgaaugagaggagagauuauuuuggcuuacaguuguagagauggcaguccuuggccuuauuguuuuggggcuuuguugacacagcguaucaugaugggaccauguuguggauuaagccuaguaaccucaagaggggggggggcucaugcgcaugagagagagggggagggggagggggagggggagggggagggggagggggagauuuucuucaagggcaugccucaguuguccaacuuucuucuacuaagccuuucuugcaauggcuuuaccaccucccuaggcucuuagcauauagaacuuugggucagguuuaauauccaaaccaugacauaucuagaguacaguagcaugugcauacgugagcaugcgcgcgcgcgugcacacacacacacacacacacacauacacacgaggcagugagguuccaggaaaguaaaggccuuuucuacuugugguuuucucccuccuguggcccucccuucuuuucuuuccucuuuccccauccuacaccugaaagcauggacucagagccuaagauguguugaagcuuuacguaacaauugaaaauguagaaggcaugcaagagaaaaugcagcaggcccugggagaagguuguaggcuagaccuggagucagagagcccugaagaggaugccacuccuaaacagaggaugaccuugagccaggcugacagggaggagggggauaugguucaagcagaaagaacagcauaugggaaacacccaaucuagccugauaacuaccaauccaagcugaacaugccuguaugugagugugugugugugugugugugugugugugugugugugugugagagagagagagagagagagagagagagagagagagagagagagagagggguugucucacuauggaguucagacuggccuugcucuugaggugguucuccugcuucagccucuugaccgcucuuggcaguucauucauuuauuuuuuaaguuuagaaguguuuuuauuuauuaauguugcacuuguauguagguacauggguaccuguaugccacgucaaguguaggaaggucagaaagguaggucucagugauggagcucaugagauuuuacccacugagccaucucgcuggccgcauucuccuugcuugugacauugucuuccuauuagaaaugagaaauagaacagaguagguaaaagcauacauucuccuuauaggaauuugugaaaauccagcuaaguacagagaaaaccugcacagccguucucaacaaucucguuccuuggagcgauggcugcacaggucccagcaguccuuucugucacugcuccugugcccuuccuucucuguaauuguauucuuucuucucuuaacccugcuucccauuuucuacaucuuuagugauucuaaaauugcuguauacucacagcaucucaccgugauugcuaggucuucaguugugaggagauuuauaaaccuauauagacuaucuucugaagucuaacaagauacugucuugaguuaaggagauaauucaaaucccugguaaaugagacagugaacagggcaagcgggccagcuuucuuccccuacucucuucugccucucccuuccauucccuucccucucucuuuuugugacauuccuuuuugcuuuguucagugggugaaaggguuauuuuuggucuuuaagaaaaugaaguagguaggcagagagccaugcauuggccuggaagugagaaagccugaauuucugcuuauucucugaccacugauucagucauuccauagucugcucugacuuuucucaccgguaaacaugggaggaguagguuuuauaacagauguuuucacacuggguuugugugaguuuuaggguuguguggaggugcucuugaauacuugugucucauggaugaggccaagcacucccuagcacucacgaagccuguguuugauucagcacuuaaaaagaaaagaaauuagaugauaaaagaaaaauuagauuugaaauuuuaugaaugaaauacaauuauacuuuugaaaauugagauagacuucagaggccacaaaauauacccuuaugagucugccuuaugagguaugcccaaucuggacauuuugcauaaguguaacuuauacaauauaaacuucauaucugguugcuuuuauuuaauguaaaaguuuacaauuucacccauauuguagcauauguaagaugcaucuugauuuucuuuucgauacgugugcauggucuuguuuugaggcagagucuugcuauguagcucucaaaucaaauuugcuauccuaccgcuucagccccucagagcuggcauuucaggcauaagccuccauacccaguguccuuuauuaauuuuuauuuaaucauuuuaggaaaacauuuccuauguucagauaaaaaaauugaccagccuauuagacagugccaccguagcgaugagcucuguguccauucagauguaaaccaauuuuggcuucuucuauuuuuaagcagaaugcuguguuuagugcacagggaagcuuuuaaagcucccguugccuuaaagccuggaaaccaacacccugaucagccagucucaugucccuccucuggaucuacggucucuagagucggucuuccuuggaugacagaagugguggugagagacuuaugcugggcugacaggugaccagaagagauggaaggugaacuggugagcuuuaucugucuuuggggcaaagcuccuugcuuuuauaucccuaguauccccaaggggguaugaggaaggcagcugcgguuauaggccauagacugguggaacauguggaugcugccuucuccaguuccuaagagacagaaagggguucuugucagagucagacuccacaggugauacaaacucuuugaggucaguuugccucauccagauuacaucccuguuguuucuuauggaaccuagcaugcaugagcuguuccaugaguaucucuuaaauaaccagugagcaguuuauuguacuguugacuuaaaaaaggaaaggaaaacaaaaccugcccagcucgcaucaugaugcguaccuguaucaccugagcaggagacuggugaguucaagccugcuugguuccacagcuaaaagacaaacauaaacagaugaaaaccaccaccaccaccaccaacaagaaaucaacaaauuauauaguugccagauauuucagaaaagcacagugaagucuuguacauacuuccugaguauaaaacuuuauuuauggggcuggaaacauggcucagagguuaagagcacugacugcucuuccagagguucugaguucaauucccagcaaccaccugguggcucacaaccaucuguaauggaaucccaugcucucuucuggugugucugaagacagcuacaguacucaucauauacaucaaauaaauaaauaaaaucuaaaaaaaggaaaugcaugaaaaaacaauuuguuuguuaguuuguuuacaugugugugcauacaugcacuugaaagugugcaggucuaaaguugaugucagaugucuuguuugauugcucuccaauucuuuccugaggcaggaucucuugcugaacccagaacgcccgauguggauagcagagguagccagccugcucucuggcucuccugucucugccuucuacaugggguaucauagacggccccugugccugccuagguuuuacuuggguucuugggaucugggcucuccuccuuaugccugcacagcagcuaucaccuaggcuccauucaccucccaugccucucugguacagcaccaaaacuaagaaccugacacuugcuuaucaucgagcugacuuagguugcaugaauuacacaugaacucacuuguguguucauauguauaccuuuguacaguuucuuuuagcauaccugugaucuugaauggccacuacuguacucaacagucaauuaaaucaugacuauagacuuccuuuuguuauaccuucauagcagccauccuuuucccuuaauaucugauccuucaauuaauuucuucuucaucuuuguaauuauuuccagaaugaagaauuuccaucaugaaguauguuugacuuuuuuuuuuuuaacuuagcuugauuuccucaaggauaauagaggugguguggaccaauacuuccuuccuuuuccugacuauuagucugugguaugcacaggccacagcuuguuucuucagacuugaaagauacaagaguuguuuccagguccugucuguggggagaagagcugcuaugaauaucuguauaaaacuuccugugugaaacuaggauuucauuucuaccugacaaagagcuuaagacuguccuugcugaacaaucugguaaagacauucuuuuacuuuuuaaauuuuuuuuaaaaaagaauuauuuauguauuuuauguauaaguacacugcagcugucuucagacacaccagaagagggcaucagaucccauuacagauggcugugagccaccaugugguugcuggguauugaacucaggcccucugacagaggcgucagugcuccuaacugcugagccaucucuccagucccugcuucuuuuaauuuuuaaaaggaauugccaagcuguuguccacaaagugucuaccauuucacacucaacagaacugcacaaauguuuucacacacuugugagugugugccauuauaacuaugcuuuaucuagcuguuaugauagauguggagagauacauagauuccuucuucuauguuucuccuuccaccaaaaagaccacauggguuuugagaucagcuuuccaauucucagcaaccaucuccuaugauuuucaaacuuuuuccuagcucugugaccuggcuuacauuucuucccuccccagccugaaucccagagucuuucccaguacuuuccuuauuccuggggaaagucacagagcugaccgaguuccugacagaaucucaacugcuagcaucucaacucuuguacacuccuuucuuuuaccuuggugacucucuuccauuuuuggaaaguacugcuccaaauguguugcaagcucuucucuuagauguccuuuccacccgugagcaagacccagacgguucagcuuaaaucucagcaccuucgcaccagggccuucugcaucuuccaccucaucucaaguccuucucuuucguggaagggcugacugcuuguggucauuuuggccucuggaauagcagaaaucccaguuaucuagaccagggaucauuuuguucuucucuuuugaucacuuauaguaucuaucacuuccuaggauuaaaauggccauggguucuguccugcuugauaaaugcagaacaccaggagagaaagaacuggaagaaugugcgguuuuuguuguaacucuauugaggacgccuuugacuuaaaauguugcagaugcagagcagguuaauguauugaagaaacaaaguugcuuccuguugccauuagcugacugcguguacucugcugaaugcucagccuauggggaugguugcuuggcacuggcagcuugccuggauguagaaucauggagaugcaccaugugaaggcauugcaagaaagauacaagacccacaaguaauacaaagaguucccuccuauggaugggguccaggcugaguaaaaccgagaaagcaaguugagcacaaacuuucaucucucugcguuuccugacugugagugcauuguggcccgcugccucgggcuccugcugccaggccuucccugcuuggugaacucgauucccaaacuaggggccaaaauaaaccaucucccccuauugcuuuuguuggcauuuugucacccuagugagaccagaaacuaaugcaugugugguuucacauuaaaaccaaagugguaauccccagaggggcauuggcuuaagcauauacaugugccuguguugcauuaagaaaaagaagaggggcuggagagauggcucagggguuaagagcacugacugcucuaucagagguccugaguucgauucccagcaaccacaugguggcucacaaccaucuguaaugagauuuuaugcccucuuugaugugacugaagacaguuacagggugcuuauauauaauaaagaaaucuuaaaaaaaaaaaaaaagaaagaaagaaagagaagagaaaaaacauuuccccaggagugauuuaaccaagagugagcccagauucaaauccucccugugcugucugccaucucccacuuguuguaggagucugauucuaugccugccugagugccacugccuugucucucccugugucugugucucucacaaagagcuuugcucuguauuuauuaaacaucacagagucacaugagggaaggaaugagagguaguuuacagaaaucuuuaauagaauuuuacaggggcuggaaccuuccuggcucuaccccaccccccacugcccccaguuuacccagacaacaagcuguacuacaaacaccacugcacacagacuuaucaaccuauauccauggcacguacaaccuuuaugguggauauuuguuuuauaagguuguuuuuaaucuguuuacuguuucuaguguuuauuaucauaauacacacacacacacacacacacacacacacacacacacacacucauuacucauagggcagaacauggaagaguauauaauuuaagauuaaagcuuugcauuagcuuagguuguaaaaguugauuacaugggaaacccaagacaaguaagguuggcuguuacauuguucucguaaaggcagauuaaaugaacaggcuaaguacacaguaggcuaacaaucuucagucauaaauaaccccaagguguguuauuaacucugauugugagguccagcaaaaguucuaaucucuuagacuguuggagguauucuuauaauaauguauugccacacagguauuaguauauucauguggauggaggcauggaagauaggugcagagagauaacaugcucaaagacagacagcuaacaggugguucuaauccucuguuccccaaaggcuuaugacuuguagacuugguccccaucugaugguguuuuugcagaugguggaaucauucggacgagaaaccuaguagaagguggucauuggcaaugugauccugaagggaaugugggagcccuggcccaucuuuucuuucuucuuccaaguugguaugacaugaagcuugcuugaccaaugcccccuaccacugcaggcuccacagcaauagaacugacuggccgagaacggaaccaucuaaccugugagccaaagcucagcuuuucuucuuucuaaguugauuagcuacgguauuuuagucacaguaacaggguugcauccaggaugccagcauguuucuucgaucccacaacguauuuauuugacuuugcugagacauuguagaauguucaggguggcuucaaauuaguaacccucuugcccuggcuucgggagugcugagauugcuaggugccagcaugcuagucacaacaaugcuguuuaugcuguuuugucguaccauaagaaucaauucccguguguauguuauagcuuaaaguuauuaucuuuaaauaacuucaggcuuguauggagcacccaagccagagacgggaggaggcuggaagagcaauagggaugagacaaugagcgaagggaguccagggggcuguaguaggugcugcucagccugauauagcagugcacuuaagauuagauucuuacauuaauagagguaccagaaaaaucucacuaaaagaaauuaaaaguccauuaaaacaaugcagacaaacgagcuaguacaauauaaagacauggaagagaggauggauuuauagauagagucaagaccuacaguccuaugagucacugcgauugugagugaaauacucugauagugaguuauggcuucuacccccgucuuuuagaaagccucuccagugccucuuaaacuguaauuuuuauuccugauuacagcauguuucucacaucuuuuuaucagucuuuaggggaauaaguauuuacuuauuuaucuagguacucauuuuauggugcaaggauagaaucagagguccugcucuugcuggacaaguaggguaccacuaagcuacaucccaggucugggccuguuuuguuaggcuucaagagaccaacugugaaucaccaaguuccuacacacuugccuacaucugcuuugcugccuauucucugugagggagaauguggaacacccuagguagaguugcuggaggguuuggggcuuaguguuuugagaugaucauuuaucccaguguaaaagcccugcgugauucccuguuguucuagaaacauuuacucuccugcugagcagacaccugcgcacuucaggaccugaagagaaugugcgggucucaccaguucuuucuuucuuaaaaaaaaaaaaaauuagauaauuuaaaaaaauguauucacuuuacaucccacucaccaccuccuccccgccauccccucccacagcccuucuaacacuuucccuucuccugagcaggugggaaccuccuggguaucuccccucccuggugcuucaagucucugugaggcuaggcacuuucucugccacugaggcuagacaaggcagcccagcuagaagaacauaucccauggacagggcaacagcuuuugggauagccccugcuccaauuuguucaggacccauaugaaaaccaagcuguacaucuguuacaugugugcagggaggccuagguccagccuguguauguucuuucaguuuucugagagccccaagggugcagguuaguugauucuguuggucuuccuguggaguucccaucccuuaggggcuggaauccuuccuucucuucuuccguaagugucccccaggcucuacucacuguuuggcuggaucuuaccauuucuuaaguagaccuaggcaauccuaguuccugaguuuagucuugcuuucacaacucaccacauagagcagugauucucaaaucuucccaaugcugugacucugaaguacauucucaugugcacacacacacacaauaaauaaaagcaauaauuguuuucaaauuuugaaacaaccuaaucuuccuagauaagucaguaggugguucauggguggcaauccuggaacccaugugacgguagaaggaggaauugacuccacaaagcuguuguuugccuuccacuugugccuuuugacacggauguccacacagacaucaugcauauauauauauuacagacaaacagacacacacaggcauaccuuaaaaauaauuaaccauugcaagccuaucucuucaucaacuuuacacacaagcccaucuccuuaaaccacaacauuucacccuuggcucccaaaggcucgugucuaucucuuaaugcaaagagcauucaguccaucuccaagaauccccauagcaacaguucuaauauuguucuaaaguucauggccaaaguuuccuaagauuuaagguaaacucuuagcugugagcuccuguaaaauaaaaagaaaacugcauacuuuccuuaucugguggcacaggauaagcauuccaucucaaggggaauaggcggugguccagaaagaugugauggggccaaagcaagauccaggugcaucaagaucgacauaaaucauggagcuccuugucuggcauuuggcaaagaaugcaucauguggugauacaagcucccacugcuuaggcagacccaucucuauggccuuccuggccacgcccacaugauuuauuuugugugcguucucugcuuauugccuuuuuuuucuguuuuagcagauguuucaauuugcuggcauugcuucccauguucucuuguucucuuaucauguuuuugccuccauacucacaguuucuuacauugcccucucagaggcggccuauaggcugccauguauaacuuguccccaggucuucuuugaaucuauguggaaggaaucauuacucuguaguuuuuguguucugcacacuugcaaagguaacaccauguggaagaugccaccacacacaguugaugucugugcgccuauauugcagagcaguaaaaugaauccugaagaaacaauuuucuagucaggcuggugcaagcaguaugacucuaagguacucuguguuccgcggaaagaauuucacacccuagaguuuguugugaguggguucuggccaguucuugaaauacacacacacacacacacacacacacacacacacacacacauuuuucugaugcuaaugacuucuuuuaaaugaaccuaaaaccuuuagaaaccauaccuuucuuugcucuauuugcacuggcuuuuauaaucaaacugagaguuucucaagucuuuccuacuuugcauuuugcuuccuguucucacuguaaacuuggccagaagaagccgacauuaaccacgccacagucuaaauucuggaucgcuuugaaauuuccuugcucagaucacuuugucuaucaccuuuaaacucagccuccuguuaagacacaggacauggauaaaauguaauaaaguucuuugcuaucuaucauuggaaacaggaacagcuuuuagcccauuucccaauagaauucuuauuuucaucugaaacuuuacaagagcaaucuuuauuguuguaucaguuauuuuauguuuugauaaagacuucaugaucaaaagcaaauuaaagaaguguauuuauuuuguguuacaguucuaaaggaggaguccguaauggugaggggggaaagcagacagagcugagaggucacaucucagacacaugggaagagggagugagcagaaaguggggcagggucauaaaucuuuaaaaccuucccccagugacauacuuucuccauuaaggcuauaccuccuaagaaguugcauaucuccuccuccccagcagcaccaacaacuaaggaccaagugucuaaaugcaugagccuaugagugauguuucucauuucagcaacaacaauaacccacauuucuugucaucauccugguucuuuaagcucagugcacucugcuuguagcagccuagacuuuauuuaucccacuucuauuuuuuccaaauuccucuugcaaacuagugucacagcauagaaucacucagucaggccuucacagaaaugacccccacuucacagggccagauucguguguuaguuauuucuacguuugcugugaccaaauaccugagagaacauauugaacguagaauuauuuauuuuagcccauaguuucugagguuuuacuccauauucuuugacuccauggauacuugggucugugauguggcacuagaugaugacaucagaagcacaugacagagacuacucagcuuagcacacauuaagcagaaagagagggaggggauguagacagaugagagcuagcuagauacauagacagacagacaaacagacauacagacagacagauacauagauacauaaaugcauagauauguagauagauacauaguacauagauagguacauagaaagauagauacauaaauacaaagauagauauguagguacauagauauagauaaugcuugcauuauuuggauuuuuucccuuuaucuuuuuuuauuuuuuccauguagcucauggugugguaccacccauauucaggguaggucaucccucauuaaucaacccucuuuggaaauacucucacagacaacaucagagguaugauucuccuaaucugguaaacaguuuucaguguggucauguuggcaaugaagaaucuccauuauauaaggcaaagcuuuagcaaauacugcauaucaguggugguacccaguauacugucagcagugugaggaucaccguggccugccacaucuuuaccaauguuugauucugucagucuuuaaaauuuaagauauccucuucgguauggauuggucccugugguuacaauuugaguuuucacugugacucagcaguuaagaaccuugucguaaauaucuuggucacuuucaugaaagaacugauuguaauaacuuuugccaauuuuuuuuuuaagacagagauucucuauguagcccuggcuauccuggaacucacucuguaggccaggcugaccuugaacucagagaucugccugccucugccuacuaagugcuggacuaaggacgugcuccaucaccaccuugccaaaguucuuacugggcuuucuuugcuuuucuuauugauuuguagauuuuuauaucaauuaauuaguuauuagcaugucugcaugacauguguguggagggcauguauguagagguaagagccugacuuugagcguugguucucccaucccacuauaggguccagggagugaccuuauaucagguugauagacuugagugucaagugccuuuaccuauuggaccaucucaccagcucugauuuguagauuuuuauuauuuaauuacuuauucuauauauaaauuauuugcauaaauguacuguuuaauuuggauaaaugaaaugaauauuucuuuacaacauagcuuguuuuuuuuuuuuauuuuuacuuuaaguguuuuuuaaaaccgauucucaacugagcuagccuaacguugagauucuccugucucagucucaugaauguuagauuacaggaauguacaaugauauccacuuccuuaaugaugauuugacgggaaauaaaagcuauauucucugaggccggugucugggagacccugaggccacgugccggguaggcaugugcucuaccggagagcagugaaucucagauucauaacaggcuucaauguugucugcuaauuuuggauuuugauaacugccucugggauucuguuuaacaaguuccuauuuuccgcagugugauaaagauauuauuuuaugcuuucuucucagagcuuuguuuuagauguauuuguuuguugauuuaugaaauuuuuaaugaauuugaucuguagaaaauaaaacaaguaagcuugaauaaagacuuugccacacguguauuaagaaauuguuucggugucagugauugaacccuggaacucauaugugcuguaaacaagugcacugccaaugagcuauaacucucuucuuucauuauuuuaaaauucauagacauacguguguguuguuuauauaauguccggcaugacgguuuuugucauguugacauauacacaucacauguguguuauacaguggucaaaucuagcuaauaaacaaguguguuaccucacauaauuaucacguugugaugagaacacaaguguacuguguccuuaguuuucaagaaugaaauaugcugccauugggcauggucacagugccauucagucgacuucuuaaacauaucccuguaaucaugucguuuugacuaacaugucuccaccccggcuccacuucacaccaggccagcucugauaauaacuauuuuacucucuguucgcaucaacuguuuaaauuccacaugugugagaucaugugacauuugucuuucugugucuggcuuauuucacuuaacgucuuccagguucauuuaugaaucccaaaugaugggauuuccuucuuuaaauaguauuccauugugcaugcauaccacauuuucuucaucaaguuuuauucaacagauauguugauucaguaccuuacguacuuaaguaguacuuccauaaauacaggacugaagguguuuauguaacauugauuccauuucguuugaauauauaacaaguuguggguuuucuggaucauguaguuguacuuuuaauucugagggaccucccaaguuuuccaugauagcuauauuaauguauacuucuacccucugugugugugugugugugugugugugugugugugugugugugcuauccugguucuaccuucucaucaacauguucuguuuaucuuguuuugguuguagcuacucuaaggauaaggugauagccacuaugguuuugauuuguacuacagugauggugagaaauauugaacaccuuuccacauauauuuuggucaguucuuugucuuuugagaaaugucuauuuuuaauugaucauuuguuuucuuacucuuuccccauuguguguucaugguacucugguugaaagucagcagggucaagaaaguguagaucugugucugucucuccagucuguuguguugucuacaagugaguuuguguuggcauccugugguuugucacuguaacguuguggaguauuuugaaguuaaguaguacgaugccucuagcuuuguuccuuuugcuugagagugccuugccuguuuggggucuuuugugaguuuucaugaguuccaggaugauuuuccuccuucugugguuaauguuacugguauuugguagcgaucccacugagcuuggacuuugcucugacugguggacgcuacauguagcagcaugaaagcacgggauguauuuccauuuauuuguuucuucuccaauuccuuuucaguguaaagaucuuucaucucugugauggugucaacuuggcuggagugaggauuacccggagaacugguaaagcuuuguggugggguguguccguguccugaggcauuugagucauugacugaacaaagaggcucuucuggcacuguaggcaggagucauccauucaacugagggcagucagauagcaugaaauguccagaggauuuuaggucuuugccucuuggaucugggguucacaacucuucccuccuggacaucagcacaccaaguuuagacuucaggacuuauaccagaaguacuccacuguccuuaggacuuaaaucucucucugagaauuauaccacuggcuucuuuuguucugaggccugggugcuuggacugagccacuguacagucuucacaagauauaacuucgccaaguggcuuuugagucauuugacuuguucaggaugggaagagcugagggugaauuauguagggguuggugcugccuacaugaguaaaaugagacauaauuacucaggccuugcuggguacgcgaagagaugcugaggaaaggaucugagauauacuggacgcccauuaaaagccaguugcucuguuggauaacaucuuuaaaagugauucugggagagaagucuuaguggaaagucuaacagcuuuggguaauuuaacauagcuacuagaugguggaguuaggauucaaacucauuucuauauuguuuucuucccacucuccuccacgcccuuucuuuccaugcacuucccuuaucuuucucugccuuuucagcuauccuaucauuccuuuuguggauuucugaagcucugcucuuccuuacuuucuauggaacagaaucuaucuuuuuuucuuuuucuuuuucuuuaaauaggaucucucuguugucuugguuggccuagaacucacuuuguagaccaggcuggccucacacgcaaugauucuccuguuuccccuucuugagugcugggauuaaagaugugugucaccuauucuuacugcaucacagagaagcaacuucccgcccacuuccuuucuuuuuuuuccauguuuuauuuuuauuagauguuuucuucauuuacauuccuaguuuccucuccgaaaauccccuauacccucgccccuccccccgcuccccaaaccaacccacucccacuccuggccccagcauuccccuauccuggggcauagaaucuucacaagaccaagcccgcccacuuucuuacccuaaaguguuacacuuuuuauuguagcaauucugaaacauguucccaugucacuuagguaucgcuguauaaggaaccaucuaagcagagugguuugagacagcagacauuuauuuagcuccaguuuccacugucaggaauuaggcacaucagcucaguaguacugaucugguccacacucaucuguucucaugccuggggccucagcugagacgcugggaccauccuacagcuggcuagcuuggucucauacuuugauggagaggaaccaagaaagccaauggaagccggaggcucuugggucuaggcacagagacagugcaguagcacuugcagugucuuagcuggagcuguuguaacaaaguaucccagacuggguggcacaaacagcagguguucguuucucauaguaagaugcauggaggucaaggucaagaugcuggcuuaguauaugauacagaccauuuuguggcucgugggaagccaccuucuuucuauguccucacaugauggaaagcucuaucucuuuguucuuucacaguuacuaacccauucccaaggcuccuguucuagugaccucaucauuuaaaaauacuguuuuagaaccuauuuacucuucauugcaacuucaugugcacuuaggauguauucugaccauucucucuccacauccucuuuuaacccugacuuuugguuuugucuuguggccuauuuagagccaccugggucacuacuggacugacacaguccauuggaacaugguggguucaucagugagcacacaacugaagccaaugguucccucucacccugaaucuuauuuguaguucagcaucaaguggcaggacacccugcaucuucccccaccccugccugccugcugauuggaucuuuuuuguguugucuuacuucaggcagcuacagcugcugugaguucaugauugcaauggcugauuugaagcucuucucccuauauucuggcuguugcauucuuccuacccccucugccacaguguuccuuaagccuuagaugggaugguguagaugucuugcuagggcugagcauccuacacgaccucauuuuaacccaauuacuuccugaaaguccccucucccauauaaacaugcuaggcaguuagggcgucagccuaggcccuuugugggguucagugauaucaaggaaagguaacuccauuucuuucacugcacuguaugcucuccuacaugucacaugucacuuccaaguuuccaaagaugcauggggaaaucucucaucaucagguagcaaacaaucaauucuauagcagaaaugcaacucaacucugcccauuucuacuuguggguaaaaucagaucuuggauauugagggcucaguugcacaggacuguucaggcaucaguucagaguccaggcuucagguuuucugaccagcuggucacaagcagcuuccuacaacuacauagcuuggcuuuguucauuugcuagggcagcucagagaacccaaggaaaaagcacacuuauugguucauuguaaggccacaaacgaggaucuggaugaagacacacaugggaccaucugacaggugccuggcugcuccugggauguggaccaguucuuccucaguuuccucagacuccacagguuccccagaacucugaacccuuccacuggaguuuuguggugaugucacugcacaggcgugacugaagcaugggcaacuauguaccaauuggacugggcagaagguuaucaucugugguccgagucagugagaaacucagcacaaccugucuguucagauucuucauggccccucugugcagcgugccuuccuuccugguauggggcagaaccccauguggaaugaaagucuuaggaucuauucuuagacaaaguaguuaagaguguccuucuggucaggaguuagacaggaaagcagaagguuauaauauacuuuugcuuuuagugaucugaccuggggaagaaauauccuaguucuuacaguguaccuucaggagaaaaaagaacagagaacagaaaaaaaaaaaaaaaaaagaacagagaaagagguuuugcugaggccuaaguugccccagcauuauaacaaagacauuuaaaaaaaaaucuuuuuagcuuagcuuuaaaccugcuuuagaaacuaaaggccaaaacuaaagcuacacuuacuguucuagccaauuuggaaauaguaagaaccauggaaucucucucucucucucucucucucucucucucucucucucuguauguguguguguacauguacaugcauaccauuuguaugcaugcacacauauauucggcuuugugaacacagaggguaccuugcaggcuagggaguauguggcagagggaagacaguaguuaguggcaguaauuaauugcacucaugaaucuguauacacacaaggaaguguggauuuggaaauuauuuucaugaaaggcucucuuugaccugaaaggaaauagaguccucauguaucugggccacgcuguauggagagaccucagcccaugcuuuccuuuaguggcuguaguucaggauugugucgaacaugguuccuacccugcagccuacacagugauguguagagcuucagaggcggaggccagaggccaaggcugcaguccaggcucuguacugauuaguugcugguggaagaaauguuuauucuuuguguuuuacuuuccccccucauaacaacagaaagcuugucuccuuugguuguuaguuucuuucugugaugggugaacaguagccacccacuggaacaggcuacugaaaaauaagauacccaggaaauguaaagugcaaagccuagcaaguauguagcaggaagaaaaucuuccuggcuccacauugaaguagcaauauuuuguaucuacugagauaaaugagagacacuguagagcuaaauucaucugcaaauucauuuguuucacuuugguuuuuaauguggccacucgaaauuugaaaguuauguuauuauuaauuauuauuauuauuauuauuauuauuauuauuuuuuuuuaguuucuauuguugugauaaacacugacuuagagaggaagguuuuaguucaucuuauaacucccaggucacacuccaucacugagagaagucaggacaagagcucagggcaggaaacuggaggcaggaacuaaagcagacaccauggagggaugcugcuuacuggcuugaucugccuagcuuguucagucugcuuucuuccauaccccaauauaaucugccuaggguugacacuuccuacaguggacuggguuuucuuacacuaaccauuaacccacagacuugccuaugaaccaaugugacagaagcauuuucucauuugagauuccuucucagauaauccuaucuugugucaaguuuacaaaagacuagcauaacagcacauaauuuuuguucacuaggggcuugcauucuauuucuucagacccuucuuuugugaucaugaaguauuguauaaguguugguucuauccugaacauguauagauaucauuguauagguugcaauuccauuuuuuucuaaagcuuauuaacauucacuaaaguuuuaacauaagcuacuauguaggcaucuuaguuuuuuucuccugacguauaaaguagagaagauauaauucauuuauaugaguaaauaaaaacuugagugcacuggauuccaauuaugugagcaucguguccaauaguagguagaauucuuuuggcugcacacaccaccgauauaguacaaaucaauuuaauuaaaacaggggcuauuauaaguaugaaaaggcagugguauucugaaauuagugccuguagaaaguugucuuccuauaucuuuuuuucucucaaauuuacuucuuucucauuggcaacauuuucgucucagcucuccuguccccauauaucaaaaacacagauuguaggcaugauguauguuaucuuugcucaaggguaggauucaguuugacuuucucucugguuuucaucuguugaccuagcuugauuuuuagauauugaucuugguaggccugggacaguuucaacuucagccagagaagaggagaauuucccagaaagagugcuucuuuuguuugcuuaaagaaaguguaucuuaggucuucuuuuuagauauaguuugucucccagagcuuugugggcugaguauucagugacacugggucccuaguaucauccucugagagcagugggcccuuuaagaggugggcuuaguguaagaaaauuaggucgugagggcuccaagcucaugaauggauuagcauuguuuuguggucgugguucaugggaguggacucaugcuggaccuugugguacaaguucauuauccuaguuacucaggaggcucaggcaagaagaucucaaguuccaggccugcccuaaauuacagagugaguucaaugcuuagccuagguaaguuagcaagauccuuuuucagagugaaauaaauaaacauaaaagaugacuagggauacaacuuugugguaagugcuugcuuaacauauagcagauauaaggcacaaggucugguucugcuuagcacaaggagucaauugauuccuauggagggugggcuguuaucaagagcaggccuugacucucauuaucucuugguuucuugucgaguaauguuccuucuguguucugggucccuuaacacuuuucucccauguuauaauguagcaggaagucuuccccaacucaaccgugcaguuugguccuuccugucaccagaauugugagcuucauaaaccuccuuaaaagggccucaacccauguacuucauuauagcaaugucaaauagagugggaccacagugguaacuaauauguacagucaauacauacagugaaaagcucagaacagaaaagauuagggcucaaagaaguucuguauuuuggccaguuuuaaacauccaggcuaaauguucaugucuuuuaaaagccuacauguuuaaccaauacaccaagaaaaugcugguaaauuggguugugcugacuugaauuuuaaggaguuagcccuugccccaucugcauuagaucacuucccauugagccugauggcuggacuucccaugaaugaaguggguccagguaauaccaggaaaguucuucuggaacugggaauggauacugggagcuugaggauauguccuucagccuugcagccaaagccugaaaggaaauggggaagcacaccaguuagugucucugaccgacuguguuucagauguuagcauaauuuauauauauauuucccaccauuacauggcuccccaugguucacagcucaugggcauggugaugguaggaacaggggugagcaucauugcaucauuuucugucauucacaaacaauaugcgaacuaaagggauauucucucagagcgaugguuccuacaucgcccaaaaaaggggggagggggccagguccagaagguguaaagcuccuagucuggucaaacacaaaaagaaaauucaagcuaauguggugugaaaagacaaaaacgccuguuuucuuuaauucuguugaaauacaagagggcaguaugugguagcuuuguugggugaguccauuucaaacauucagggagucugacacgaauuucucaggaaaauuguucucuauauguggcuccaucgucuccauuguaauggaugcagcaggcaguggaugugaagcaguaaacaagagccuuucccaaagauggcucaucaacuucccauggccugacaucauggaguacacagacuggagugggaaggcacaguguagacaaacacguggagcaugugugacacguuacaagaugcacaauguacuaugggacaugauggaaguauaucuaaccugguccugacagcuuaaagaaucccuggggaagugcuguccucauaggcacuugaagagaagguuggacugggccaugugggaaauccagggaugcuaaaugucuggaccuaaagacugagguagagagacuugcagggugaauuaguggguaaaagcagcuugcugcuggcuugcugaucuguguuugauccuugggagccacaugguagaaggaaagaaccaacucccucaaguuguacucugacccuaacaugugcaugcaugugugcacgaacaugccuaggcacauacacacacaguaaagcaauaaaauguaauaauuaucauuuuaaaaaggugaggugaaauaagaaacaagaggucuaguucugagcgagaaguaacaguccuggagugugaaggguacaugugucaaauacuuagaucaguggucagccuuccugaugcugccagccuuauuaauauaguuccucacguuaaggugacccucccaaccacaaaauuauuuuuguugcuacuuaauaacuguuuucuugcuacuguuaugaauuauaauguaaaugucuguguuuucugaugaucuuaagugaccccugugaaaaagucauuugacccgaaagggucaugaucuagauggaggccugagcccuugucuuucuuaggguuaauugcugugaugaaacaccaugaccagaagcaacuuggggagugucuuaguugcuguucuauugcugugaaaagacagcaaggucaaagcaacuuauaaaacaaagcauuugauuggggauugugggcuugcuuacaguuucagggggugaguccagcaccaucaugacagggaacauggcggcaggugcgcagacaugguggugcagcaauagcugagagcuuacauccugauucacagacagcaggcagagagagagagagagagagagagagagagagagagagagagagagagagagagagagagagagagagagagagaauagagggagaacgaacagagaaagauaguuaagauagauagauagaaagaaagaaagaaagaaagaaagaaagauagaugauagauagaucaauauagagauagagauugaaagagagucuugugugggcucuugaaacuucaaaucccagacccagugacucacauuuuccaacaaggccacaccuccuaauccuucucaaauaguccagcaauuggagagcaagcauuuaaaauuauaagagccuauggauaauuauaagaggccagagcaccccagggaggaaaggguuuauuucaucuuggagaaguguagcuuguucccucuggguugcucaguuuguuuucauauacuauccaggaccagaccaccugcccagggguagcaccaccuacaaugagcuagacccccucacgucaauuaucaaucaagagaauacccugcagacuugcccacaggucagucauauggaggcauuuucucaguuaagacuccuucuuuuccaaugaccuagcugugucaaguugacacagaaacccgccagcacaguccuauaauuagauuugcaucugacucauuuuucuuaucucuaaauugaaagggaucuccugcucccugcaguuccuuucugcuuuaauauuucauacauuccucuggcuguagaauccuuaaucccacgcuagcuuccagaucuccugggcagcaaggcccaagauuauaaccagggcuggaagagggacguggacuguagaugggggugggcagggagaggaagauaaauagaugcugucucuuucccauuagacguuagugaaaagaaugggaagguagcaggaacaagaaacgcguagguagcuuugccuucucagcaagcagguagacgacaucuggcucugcuucuggcauggggaaauguaauauucucccauuucugucaaaaugcuuaaaggauugcauuuucaaguauuuaaugauaaauaccaugaagccugaaauguacuuuaaaacacuggggagguuacaguucaguggccuagcauucauaaggcucuggauugacuuccccagccuugcaaguaaaagacuaaguacacaaauaaaugagugaaguuggggcuguacauaugaaaggagauugauuauggcuugguauuguuaauauugaguuguagguacagauaaauccaacacauaauuuaaucugcuuuuguguuuugcuugauaacuuccauaaaucagagugaaaaauaacuacuucuaaccucauuaccuaaaguucuuuauuauuauuauuuuauuguacaaguguagaauggaucagacucucucuuggccauauaaaugucuuacaaauauuguauuaugaauagcaacagacuauuuuaaguuauauuaucuacuuggaugacuuaaaguguuuuuagacuacauugaaauuacguaggugggucaaagaaagaauucuguacaaaggaagggacauagacuagggaagucuuggguaacaugaacaugacaugaacaggcuugcaguucugugcugggucagucugaaggaggcuuuggguaucgcagauagucacugggcuuggaaucagguagaguagacaguuauauacucguugaaggguaacauauaauacacagccaggcaccaagccaaacucuuuguguccuuggugucacacaauuuuaauagcugccuuauuacuuagauauaaugguuuuaugagugagcuagcagagucuuaaguuauaaaacuugucugugacuguauagacauguaauucccaauaacuguuaugaagagugaagaacugaaguccagagguuagguggcaccccacuggggacuagaauggcugcauguaacagggaaaaacaaaagagugacucaccacagggagaguucuuucuuucucucccuuugcuaaucuagguauaguugaccuaugacugcuauggguuucuaaagcucaggguccuucugucuuuugcuugggugccaaagccuuuuagccugaagcucucugaggucagagagugacucaaacaggagucuguucuuuccaucuccuauguggguucugggacuagaacucaggucucagguuuggcaaucgccaaccugcucacacaucucacuuuauuucauccagugauguagggaauggaguuuucccucacuguagagacaagaauguggccaugagucaggucauagaaaacuuauguacacauguuuggacagugcucaaacauugauauaacauagguuuccuuugaagccaguggcuucucuccgugucucuuuaaucuacaucugcucagacggccacacugacaugccaaauggaacaugugccaaaccucuuucacuguuaagagcuuguucuuauuuuuauaucuuuguggcuucaaacuuguugccauugcccugcucccugucacccaagggcuggagaaacgggcaugcagcaccaagccugucucaagguuuacuuuuaaaaauuuauugaucugaaauaaagccuugaacgauggagccuagcccagccuugaacuuuuuguucugucugaaccucuugaguguuggcauuaugaaugcgugcccuaacuccccauuuaggaguuacuuaguuacuaucaaaaaauuaaacuauauuuuaagugguuuuaauuuacaauugcaaugauaguagggcauuggagcuaggagcuugcuuuugaugagaauaaaaauauuuuccuucuaguuauuuuugaauugaaccgaagggugaccgagcaucaaauuuuagguguaugaccuaaaauguguacaagaguucauaggaagaagcugucuccaccagaagcugacuucaggcaucacugagcagaaacucccccacaggcaguauagccacagcaggucgaguuucacuggucacccugggaaaggagugcuauacuaguguggugacaccaguaggcucaagcuucacucucaugguggaguuaccacugcagccaugugcagcagcugagcaugaccggagaguuugacauuagagucauaauauccuugugagcuugcgcgugcgacauagguucuccaaaaauaaguuuucaggguugucaaggacaugagaguuaagcaaggaagggaccugaaagugggaaauaagcaaugagcgaucuuuauuaccacaagaucuucaaguaagccuggguuucaggaugaguucagaaaggaugccccaccuggaaaauuagucuugucuuccaggagacacagcacuuggucaggcacucauaacagacaucucuacucccagcccauguuacauagacguuuucuugcauuagauauucuggcucucucauuguuugccaacacacugcuugcuugcucauguguguugcuguaugaaacucaugacagcugcucuuagucacacgugugauucuaugcugaacccuugaucagcaaaugagaacacuugaaugauuguagauuucuccucuggaugccauuuggaggaggagagggggauggcaagucaagguuugagaagacaggaaauuugagcccaagagacuccuauaagucagggcccgcaguauuccugcaggaggagagagucagguccacucugccauugaguuucccugcaggaggagagagucagguccacucugccauugaguuucccugcaggaggagagagucagguauacccugcuguugaagaacccugaaaggauucccagccuguucccuuguuuauuuggcuguggcucagagauguagguuuuggcuuuggucuugguuccuguccuugguucuucaaaugagauuuugacccuggagggcucagguccagaugccuaugagggcugguaggaaguaggccaggaggcugggaaugguggugagagacagugcucaaacuggagccugagaaccuucugaaaagacaugcaaauuaaaaguuguuguguuuuguuuuuuuaaguccagacaagcuaaagcuaaagcuaaauaugucaaggauauaccuaagaacuguucaguuaaguaccccaguuguguauauucacaggucauaucccauaaggagauaaccuggaugugacugagguguguugcucacauacguuuuaaugccucucauugauuucuauugguuacaucagaaaaucaaagggcucuguuucagagacccguguuacaggauauuugaucacacuguguaccucaagauuguguuauuuacuggaaaaaccuauucuuaguugugguguugcucagccuuaccacacagcuuuaaucugagauccuucugguugaauauuguaaaccagauuaaauaaaaucaaccaugggucaagaggaagugaacagaggauuauuaagaaaaaaccggccaggcagugguggcacacgccuuuaaucccagcauuugggaggcagaaguaggcagauuucugaguucgaggccagcuuggucuacagagugaguuccaggacagccaggacuauacagaagaacccugucucgaaaaaacagagagagagagagagagagagagagagagagagagagagagagagagagaggaagagaggaagagaggaagagaggaagagaggaggggaggggaagggaggggagggaagaagaggaaagaagagaagaagagaagaagaggagaagaggaggagaagaagagaagaggaggagaagaggaggagaagaggagaagaggaggagaagaggagaagaggaggagaagaggagaagaagagaagagaagagaagaggagaggagaggagaggagaggagaggagaggagaggagaggagagaagagaagagaagagaagagaagagaagagaagagaagagaagagaagagaagagaagagaagagaagagaagagaagagaagagaaaagaagagaagaaccauggagaguaagagaguaagagagagucagggggauggauagagagacaaacaggaaguagaagagaggaacauccagccuguagguuuuugagaugacaugugagagggccauuccuagugggacacuggcugaggaggauggucagcuggguguuuucucugccucucugagcagcaggcuuucaccccagcaccuggcuccugagucuucauuaguaaaaucgaacaauugagauuuucauuuacaaaaccccaacagaucuggcuuuauaaaagcaagagcacaacagaaaaacuuuguccucauuuguugucuaauucauaagauuucugucauucgauuguucuggugaacccaguaaucacagcguagagaguugucauaguuagggacacugggagugcuugguaauagagauuaggcucaagagagacagguagacuuuuacccucagaacccauggugaaaaacccauccauaucauuaguuaauguaaacacacacacacacacacacacacacacacaccacuuuaagcaaaauuuuaagaaacaauauuuuccacauuccaaaaacuaauguuuuucaucuuauuuccuuuuggugaaaauaaugccuaugaacuguuaaguuuaucuuacaauuugccagugggccacagugugaauuuuauaaaaauguaaaagagaucacugguguaggggaagggacacgauuccaugguuaaagcauuugccugaguauggauggaucucugaaauccacacaaagugcccagagggcguggcggcucacuugugaucccagucccagugacggaggacccuggaacaagcuggcuagcagaaccagcuauauuugugaguucugguuuugauggaugacccugugucuaugaauaacacggaagagugacccgggaugauuucugacaucaaccuugcaucucugcauguacaacacacaccuuugugccauauaugcagaccucacacaaaaaugcagagaggacggugggaacacuguuuuugauucuucauuaacuuuuuaauuuaguauuuucucacgguuuuuccuuuucuuaccauuuuuucugaucccggggucucaggcauuuacucaguauucagguacucacuggcugucaugggacccaaggaaagcauggacuuuccuucuuaaauacuccaaaugucacaggaaaagugagcauuuagacgguaaaacccagugcagaaaaucacuuugcuuucuacaaaaggcuuuuccuauucucaucuaucacaaugguaguacaucucuaaugcaggacagguucuagcuuacucugaaagauaggaaacuaucugcgucuugagaaagugauuuaauuagauacaaaauacaauaauggcuagaaauaauggcaggaagucauaauauuguaguaguaguaguaguaguaguaguaguaguaguaguaguaguaguaguagguaacgacaguaguauuuauuaagccuuuccugugagaugauaauugauuucagagcuggagagauggcucagggggaaaggaagcuuggugauugucuagagcaugcgcacugggaggcuugcaacccauagcuccagcuccaaggacuuugaugcuccuuccuggccucugcacucaaugccagccacacauagaucuacauuuaaaaaaaaaucuuuuaaaaaagcauuuaauucucacgucaacuguguuguaauggaaauaugcuccuuuuccaugggaaaaauaagacagguuaggugauguggccagagccugagggccuggaacucaugacugagugguuugguuccagacccucggucuccauccucauuccccaagguagaaggguggcacagucuggcacagucaggggcaaugcaguacagucuggaauaauccggcccagucuggcccagcccaaacucaccuuuacucuauggcaucacugcaaaaugugcguggcagaugcuaugaggagagaauguuugguugcggguauggacgacgacgagagauccagcuccugaauaucucuauguggacacucaccauggaguugguaaaaaugacugaagacucaccuuacaggggacagccaauccuuugagucuauccucauauguaauauuuuauucuugagauaaauagauuauggagcaagcuguuacuuuucauugaauauuuauuuauuuauuuaucaaucaagauaugaucuuacuguguaucccugcuuggccugaaauucacuguauagaccaggcuggccuugaacucacagagauccaccugccucauguucuggggcuaagggugugugccaccauacuuggcaauuguauuuucuuuuuauuuguguguguaucuguggaaggcagaagagggcaucugauccuguagaguuuuagacaauugucuucuguccaacauaacugcuaggaaucaaacuccagugcucugaaaaaguagcaaguguucuugaacauuaagccaucucugcauccucuaugaaucagucuugaucuugggaaacagcaagauuaggcuuugcuuuuacaauauuuccuccuuuuccaaauccuagguucucaacauuaauguguguguguguguguguguguguguguguugcuaguagcugaucuugauuucuguuguguuuucuuaggugugguccacccaucuuuuugguuuuguuuauauagauucucucauugguugagaaucuuaguuucuccuuucuccacuuccccagugcugggauuauaaacuuaaaccauuaugccugauuuucuaacuccccccacccaacucccacuuugaugcuaaggcucaaacucagguucuccugcucaggagggagccuuuaccagcgaacccucucuccacucagcccuccaccgaguucuuacuagcaacacagguaacuuucuaucuucuauuucuggaguaaagaauacuuaguguuccuuucaguugcaugcaugggaggaaccaggcuugcaaaagcacagaaucgagcugugcuugaagacagaccagcguggugacaacaggaaacauuuaugugcuuaguauagauagcuauguuaagugcuguuuaauuauuucuuuagcuacaacauacuagucauaugcuaaacacuuggcagugaagagcagaaauaucuucauggggaagugagcuuuuaaggaaccuguuagaguuaaguugguagauguuccaaguuaguccccagacucucuaguuuuuaggcuguuauaaauaaaucuagacaguguagaauccuguguucauuacauaucaguuuuguagaaauauuaauaguuauucugauugauuuuuauguuaaguauaaagcuaaaaaaauaaaauaauauggcccagggguguggcucagugguacaccccuugauuaccaucuuugagauucuugguuucaucccagaaaagcaauaaguggggggagacgcugucuagcccauucauacuuugcaaacuugggagauagauauccaaaaauacaaaggcauaugugucaguuuccuuuccacaguaugucugcaauucugauguguagcaaaaauaacccaaagugcuccuuuugaaaauaacuguuuucacuuucagaccguacaacaagcaucugcuaaggcacguaauggacgcuagacguuuguguucccugguggucaguaaugaauugagaaaguacagaaagagauuauuaaaugccacugggaacuauuuuguuacuagaguuuaaaaguuaucgcuucggugaaguaaccaaaauagcucaagacuugcauguuugaaaguauggggccuguguuuaaaaaucauauuucagcuuuuccugcuaccauucaaaguuauuauaagcaagcauuagcucuggauucugcuucuggccuuacugcaccucagcagaugggaacacacuggacaguuagugaagggaugagaggaucuagcaccccgccucuuggaccucuucugacuccuucucaacccaugagucugugcgaucuuugaagaagaaaaugguugucaagcaguuaguuuguugaguuuagacuuaugaggagcugggauuuucagggaauuuuggguuccagaugaucuggauagaaggcucuuaauugcugucauuugauuuuuguguccugaugugaucaaaauaauaacagcaagagacaacuauguaagccaacaggcaggucaggccggcacucugccugugcccugcccccacgcacagcacacaugugcacucguucuucuccuaucacaggaacaugccagagugcuucugaaagguuuguccucuuaguuuauccaagggcuagaagaggaaaaugauacuuuuaagucaacauuuuuaucuggucuuucaccugagcugaggagggagccuucugaaauacuaucaggugaaaacaagcuuuggguguuugcaucuugagacugaacacaguucauaucuagauuguggaggccugacacucacacaaugcugggggacucuuugagaauacaaaaaagucacaagcggacagcuagucacaugggcuugcagagccuucuucaagaagagggcccugcugcuaauuaacuuugugacagauccccucugauaauggcuguuuuucuugccuacaacuaugaaagaaaaaugaggggcgaggcuagaggauggaaagaaaaucugguauauuucucuucccagacauccuucaagccagcuugaggaguugaguugaggaguccuuucuccuuguuccuagguaaacgauaagaaaccuggaagugcacaggacauaguugcugaauagaucuggcccuggcucccuuacccccuuuagccagcuuucauauccacagcucaucccgugccaggagcgugcagaaaugccgcuccgccugcucuggguacacagauggccugccaucaacagauuccuuuuccccuccuacuggaguuacaacccaguccaccaggucgaucaacccaggcgucuuucacuuccaacaaagaccagcugaguuacaugaaaugggcgugccuggcucucucuccaagggugcuggucuccaagacaccuucuccccuuuuuuuccugaagcacggccgcgcugacacaccccucccuccgcguugucgugguccccuccccaucccgccccgccccguuuuccgcuuucagccucccucccuacgacucuccccuccuuuacucucuucuguuuauucccucccccuccagccacuccgggagcugcccggcuuuugcccggcuacaccuacacuuccucgggcgcuguccagccuacggguggccggggccgguugggugcgcugugcccggggcgguggcugcagagcccuuccugguggccgcucccuucuuucccuccucuucgcgucaugucgggcacuugauuauuauuguuauuuuuuuucaucccucucuuagucugucccgucuuccccucccccuuccuuucccagguugauuuuuuuuucuucccccucuucuccgggcuugcccaugagccuccucgggagcuaccggaaaaagaccagcagcgaugguuaugaaucuuugcagcugguggacagucacggggacucgagcgcacggggcgcggcggcuggcacgcagagggcgaccgcgggcgcggugcguagucccgcccggcagccuccgcaccgcgccagcaccacggacagcucagguagcggccgcuguggcucaguccuucggcccggugcacauccccgguccaggcuaggagaggcuggguuguaggccauggcaucuaauaccacaugguguaacgucucuaauuucuuugguccagggagcuaagaaacguuagauccgucuggaggcucggugacauuagcaagcaccucuuaaucucccuaggcugcugaaugcaccagcugggggcggggagaugaggaaagggaggggaggagaagggagggaggggagccaggggagggugguaccuggaagcaaaguggcugguuucuccgcccaacugucugagccgaggugaaggagaaaugcuuggugcuuuugcuguuugcagaccgcuuuuauaccaguuguuccccugauggcugcuguuauuuacaauuauguaaagcuccucuaggguuaauguuuccuuucucccacggaaggcuuuacugggaucaagagcccuguuuaacaacacagcccuuacacuuuacacaaugcaauuuguuuccucuguuguuggcuuugaucuuauccuuuugcaugcuaaaauuucuuaaagcuccucauauagggaguugguucuaaaguuuguaucuguguuugcaagucucagaaaaauguuuuaaugaguuacagaccucucagacuccgugacaguuagcgauuuguguaucaaaacagucauccaggaaucccugcuguccaaagacuuguguaagggcuguuuguguacuuuuccaggaugggaaccacaggggccggcucuaccuuuguggcuuuaauccuggggcagcuaaggacucuggugggagucauguugggaugaaaccaaguaggauuuuauuccuugacuuuauaaucacuuguggauuuuaauuguauaaugucuuuccuugggcuaucauuuucuauuuccgucuuccugaaagugacaugaaauacuauccccagauauuugguuguucuaguuuaaaaaggaguuuacuaguuaagcucugguuuaaaucaaagaggguacuggugugagguucucucggaucaucuuauauacaguuaacauuguuccuaguggacugcuguuuucagggucugggaagugaugcuaugcuugguuauuugagcugugccugucuagaucuaugguacaugaaugcuauuuaucuucuggcucuccuucaaagcuuuaagagauucuuguacucugacccauggucauuugaggaaacacugugcagagaaagcagcuccauaugaggaaugugaagacaggaguccacgagugguuucucaacaaucauuucaggagugggauuuguuuuuuuuuuuuuuaaguauuguuacaauauagaagaaacacauuuuuaugggaaaaaauguauuuccugggccaagugauguccaaacacaggauuaaaguagagaauagagucuuuugggccucugguggguuaucauuugguagggacagccauucgaacacagaagacuuaguuagguccuauaguucugaggacuggccuuuucucccccuaucaaaucagguuuuucaguagguggagagaacaaugaaaugccuugugaaacugugggggugggaagaagauacaguuaugguuaaaguacuguugccaggugucucuucaacuucauggaacucgugcuguuuccagagcccccucccccaucccucuucgaggcucccugccacgucuccagcaucugcugaggggagugccuuggcuuggcugcagcuggcugguacaacugacgacuggaugcauauuuucgacugagaacauaguuuaagagugauaaugucugguuuggaugagggauuagauucugagaaccauauuuguuuccuagugcaacuguaugucuugccuaaguauagucuuuugucuaagaggcucaaaguguguggcccaugcuguguaacuguauccauuuguuaggguauuuaauuaaacucauagaucauuucuaaugcaacagucaucugcccauuuauccgguugauuguguaugacauggucuacuggauaguagguugguucacggggcuuuguucugacaggaauguuuuugaauuggaacaauagguggcuguucuuguagaaaauggaaaacuuagucucaguaguaccuuacauacgugugccaauuuauacagaacucuuggacauuuaccuuauuuccaagaaugccgucacacagauaagauaguagcaccugucugugugcccugagacuuggggaguggagccucagaacuguuguuuucagcuggaaaccccggguuuaaccucugcuguuccucuguugcaaaagaggaaacagguagacauucuuaacaugcagcuuuagcugaagcgcaaagcaauauggccggaguugcacauuuucuuuacccugcgguuugugugcucccuaauuauggcaugagaugaugaugaugauggagacuugccuaaugaaaaggagcuacccagggacucuagucuucuucuucuuuuuuuuuuuuuuuuugaaaauuauugcuuuuauucaaauuuuuauuuguguaucugugugucuuuaugugcuugugugugugugcucgagcaucauauguggacauaagaagacagcuuucaggagucaauucuucccuucuaccauguagaucccaggauucaagcucaggccuucaggcuugguagcaagcaauuuuaccuccugacucaccuuacuaguuuuguuugguauggagauagggucucaaagcauagcccuggcuggccuagaauuuacuguguagaaagaucaggcugggcuuagacauggccucagcuuccgaaggcugagauuacagaugugccgucaugccaucggucuucugggcuguuuucuuccauugaacuaaaaugacuuucuguguaggcacagugccaacugauuguugaaauccaauaauguuuucuauuuugauuuuccaucuguuuucaacggaaagagagacagcuguucugaagauuguaauaauuuucuaacucaacagcuucuuaaguguuagaguccagagcagucucccagugauccagccaggucccuggcgcuggggcuguccuacuacacugcuugagaaacuucauauuucucuuguguauaaucugccuucuagggaagguugaacucauaaaacccacagaagucaaauuauuuagauugagccgauuaaguccaaaccaaguucauaccuauaggcuauaaaagacaguccucuuaaaaucuggaauauauuagugaacuugaaaaaaauaaagauaaugaaguuuuaugauuugaaucugaaauguuucucauggacucguguguuagauagucggugcuguugggggaugggggaggauuuagaagguacugcuugucuggaggaagugggccacauggguaccuuucauggcucugccuuugguggucucaccugggccagcccuuuccuucucuccacuuccugguugcuaugguggaaggggaucugcucccagcauauccucccugccaugguggaccgaaaccacugagaaugugagccuagauaaagccuuugccuuuuuagguagauuauagcaggcauguuguaacggugacgaaaaaggacuaacacagggagaaugcuaaaauacuuauuaaaauugagugggaaaauuuguuuggaaauaaaaguugacuuuaguaaauacuguguuacgaguacuuaaauguaguauuuacauuuuuaaaaaaaauuauuuauuuuaugcacaugaguacacugucucuuucuucagacacaccagaagaaggugucggaucccauuacagaugguugugagcccaccaugugguugcugggaauugaacucaggaccucuggaagagcagucagugcucuuaacugcugagccaucucuccagcccaguauuuacauuuugaccuguguuuuaguguccugaaaucuauauuuggauaacuuuauacuucauagaaguaaacacauagguaacagucuuuuguauuuauguccauguaggggacuuuauaauuuggaggcacauuucaucuguaauuuauucaauugugacuaaauaugcacuuguuaagggguagguaaugagccaaauauguucagauuuccaauagugagggcugccagacaucuugcacuuggaaggagaauccuaggagcugaacuugccuggaugugagggcaguggcugugauaucuucagccaguugaucacugugguggaugugucugaucuguucacauccucucucaccucuccaugcacauccuucuucacguggcuugucggcuaaagaggacaaccucccugacaggggcgggccagucuuuggucagagucaaggauauacaaguagcugcaugcuccugauuggagccuccaaauacgcugucaaggagaacuuccaaagaacagccucauagcccacagaacacauuuucuguccaucuacccacagaacacauuuucuguccaucuacccacagaacacauuuucugucugucuauccacagaacacauuuuuuuuuugucuaucuuuggacugcucuggucagcagaguccuuucuguguugggaggaaaaaauaaccuuccuguucuuuaguuacaagacaaauucaaucccucuuuuacauggugauuuuuggcgcuuugggaauggagauuucuccuagcguggucucuuuucuaggccaaucaaauccaccuucuucuuuuuauuuuccacucaagucauuuccauguuauuauuauuauaauauuggagaauaauucauacuuuugauuugacauaacaggauuuucccucaauuuuuuuauuauaaauggcucuggaacucaugguuuaaaaaaaaaacccuaaagaauacagaugggaacacaaugaaaaaauggaaaguaaccucucucaucuguggucucuucggcucuugccucagagucaacccuuaugccuguuucugggggacccagguaaaaaagucaaauuugguggcacacaucuguaaucacagcacgcuuagagacaggaggcaggacaaguagcuuggagcagacuguggcagaaacaaaguggaaagaaagaaccaauuccucaagguuguccugugaccccccuccccccaugcaugcuaugacaagggcaugccugaacucacgcauacaaacaauaaaaaauuaaaaugugaaauuuuaaaggaacauucaacauguaauuagcguguauauaauauauauuauauacauuugugcauaacauuaaaauuguacuaaaaugcaauucaaauuuuauucaaguuauauauguguuuuauaauaaucaguaaugcuuaaugauagaauggauaugauucaagcaucaugcuaaauacauaugguauuuuuuuaaccuucauaaaauuuauguaggggagaaaugacaauaaaugcaggcaagaguguagagagagaggaaaccuuguuaccacuugguaggaauauaaacugguguuguuaccauggagaucaguguggagguuagaagccuaacagcaaagcuaucccacgacccagcuacaccacucauggguauagaucugaaggaauguaagucaacucacuacagagauauuuacacagccauuuauugcugcacuauucuuuuuuuucccauuuuuauuagguaauuagcucauuuacauuuccaaugcuauaccaaaagucccccauacccacccaccgccacuccccuacccacccacucccccuuuuuggcccuggcguuccccuguacuggggcauauaaaguuugcguguccaaugggccucucuuuccagugauggccaacuaggccaucuuuugauacauaugcagcuagagucaagagcuccgggguacugguuaguucauaauguuguuccaccuauaggguugcagaucccuuuaucuccuuggcuacuuucucuagcuccuccauugggagcccugugaucuauccauuagcugacugugagcauccacuucuguguuugcuaggccccggcauagucucacaagagacagcuacaucuggguccuuucaauaaaaaucuugcuaguguaugcaauggugucagcguuuggaugcugauuaugggguggaucccuggauauggcagucucuacaugguccauccuuucaucucuugcugcacuauuguuguguguguauggauggauagaugcagauguguacacgugugcaugcuuauguuguggucagaggacaaccucgaugucauuccucaagagucuuccaccuuugggagcagggucucucacuggcccgggacuugacuaaguuccagggaacuauauguggggugguaagggaacuagcaagacagggagucgggucauggggcauagcaguagagggaggaacaagacaaaguguaauauguauggaaaugucccaauaaaaacauuucuuugugugcuggccaaacaacuaguggaaauggagucaaguuccaagccagugacuagcuuugucucuucuccccacuuugcuauugcauuugccaaccugcccagccuuuuuuuuuuuaaaugaguucucgggauuugaacucaagucuucaugcuuguaaaggaagcacuucaccaaccaaguuaucuccccagcccauauauuauucuugauagcuaugacagaaccagccuacauguccacaagcagaugaauggauuaaaaauugugacaccauacacacacacacacacacacacacacacacacacaccccauaauauuauuaauuuguaaagaagaagaacguucguuguucauuuuacagggugauuuuauuacacuuuaauggauggaacugaagaucaucuuguuaagcaaaaagagagucagaaccaacguaaacauugcauguuuuccuucuauaaaugcaggaugugaaaggaaaagguggccugugaugggagggaugcuuaaaggaauggguggugggaaauaagagaggacaauggccagggcaucuuugacacgggaugagguaacuaguaagacugggagaggggucauggggccagggcaguagagugaagaaugagaaguaaguauaauauauauguauggaaaugucacggugaaagcauuucuuuguaugguaaccaaauagcuaaugggaaaaaaaugcagucuaaaauaaaaagaagcugcuuaagguagagaacaaugguucucuccuuugugcauuugaaguaacuggggugcagagggguuaagcuaguucucucugguuauguaggcuucccuuguucuucagggagcagaacacuagaaaaaugcccuucaaacugcaaaggaaggcuuguggugaguuuucuuugucugccucuuucucugaggcaaggugggguaagugauugaaggaacugcaaugaaugugguuguuuuucacccugaaacuccuccaccaugacagauaugucguccuuauuuacauauaacauaaaggaucuuuaaacugcaggaauggcggagaccgagcugaagccgugugggauagggccgauuaagccucgagaggacacuuugagacuaacauaauuggugcagguuucuaagauuuauggaauaauaucuugccaaggacaauggaucccuagugcucucaggaugaaagccacgauguucugaacuggacucgggcagcccaguguggggucucugagcccugcccggcagcacuugcuguugauccagacuggagcaugcuacccccuucuucuaagcuuuugcgaacacuugccccuuagcuuugagcauccuauuccugagccaucuggauacuccguucuaucacuguuucuaccuuucagaugcuucucgguucuguggcagccugugguggacagggucccagcgccccaucggccuggccuuuccugaacggccggccgugaugcacugccuggucugccucuuguugggcuauaggcaaaguucagagggaggccuagucucugccaccuuuguauucucuucacugcuugccugacgaauacuuguugaaugaaaggaagcauggacagauucugaauuuuuaaaaagggcauuuauaauggaaagugcccagccgaaccuaaaaauaaguauacggcuagguuugaucagaaaugaggccaggcuuaaaugaaacuguggcagaaagcucgaucaguucaauaaugaacguuuguuaugugcaagaguuccagagaaggaagaugguuaagccacauccagacucucaaggccucccuaguguaacaauggaguaaaccguuuaucugaagacugaguucugaccaaaaaacugcagccuaucguuugccuuacaauaaagguggccuuuuguaaacagaaaaauaauaauuuaaaauacccuuucccccucucucccuccuccuucccucccucuuucccuacuucccucccucccucccucccauccauauccccccuuugcuguuucuucuuucacuuucugucuuagucagagauggcuuuuuuauccacaagccugaguauuucuuagccauuagcacggacuuuaaaucuucaccauuuucacguuuccuauuagaaguuuugcacaucacucuugcuauccacagucaggcauggcacacuguuuuacagucugcauugcucuccagagcuaccuucuuuuuuccuuuuugagaaaagcugggacuuugaaguaaauaaaagaauccuggagauaaaauuuauguguuucuuucccgcaagauuuguaagcuagggaaaaccuaaaucgcaguuacuuugcaugaaaccauucuuccugagacuuaaccuggaaauuuugauggaguagcccagugucuauggaguauguccuucaagguccaaggaaugagagaauuucauagcuugugccaagggaucuggaaaacucuucugccucuaauugcuuuauaucucaggcccgaaucuagaucuaaaauaucuuauuucaaugauucauccagauauaauauuaaagggcauuagagaucgaggcuaaaugaaaaaugcaacuguguguaguaguaacaguucgauggccaccaccaaggacauaaccagccuacuuauugcaugaguggaguuaagucugcauaugcagaaaaugacuguuaaugcucugcaggguggagcugcgccugagagcuggcaggaguguuggugugcauggguagccaccucccagagaacucugcugggacagaacccacauuagaaucgggaggugagugugcaggguaauaggggacuugccugagaaugcugaagcugagcagaaacaggcacacaucaauggauggagaagggaaggaacgaauaccaccagaccaggagcucucuuguuucccacugccaggccagcuggaguugcugccuccccugagcccacacgcuccccagcaaccugcuuucuucucugcuccgacucuagcucugccccuacuuacccagccagcuggcacugcccuggugugggucuccagucccuuagguuaucaucuaaacuaccucuugagaguucuuaaagguuacacuggcuuccagcccaccucugcucacccuacuuacuaaacagagauucccugggcccaggguugauagguggggaugccaguacugaguuuuguggcaccggcugcaggugcaggguggcuggcugcccuugguuuacuaucucuaggugagcauggggcucugcucgcuuccuugcuuggugauggcgucacagcaagaagacucagacaccagaggaggauguaugaugauuauugggaauacggauucuugguuucuaugggaacaaacccugauccuagagguuguuaaggacugauuauaccaaucauuuuuuggcucuauggacuuuguggcaaaaucuuaguggggcagcuguucuuauuucucuuucuucuaguucuucuuucuuucucuccaugcucuaugguccuucccuccuuuuuuuuucuuccucuuccuccauccuucuccaucuucggcauucucauuucuuucuucuucuguuucuacuuucgucugcuuccuucuuucuuccacuccccuuuuccuaccuugucuccauccuuccucccagugagagagucaguaugucugggagacuuggugcacaggaugggcugcagucuugguuuuaugugcgugugugugugugugugugugugugacuuagaccccccuacugucccccuacccaucacuuguggccuaauaugagugaacaggaacauuacuuucagauuuggguaagugcaucugaccucccuacaguuucacucgcugcuucaauuagcaaaguguuccacccgacaaugacgaccucaugaagaacaauuucuuaagugucccagagguuguguguucaaucagaggaaagggggggggggcgugcuuucucaguccaagcaaggcacgugagauuacacauccccauuuugcccuuccuuucccuuaccucaucuuugcaagaaaacaaaccauugucuucccuucccccauccauggcugaugccugaauuuuuaguucucuuaaaauacagauuuaugagugcugugcaugcgcaugcgugcgugugugguguguguguauuugcauuguauacauguauacacaagguggcacacaccagcauauuaugagucagcaacucuaaguucuggcuuugccauuuauaagcuacccccuugaagcagucauucaacugagggauguccauuuuauagccgguaccuccucauucucucauuccuggacaucucgugccuucuuuuuugcuacagagaagcuggagaugcugaggaggucgagguagagaagaccuuggcuuuuaugaacuucccuggggcuggauaaauggcucuaugguuuguugaggaagaacucuguuuugggaagagggaaggccuggcucacuguggugggucaggaaugcugacuccgaggagacaaauaagcuucacacuaacauggaagaagcugacaaaggcaggcagaagaaacaauagcaagcagagggcauucaguggcugcacugugcuucacggguguagucugagagcagcauugugaggccgacucaugacuguguuauagugugcuugcccaagcugagauagucacgaugcuaacuggucgguuaaaaacuguguaguuuuacagauaagcugguaacuaacacaaacucacauuagaagucaggcucucacuauguagcccaggcuagcuuuaugauccuccugccucggacuacugagugcuggggucagaggcauguuccuuuagaguuaaacuugcuuugguuagcuuguaaagaaaugguauuauagcauguucagacaucaauggcauuauccuuugcccucacuguguccuccauugcucucccccaugcacagagauaaacuuuaaggcugacuuguuuuaggguguuuggguucuauucuuacaaagaguaucaucaugcuuuagucagaccggacccgucuuuccuuguuauuccucagaugggcucuuuuggaaugagagugcuuacuauuucaaaguggaguggaagauagagaggugucccacagaauuaccuuacccacuguguguguagcugcucuccuuagcugcaucuccaucaucaucaucgucaucgucaucaucaugugccuugucguguguagaucuuacaguggggagauggagagaguggugugaccaugauguaagaggaagaagccuagacccucagacauaaugagcugugacagaggucugccaaagcgagucaagauccugggugcccuguggcuaugagacaucagcuggagggacagaaaauucgguuucaauggccaggaaaacugaaagguugucuuaaaaguauagcugaaauuuccacaguaucaccugguuuuaaaauggagccauugaagcccccaagugggauaggagucuggcuuugucucugaacgugccaggauagugcugucuccauuacgccugucacuggcacagaggccggggaauucacugucuuguuuugcgagcaguuguaacagacgcgugcucuauuucacgucuggcuuuguuuucauaccuuaccccauugcacagaaacugggccucuuccccuuucccuggcccccacaagccugguuuauuuuauaauaugacauaugcauguucaugaaaaggacauuuaaaacaauccagaaaauuauauaaaagugaaaauaaaaaaaacuuucugccaguccuagucccaauauuacagguuucugcauucucuuagaaugucuaugcauauacagaaguaugcaagccagcccacaaacacauggugauucccucauggcuauguacauauauaaauaaguucauucacucaugugugccauguagaauccauauuugugcugcgguaaaagcucaaauuuuacuuaacaugauguccuagggaacauuccccauuaggcccuaaggauguaccccacuuucucuagugacugcucugaucucuauggguagauagcuuuuggggauaggaauacuuaaaaaacguuuuuaacguucacacaguuauuauacauauuuauggaguauagaauggcauuugaauacacauauacaaacuacaauggcaucuguaggacaggcaugucauuuuccucugucuacuguaccuguggggaaaacagacuugcaaaccagaagaacguaggcaggcauacguacagcuugcuguuuugcugagagccccaguaccaacucuaaugaggaugcccgucuucccauauugagucagaguugaggguugccaaacuucuuagucuuugcuaguguguggugagugauagugguuagcuccaaacugacauuagauguugguauuucuaggaauuguuuuuguuguucaugauugcuaguuauuucguaagucacacaugagcgaacagauauucauacauauguggcaugggagaaucuggaugcauuuguguugauucucacaaucuguauauuuuuagaagaaaacuuagaaaauucggaggagcacagcuggacucucugugguaacuaugguugacauuugucuuggccugaugucuaucaacccuuggagugugaguagaaagguuucucuugccuucauggaucuucuuggaucauagcuuccaguuuucuugaggagugccucaguguggcccugaagggaucauggaguuguaaugggcaguuguucuagagucuagcuuuuggcauuguugacuagugucagucuuggaggacuaguuuucaccccuuagccucugcuucucacccuguaaaggagauaacacgucucuuuaaauugucaggaaguucaggugaaaagagucccagugaguucccugcccugugcaggacacuggcgaaugugacugaucaaaggcuggaagugaacuccagcaggguggagaguauuugcuccuccgagggcucucaaagcuguuuagucccaagggucugagucuuuucuuuguuauaggcauccuggcauuuauaacgucugggguacuuuauaaacaccucggguugcuguaacuugcagaauacuuccuacuggccucccaaggaaucaaccaauaguagugcuugcuaugucauagaaaguucagcauagccuaauucaggagaaaaauugaagguagaaggcagaacuuucuggaaguaugacuguguauuguugccccauccacucuuauugcuagguccauacuuguaaccuggcauaugaguaaccugugaauacacauuuaaaccaacuugggcuacauauugagacuaugugcuuuucaagaaggggccucccuggcaaauuuggaaauaucugaauacacuuuuguuauuacaaucguggggggacuguuccuggcaccugcuagguuagagacugggauucgcuaaacuuucucuggugacugauggcagcuccucacagaacacaaucuguucaaaugucagcuccaucuggaaagcccaaaagaggacaggagugauuacaaacugaagguaaggaaccuggugaugggcaaguguuugggauguaucaaguugaugaugccacacauugaaaacuuacccaaaaggaacuucuuuggggcuucaagauggacucgggcuaugcagagagcugauguagaagagauguaaguccauuugucuugggcuaucacuugaaggcagcugagauuuuacagcuuugagcauauggcucuguguucucuggcaucaggucaguuuuguuuguucagagcugaagacagagccugaccccuaacucaugccaggcaagggcucaccacugaaccugacccccaggucuuguuccuuuuauaaugaaaauaacgaauauauauaaucucaacuaucuuaucuauagugcauugcucuugcugcuaugagguuuuguggauuuuuuaggguuuuaaaauuugauugguaggcaauagauucauuuacuuaauaaagccuuaccaagucuuugccuguagaaaguccaugaaaacaggaugagucugguuaaaguaaaggcaugaggcuagacacugcuuuuagaggacuagcuuacuccucauuagucuuuaaacgaaaacuccaggauuguguuggagccagucugaccgccauauuucuaauccacucccuuugaagccaggaccuuggccugagagagggaaauagcgacuaucuaucaaguguggcaggguacaguauggacuguguauugaguccccgucuucaucuaugguuuucgucaucauuucuacaagagcuaagucauguacagugguggauuugcuuugaguggauuagaguaaggaaauggaguccuacagggaaaggcgaguccgagaauagccaaugagcagugguaaagcacagauaccaugcuacaaaguuggaaagaacauuuuauuuuaaaaggaaggagucgaauggaaagacagaauagucaaaagaaucacucuaucguucucaugucuuaguaaucaucuuuggaugcaaguaacaaguuacugaauugucuuauuuuuuuuguuuuauuagauuauuuuauuuauuuuccuuccaaauguugcuccccuucaugguucccccacucccagaguucuucaccccaucacuccuccccuuugccucugagaggaugagggugcuccuucaugcccccuccccagcaucccucuugccugggguaugaagucucuacaggauugugugcacccucucucacugaggccaggaaaggcaguccucugcuacaugugugcuugggccacagaccagcccguguacccucuuugguuggugucuuaguuucugggaguucuguggggggucuggguuaguugauacugcuguacuuccuaugcgguugcccucccuucagcuccuucaaucuuuccccuaacucuuccauagggguccccgaccucagucuaaugaauugcuguuaguauguacaucugucucaaucagcugcugguagagccucucagaggacagccaugcuaggcuccugucugcaagcacaacauggcauuaguaauagugucaggguuugguaccugcccaugggcuggaucucaaguugggcaggucacuggguggccuuuccuucagucucuguuccguuuuugucccugcauuucuuuuaggcaggaacaauucugggccaaacauuuugaagauaggucaguggucccuucccuucacugagggccuugucuaucuauugaagguggucucuucuauugucuuauuucuaaaccaaagaaagggaguuaugauaaaggcccacaggacagugagagcaugaccucaaauggauccaagggcagaacuaagagccugcuggcagugccucucucuccucacguuugcuucauucuauguucuuucucucuauaggcaagcuucuuuuuucuucucuguguguauaacuacuccaaagaucccuaguuuguguguugcaaccaguccucccugaucaucuguccgucccaggaggaagagaucugaugggcuuuaggcauuuguauauuuaucacccaguaccuguaguccuagaaacaggucccuauguuuauagaugaaaacaggauuauauguaaaauugcuucuuccuuuuagaaagugggacuaggaacacuaucuaucuaguuccuaagucuuaagcaauuuuucuauugcuuccuucauuucugucuucccuguuugaugccacgaggucaacucuagccccaaguaaagucagcacucaggcuugaaucugcuuaugucucucccuacaaugagaauaggcaggcaauuucugcgaccacagaauuacuugugugugugugugugugugugugugugugugugugugugugugugagugugugugcgugugugcuuguuuuaagggaagcguugaguuggaugcucucuaagcuguguucugacucuuguaucaagggaggguuuguuaucauccaguuaugucagggcuggcuauauguaauuuauugcagaauuacuuauaauaggaaaaucuuccagaauggucuaacauuucuccaacaggagagugauuaagaaaauaagauauaccuauaaaguuuuaucaaaagauauuacaauaauuacuaaaggaaauuguagcuaauaagaucuccaaagugaauaaagaagaaauaaauaauacacauuaaauucaaccccacacacauacaccuagaaagacaucauuguaaagguacaucucuuauuaaaaaaaugaagaaagcagaucaaaauaucacaaaagaauauuuuggugguagacuaccaguaaguccaacuuuuuguauguguuuuacuuaaauuucaacaaugaauuuaucuuauagugcuuuguuuucuauaguugguuguguaaccaauguuuuauugagauaguuauauguucccuugcaguucugcggaacaauacagagagaugccugccaacauugccuguuccucccagcugucauauuuuaugaaucugacauauuuuauguguuuguaacacacauucaggacauugacaccaaucuguuugacaucagagucccccgguuuuccuugauuugagugcauguuuuuaugucuuauaucucauuugagaguuccaaauucugccaccacaaucaauauugaacacuuucaaaaccacaagaaaccucaacuugcuccuuuauaaccacauccauaccucccaugauucuuuaauguauuauuuauaguuaauacuaauggaccgggaacuaacuucauuuuagcuuuucaucugaagccaaaauucuagaaccuuagaguaggaaaaaguugugaaaucucaguggucacuuaaaacgggaacauuuucauguacgaagaagguuuaccaccaccauugcccaaaaccaccaccagacccaggcuuuucccgacuccuccccagacgcuccaaccugguccucucacucuaagucaggugucucgcuuauacuucauaucgucuuuauucaaguacauucuucauuuaguaauggcucacagauaaaacacuggccuggggauggcucaguggguaaagugcuaguggaccugaguguagaguuccugaacucacaagacacugucucaaacaggguggaaagugacgacccacaacagaggcgguccucugugccuuaugugccuguggcuugugguccuuguacucauacccauaccucccacguaugccugaggcugcuggcucucccucuucuucccuaggugggugguuuuagaucugucaucugucugucugucugccagccugccugccugucucucucuuucucuuacucugugucucaccguagagcuugaaccuggggccucaagcaugcuaggcaaacacucuaucacugaacuacauuucuggcagcuccugccugcucuucugcgauagcauguucgcagugaggucugacuuaucccggcuacagcugcgcuuacuuugccuagaucccagcucucucccggcuccuuccucuaucagggcacccgaaucuccuuugaguucaccacauuucguuucuuccuuugugaagguaguaagacaaugaugagugcuuugaguggcucugagucagcgcugugcugugugcuugacaucuuuuugcuucacauuguacuuuguuauccccaguuuuaaaaugagaaaacaaagcaaaauaaagcaaaacacugaguugagcacagggugguguaacuaggcaacugcagguccaagcucagcagcgcugaucccuagccacuguccuucgugcacaaagcagccgaguucucuggaaaugccacggauuuuaaaucuucaacacuggcucuaugggccuaaagccacgugcagcucuggcccccagccugauuugaagaaggucauuccuugucuuugauguggagugggaacugucccuucacacacucccugugguauccaugcagguuguugcucuagacuuugccaaaacaaauaucucugaaucuauagauccuuccuguuguagccggagaggauuguuuuaccuauuuauuucggaugaggaaauuugagugcagagaggaaccccguucaacuuaccacccuugggugacuugcaaccuuaucgugucuuccuggcuuaccucugccaucucuccagaccucuccugugacgugggcuuucuugaccuuucgucacucuugucauucuguagacacuuuccagccuuugggucugaccucaauugucuaaauuugggucgguugacuggaguccuagagaaauucuacacgaaaugcgagauccuacugugugccaaggcagugucacaaccauuagcuacgcuucgcccuucuccgcauugucuaauguaggcuugaccgcaaguagcaaaaaccauccugauuauaucuugaacgaaaguaaguuuauuucuuucuuauguaaaugucugaucugaauggugcccuagccuaugaagcuggaagggucccaaggaugagucucauuaacccagaggcugucacuuucagcauuuuuaccuagguggggcagccaauguguuuguuauuuagacagugugaaaucaaaaggggaugauacaauuccucucaccuagaaacagcuugcaaauugaaagcuuacauuccauugguaaaaauguaauuugccacagcaagucaaagggaacccugggaaauguagucuuuuauugcaggaagccaccugacaaaaauggauuuggguuagaagucucggcuauauccuuuuuaugccaguucugggaacacaggcccugguugauugauagaagaaucaguucucaggcuuauggaguucuagaaaaagugcaaaggggccuuguagaaaaugucaggauuccacaaaggauuagaauucagaauaauuugugaggagguuggaauguuaagaacaccuaucauuuauuugggacuuacuauuuacuugcuggguauuuguuuaauacuuaagaugcauuauuuauuuuuuuuagggaaauccuagagaguagcugccauuuuaacccucaacuuacagaucgaauuuccaugagaaaucaaguaaauuuccaaggucacuaaucagggauaugaagaaauaccugugugcuuauuaagggagccugaggucacugcccacuuacucugaugccagacaacucggaauuauugcucauuaacacuucagaaagcccuuguguucccacaaugauuagacccuuccaauuauaacuugaccaggagauguuguuuaaauaguuuauaagcccaaguugaaaggucaugucuucuauuugcccuguuugcugagugugggcucagaugaagugaaacaagaccaaauugacaaaaggauguauuauccuucuguuccacuuguguacacgguuccuugggauauuuuucuguaacaauguuuugaauuauauuuuauuuauguguagggucugguguguguguguguguguguguguguguguguguguguguguauacauacguguguugauggcauguauauggagguauggacaacuuguagaagcugguucucuucuuccaucaugugauuucuggaggaguagaacucagguuaucaggccuggugacaagcacuuuuacccacuaaaccauccugccagccugagagcuuccuuugugugugugugugagaaaaccaaggcuaaggcaucucauaguuaaaugaaguagaguugggauuuggccacauguuggugugauacaaauuggaaaucauaguuugcugguugccucauguccauuauguuaguggggauaguuuuaugaggauucucaguguguccugggaccagguaccaggccuauugcuggaagaucauaggcucugauuauucauaguuuuauuugaugacagcuucgauuuuuaaauuuugugucucuuuuuuuuuuaacuaacaugguagguggguuaugaaacuaaaaucaagaauggaguacucuaugaugaaaacauaccuuuauguaaacuggcuuuuccaacccaaaucaggauuagguaguccuuagaagggguacugaaaagcuagauguugcagaauaacacaagucuguguaacugcuauguaaagcguugcccuuuggguguggugacauuuacaggggaucugcuguaggucaggaaggauuugaccaugcaaagagccaggaagaggccccugaaaggaaaagcaaacacagauuccuaggagaugggaaagagaccagucacucacugagaguucgagacuuggauuuuagagcucauuuguuacagaacaggagcugaguuacuuugcccacagcacccuccacuuccaagcaucaguggcuguuuuggguuaucuuccgcaaaacugagagucaaugcuauaccacacuugucaaguucuacuuuggaacuauuuggaagaauggccgugagcugccuugaugaagugcugcucucuuucacucaccuucaccugcaggugauucacucaaugauguuccuuuggggcgucuuuuuggggccucaagggucucugacuauaagaaaacuguguggugcuuucaauauugguaauguuuuguaaaaauauuuggauucuuguuuccauuuaaaagccauucaaagaguuaguggguggaaauuaaaugaucccaucagaauucuaaaccuagaaucuauagcaaacucagaggguucuguugacagaggagcugagcuguucugaaaacaagggcggauucuuucauuuacaaugcugcagccucacagaugugcauggcuggcuguuggccaucaauaacuagcagauugggacauugucucaguuugggcacuuggauuuuuaaucuaauguuaauucagcuguucuuauuaaggauuuuuaacaaaccaacaggcucuuuaaaaacaagcaaaaagaacccaagccuaaaaucaaugguagggauuuaaaaggacauuccggacuuguuccuugcaggggcucagaagagagccuuuugauguguuucccaguacaaugaaaauaccagcuggguaggaugaagagauucucagguagaacagugaagcuugagggagcuuugucuucucgguguauuacucuuuggcagugagcacacuaaaacacccaugucuugauuuuuuaguuuauaaaacaauggauaucauuuccuaucaauuuucuagcugauucaugagcaauauaugaccauguucucuugacaaggaaaucagguucccaagggcugcccaaggucacaguauggcggaugaugcaguuaauagucccacccaaaugccacugugcaggugguugguacuacugagaaacagaacaguguuaugacaucgucagaacaaugacuuagggccuuuucagaaugucccacaaaccagagcaccuugggauuauuugauguuuccuuccagcuuuagucuccaauguucucuugugccugaguauguuaugucaaaggcagagccuagaaaauaauuaugguuuguuugcuaugaucuuugaaaaugagaagcacccuuaugaagagaaauagccaaaaccauuauacaaaaucaccaagucaccuuaccaagauaauuucucagacagcauaauugagagaaaugugauaauuuuguuauuaggguauguaacuaucacuucuuuggagaacacaauagcaaaaccaugucaaaagaaaaagaaauuuccagaacacuauuauacucccaaaauauuuaaggcagccaugaagacuguaaacauuagauauagccacauuugaaaguggaacuagaacacaggcuacaaacccucuaagcuugauggccucuugcaaggcggcagaguguguucuuuuuuugccuuuucugggcaaagcacagcauguaaggcaugcuacaugcauaaccaucauggcagaagaugccgcaagaugccccugccacuguggagaacgcuugagcaagugaaaggcucucaaccuuccuaaugcugcggccauuuaauacaguucuucaucuuguggggacccugaucguaaaauuauuuuguuacuaccucauaauuguaauuuugcuacuguuaugagucauaaugucaauaucugauaugcaagauaacugauaugcgaccccuacgaaaaggucauuugaccccacccccacccccaaaguggccucgaaccauaggcuuucuaggagaaagggagagugugggcuaagggugguuuccaugugguuuccuggggaugcaaauggcuaaagaaggauaaaccugugaauuuccuggaaagagauuggugaaauaagaugugugauggguagacuggagagauggcuuagugguuaagagcacugacuauucuucugaagguccugaguucaagucccagcaacaacauggugacucacaaccaucuguacagcuacaguguacucauauacauaaaaauaaauauuuuuuuaaaaagaagaugugugaugugcaugacugcagccuccaugugcauguggaggggcccagggaaggcuacagaggcuagauagcuggggccagauagcugguuagucagaaguuagggauggaaaagacuaagacucuagcugggaguggguagguagaacuggaauggccuagacugaccuacugguuagcaguugggucuauaaacauagagaggguuuggaaugggggacugagugguaggagguguggagagagggaaauggccuggauggggguucuagcagugguuuuuguauauagcauacaagagaaaggugaguugggguuuggauuuucugugaacauaugggaaacuaacucuuggguuucccuguauuuuccuagucuugucccauaacuuaucugcuguaggaucacuguccuuacagggcuuaauuuaaaaaaaguuauuagcauauauuaguuauauauaguggauuccaucaggacauuucaaacauguguguaaugugcuuucaucuuguucaucccauuguuccuuucuugugucccuaguuccugguguaccacuucucccuauucuucccauugucauuuuuccuuuucuuuuucuccccccuuucucuuuaucucuccaacuccuccccccuuacucaugcuccugagugaggggucaucucucaggagcuccuuacaccugaagaaaaugucucucccuaucauucacugugcuauccccucagggagugaugaguuccccuggccgccucucccuccgacaggauguugacagaccaaucuugugcagaucuugugcugauaucacagcugccaggagucaaagaaugcaguggccucaucacuccccgaaggaagccuuccgccacacucugccgcuuccaccuucugcguucuuuuugccucuucuucugccauagugucugagccauggaaggggcuauacagauucaguuuggcuuucggcaaucaguugcucucagcaccuugaucagugaugagucucugccauaacugcuguccacugcaaaagugaaccucugaccaaagcuggcaacggcacuaugggcauacacaaaaauauucauaagacagcuugacaggcucuucuugucuagacaaaacagcaaguagcagguucucccucagguccgugacuuucccagccagaggcuuuugucgaagcuuacugucccggaaguguucucucucccgucgagcaggucgcaaauccauucauacggcauucacuugcucccguaacacccuuaccacgaucaugcuaguaggccuucuuucauagcuggucagcaguguaccuuaugucaucuacaaggaagcaagaguggaaagacuuucccuucagcagucuguguugcaauuucuggugcuagucagcaggcagggagccucuaacucgguuucagcuugauuuuuuuuuuuuuucuacuaugucuuggaaccaaccagugucuuuagcaauagucuuaccagucuagugggcagucagcaguaguggcaauugcuugcauuguuguggaaacuucaguucucuccuggaccaacaggccauggggauguggguuacuacuacucaagagcaaguuuucagcucucaaacacauucuuuccuaagacccacuccgacguuggcgcuggccuguguuaugacuguuagagaucgucuuaagguuguuacuauagacaggcccagaccauuguggguggcuuugcucccugggcagggguggggauccugaacuauaaggguggagaaaugaaguuugagcaggaagcaagcaagugggcauguuuuccuucguaccucucugcuuuugacuaugaaagggauguaaccagcucucaagcuccuucugcugugacuuccacaacugugaacugaaauaaacuuggucucccccaggcugcuguuuguugggguauuuuaucccagcaacagaaacaaagcuagaacagaugggagacuucaauaaggagaaagucuuccucaucagauauuugagcaguuuauuuaagcaaaauuauaaaauuagcagggggaaagcuugauuuuuuuuuuacaucuucaaaauuaaaaaacaaaaacaaaaacagauuuccuugucuuuugcaacagugucugagagucucuuuaucuuacuauuacuauggauccauguuuuaaaacauaacaccuguuuuauucagccucaguuaggacuuuauugauacuuacaagggcuccucccuggacaguaggagcccuuucuguuggcuccuagcucuacugcagucuucccugaucucuguagcuacuccgccucucugaggaucaaccauguuuucaaagagcccuuguuucuuuuagagggagguggaauuuugaggucacagucuccacggagggacgcuugcugcuccugggcagcaguaucuaggcuuuucaggggacagcacuacaaagaacuuucuaagagaugaaauaccucauggauuucuaaugagguaguuuucuuuuaugccucauaucccaaaucuuaauuauagcuauauaacuacuuauuuuuuuuaugcagucacacacagugauagaacacaguagcgguucaacucaagaucauuuaaaauugcuucauacucuuugggaggggucaguggauuucauuuuagcacauuauuuaaucaagucaucugagacuguuuuucugcacgguuauaucauccacauguacuuacagaacucuuuguuucguguugcuuuuguuuuggggaguuacuuuaaaacuuacauuuauaaugauauagaaggguuaccauauguauuuccagauuacaauuuguaugacaauuguauuaaagaauccuggcuuauggcagucucccuacccuguucccugucuucuagaugacuccuuuuaguuagaguaugucuuuucacuguguaaacacgucggcucccaucuccucgauuccuuuuagauaauggagaugucuguauagaguuggguugugccuagcacuccagggugaaacaggcaguauuuucugagauguuggauacaagcuaugagaauggcaucaagguugauaccuagcggagugugcugauugauugagagacucuccaucuuugcaaucucuagccggcuguccuuguccucagaugcccucugcugagcuccucugauaccccaagcacaagcacuguccuuccuaaauggcauaugcgucuuguuuucuuuauguuucucggugaauagauuaugcaaagcuugagggcagcaaccaugccuucuccuucuguuuucccacugccucccacagagucucgacacuggaggggcucagggaugcacacaaaucaauaacaggcagcuccaacagugggugcuucuuuuucuuugcuuguauguguguaggugcacacuuaugugagcacacaugugugcaggcgcguaugcacauggauacagaggcugaugguccaccuuggaugucauuauucaggaaacaacuuuuuuuugccuuuuuuugagacaggguuucucuguguagcccuggcuguccuggaacucacuuuguagaccaggcuggccucgaauucagaaauccgccugccucugccucucgagugcugggauuaaaggugugcgccaccacgccuggcucaacuuguuuuuugagacagggucuuucacuagguuggugcucauucaauaggcuaggcuccuguuugcaccuccccagaacugguguuacacaacuguguagcuaacaugacucucguuauauggauucuaaggauggagcucagcgcucaggucuucaugaugcacagcaauuacuuaaccccaccccacccccagcugccuuccagcccagcacugguuucauagacaugcacuugucucugauucucagaauagcuccuggagguagauggugauaucccaucuuucaggccauguaauuucagcccagaaagguuuacccuuuauauaauaaccacaauaauaaccacuuaaccucuaaggguaaggcacauguccaaccgaagagggccagcagaaacaaacccaacugcguauuuggaggcucuuugccucauaaugucaugucaggacuuuuuccuuuaaacaaaacucugugugugugugugugugugugugugugugugugugugugugcgcgcgcgcgcgugcgcguuauucuuucauuuaaccugucgguccuuugcauguauauuauggcuuccuuccagguuuguguucuuaugggauucuuggguguaagaacuagugggucucuguuccucaugacuuuuuuuuggggggggcgggggggugucuuuuccuuuuguuuguuuugacuaauucugauguguuagauuuuuaaaaauuuuauuacuauuauuaucucuuagaaaccugauuguuuucuauucagagacagaaaggggguggaucuggauggaaagggguagggaggaagugggaggaguagagggagggaaaaccauaaucaggauauaguauucgaggaaaaaaacccuauuguaacaacaagaagaaaagaaggaggaggaggaaaaggagacggagaagaagaagagaaacaacaacaaacagcuacaaagugcugagcuggaucugggcacacacugccugacgccaaggcugaucagcccugaccgcuucccauacgcuuccauucacgugggguggagcagagcacauuugccuaucugacugcugugcacacacuuugccuuuggcacuguauucauccuauccaucuuccaggaguuacaggcaagaugucugugguuaaagguugcagucagggccacugggcagaggucggucagcaggcagucaguugagggcaaugccaagugcagagagaagacagaaggcacuuacagcuagccacccguuauacaauagucaucaccagggccucccaagcagagggaacaaaacccgugauggagucaugcauguucuuguucuacagacaaugcuggcauuaguggcaagucaaaccaauaccacaugcacuuuggugauguuucuauccauacuugccguguaguuaagucacguuuuccuuggguuauauagucugagacucacagguuugcuagguguugggggcaucuugguaagcagauaauuaaguuccuuuucccaugcaaagagucauuugcuucagggcccucuggcauuugggauuuggaucuaugaauuacccucaugggucagaguguggacucagugucuggacucaggccugagaggggugggugucuaauguggaaguguuggaaggaaggcuggggcugugauauuaugcuggcccugugcuuggcgaggccagacuucuaucagaauagugaugauggcugguaauagguuuucucugcggacgaaauaagccaauucaagccaaauugcaaaguacauaaagauauaaaggcaaguuuauugagggcaguucuugggcagauaucacacgaggaggucagggaagucgccaugcagacaggaagacagaggagagggggaggagaaagaaugaacauguauaugcugggcaagagacaugcagagagggagggagaguggugggggcggagagcgccaaaugucuggaguguauagugaagagacuuuccagagcccagucccuggucuggaagguucaggguagauagacagauaugcuagccauguccuguaauaggcagagacggagggaugcugggagaaccuggaggccagguccaauuugguaugguaaauaggcaccucagcuccuguccaggcuccaaaagccaacagcuggugaagggaaagauggacacuucccuuugcagccauuucugcuaugugauucaucuugugcacugucuucucugcauccauccaaacauagcugacaacuauggcgaggccuguucacgucccucuguuaaacuaugugauagcaaccguguccacacacgguuuagagccgggcagaacuggaucuguucugacccuguauuucuuagaugugcagccuuuaucuaauuauuuaacuugacuaaaucucaauuuccuccucauauaucagacgugagaucugccucggcaggguguuguaaggacuagaugugauuuaaugaauguggcagauggaaagugcgacuaaacgggaaguccucugucucucugguucccacuggaccuucacuuagggcuggcucuucuugcuaacgugagaugccagagcugaggcugugcaaccaugcuucccugguuaucaguagcagacagaugagauuagaaccucaucuguagagguucuaauucagaaaacauauggacacacacacccuauaccacacuauaucacacacaccacacacacauguacauuacaccccuuuacacucauacacacaccauacauauauacuauauaccauacacacaccacaccuacuuuacacaccauggcuguguacauguuuacaaaacauggcuuccuucuguugaaggacacugagucuuaccauaaacacacacacaaauacacacaccgcauacacacacuauuuagaaacaaaauuucacuauguagcacagguuggucuugcucuuacuaccuagccacaacugagccccuucugucucagccucuugaauguugagauuaugggcacccccacccucgcucaauuuagcuuuuuuuacucuggauauuuggacacaguggccuggcuucauuaaagucaggucaucuggagucagauguaauccuugauccuggcaacucuuugcucaugcuuguaggccucuuggcucagucaggcucuauagccccucacccccaccccugagcuuagucuucacagcuauaaaggagcggugugaccuuugcugccaagccuuugaaagcauaaaggaagaugcuaugcauacagcuucuuguccuaccugacacauagcaggaguccagggaagguuagccuccccggaccaccgugcuugacuguguauagucauauucacacauaggcucgguccauaggaauggaacugauaacugaagguaagggcugugucacccuccuucagugugcacacagguucuguaaaaacaugacuuccuucuguugaaggacaccgagucuuacaaagugccuggcaacccacgcuugccuuucuucacagaggacacugugcaagauggaaaggcauagcuuucaaccuugccugcugucuccuuugugcucagaccccuguugugguugucaguggcagccuuugaaaucuccgagucugugaauccuggccauguuaccugggaucuaaagguaacacagagggagaucagaucccucuaaugacgcaggaaacuuuucagucacagucaccuuccuuuaggaaggcuuugaccuuggauuugucagugucagugugcuuuucucucucaaagggauuugacagugagcagucuccaaggcuugcagaaugguucuguggggagagggcucauccacuguagcuugcucucuggguccuugcccuuagccaccuaugugcugccgccacacugacaaccuucaugcuugcaccuggugaaaguaagacugaaagccuaaauagaugcugacccuaaagacaaugugcugugugcaugcgcguguguauguuggggcaugaggagguuaggccuaggcagcucaaagaagcucauccagaaaaaccauccugccuuguacccuaucccuugugaaucugcaggagggggcaugguuagacuccccuccuucuccugccuauuaaaguccuagcuguaguuuucacuaauuugugucuuccuucccagccucugaugcucagcagcuccccccaugcugggugucuggucuuggaaguauucuuagaucacucacaccaggcugugucugccuuuccacuugcugggagaccugccgggcuugcuuauuucccuuuguguuuuagacuuuuaacaaauacaugggaagcagcaaugucaugagaggagcucaggagugagauaucauggagaagaggcuagggugugucgccugugguuuuguuuuuauguccugcuugcggggaacuaacuauuugugcucccugaccccccaaaguuguauguugaaacuguuaggauguaguguuggacauuuggagcugaauggaucaugauagcagaguugaagaauuggugucucgggcaagagauggcucaaugguuaagagcacuggcugcucuuccagagauucuagguuccagagauuccagcacccauagaauggcucagcacccauagaauggcucagcacccauagaauggcucagcacccauagaauggcucagcacccauagaauggcucagcacccauagaauggcucggcacccauagaauggcucagcacccauagaauggcucauaggcaucuguaaauccagccuuaggggaucugauuuucaauucuggccuuugagagaacagcaugcuugugguguacagacauagaugaaggugaaauaaccauauguauguauguauguauguauguauguauguauguauguauguauaugugcggauguauaauuuauguauauacauauauauguauuauuauauuauauauaaauauauugauuuuaaagaaagagacucuagaggauucauucaccaugugaggacacagggaaagguucccacugucucucaauauaguuucccccgaucuuauacuuucccgccuccagaacugagaggaauguaauucuguuguuuguagggcccugguuuauggcauuuuguuauaucagcucagauagcuuaagacaggcccucaguuugcucuucuuuaagagagaaugguaaaguuuaaccugaaaaaaaugucaugaauaauggauguaagccugugguugggacacacagagaaugugguugauagacaauggccacuguuguuagcacaguuauacuucagugugauugcagcuguuucgaaaugaauugaggggcuaggaagauggcucagcugauaaugugccuacuaugcaaacagaagguacugaguucacauucccagcuccuauauaaaaaccaggcucagugucacaugucuguaacucugaguucugcaagacguggagauggggaauccccagagcucacuggccagcccgcugagccaaucagcaagauuccagugcaaugagagauccugcuucaaaacacuagggcggggcggaugagaugggccugcagauuaugguguuuguuuccaagccugaagacuuguuugaucuucaggcccuacauggcagaaggagagaacugacucuuguaaguuguccucugaccucuucaugugcacuguaauacagacauucccaccucauauagguaaauaaauagauaaaugaaugaauguaaugaaaaguagagagugauuggaaaagaugcccaaugucaccucuggccuucaaaugcaagugcacacaguuguacauuugccacagaaaaacguacacucacaagagaaaagaaaggaagagagaaagaagggaagaaagaaaagaaggaaggaaggaaggaagggaaagaaaggaaggaaggaagaaaggaaggaagggagggagggaaagaaaggaagggagggagggagggagggaaagaaaggaaaggaggaagaaaggugggcuagagcuuugguuuccugccgagcucagcucaguucaguuuaaugcccuucuuuggacugcucauucugggaaguguaaugcuggaugcauucuauccaucaugauggauauaauccauucauucagcgcuucuuguuucuucucaaguuugucuuaaagccuucaacagagucaucuccauaccuuucacagcgguuucaaauacugccugucuccuuugaaggucaguuuguccuuacagccucuuaaggcugaaaaccaccgaguuuccuagucucaccucucaugccucgaauacaucugaagaugcccaguucugugaagaaccacaguuacgucuggguugcaaucugugcugaagacagcauguuacauaugugacccauccccuaggcuccagccuuccucccucucugggcugguuugugugucucuguccccaaaccaggcacaagcucacuggcagacuucaggaaacggaagagauacugggaucaagucaaaggucaagcagagacagaugcagccuuaagcucaagaaggugcuggguguaacugauuuuucuacuccuuugugguauuguuuuuguagucagucagguugcagcauguaccaaaaaggucacacagcucuuucuuccaucccuuaauuuugguaaugauagcugaugaugaaaaaaaagugaauauggcagauaauuuauugagcaguguguguguguguguguguguguguuucauuauuauuaauaccuaccaucucaaagcagagguucaaggagguuacacaucacaugguugagcaugaagaaaacagaaugguugaagugaugaugguggacccuucagagugugacuucagccugaucugaugguuggguaccuaggaugcugggaaguaaucaaugaccugucuuucucugcagggcucaguauugggcguaguugucaucggcacacauccguuaucuugauagaggugagaaaacaggcugcagaaaauguaauccagauggcgaugcuaugccuagaauucaauuaggggcaugauuuccaauuaauagaccuucgugucaagauugaggucacgucguuaaucuugcuuuuauuuuaggauuuccacugucaugauuuacagcuaggcucagccagccuugucgggguuauucgagcauaauuaaacagggaagacagccagaucagcuugcuggugaggagcagggagagagacuguuguuugauugguaaaggggcuggcaggacggggcacaccggaggauuccuucuucaggaccauuuucugaggcaguggccuccugcaucccaggcggugagcucucuaaguacugucugguccagccagcacugccacacucacgugcaguucaagguacccuuggcuggguuguaaaugucgcagacagugugccuuuuaugugugacgggguacugugaggugcuccacggggaagacaucuuaggcuuccucuuugcaacagucacacaaaagccaaguacacuuccccucccccgcccgaaaaaggaugaaggauguggcgguucugugauguacaccaugccuucauuucuuuccaauccuugugguguuucugguuuuccucuuugugucuauuaccccugcccaccacuucccacacaguauuagguagguaagcaagaauuacaugugaugcuuuuuaggugaugguuagguucauaucuaucuuuucauuaguuccuugucauacacauggcuggaggaugccauguuuccagucuguuugcucacaaagcaucucuuccucucccuccccuccccccuucccacccuucccccacuucgucucacucagcacagggucucccuuucaaucccuccauguucccagcaucccagugcuuggcuaacagcagguacuacccagcccagcucgccuagacccucuccaucagacuaugccuguagcaaaugccuuuucucuuuuccugguuaucagguagcugccacuggagcugaggcucuuugggaaaaguagcauggagaaugucgguuuuugaaugggaagagccuagagagaggguaggaaccacgugucugugauccagcaggcgagggugugccaccggcugcugugaguaaaguugaaaccuggcugucugucuacucagucuagcuaagcacagaagugcaccagccugcucuuugacaggauuugcucagcgacaggugcguccacacagaggagauaagguuacauuuauuggaguguuucaucaaccacagccaugcuagaaguugggccaacagauaaugguaguuuucuuugucauugagacccaugaaaugaagcacuagccagucaccuuaaacuuuuuuuaguuacaguuaucuaugugugugggugcaugucaaagagugcauguggaggucacagggcaucuugagguagagucauuucucaccuucuaccauguggguccccaggauggaacucugauuauccggcuuaguggcccgugccuuuacuugcuguauagccgguucuguuuauaguuaaguagcagauuuucuuccaagugcuugcuguggguuuuuuuccugucuguagauucaucuucugaccucucauccuuccuguuuagucagcacuuggcuguguucugcaacucaccaauccucccugagcauuuuuauguauccguaugagcaaccacagacuauuacuggguccaacauccacacuuauuuuugagggaguuagaugcugaaaaacugccuugaaauuuccuucaggugccuuggggugggauuguggcuuuugaaauaaacacuaaagcaauggcucucaaucuuccuaaugcuacgacccuuugacucaaugucucauaguguggugauccccagccauaccauuauuguguugcuacuuaacuguaauuucgcuacuguuaugaaugguaauguaaauaccuguauuuucugacagucuuaggugacccccgugaaaggguugagaacugcugcuaucccugggaaaaucucccugucagaaaaaccuacuguaugaacagcucuuuggaaaucugcugauccuuguauuuugccauuggugugucagggcaaggaccaaacuguacaagcaguuacacagaguuuguuuaaaaauucacauucuuuaucuugaccuccaagcccucuggaacguaagggauacucacucacccuguuuggugguauaaguugauguccuaaaguuuacuaauuuguucuuacaguuuucagccuuuguuuucaagacaggaucuugcuaucuagcucacauuagccuugaaccaacgauccuguccuucuacgucagagguucucaagcuguggguuguggcccccuacaacaugaggaaccacaguacagggucgcagcaucagaaagguugagaagcacuguucuaagugcucaucuaacagauuauaggcacauaucacagcuaccaccucuacuacccucaguucccuauucuguccucaaguuuauuuaacaaaauuuccaucccuauuuucuacuuucaauucuagaaucuccccucucccucuccucccccauuucuuuuucaagacuuuuuucucuuccguucucuaaagauauuuaugaacuuuaaaguauauguuagcuaauuccaacacugggagcaucuuacggucuauuucuuggagcuuuuuuuauugccgacugacuaagcucaaacagacaccacaugaauaguguuucacgugaggcuucauuggguagaguuuggguugccaguuguagccugguuucaaacuuggggcucgauguggcuuucauccacaccauauuucuucuacuacuacucuuaucucuuccccauccauugcccuagaugucuuggaacucacucuguagaccaggcuggccucaaauucagacauccuucugccucugccucccgagugcugggaucaaagggauaagcugccaugccuggauuuguuuguuugguugguuuuuuaaaaauuuaauauuguagauccucuucugaaagaauggcuaguauugguuuucaaugaacucuuccuaucuauuuuaugguccucuccaucaaacauuaguaucccauauguuuacugagcccuuacugugugccagguccucuaugccccuagggagaugugaaaaagugugaaacuggcucucuguuacuggagugcuggagguaggggaguugagucaauuuuaugcaaaucaguccucucugaguccugggguggaguugcaaaguaaugugggaaauggcauggggggacaugagagacaaagacacucacaaaaggaggcaggguugggagguagguaauaacugaagccuuuggagccaacccucugugagguucugucaguaucauuccuaaaccuaagcagaggccagcuuuuccuacagagaugcuguuuucuuucugaugcugugauaaaccugaaguaaugugucgaggaaagggucuauuucaacuuucagauuacagucuaucauugcgggaagccagggcaggagcccaaggcaggaccguggaggcaggagcugaaacggagucuguggaagacgcugcuugcuugcuucugguucacauucagugacccaggcccacaguccugugaauguucccacucacaguaggaguacuaauucgcaaucaaaacaaugccacaagaguuguccaaaggccaaugcaaugaaagcaaguccucacccgagguucccucuucccaggugugucauguugacaacugacgcuugacuacuucaggugcuuaugcccaugugcauacuaugagggucugauuuuguaguuuauggaaacuucuuaauagagugccuagauuagcuaauaggaagucuuucuauuauaauauauuauaaaaaugaugccaucaaaggguuuuggaacuggagaggacuuaggaaaucaugcaauucauucccauaguuuauauucccauaagucacauaauauuucaaaacuggugauaucaaauccauguccuagugucaaaucugaaugcgaguguucuaccaguagcuuauaauaugugccccaugccagagcucuacaaaauggcgagcagaaccucagagaugcagaaaguucugcuucugugaaucgguguugcuucugaauccucgcagugaagacuucccaugcacagcaucuagaaguucccugcuguaucacucuccagucuggcuguuccagcuaugagucagaacaaaguggcccuuugugaugccggcugcauuggucauggcuuucuccacagccucugcucacuguuauuuacugggugcucacaauauggcugggcgucagcugagagcagacguuagcucccacaguccucccacagcugcacgugggugcuucuuucccgagggucaggggacuguuauauagcagcuguaggcugcaugcccuucuaguugcaaaguaagaucugaaccuacucugacuaauaagcagccugcauuuuaauacugacagcuuuguugagucccugccuccuuguuuggcauagggagcaucaaauacuuuuugcacaauuuuacuuauuuauuuuucuaugugacaaacucaugucaugugcuuagaugccugugcucucuggcugacuugcuguuguaggcaaucccuggcaucacuuacuauaauaccugaauuucuaaggaugcaauuuaaaauuucugaucguguuaaaaaagauuuauuccuucaaaucgucaauauauguggucuccuuuuauccuauugauaauaugaggcaugcaggaacguuuuuguuucgaguugguaucauuggaagggaauaaggaacccuaggggaauaugaugauaugcuccagcuuauaugggcuuugaguaggaagacccacccucaagucuaagccaucuuuccccagaguucauauucuccccuugaaagcucccuggaguaggcugaauggggagcagugguucuggaggccaaagcaguaggcuguuuaauaaggagucuuauuauuaugccuacaugaccuauuuguuuaauuguugggaaaucaagacugaaauaucuguaccuugggauaaggaagccuuuuguggcaacggcacuggacucuuugccuuuggccaagcuuaguagcgaaggcaugguuuauuguugggacaggagcuggcagugcacgccaaggugcuuuguggucuuggauuucauccccacaccuaccaacuuugugaaugucaggugacaaguguaucauggucacacuuacacacacacacacacacacacacacacacacacacacacacacaggaaaauggcccucgugaaacgaaugugaacaugaccagauuucuauuagugacauugguuuuaucaguguuaccuaacaagcuggcuggccuugaaugguaacaguuacuagaaccagggauagaacuuucuggaaagaagacagauggaagaugcuggggaagugucuuuguggaagacuggaagacuugcugagggggacugauggccccaggucugugauuguugccaauuguucccugccauuacuucucuauccuuaagguccuggacucuuagauggaaucucagcagaaggaugcucagcccgcuugcaguuagagagccauaggugcggcuagaagguuggggugagcaggguugcuucucagaggccauugaaagacuucuguuagaacuguuaggcgcagaagggccccacaguuguuuaguaggcauguacugagcuauaguaguaaagcacuugguuauuguucuuacuuuauaugggcuuuuuaacugugaagcugugagguauggaaaaucuagaaaauucagucauuuaaagacccccucccccccaaaaaaaucacuuuauaauucgaugucuuuugaaaauguaguggguaaaaggcugggcucuggaacaguguggcuggcugcaaacccuagcacagcggccgugggagcuuggguagguuccuggugggucuguaaauccgccuuccugugugaaugggaggaagaguggagcggccucuggaguaaugugaagauuagugucacuaugaacuugacaucuaggucagugacaggucauaagaagcaucucauaagacugggcuagcauugcuauucuuuuacauuaauuauaauauaugaguggcugugguguauaugccuauaaucucagcacugcggagcuggauucuucaggaaggaguuucgggucacccucagcuguacauggaguccaaggacugcauggauuauaccacauccugucucacaacccccaaaguauauaacacuucugaauucuuucucuacacuucaguguuuaccaguauugcauauaauguuuauauuuugguuuuccuuuuaugauuaguuguagcugucuguacucuucuacaagguaauuaaaugguuaauuauauguguguauauuuauguauauacacauauaauuauaauuagcauauauauguauauauauacacacauacauacauacacacguaauuauaguuacugaauagcaguauuaggaauacucaauuaauuucuuuaccauuaaaaauauaucauuuggggcuggagaaauggaucaguaauuaagagcauuggcugcccuuccagaggaucuggguuuaguugccagcacccacagaauggcucacauuauguagccccaguuccaaaggcucuagugcccucugcuggccuccaugggccaguggguaugcacaugacacucuggugguggagugauaauggcccccauaggcucauagauuugaaugcuuggucugcaauuggugggacaguuuggaaaagauugggacguauggccaggaggugugucacagggagggugugugugugagguuucaaaaccccacaucauucccauagcucacuugcuccccccacaauccccuucauaguguugucucacuauguggauucuuagcuacuguaccaguguuuugggaaauauuaaaaacaaccugaaaguuccugugcuaucaccgggcagagcaucggggccacaugucuccagccaggugaucucugcagugucucugggcuggagcucccgaguuccuuugguggaucacugcaacgccagccucaugcaaugaccauccauccuguggucagccgccacaacacccagcaaccugguagaaacacaacucuugaugacuggcaggcuuccccagcuacugccagcaacucccugcccaugggggcuggccggccaugcacuaguggaaaaaaaaaaaaaaacaaaacccuguuuuuaucucauggagacuuugucucagaacuccacaaugucuccacccagcucacuagguucccacugauggguugcuaccaugccagcaccaugcuucaaauccaccacagccuuuguggugcacaucuggcaaacccacgugguaccuuucucucuugaacccagcugagccuugugaaggaauacacaauacaaacuuaguuccaaaacaacaguaacucaaucgcugggcgcaacaacuaaaguccuaaucuaguaagacuuauuaaaucuaaauaauaugguggcaaauccugacagauccaacauugaaaccaggagacacucauagcuacaucuuguccucacacuauccccaaccaaaggagaccuaacucucuccugcuuccucucuuccucuguucaacccgaagucccuccuacccacccagugauuggcuccuuuauucauuaggggauugguucacaagaaguccccugaguaugcaaccccuccuaggagagcagaauuagcaucaaaauacaaacaacaccaggcccauccacaccauaccaggaccacgccagccugccaccauguuucucaggcaugauggucauagacucugcuacccucuggaaccaugaaccacaaacuaagugcuuucuuuuauaaguugccuugguuaugaugucuuuucacggcaacagaaacauaacuaaagcauaucuaugcacauacaauuaaaaauauguuaaaauacaucauuuguaguuucuggucacucacaacaauacuauggucaguauguuuuauuuuuuugccucugagucuuuucaugguauaauacugcauggagaguaugccuucuuaggaguuaccaaguaagacugcacacaguucagagugugcaggugcacugcgugaacuguggguggcaggggguguggugugauaguguucccuaugggcugugaggaccuugucaacauuuuccaucuccuucuuuggugcuuugacucaguuauuacagguagauaugaugcccauugucuuaguuaggguuuuacugcugugaacagacaccaugaccaaggcaagucuuauaauaaacaacauuuaauuggggcuggcuuacagguucagagauucaguccauuaucaucaaggugggaaaaugacaguauccaggcaggcauggugcaggaggagcugagaguucuaugucuucauccaaaggcugcuaguggaagacugacuuccaggcaacuagagugaggaucuuauacccacacccacagugacacacccauuccaaccaggucacaccuauuccaacaaggccacaccuccagauggcgccacucccugguccaaggauauacaaaccaucacacccaugaagggcagucucaccugccuuuucuaccucucuuacuuggcaaggcaguagggaccaccuggacacugugccagccucugaaggguauauuuuucaaauggauagucauugccuccaguuuuccuuaaaaaacaaaacaaaacaacaacaacaaaaacagguuaacgcugaugggugaacagacagugagcaguucagggggagguauccucucccaagacucacaguguuguaagaacuggucaggcaguuugugugccggauacaauguggugaugcugcucuccuaagugcugauaauccccagggaaacuaauuucagacauucuugggaguuacacguaauugguuaguggggaggcaggguauggcucugacaugugucuuuugugggcuuagguuuuaaaaagacaaaaugucauagauaagagucugccuggaguugaaacagaggcccgggcuuuucuccuuauaugguacucauucacucucacuucuuaccuugguacccgcuuccauccuuggaugccagaggacccuggcuagcaugauucccauagguagcauguaagguggauaaucuaguacagagagguuaauaaacuuccucgaaaagccagcugguaaauauuuuaggcuacaugggcugucaggugugucacggccgcacagcuccaucauagcagcauggaagugccacuggccagacauaaacacgcgagucucacucugcucuuguuuucugugcaucccaugcaagugaucuaccauuaagcuacaacucuagcuccgaauuccaauaacguuuuacuuccagacauugaaagucagccuucagaaaacugucauaugauaugaacugaugugccuuuuaacucuucuuucccagacaauuaaaauauagggaagucacugggguuucucagacuauauaaagacagagaagugacuggaauugccagagcucagucuugcuguacugaggcuacuguuuguuuguuuguuuguuuugguuuucugcauugucacuuuccaaccaugucauauagcucugugcucaguuagguuuuuaaaaccuuuuuucacucaucuaguggagacaaaaauacccuucgcagaaucuuuacuuuugacacccaauguuccucacuaagaaaagcuggcauggcuacccaaaugagccauuauggugaaagaaaucacacagcgugccuccugccuucugugacauggcuuacgugcugugguucggauguauggguguuauaaaugaggucuggaaagucauucuggcuucuucagcauuccagggcucuaaugagcagagugagaucugagauaccaggagugagguuugggugaucaaagacauuuauaucguuuaauagggcugugucucaguguucuguaccagugugaaacuaagucagcgagaugucuagaugauaaucaacuugaugucuucccugaaaguggugaggacggggugcagacacagcacuucgggcuguaacuggugagagcauuuuaugccucucuguccucaguguauuuaagaugaaaacaggaaaucauuuuuuuaugcaugcauguucuuaaagggagauaaucugucccuuuucauaggugaggcaguuuugcauuagaugcuuccauaaaucucagacuugauccccauuuggugguuguuaauggaagacuccuccaaaauccacucuagggauccaaugaguuuauugggcuuugucccagugcuuguguaugugaggggcuacuuguauggcugugaguguucuucccccacaggccuuuccuuugcucagcagggaugaggguuucccucugguuguauagauggauucccccaccgccaagucuucucugcuuauccacuacccaaggcugaggcgcauacaccagguguuguugugcuagggaaauguuagugaucccccaaaacacacaggagccaaucggaugcaacucacagcagggucuuuauucuauuugagcuagcucuccccuacccccaaugcaccacugccacacaggacaguuuugguggugggggaguccuggaugucuauuagggcaaggcuuaguaguaagcagcaagcagggaauacguguguaagcgucuaauuggaaagcugcuguggccuuuaacauaauuggcuggugcugggagucguaucauaaacuuaacuucuucuccccucugcauugguggucauuaggaaagggauaggcuuguaaccucagggugcagguuuguugggggaauaaccuagagacacuggucuuguugaggguguaaccuggaaacgcuggucuuguuggggauuagccuagagacuggagcuaggcucagguuuuguuagggggcaacuaagaaacuaaugcuagguaccagccuguuaguuuaccugaguucaaacucaggucagguucucuuaaaagcuuuggcaucuccgugugagcagcuggguucuuaggugagggucucgugaccuuccaagagagaaugcaacaguccagaaacucagcugggaugaucccugguaaucgggagcagccuaauucuuuaagauggccauuucuuggcuuggaggagcgucacggagaaagagcaaggaaagacuauuuugaucacaguugucagaauuguggacuaguauggggcuggagacggugggauggggcugguucucacucagauguuagaacugcacacauggguaugagcggcuggcuguucuaguuaagguaugagcagcuggcuguucuaguuaggguaugaguggcuggcuguuccaguuaggguaugggcggcuggcuguucuaguuaggguaugggcggcuggcuguucuaguuaggguaugagcggcuggcuguucuaguuaagguaugagcggcuagcuguucuaguuaggguaugggcggcuggcuguucuaguuaggguaugagcggcuggcuguucuaguuaagguaugagcggcuagcuguucuaguuaggguaugggcggcuggcuguucuaguuagaguaugagcggcuggcuguucuaguuaggguaugagcggcuggcuguucuaguuaggguaugggcggcuggcuguucuaguuaggguaugagcggcuggcuauucuaguuagcugaaacugucaacgagcugccuucuucuuuucgacucuguuucuccuacuguagaaauuagaguaauaggcugggcagagugacuucuacagguaguccuagcacauggggagcugaggcaggaggaucacugugaauuucaggucagccuuggcuucagaacaagaccaugucucacuguuucucaauaagaauaauaaacaauuuccaguuguggggaacuguuccaccauaaacggccuaaguagugcuccugcugauaggaaaguccgggaaauggagaacauuugcucacauguccauuuauuuauucuccaguauucacugcucuuggcaauuuccaauacaggaacacuuugcaauagauugcuaaugaugcaccaggcaucuguagcuguugugaucaauauggaagaguggcauauuuauaggcauauacaagaguauagaagguacuugaaauuuaaaacacaaacauuacuccaaccaguaaacacaaagaaaguuaucucauuugaucagaguucaggaaaaaaaaugacaaaaauagaauccucuuccuugcauuugcaagaggcuucguuccaagccccuagaggaugccuggaucucuagggagucccagacucugugauggcuagggauucuacuaagcacccugugaaacaggugacaccucaacagagaaguacuugacccaaauaucaauagugcugacuagcgcuagccacagggguacaauuucauguagucacaagggaagagacacugaagugucugauaagucccagcagugaccgcuacacaguucuaggcacgauggaauggauauguugcuguggauagcggcccuggcauuguagaucaggacucuguagaccccuguuccugggagugaauauucaacaacuuaccuugcccucucuggguauaggcagcacugcuaaaacucagucaguauacuccgagagcagcccgcaauugcugggacaguccuagccuguugaacaugacaugcauguugugggauuaagagggauugguguugaauacuauaguaacuuucugcuuuuccuucgcaggugccucgucuccagacauggagcccagcuaugggggaggccuuuuugacauggugaaaggcggugcagggaggcuauucaguaaccugaaggacaacuugaaagacacucucaaagauacauccuccagggucauccagucuguuagcagguguguacauucuuccuggccaggcugguggaauccaggcuuccaagggaucugguugcuugccaaccccuuauugggcugacauagugucaacuuugugacuucauuuugacucugaucaauauaaaccauaauguuaaguucuuuugaggcuacaaguacagccugugggucucagcucauugguauguuagcaaaggauugccacugacuuugguuuuauaaacaauguggcucacgaugccgugucugugcuuauaaacucuauaugguguaaggcaaggugucaaauuaucugauaggauucaugucucugaguggcuagagaauuagaucagauagugcacaggcagucugaggguugaaauggaaacagaacuuuuguaucaugcaguccuucaacauuuauuuagugggggaaguuaauuucucuuccccuauaugaaaauucuuacaugaauaauguaguaguuuuuuauucuuaagaauuacaaaauuauucauuuaauuucuguuacaauuugcaguuuugaaacagaagucaauuccaauauauuuauugacauucuaaucuuguuuccaaaggcaaacuuuucuauuuccucuguuguuuaaucaggaccuugauaggaagggacauagggucuuuugcuuuuucucagccacuucuuucuuucuucauagcgguucacaauuaggaaagagaguuucagguggacagacacucugaaccgucaguguuaggaaagacauggcaggcaguucuauuccaagacugauagugcucgucaaggggccuguguggggcagcagcaugcacggguggguggugaggccagaggaugugggcugccuucccuuagugauuagaggaaagagauggagaagaucaaacuaugccggaaguggucugauucaugauguuuaagugauagagagagaaaagccuugacauaucuggauugcucuaaugagugcccucuccucccucacuuuuagcuacacaaagggagaccuagacuuuacuuacgucaccuccaggauuaucgguaagguucucauaucuguugacugcucugaggugcuguucauccugacagcagauuuguguaaccugcuuucugucugugugaccucuccuagugauguccuuuccuguggauaguguugacauaggauucaggaaucagguugaugacauccguagcuuuuuggauuccagacaucuugaccacuacacaguauacaacuugucacccaagucuuaccgaacugccaaguuccacagccggguaaggagcuuucccacugagcaaggguugcagagggugcuguugcuucaccaucggcuugguugaagguguuuggcccuugggagauauccuuggggcccuuuucauaggcgcaugaggugagggacuauggacacuggaccauucuaacgacaaaaauucuuguuauaaaauaugcugaagguuuugcuuagcugauaguaauuacaagaauuugugccugccagugaaacaccccugaagcuggcagcucaaagcauucgguggcuguuuaugaggcucaguuuagcaauggaacuauuucacaugguaaauugcuauagaaaaaccacaguuuuugaggaugccuuugaucauggcaucaugguaucauuagaagcuagugcaguuagaacaguacagauagaccuuuuuaagaauaauguauuucuggggcuagugagauggcucagagguuaaaguauuuucugcucuuccaaaggauccagguucaguuucgucaccuaaauaguggcuuauagccacccauaauuccagguucuaggugucuaauacccuuuucuggccucagaggacacuucacauauguaguuacagauauacagagagcaaaaaaaaaugcucauuaaauuaaauuaaauaguaauguauuucuggcauccuauaaaugaaggauaguaugaaaacaaucuuuacuguaggacuggugauacuauuuuaauuuguaaauuaaaauuuuaaugacacaacgucuugcuacauagcucuggcuggcuugaaauucucaggauaggccauguugguuuugaacuuguggaauugcuuuugccucucaaguucugggacuaucagcuugucuuucuauaccucaucuugguaauaugauuaugaauauuguuaauggaaaggucuacaaucaaugcuuaugaagucuuuacauggcauggagaaguuuacauguaacacuacacacacacacacacacacacacacacaauucaagaguucucucggggcagaauacaauuggcccagagaagugagguaaauugccacaaaucacacagcaaguauguggcuuccuuucuuucuccccccugccccaacaugguauuuguauugauuaucugagaauugcaugugauguacccuaucacacucacuucccagucuucccaagcccacucccacccuugugccuucuccccaaaaauaaggagaagaaguaccaagugcugucauuucucuucauggcaaagguagaaagguaagaaaauuuguaaauugauauagaagcauuuauacauaugaagauaugcuugaguagcucuuguccaaacgcuauaagugucucauuagauucaucaugaggggcuuuugccucucuagagucaucauuuacaguccuucauuauuagagucucugugccaaucaggaauguacaaaugaugcauacacauacacacauacucaucuacacacucucucuuuuauacacacacacacacacacacacacacacacacacacacaguaguuuuguauaagcuauauauucuccauaaaaagccaucugagcuguaggcuggccaaacuuuccuuuacuggucuuuuuucacuaagggggagaguucacauacucuagacuuuugcaauucauuccccuaccacagauuacauaguauccuuaaccccuccccaggacuuccagcagagcuggucaaaauagaaccggacccacuuaccugugucucucaacccuuaguuacgggaagacgguccccaaauccaaguguucccuucagcucagguuuugauuuggaauaucuucuuuccaaagagauuugcccuccucucugacuguggacugauuggcaucucauugucacauacugagacagucugucuucuugguccuuaugcucugggcagugaggacuagaaccacaccuuccugcuuccaguuuagugaagggccuggucggcuacaaaaucucauuuuuaauaaauguagguagauuuucccauaaagggucaguauuggaaauaguguaccauaggacugauguuacuaacagacuuguggaaucuagcgucacauccccuuagauuuuguguuugaauguuugggguacagauuauagugaugaagacagguuguaucaggaagauuuuacuuuucugaggguuggguuuuuuuguuuguuuguuuucugugucauggugaacuuccaugguuuuaaagccauauaaauuaacgggaaucauaugagacaaugaaauagcacuuuuguaguauuugcacauuugacaggagauaggcacauaagacaggaauuuuguagucuaaagcuaguaauggaguugaccccaaacaaguguggacaaauaaacucacacugaaagugaggcgcuagaaugcgcauucagaauugccaaagaauuuuuuuaaauuauuauucauagaaaaaauaucuacccuuggggauuaaaagugccaaugcugucaaugacauucaaaccaauaagaugaauuggcuaauccaaaucuucuuucugaaaauuauuuauuuuaaaugauuauugauauaccugugugagauuuuauguaucauguucauagguguaugaaucaugagcaccauugcaagccaaacccuggcacuggauccucagaacuguaguuacaggugguugugagccccccaguguuggagcuaggaacugaaccugggucaccuucaggagcaguauauauugagcuaacccuagcccuaaaacaaguauuccugaaaugaaugacaauuuaugucauuuguguauuuuagauuuagguuuguguauuuagaucaauuggugucuuucagagaacuuaacaagguucuugcacuaguaaacaauacugugggacuauauauauaacaaugauacaguucuaaccacuggaaguguauaguuuccuuaauuacacucaauacuguguuaucuagauccaaaucuuuuuaaaaaucaucuccaguguuaacgcuguauugauccacugugugcauguguguguguguguuucuguacaggcuuguagcuauguccuuuaguaucaagaaucauuguuccacuuacuucuuggcaauacuguuggagaaaacaaaaggcugggugaauagaggucaacucuaaccuugcucaguguccccaaguucugggcaauggcauucagcauugcccaggccugcccuucucuauccaccuaugaaggacaguacugggaaagccuugguaguaguguagaaaccagucacccaguugguccuuuuaaaaucuuccuucauauggauuauuuccaaaucucguaggguguauuuuuugccuuugaaaacagcucaguuuuuggaagguguguuaaugacuugggguucuuacagggcucaugacugcaagacaggggcuucccucauuuguuacagaguucagugaagaagucccaguagcuccuggucguuucugcuuuaguuugagguuggugaggagauggcugcagaggagagagugauaaacucucucucucucaggcucuguacauuauuaucugggcaggaauuaggaagggggaaauuauuaccuggcuugggagccagaggcucacauacuacagauacacaaccuucuauggacugaacgucucuaccuaagguaaagcucaguuaccuuacacacgccuuauggagcuauucuuaagaacuauaggcagggcaucauaguaaaguuuauuuuuuuuuuguuaggaugaaaguauacacaaauaauaaauuuuaaaauuuaccuuaggcucauaucucaaauguuccuuuuacuguacaagacauucuuccacugccuugacucaguuguuuucuuguauaagauaguuaugacaguuaaguguuaugguaccugccuuuaauuccagcacucagguggcagaggcaggcagaucucugugauuuugagaccaaccugucuacuuccagaguuaguaccaggacagcuaaagccgcagagagaaacccugucucaaaacacuacacuauaaaaaagauuacuaugacaauagcaguaucuauuucacaaaugcccuuccuuccuccuucccuuccucccucuuccucccucccuucuccuuccucccucuuacucccuuccucccaucuucuaucccuuccuuccucuauccuaccuucuucuauccccuaauuccuccuucuuuuauucuuccuucuuuuccuuccucucuuuauaguacuggcgaucaaacccagaaccucauguguguaaggcaaacauucuaccaauugaacaccaucuuuaaccugcauaagcaguuuuucccaugugcuuauugucaaagauaaauuuguuuaauaaugccuaacuugaaguaagcacccaguaaauggugauaaagauuaacagugguaauaauagacuaucccaauuggugacugaaauacuugucuuccauaaauguacuaaucaggaaauaccagacacggugggucagccugacucucuguuauacuuuuggcucuugugcuuggcacacagcuuagaggaaggucaauauuggugguguccagcuccagcccugcuguugucuuggccucuuccaguaucauggugagccugcgacugccaugguauucucugauaaucagugaguccagcagcauucagggagauagguuaacaaagugucacacagccuagggccauacacguuguauaaaguguggccuggagagucacagaaagcuggcacugaucagauuccuaauuuggugauggugggguguuuauggcuuaauguuuuuccuacuuuagacagaguacacguuuuuuuuuuucuuaaaaaugucuaauuauguguuugccuagugccauguaauuauauaucgaggaaagauauaauuauggaguacuuuaaauuaauauuauuuccuugauugauuuaaugauccuagagcuguuagcuuauugucgaagaacaauggagccagcuuuuagcugagacucauuucagauagugacaugcgguauguggguaguuagcauaugguuuuuuaaaugcuuuaaauuuaccuuagaagaaaauuuucuuguauuuuucacucugcuauaauguaaaaauuuuccaacaaauuugaucugucuauccuuucucaaggauaucuguguagaagcuggugagauggcucauccuuuaagagcagaggcucaggguucagcucccagcacucacgugagacaacucacaaccucuggcaauacaagcucaaggggaucuuaugcccucuguuggccucuguguguacuugugcauaauuauguaaaacauguucauaaauaaaaauggaauaaaucuuuuaguaagauauuagaaaaauccuauuacaaaaagauugcaaaguaagguuuauuucuuuagcuuuuguucauucauucauucauucauucaguaaguaccuacccaccuaagacuuagacacccgacuuugagguuacaauagggaggaguuacauuuucuuuugucauggaacucaguaaccagggagggagacagagcagcugacacuaaaccugacuuaaucucaacagcaacccucaauauucaacuugcauucaacacccaagagaauggaagcuugggaaagucacuagguugucauggaaacugcaacauuaaacacaauccugggaccuggagagauggcacagugguuaagagcacugacugcucucccagagguccugaguucaggucccaggaacuccaugguggcucacaaccaucuguaaugggaucagaugccuucuggugugaacuguacucauauacauaaaauaaauauuuaaaaaaacacccugaaucuuuaacuaauaaaaacuggaacggguaaaaauugaccagggcauggaugcaaaggagauugguucuaucuaugagugucagagaguccaggauaagugaaaacaugaaauugggcuuucaaaggguaacaaaguuuuccaagagaaacaccaccaacaggaagcagcaucuacagaucuguauuguauagcccuggcaacaacagccauucucccaauuuuucaacuguuuuauucuguaagucauuucuauuccgugagaaaacaucaguggagcagacuugagaaguaccuaguagccuggauagccugacuuguguuggguagaaggguuagccacuguggaguuuaaccugauagaccugaguugcuaccuccaggaccccuugguacuuaugcgaagcauucuuauguuuuguuuagcaugcuauacuugccguucucaaggguauagaaaaauggguaaccuggaaaguccuugucaccuagucauuguauagaaaagggggcuccaguagaacagauagggaauucugcacaguguccagccagugcugccaaaguuaauggauaaugcucaaaagaccugggcugagcaguguggcuauauagaucgcuuaccuuugagaguaaaauuucucaugaacaaaauugucaucuaaucaauacuagucuuuuuggauugucaacagauuaggacaagcaguguuauaguggaucgcuaaccugucaaauauguauguuaaaggaaggugggaaauaguuccccugaggagaaaacuaagacauguaagccacccuuggcucucucugcaggacuuuucauguugucaggagagcugagaugcaauagagagcacagaguuuauaagaaacaucuagaagaagaguacuagaaacugaauucugugauaccuaaggcaauuuaaaaaaauccaagcauuaguguaaaugaucuaguuaauuuaaaguguauuucuaaauauguuuucauaucuucagcagaaaggaauucuuuaauuaaaacaaaacaacaaccaaacuaacaaaacuacugcuauauugagccaggcuaucccaccuguaauccuguuucucaggaggcugaggcgggaagacaguggauucaaggcuaaccugggcuauguccugaaacccuggauuacaaaguuggugucgugaagcucuuccccuuuugguauuuacaucccuuuuacaucucugccugucugugucaaagggugacgcagugucacuucuagaagguugguguaacucaugauuauggagaucucaacaaaguauggcaucaaguuugucucccugcauuuagacccuguuccauacacggagagacgacaggauaccacuuccagaaguucuaugugacaugugcuuauggagaugggaggauuaauuucuuuucuccauuccuuuaggucucagagugcaguuggcccaucaggcaggcuccaagucuacacaaccuguuugcuguguguaggaauauguauaacuggcuacugcagaaccccaaaaaugucuguguuguccacugcuuggugagugaucuuuguuccuucugcuggugggauuuuggugaaauauggaccagaaggguaaugccugagcuuagcagcauuuacugggacuuuacuuagagggaaagcaguaccaggcagauaaaaaugauggaagaaaagaaaugauguauuaguguuaaaaccuaucuuauuuuuggccuuucccucccuaauccccuaaagaaaaaauaauuauuaaaggaagaauuuauuauucuuggugguguuuuauuuuguuuugagaugaauucauacuguguaguccagucagguucugaauuuguggccaucauccugccucaguuucccaagugaugggauuacagguuugagcacaguaacuggcuuuacucuugauauuugaguaaaaguaggagaggucuguguucacaggccaauuaaugcagggguucuaaaaugugcugcgugucauaaaagaggaaggaaaggaguuguggguacacagguaaaaaugcucuaagcuuuguaugaguaaaauggagauaaaugcucuuaacuauuuguguuuaaguaaaaauaagagacagugacauuuauucccauggaaguaguuucauggaccagcucgauuuccaaaugauucucgaagggauggcuaggucuuugccuuggguuugcugcagccccuuuccucagcucuuccucucaggccucuuaccugucccuuaaaacucaacuuucagcaaaacccuuccaacucuugaguaauuuccauaguacggacauuuccacugugcaucuaaacaucgccugcggcacugaaugcaugacaucacccuggccguucccugcccguuucccacuggccuguccucuugcagaaagaaacugccacugaacuguaacacaaaagguucgagcaaguggcugugugcaugaacacagggagucgagcaucagcgcuggacaucguucugucuucaaacaucaguccguuuguguugugguuuguucuucuguuuugcucugagggccuccagguugacucuccccuccguaagugccagcuggcuggaacagaggagacaguugaagaauguuuuucauaguucuauuuccacucccaaauucuuggcaagaaugcaaagcacuugguaucuguaagcauguagggucagauggauaaaauggauacaaauguauuuaauuuucuuaacuacuuguguuuaaaaaaaaauaagagaaagcgacaauuaugccccuguggguaguuucacgggccagcuguauuaaaugccacggggcagggcuuggcuuucaggggcacauuccauccccugaagaacagcuugcuuuuaggccuaggcagccuuaaguguaaugaggauuuuaacuuaauuuuucuuucugaagguuuagagagauggagccaggcaguggugaugcaagacuuuaguaccaguacuuucaaggcagaggcagguggaucacugugaauucaaugucagccuggucuauaggacagccaaggcuacacagagaaacccugucucaaaaaucaaucaaucaaucaaucaaucagucagucaaucaaucaaaaguuuagagagguucgaggcuuuccagcucuuauacugcaaucacgacucaaaaauucaaggcuuuguggauucaucuggggauuugauugccaugcucacuacaguuggucacccugaaccacccuuuguagucccuagcuuucugucaucaugugcaaguucuagaaagccaugaagaggggcuggagagaugucucaguggcuaggaguacuugcugauccuacagaggacccaaguucauuacucauaacucaugucugguggcuuacaacugcuuguaacaguaguuccuaggauccaguguccucucccaacuuagguaccagccaugcaugugguacacaaacauauauucaggcaaaacaucugugaauauaaaaauaauaagcuuuuaaaaagaugccaugaaagaaccuggagagauggcucaguggauauccugucuuggcuggacuugacugcagcaucaggcuucaggcaucuuaccugugugaucaugcugaagccccauggaaaaacaucagaggccgaugaugagugucuggaggacgugcaggccagcugucaccuuuaugaaagucuugggcugcagucugacaccuauuacagaagcugcuggcuaguuaugggcagcugugacccucugaguaccccccugacucucugaggcauggauuugauuccuuucuuuccaaggcauggagucuucccaggcagcaucaagucaacagcuguguuuggagacagagucaucaucuuucccauuagugcuauuucuuuuucuuucuuccuuccuuucuuccuuucuuucuuucuuucuuucuuucuuucuuucuuucuuucuuucuuucuuuuuuucuuuuucuuuuuuuuuuuuuuugauuuuuugagacaggguuucucuguguagcccuggcuguccuggaacucacuuuguagaccaggcuggccucgaacucauaaauccaccugccucugccucccgugugcugggauuaaaggcgugcgccacuacguaaaugaagauaguuccaaggaugugagggagguauaaguagauacaaagcgggauggggggugaaaacuguauaaagaggaagaaacagagauuaaccaaggacuguugucugucaggauguucuuagcaucacuuacaaaggccaugcaugaaugagucagauggccuugaccagucugggaaaaagacuggaagcuaugcucuagcccuucagugcccuccuguguauaucauagauguauuuaaaauaaugagcauauaucaguccuuuaauaaaaaguaaaacuuaaaaaaaaaaaagguccguaugauagauaaaaugagcaaacacacaucuaagaguuacaauuaagaauggcaacgaggcuaguucuggagagaaugacgagucaggaaaguauuccucacauccgaaacccccaccccuuucuauguucagagcagggauaguaaagucuugaggcacguaguauaagucuaacccuuuacugcagggggacagaugucaggcuggcagggacagcugaugagcugaaguuggcagguauugagguaguagaauaugcagguuuaaggugccccaaaauuagcccauuuucaggaccuaaauucugugacaaauuucugacagcauguggagaaauagcuauggcucccugccuucuucugaggaaacacaaagaagaggagccaaggaagcaaaggacccucccaccccugccacccugcaaaacuacggguccucaggaauaagucaaacaagucauuagauauaacuuaaaagucauagggaaaaaagcccacagacucagcugagcacaaggaucaaaccaaugagacauuuugcagggaggcaaguagacuaguugggaaaguuuacgggguuccugcuugagauuucuacauuucuuguggcuaagacggaguaagcugggacagguuauuuaauuuucaguuggguuauagcucaauaucugcuuggaguagugggugauucauagaucaacauauuauggguguuguuuaguuauguuuuaaaaaggaaucaucagcuuuggugaaaauauggaaggcaagcuuuaucaguucucucagaauugggauaaucccagaaugaaccuggauuuauuauuuauuuauuuuucuuaaguucuuauaaugagcuggagagauggcucagugguuaagaagacaggcucuuccagagcacuggaguuuggcuccaagugcccacaucacaacugucuauaacuagcuccaggcaccuggaccucuucuggccucuguaggccccuguaugugcacacgugcaugugaaugcaugugcacuugcacgcaaauguuuugaaacaaaaauuguuugguuguuuaacaaacagugugaaacauaggaagaacauguagccagaucugaaauaauuaaacauaacuguuuaccuuaaagauugcucugcugugauaaaacaccacggugggguuuauuucuaauuacaguuguuccauaucacagucuaucaccgagggaagucaaggcaggaacucaaacagggcaggaaccuggagucaggagugaaugcagaggccaugaagggagcgcucuuuccugccuugacuuccuggcuugcucagccugcuuucuuauaccauucagcaccagaagcuauuucucagcaaauauaugcaaguagaauuuguuuuccugagcuucuugggugauuauagagucaguuuuauaaaagucuuuccuugaugcuuugugauuuuuuuuuuuuuuuuuuuugguuuugaaaugagcaauucugaaguaaaaggaaacucgcaauuuggaguucucucuguucucucucucucugcgagcaggcuuucccugcaauggauguuucugaugaguuugugggucuuccuugacaggauggacgggccgcgucgucaauccugguuggugcuauguucauuuucuguaaucucuacuccacgccuggcccugcuguucgauuacucuacgcaaagcgaccaggaauuggacugucuccgucucacaggagguacagugauggaggcaucgggcuggcacaugcgugauuuauguaguacucggugcugcggaaggucugccuuuugggagcucucuuuuagauucuaauugguugcuguuauccugaacuaugauaacaaaguaaaauggauuagaauguuggguuuucacaugaaccuucauuugaaagucuguggcuuuaaaacugaaggggaauguuaaagaaugccuagguuuucuuuguuuguuuguuuguuuguuuauuuauuuauugggacaggguuucucugugugcaaaccuggcuguccuuuaacuaacucuguagaccaggcugacuucaaacucacagagaucuggcugccucugccucuugaguacugggauuaaagggugagacaccucuauauccuguccugcuuucuucauuuaaaaggagaggaaagaggagugagaacuaaaccaagguuaugcugugcuaagcaccagucugaaaacccacugaacauggcuugaccauucuccccagcccggcucccagugccuuccaguuucaugcuguaggucuuuauuaugaugugcugguaguuggguaugguggcacacaccuuuaaucccagcucuugggagucagaggcaaggggaucucuauaagucugagaccagccugaucuacagagcaagauccaggacagccaggguuacacaggaaaaaaaauauacacugaugauuacuauauaaaaaugcaaaaaacagagagaauagguguuuuaaagcuuaauuuuucccaugacuaagauauaagucuguaaucaauauaggcuaaaaaagaaaauguaaaauggcuuuaaaaggaagcccaauuuuagguagcugauuaauuuucuuuccuagaguuauaauuaguuucucuguucuuacuuaaaucuuuggauaaaauucaaauuuuggauaauaaauucuaaaguuuauccaacucugccuuuugcugacaugcuuaaucugcuagauuuaauaggaauagaugcucagauaucaggcuagugaaguguucccacaagccuuugacugcauacacacccugcuguuggcucagcgugucagugaaaauaagcucuuucucauuagaacaagcucucuuauucuuguuauauauauauggguguuuugacuacauguauguauguacuacucauacaugccuggggcuucugaggucagaaaaaaaggugucagacccauuuggaauagaaguuacagacugggugagcaacuaaauugguguugggaaccaaaccuggguccucugugagcagcaggugcucacacccacugagucauggcuccagccccaauauacaagcugucuuaauugucuguguuucccugugguaguuuauguuaggaaugugcagaauacauuuucuaaugcaauuuaacuugcaagaacaaccgcagaaacugucaauccuccugcugcgauggucucacagaauggcggucuucuguuucagguacuuaggcuacaugugcgaccuacuugcagauaagcccuaccgcccucacuucaagccacucacgaucaaggcaaucacugucagcccaguucccuucuucaauaagcagagaaaugggugccgcccuuacugugacguucugauuggagaaacuaaaauauauucaacgugcacagacuuugaacgaaugaaguaagucaccauguuuucucuucuugcauauuuaauuccugugugaauugcauuccuccugcuuagugcugugaugggugacaauuuuuuuauagcucgacauaguuuaaucaaagaugagcacagcuaaucuagggauuuguuuccuguguagacaggagaguguuugaggugucuaggaugaggggagugaggugggcacagaggaccugcacauuugaaaaggagacucugugauuuggguagaugauuguuuuaguacuuuuaaauugaugugaugagacacuaugaccaaggcaacuuauagaaaaaugauuuuucgggaucuuaccguuucagaggaugagucuaugagcauaugugggaagcacaggagcacucaggcaggcuugguauugguacaguagcugagacacaaugaccaagagguggaaaugaccaagagguagaaagagcuaaguaagaaugguguggguuuuugaagacuuaagcccaccccuaguaacacaccuccuucaaaaguccacaccucuuaauccuucccaaacaguucuacuaacugggaaccaaacuauugaaauauaugagggggggggagcauucucauacaaacugcuauaaagaugaugaacuuaaaaguucuuauaugaucuacaaggaugaacaggcaccaaugagagggccuuggauuuuaggacauaaggggauggcugguuacaccacacagauuuaguuggcaauagauuaauuuaggagucaguggucuagacucccagagaguaugacauuuuuguuucuguccugaccuugguuggcauuuacuguuaaagucaggaaaaggugacuauauggggcaugguuguuugaggaaaacaagaugugccuagacguccagauuggauggagagagaaggccuacauuguugugucagugcucuaccagccaagaaacagccugcagccaguccauaccggcaucauuccuacauuugcacaagauaggaaggagcuucuaugucuaagucugggugagcaggucccuuagagccauagcagagguuccugugucugugauuguaccagacucucaugaucucuucugaucuccauuuaaagagaauaccguguccaagaugggaaaaucuucaucccucugaacaucacaguccaaggugaugucaucguuuccauguaccacuugcggucaaccaucgggagccggcugcaggcgaagguaagcuuucaggaggacuuggacugugagcucaccugaguuuguaacaggaguauuacugggucuuuucucuguaucacuuugggcuugauugacaggugaguuuggagugagaaagagccugauggcuuguugauguccaucuucuuugucacuguggaagggaauggagauugaggcagguuguaacuuauacauagucccgggggggacucucuugcaucaugacuuucagcaagccauguucuugagaauaugagucuuuuuuuuuuucagugcugugguuaggggaaccacuauaauaugagcacuuucaacuaaguaugaguauaguuaagaauuuuuuccccaagagaugguucagcagguaaaagcucuugccacaaacccucaugcccugaguucaauuuccagaaugccuuccccaaagguguuguuacuauuagaauuaucuuauuuugaaaauguuuccuucaccacuaaaagagaccuuguacccaucaacagucacuaaccaucuccacucccuuccucaucuccugacuaccaugagucuuuuuccuguuucuauagacuugcuuauaugcagacauaucauauagauggaaucauauaauauguggucuccuaugguuggcuuuuuuuacucaguguaauagauuggggguuuauuuauguuuuagcagguagccauauuccauuccuauauauagcuaagcaacacuaaacugaauguauauaccgcauuuauuaacucuccaugcuuagauuauuucuccucuuuggcuauugggaaagauguugcaagcaauuauaucuuaaucaaauauuugcuaagagcauauaucauaucuauugucuagguguuuuggaccaacaaaaaaguaagauuguagccuuagcuuuacagaacugacccuagaggggacaagucaaacauaugaauauccacuaugcuguaucagaggacagacaggacucugucauugcaacaguguuuuuagcuaguggucaccaagcagacuauggaggugggccuugaaggaugaugaguuuguugggcuggagcaggagucucugggaagaaagacuacagaaaagcacaggacacugaugaguaaggaaaugucuugcuuucauggagagaagcuagaaaugaaccugggaggccauuuaauauuuauauaauauacaaagaaucagauaaagggguaauagaaggcacagacacaauauucgauguagacucccguuucuccuacuaauccugcuucuugcacauauuuuuaggugaccaacacacagauauuccagcuccaguuucauucuggguuuauaccacuggacacgacaguuuuaaaguucaccaaguaagugcugugugcaccugaggccuuuaccagcauggcaggaaagcuccaaaagucuguaauagcaugcuguugucuccagaguccugagcugcaggcuauugacuguggcuccaucacuuagagaggcuaugcagguuugaagucuuuccauugaguaugguugaucuaaagaagagcaaauggauugaguuaacuagaaaggucuaacguuccauguuagggaacaaaggacuaugaccuugauccuguguguuuguggcuagcuauccccaacaggaaugguagaguuuaauuucugggauggcauaagcagugacuccucacaagggcuggcuggcuauaguaccaaaagagguucuggggaacccagcugcacugaauauggaccugcugaugcuauaacguaauguggcuauagaucucaggguguggcugaaucuggggugguggggaugguugcuggagcuaagaaacaggaaacuaugaagggguucagagguucagguucagaagguggcuuuggaccuguuucacuguuuugaugacccauuuagccaugccaguuaauacuggccagacauaucaacucugcuucucacagcgcuucuauuaauauguuccauaguaguccaacaaugugaagaaguguuauucuucuguuuucucuacaugagaaaacugaggcauagcaaaguagcaccuaguuaguacccgagucaaccuagaagugaguuucaagcagaacucgacagcgugagccggguccuguguugagcauccugcugacugcacuguuugugcugcuguuuuucuuuccauuaggccugagcuggaugcaugugauguaccagaaaaauauccucagcuguuccaagugacacuggauauagaaguccagccccaagacaaagugaucgacuuaacuccaccaugggaacacuacugcacaaaagaugugaaccccagcauccucuucuccucucagcaggagcaucaggacacucuggccuuaggggguauggcucuuggauggcuugaguuuucagaaugaagccuccaguuacacacugugugguuuuguuuccuguguucgguugaccuugggaccuuuugucuugcaggucaggcuccagccgaucucccaccagaccaucccaggaaucuugggcaaggaggcuucuuugccucucucuguuggcaagguauggcagcgccuugaccuuaggaugauucgaugauaaagugguuaaguugucugguauuauuaaaacucuucuugaagcagugucaauggaagguuccuuucucccuuauuucaaacucuucccuucauguuuuucaaauuggcaucuugacgucuuuccaggccacgagugcucagacugaccagaaagccaaugucggcuauguccuaccuuccucauuugcaguauuucuaagccauaucuuucaagacugaugaagugugaugcaugcuaagaucccucuuuaggcuggugacaacucagaaaggcaaaacaaagcauugcugccuguaagcagauauucuaaagaccgagcugggcauugucucaaggacuguagcuccaagcauggugaaggaagucaccguggccuguaucucugcuaguugcuuuagcaaccauuagcccacacagggcucuaccgcugugcuauuuucucccacaacuggaggcauuucccgauuccuucuuaacuuagugcuuuacauuaugaucuugaggggacagccacuggcacccuaguuaauguacccuggccacgauugcuuugcagucuguaggcgauagcuaugaagugugguauagaauggaauauucaaacuuuauaagagaaaggguuggggauucagccucagagauguccucaguaacauuuucuugaucccccugauguguguuuguaagacaacacucccagauguuuucaauguuagguuaaaaaguauucauaugauuccuuuggcuccaaagguuuguuuacaaaaucuucuuuugaaaaauggaacagacucggaagcccaggcagauauggcuuguagauagauuguuggucucuuucuugguccuuaccuugcuccuuucucacaguaaugguuucuaauaagucauuaccuaucccuuuccacugccguguuaauauguagacauaauuucuguaugggccuggagaguuggcuuaguggucaagagcaugugaugcucuuacagaggacugucuguaacgccaauugcagggaaucuaauguccuuuucuggccucuagaggcaccaagcacacacacaugguguccaggcauacccaauacaggcacucaugcaaacacauaagacaaaauguuuuuaaaaagaaagaaucucuguagauaaacuuaggguuuuguuguuguuguuguuuuguuuuguuuuguuuuucuucugagacaggguuucucuguauaacccuggcugucuuggaacucacuuuguagaccaggcuggccucgaacucagaaauccuccugccucugacuccgagugcugggauuuaauccaaauguagucacuuaucugccugugguuuuuacauuuuugcaaagguauguaaaauauauuacuuaauaucuccaguagccuauuuucucuuucugcaacaauguaaacauaacaaaacucaccugacccagcagucagucauauaaucguuuauuugcacauuggucuuuuuuagaucagaaaucagagaagucacgcugugaggaggaccacgcugcccuggugaaucaggaaagugagcagucagaugaugagcuacugacucucuccagcccccauggcaaugcagagggugauaagccucauggagccaagaagccaggcaaaaagcagcaggagccagcugcgccuccucccccagaggaaguggaccuccugggccuggaagggucugaugugagcacgaacuucucuuccuuggcagcuccucccagcaauucugaguugcugagugaccuguuuggggguguaggugccacagguccugcucaggcaggacaggcugggguagaagauguguuucauccuaguggaccugugucugcacaguccacaccgcgccgaaccgccaccuccgccucugcaucgccaacccuaagagugggagaagguaaucuuucuauuuuucugcuaucuuugauuuuaggaauaacuuuggggccaaacaaguaaaacucaaaugcuuuaauaagcugaacuuuucuaguuuuucuagacaguuucuuggaaaaacauacaacacauacaaacauuauccauuuugguagaaagauaugggguuauauuuaagauccauacucucucuuauuuacucuuuugaauauuuuauacaugaauacuauauuuacaucauuucccccuugucuccucccuccuccaacuccccccaugucccccucacucaguucugaaguucauaaucucuucuuugucauuauuguuacaucugucucuucuuugucauuauuguuacaucugucucuucuuugucauuauuguuacaucugucucaagcuccugagucccuguaguguugcucaucugcauuuagggcugacuacuuaggauugcauaaccuaucugggacuuguccacggaggaaaagucaguuacucuguugauccacugcucuucaucuagggguggggcuuugggaacuuugucuguguuggcaugcccccuggugcugucacugagcaggucuuguuuagccaguucuaucacugagaugucaugggugcagcuuuccuguuaccuccagaagucacucucuugaagcaggcauccugauccucuggcuuaacuucuuacucuucauuuccucuucuugggacuuaagccuugagucaacuuuaguuacuucuguuugaagauggagauggaugagcuauuauuuacuacagcagcugauauuuaugugguacccaccacuugccagauauggaauacaugauuaaauaugcaucgcuucuuuuaaaauccaguagacagaugcuacuguuauuuccacuuccgaguugaggaaaugaaagcguagaguuuaauuagcagcauuuguucaaacagcugggcguagauggggccaggguccaaacuugacauguggacucagagcuuucccccagaccuccugaaauacuuucuuugaauucuaguuuucuagauauacccuggcuauacagugaaguguuugaauacaccaggauauacuugagaggcucagaccagcagcacgucuguggaaagaaguguggcuggucuuuguagggcgucugagccauauauacuuagcuagguucacuugacacaccacuacaaacgugacucuucuuuuuccuggccagccacagcauuaacgcuugcaaggugaucuggcuggguaccagagauucacugcagcuucugaauaaccagcacaaagcagcucugugaccggcacuguuaaccaagaugcugcugcauuagaaaucguaaagagaugaaucucaaccaccuaggcugggaggaugcuguaggaaccuuuucccaugcuaauccuucaccuucgcuggaggcucaggggcuggucuuggcuuuugaaguucugcuggcugccucuuuugugagaaggggaaucagaaucacaggguuugggcuggugguggcuagauguauacccgggagccugcaucccacauuguggcucuuucuucugugcuuugcuuucuuccauccaguucugauucaucaggaugaguaagaaggucuuucaggaaaacaaaaucccaagauugaagacagcacaguguuccauggcugaauuuuaagacaaaccauccuaaggauguuugauaauuuaacuugccauguccuaugcugcuuggugcauucauggcagagcuagaaggcaccuucgacauuaguuaauucugucugugacaucauagauacgaugaugagcauccccaguuguuaguggcaguccuagauguauggcuccaguguccugucccuccaaaaagaaucagaaaggaugccaagucuagaauuaaugaccugcauuugaaucacacaggacuaacacuuaacuaguuggggagccuuguuaagaacuuaauuuggccaggugugguagcacaugccuuuaaucccagcaauugggaggcagaggcaggugggguucugugauuuuucaggccagccuggucuauauagggaguccuaggccaggcaggguuacguagugaggcccugucucacuaccaacacaacaacaaaaaucaucuuaauuuucuuaguuagggauuauacuuaugggcauaaugguaaagacuaacucuugaguuuucauccauacuauuugcacuucacuuuuggcuauuagggaauuucuuaaacaaggugcuauuaaaagugcucuaguaaucuaagaagucuuuaguguuuucuccauugauuagcuucaaccuagaaacaaguggguuuaccaguuguccucuuacagcuacccugcaagcccuaguguucuguguuagagaggaugaggucauaaauggggucaaggaugugcauccuggacugcauggcuggaaacaguauagguauugcuacugcaacuccgccaaguguugggagagcauugugcuugccacugacaccauagcuguaaacuugugagccacaugccucaacacgucgugacagugggaagugucuguucgcugguuuggcucucaggcucuauuucuagaaugggucagccccacuccaggaugcaagcagucaucagcuugguaccuacagauuuggaagugacaucucacuuuagguaguucaaggagauuuuuuuuguuccuugcuccacagugagaaaucagggcaguugucuccaugcagcuuggugauuggugucacacuucgugacuagggccuguggggguuaucuggaguuuugagcuggaaaauuugacuaugagucuagccuaaaguauuuccuggaguugaacaaaagauaauuucugaaccucaguuucuccaggaaugagugaagguaauggcacuuccguuugucagggagaaguugaggaccacccaaggucaccucuauaacacaguauagccccaagaagauucacuauugcugacaaccagggauucccaccuucuuaguucccuuacuuaguucucuagcucagugguucucaacuuuucuaaugcugcggcccuuugauacaguuccucauguuguggugaucccaaccauacaauuauuugcaguguuacuucauaacuauaauuuugcuacugguaucaauuauaaugcaaacauauguuuuucugguggucuuaggugacuccuaugaaagggccccaaagaggccaggacccacagguugaggacugcugcuguagcuccaagaagcugagucagaaacacuuguuucccauggacucaaaaaaggcugagagcucagcuuuacucacuccucagguuuuacucugccuuuagcuuucaagugaacugaaacucacuucauacaacaucaaagcaaagccuacuuagugggguugccuuuuucuuuugagaugggucuuacauaacucaagcugagcuugaacucauuguguagcccaagaugaccuuaaacuuccaauaucuuuccauuuacaccuccuaaauugugugauuauaggcaugugccaccaugccuaguucuaugugaugcugggaaucaaacccaaggcuucgugucugauaggcaaauacucuaccaauugagcuacaucccuagucccaugaggggguuuucuaucauuuuucuuuauaguaguaguguccucugucugguauuuucccauuaauuccuuuuacaugagcacucauuagucacugaaucccuguagccuauacacaguuugcguaacucauggauucaucuguguugaccuuguuuucuugggcacucugugacuacgauuuacugguuuuauguuacuaagauuuucaaaagcuggcuuggagagauagcucauugaguaaaaaagcuugccauacaaguuucagaagcugagucucaauccccagaacacacauaaaagcuggauauuuaaggugaauaccuguaaucccaggacuucuccaaggagaugggaaguagaggaagaugagccaggaguuccaggccagcuagccugauguaugcagcagaaaaaugacaccgucucaaacaaggcagaagaugagaacagaugucugugcucuguguugugauguauacacacacacacacacacacacacacacacacuguagugacacauacacuacacauaccuacauacauauauuacacacacacuaacauacgcuacauauacauacacuacacacacacuaacacacuguacacaccauacacacauaauacacauacacacacaccauauacacuaacacacauacugcacauaccuauaccacacguauacauuaacacacuacacacacuaauacacacacuacacauauauauacuacacacacauauuaacacacuacacacaccauacacacacauaucauacacacuaauacacacuacacauauauauacuacacacacauuaacauaauacacacaccauacaaacacacaaauaaacacacauaauacauauacacagacaggauuuauaaaaagcuaauuggacacucauuuagaguuauagcuuuucuacuaaauaaauccagacucuuucaucuacagaggugggguaauuccuguugugugggacccacuguuagcuccagagaacguugugaggcuaggaagggcuggggaagucaggaggcaaguaucauccucauauuucuaguguuugacuaaauaaugguggcagcuuuucaauauuauaacaauuaacugacaagauaaagaaaugccauuucccuuuguuuucuaggugccaccuuugacccuuuuggagccccugcuaagccaccaggucaggauuuguugggcuccuuucuaaacacauccagugcuucuagcgaccccuuucugcagcccacgagaagcccuuccccuacagugcaugguaagaaaguguuuucuauucuaaucgguggaauaguggagugguuguccacaagacaacacugaguacuuuguguguguguguguaagugugcgugcgcuugucuauugugguaguugcuagccuugcauggcugcagaguagucaugauggguuagucugauuugaaauguguuccacguauaaggcaaacaccagauuccaaaguuuccugugcaaugaaagaaugaaagguaucuuaauacuuuuauaacagucacucacuagaauaauacauguauuaucugcucaauaaauuaacaucguaucugacugauuuaugaguggccuguguagaccucguuuaccgcaccauccucaggccugggaucuuauuuccaguuccccuccuuccuaucuuuuauuauucuuuucagcaauucagguuucucuugcucucuuucuucauuuugcauccugauggauauuagacuuaacaucagaauguaaagaaagccagagagcaaauguuaaaaaagcugucgacuuuuggaacuuuuucuugagugacugcugagcuggagcagggcagaguagaaaggaaagaaccauugucacuaauagugguguaauggugugugcuuuuaaaugcaugaaccgaugggaagguaccuggcacuagagagauacaacagaugacaaugaagccuuagaauucucguccuggugccuuagguccuuuguuuguguggaauguggguguuugcuuguguugugugugguauauguacaugugauguuuauggguggugugugguauguaugugaugugugcauguguguuguguguaagugggaugugugugguuuguaugugugguguguguaugugggauguguaugugugguguauaugugguuugugugugggggcguauaugugguguguauguguguguuuucaauccuacuuguaauacugccuuagugacugaauucuccugaauuuugugggcaacuuccuagggcaagauucucuccuccagcagcacguuucauuuccguucugcuuggaacuuugugaggggucagagugugcucucuugaagcucuaauggguuucuucuucuucuucuuuuaaagauuaauuuauuuauuucauguacucauguauuucaugaguacacuguagcugucuucagacacaccagagagggcaucagaucacauuacagaugguugugagccaccaugugguugcuggggauugaacucaggaccucuggaagagcagucagugcucuuaaccgcugagccaucucuccaaccccucuaacggguuucuuuuugagugaccguagacacauaucugccaccagcauagugggugaugcauaguuuuuggcuaauuaguguucugaguggcucaucacucucaauccaugcugcagucaaggagaaaacagggccccaguucugagagguuugugccuuggugcccuugucugugccgagcuaagccacguugagcuuaaggauauuuccuucuuuuggcacggcccagaaucuuaaguauauaagugggguacacaaagaugaaugagauaguucuuccauucaagggacucagaauuuaaugaagacaggcacccacacaacuauaauuccaagucaguggauacagagguacauaaagaugagccaaggaaugaacagcuucugccaaguucuugugagcaugcacagaugagaacagcaaauaucccuguugcagaguggaguaaaagcccagcagcagaauggauccauuagcuacguaaaagcugugcagagccaugcaggcucgauuguccugugcaaacucagaagagcagguucugagcugccuuguucucacccaucuucucuccauuugcagcuucuaguacuccugcugugaacauccagcccgacauugcuggagguugggacuggcacaccaaaccagguaaaaaccaguggguuauuuuuguaugcacgugaccagugguaaacgcaugguccuucagccaagaugagguggaugcuuggaauauuguaguacacuguguaguuugaucauucccaaagaucugcagaccaaugugcuuagugacaugaagugugugugugugugugugugugugugugugugugugugugugugugugugcuauuuaacuuuccaagacucaucugcuguauaucuaacucaacaauacaauuagaugaaucugaacuggcucuaccacucagacucuccuguuuuuguuuuuguuuuuuuuuuguuguuguuguuuguuuuguuuuuauguuguuguuuuuggauaagucucagcuucaguuuucucaucugagaaauggggggaacaauguuuauuuauccuacacagcaaaguaaguguaaguaaagcaauguaaauggacccucccucauugcucaugacuaaagcuccacgcccaccaauaguucccaugguuucuuucccccagccccagauaaccagcuuucaauagaaaaguggauagguuuccuacuaaguagaaugucauagcauuuguguuuuugugagugccuuaugucauuuuauaaaaugucccaagguuuauccauauuguaguccauaggacuauuucuuccuuuuuuaaggcuaacucauauuucacuguucauauaauaccacauuuuuuuuucuuuccugucguuuucaguggccaggucuaaugcggugacuaugguccuuauuuuaaugacuaccuuggauguauccccaggaauaugggugcugaaucauggucuuuuaaaucuguggcgauguugcauacuacuucccacaguaacugugcccugcuuuguuccuauccaccguggacaaggauucuaauuccuucccauuuuuacaaacacuucugauuuuuuuuuuaacaaaugccaaucuugacauguauaagguaauaucucauuguuuacaugauuggcauuuccuuuaauaacuagugacuguggugauuugaauaagaauguacauauacaugaauaguuggucccaguugguggaacuguuugagaaggggaaggugugucacugagagugggauugaaguuucaaaacccccaccccauucccaguuggcuuuuuaugccucaugcuuguggauaagauguaagcucucaaguagugcuccagcacugugcuugccugcugccaugcuccccgccaugauagucaaggacucuaauugucuggaacuguaagccccuuaaacgcuuucuucuguuuguugccuuggucauggugcccauuacagcaauaaaaaaguaacuaagagagugauguugagaaucuuuuuauguguugugaucauuugaaaauuuucuuagcugaaauauccuugcuuauuuuuaaaucaagucauuugucaauucauuauuaagcuuuaguugcuuuuuuauuuuuuuuauuuuuauuuuuuuacauacuguggcucaaacucuuuaucagaauaaagguuggcaaauacuguccccgauuguauauuugacuguuuuuuuuaaacucuguuaacuaugccuuuugccauacaguuuuuuucucauucaauuuguccacuuuuugcuuuuauuaccugugacuuugaauuauauuuuaaaagaaguuaaugggcaggaugguucaaugguuaagaacauuguuugcucuugcgguggacccaagcuagauuccuggcacccacauaguggcucucaacucucuguaacucuaauuccagggcaccugaugcccucuucugaucucuguggguauuguaaacacaagguacacauacaaacauacaggcaaaaaacacccaugcacauaaaauaagugauucauacaaaacauuuuaaaguuaaaaaugguguaguucaaagaugauaagcaagaccccuccaggggguggggggggcguugagauacagccugaauccagaucucugaagagagagagcugguacaggagagguaaacacgggcaaaggcaggcauggaccacgaagaucucaugccugacccguguguuguucuuacuucaggucaccacucuccuaaaucacaguaagaguauccagagacuuuucacacucuuucagacuccauccuaauuugccuuagaggcagccgagcggguucucuggaacucuugacuuugagcauccaauucaggguccgaacucaucuucaaugaucucuguuccuuuucaggagguuuuggaauggggagcaaauccgcugccaccagcccgacaggcucaucacauggcacccccacccaucagagcaagccccagacucuggaucccuucgcugaccuggggacacuagguauauauacacuuaucagguuuagcugugaauaauacuugaugcuaaugucaaccaugucagggacaaaggcacagcucuacacuguuccuauagcaauguaagacuucccuuaaucuuuuuugggaccuuagguaaaacuggauccuugaacucaauucaaagcaaagugagaguuuaagcacuaguguuaagaggaagagagguacuggggaagaaauuaagacagguuugagugcauaggugugggcuucucaaaguagagucucgugugaguaucuuaguauuagccauagagacuguuuugcuuucuuuucagguaacaucucaaagaguugcuuuuuugccuccuuuucaguuaaugagguucuagaguggcuccagaggugccuuggaugggauuauaguguuauaaaaaaauaaaacaaaacaccaccaccacaacaacaacaacccaaaccaacccagagccacuagaguuacacaagggguucagaucacacacuuuuacugugaaguggguuucaggugagauucacagaaaagugaaggcuuaccauugggaagagagaaaggcuuugcacaaauauuuauuacauuagcauucuucuuucucagccaagaauaagccaaauauaaaagcaguagauggaaauaaauagauuggagcagaggacugaagugauggcucaucgguuaagagcacugacugcuuuuccaaagguccugauuucaguucccagcaaccacaugguggcucacaaccaucuauaauggggucugaugaccucuucugguaugucuuaagacgggggcaguguacucacauacauaaaauaaauaaauaaaucuuaaaaaaaaugggagcagaagugagcgaaauagaaauggacaaauaauacaaaaaacagaacagugaagagaugaguuauaaauaaaaugggcaaauccuucaccaacuaaagaagagaagaugcacauuaauaaaauuaaaggggggaaggagaaauuacaacagguaucugugaaauucauaaaaucacaagagcaugcuuuaaaauuuuacauuccucuaaauugggaaaccuaaaagaaacaauugcauuuccagaugauuugaccuaaugaaguuaaauaaagauggaaaacaauucaagcaguucuguaacaagcaaggaaauuaagcagugaucugaaaaaacaaaacaaaacaaaacucuaaaacugaaaaucaccaggcccagauauauucauagacgauugguuauaccagggcauuacaaaauuauaguaccaacccugcucaaaguauuccguaaaauuaaaagaaagguauagccaguuuuauccugauguuuaaaccagauaaagacuccacaacaaaauuucucugauagaguuacacaaaaacucccaguaaaauacuuggaaacugagcucacguaauaaugaccacucaccacgaccaauuuagcuuagcuuccuuccagaaaauaaggaugguucaacguauguaaaucaacaaaggucauacaucauagaaacggacucagggcagaacucuugacaaaaagcaaacauuggucaacaauagccuuugaaaagcucagaauggagggaacauaucuuaauauaguaaaagcaguguguggucaaccuauagccagugcuaaaugaagcaaaacucaaagcauuucuccuaagaucaaaaauaagacgaagauguccgcuuucuccacucuuauuuaauguagugcuggaagucuuagccagagcgauaggacaggagacuugauuaaaauggauguaaauagagaggaagaagccaaaaagcaccuuuaugcguugguccaugguucuacacacgagagaccagaaggaccccaccagaagacuguagaagcugauaaacgcuuucagcaaaauaguaggauaaaaaaaacccaacauaacauaaaaagccaguauccauccugaauacuaauguuugugcuaagaaagggaacaaauucucauagaagccuccaaagcaacaacagaauaucccaaaaccuuuggaauaaacuagccaagggaaugaaagaucuccauaauggaagccuuaaaauauuuaugagagaagcagaggaagacauuaaggaaggaaagcucccccgaccacgcccauggaccgcaagaauuaacgugguaaaaauggucacccuaugaacaagcaaucuacagauuucaugcaaccccaaucaaaauucgcugccagcacugaagggauggcuuaguaguuaagaccacugauugcucuuccagaggacccagguucaauucccagcacccacauaaccacucacacuugucucuaacuccaguuccagggaucagacacccucacacagacaaaaaaacaaaaaacaaaaaacaaaaaaaacaauaaauuacuucugaguucgaggccagccuguucuacaaagugaguuccaggacauccagggcuauacagaggaacccugucuugaaaaagcccaaaaaaaaaauguauguauauauauauacauauauauacauacacacacacaccacacacacacacacacacauauuccaaugccacucuuuacagaaacagaaaaagacccuuaaaauccauauggaggcacaaaagaacacagagagccaaugcaauccugggcaaaauuaauauugcuggagguaucaccauaccugauuucagguuauacugcagagccauaguaauggaaauaguguauaguguugacacaaagccagacuguuguuagugaacggaaacacccgaauguaaucuauagagcuagagcuagagcuaugugcuuggauuuuuuguuuguauguugguuugacaaagaugccaaaaacauacauuguagaaaagcagauuaagcaaaugguacuaagaaaacuggauaucuaccugaacuaaaaggaaaacaaaucccuauauuucacuucccauaaaaaccaacuccaaguggaucaaagaccuucauaaaaguccugaaacucugaaaccauuagaggaaaaaguagagaaaaggucuccucugcacaaugucuacauagguaaggacuuucgugagaggagugcaguugcuuagggaauauugcccaacauuaacaaauggaaccuuaugaaauuaaaaaucuucuguauagcaaagggaaaguuaauuaaaagaagauaccgccuacagaauaggagaaaauucuuugcugcuuuacuucagaguaucaauaucuagaauauacaaugaacuaaaaaauacuaaacaaaaauaaaaauuaaacucaaauugggugguggugacacaugccuuuaaucccagcaauugggaggaagagacagucagaucuccuaauucaagaccagccuggucuaaagagugaguuccaggacagccagggcuacauagagaaaccuuguuucaaaaaucaaucaaucaaucaucucaguaaaugacuugauaaaaugaacaguuuucaaaagauaaaguaaaaauacccccaaaaugauauggaacacauucaaccucaauaggcaucaaaagaauuaaaaauugcacacauuccaucuuacccuagucagaaugaaugccauuaagaaaacaaaaacaaaugcuagugcugauacggacaaaagggaauccuuaugcauugcuggugggaagauaagcuagucaguguugacuuuuuuuaagccguuucuacaaaaaaaccuaaccaaccaaccaaaaaaguguaucuuccauaucagcuuaccucucuauauuaauaaugugacauuauacugcaaggaucucucucucuuucucucucucucucuuucccuccuucccucucccccucccuccuucccucccuuucuuccuccuuccaucccucccccucucccuucuuccucuuuuuucuuuaucauccaucuaucuaucuacccauuuguccauccauccauccauccuuccauccauccaucugucaguccaucugucugucuuuauccguuuauuuucuguuuaucuaucugucauuuaugucacuuaucucaggauagacagacugccuucuuuuugguucaguugauuaucaaccacuucugacauuauuuauucugcuguucuuccagucauuggucuguuuuaugaauucuccuuugccuuuuaugucuguuuuacucaagucuaucaagggaaagaaagaggcauccuuucuguacccguauccuaaccauagaagccacccuggucagcucuccuauccugggcccuggcuuaugugauuucagauugaagguggacagugggauagucaggcauuucccaagcuucuuauacuccaggucuaggugucuucuuuuuguaaggugucuguagucauuuuuauggggaauaaaauuuagaagccaagaucuguauacuaaguaugauuauuggaguguuauuucucucccuucuaggagacauagugugugugugugugugugucugcaggcaugcaugugagugugugucuguguguauuggugugugucuaugcaugcaugugaguauguguguguguaccguuaaucugacucccaguuucuuucuugccuucuacuccacaugugaaucuuacauuuccucacauugcaguuauagucagacagcaucaauaguuucagaguagcuaaaccuguaucaccacaaacaaggaaccugaacgugcaguuuggaaaugcaguaauucucacagccuccuucucagaaccuggcuucuuacacuucucuacuuuuuaagguauacagcuuagaaauuuuaagugauuuuucccacuaaggccacgggacaaacagauucaucaguggcagauuauuauaagccaaaauuuccacucauuagacaauacaggaguaacucagaaaaaaacaauagacagaggccuccaguucaacaucaacgcucgacuacucccuggauaaucagaaguuaacuggccuagagguggcuuugguggggguggagcuuugugaguuccaggcaaucucuuaugcuucccuugaggagggccuugaagguguauuuugucaaaugacagcgguaggcagcacauguugguguugccucuauuuccaagcacucucaggucaggaggaucaccagugugaggccagcuuggcauacauagggaauuuuagaccauauggguugcauaguaagaccuugccucaaaaacugggguuggugauggaaaaugacaggggcagcgauaggcuugagugccaaccugaccaaauacucauugagguuuuuguuguuguuguuguugugugugugugugguuuuuuuuuuaagauuuauuuauaaguacacuguagcuguuuucagacaccccagaagagggcaucagaucucauuauagauaguugugagccaccaugugauugcugggauuugaacucaggaccuucggaagagcagugagugcucuuaacugcugaacaaucucucuagccccugaucauugagucuuuacaaugugucaaacaugugguuaauguuguuuugugguguguaguguaccugcguuuguuuaauucaggggcugugaaacacuuccugcaaugguuauguguuuauacuauacuuacucugauaaagacauaguuauuuuguagauaagaacauugaagcucacagaaauuuaaaaaaaucauuuaucuuaagaaaagcaagaugcuuuguuuguguagaauccaagugcccaaccuggcacauggcaggcauuucagcaccugcgggagaauggcuugggacccaugccuaggagagcaaauggugcaugagagauagcacuaaacucaaacagguugauuccagaugcuauaauacagcauccaugugugaaagggaagagggcucucagggucuaaaugaaaagacauagcuauagaagaaagccauaggaaggggugacuuuuagaagcagcucagaacuuuggcugcagaggugcagagauaagaugcucguggucagggcaucucuguuaaccaacugugugaucacaauauucucgugacccuuugcauugaauugaccuagugauacuauuuacuuacacguaacacacugugaagaucuauagguguuaguuguuucaucaucgucaucaucaucaucauuauuuuggcucuuugaagggucuuuggagaucaccguguuucagcuucucaauuugccuccccaauacuaucccuccugcaauucaaugcggcaguguaaaacugaaacguauuugugaaauuuagaaacagcuauaaugcucuuggguccuaaccaggcuuuuucuuauagcaaaugauaauuaauccuaauaguugacauuuaaguagaaucuuaaugaggucacuuguuuuaucccaauacuuaccacuugguaguuuugacucuaguaaagaaauuaaacuugcuuaggagggagcagucuggucaggguaucacaguauggucuuuuggcuuagacuaaaaaaucuagauucaaguauuuugccauaggcuggcugugugauauagggagaaaaaaaaacccacuaaaguacucugaauugcucuugguucauugaagaaaaaaguagggcaagggcacuaccugggcugacugaggacaugacaggcagauaugccugugauuucucuaucuguuaggaaaguuaacucuguuaccacccaaagcaguuuccacuaaaaucaucacaagcaaugccuugugacccaaguuugaagccacucucaauagccuuacugccucucucccuucuccuuuauagguagcucuucauuugccagcaaaccuaccaccccaacuggauuggguggaggauuuccaccucucagcucaccacagaaagcauccccccagccaauggguggaggguggcagcagccagccggcuacaacuggcagcagacacagucuaagccacaguccaguaugccucacuccuccccucagaaccgacccaauuacaacgugagcuucucggcuaugccugcagggcagagcgaacguggaaaaggaucuacuaacuuggguaaggaugaugacaugagacugguacagggugaccugccuguauugucguacugcuggggauguuaugucugaaagacgccauuauagaguuuaagggacaucaggcaauccauaccccaaguacuguuugcuuuaacuacugagcugucucuccagcccugcuagauuagauucuuggcaugaagguaaaaauaauaugugcuaaaauugaacucgucagauagugucagauacacuuggccuuucaguuggcuugaugauucucuuugaggaacauggacaaaggggauucuccugcacagugguuaccauggauugagcacuuacaacaugcaggcauaguguagacauguucauguauuauuuuauagcaucuucaaaaccaaagcucuauuauagaugaauaaucugugagguagaucuaaaaaguaaucucucagguuuuugagacuugugacagagccuggaugugaauuccagucauuuggcaccagaacaucuggcuuucagugucaccccagcugagcaugauaucaguguuuguucacagcccugcugugacagaaaugcaugugcuggagaugugugacgucauguuuauucuucaguucucuggggcacucauuggacaauucuguugagccauguggcgucccauucauuauuguuuugagaagauagugggugaaugucuccugggagcacuuaauuuuggugugcacauaugugaucuggcuucuuaagaagagagacggcaaaccauucccaaccaggaaaaaaacaaaacaaaacaaaaaaacaccuuggguugauuacugcgaacugugugggcugcugugguuuuguucuguuuuauuuucaaaugaacacugagauaaccaaucaugcuuuuagcucauucacgugacaacacgguacuguuaacaucacccucauucucuggaugaagaagcagagguacagaugccugcaacaucccugugaucauagcuggauuuuagacacacagaguuuguuuccaggaucuaccucuucaaaaagauacagagagauuuagucugaagccagacuuacagggagagggcacuaggauccaccgaacccaucaacuggguauagacaggagagugauaccaaggagguugucaaggauucaagucuuggcucuugucuaauugcugaugcuaguuaguuguaaucauuguagaaccuugaguaccuucauccacaaaguuacacuggugaugaaaugggcuuuaaugaucuagacuccaguccuggccuugccauaaacacacuguaugcuucuggacagaccucuuagguuaucuauucuuccacuuuccucaucuguuacacagagccuuuaauguuccucacaaggcaacuaugaagggaacaaauguauggaaaaucuauacuccuguacuccugugaaguggcaguuugacauuuuguuuaagaauaaaaguugugaugguuuccaaauauuauguugcagaagggaaacaaaaggcugcugacuuugaagaucugcuuucuagucaaggcuucaaugcacacaaagacaaaaaggggccucgaacaauagcugagaugagaaaggaggagauggcuaaggaaauggauccugaaaaacuaaaggugagugaccauccuauaggacaaagccaugugacaagucauugugcccaaccaccucucuauucauuaccuuuguguuggucauuagggacugaauacuugauagauacaacuugaggaaagaaagauuuauucugacccauggucucagaagauuucaguuuuggugggauaggaaagacauggccaugcacgcaugcugcauggcuguucacuuggaaacagacaggaagcacagagaggggcacuguagcaaauggugggcagguggaaccuucaaagcuccauuccuagggaacuacuuacuucuacuagcuaagccccauauggguuucacaaucuccccaaacaccauccacuggugaacaggggcucaaaacaugaucugguggaaaagaauuuaaaucauaacaccuucuaaggguccuuaccuccuauaaugucauucaccaccauaaggguaaaaagucaacacugauucuaggguaggacacagaucuuaucaacuauggaaggcacuucauacuggcaaucacuggguuacagugggucucugaagcugugguuugaagauggcuaugcuuuucaguagcaaaguagcuuugggaaggcuggugcaugaugcugaguuugcccaccagaugaacaaugguauuugacucuguaguuuggaagaagccuuuagauuauaaguaucagucauuagaguuuagugagaacaauucacccuuuguauuuucuguccaccuugagaacuuucuguucuugguugacugaaacccaguuucaguucucuguggaucaagagagaacuauuucugcacccaggguuuaccauucugaagacauuaggcaugagguccacauagguugaggacaggaaagcuaaugacggugaagccccuggccucuaucacagacuccuuccacuuuuaaguaaagaaguucuauuuuuuuucuuaaaacaaaaaacaaaacgaaacaauaaaaacaucuauuuuugauucuaaagucuaugugagaaucaguuuuggaaagggagaaugagguuguuuguuuguuugguacuuuaaagaaaaaagagggucuggagagaugauucagugcuuaagaaugcucuuaaccugaguuccugagguccugaguucaauucccagcaaccacauggugguucacaaccaccuauaauguaaugugaugcucucuucugguaugcagauguacaugaagauaggacacucauauacauaaaacaaacaaauaaaucuugaaauaaaagaagaaaagggaaagaaaagaaaaagaaacuugucagucagugaauccaaguucguuaacugguagaggggauaagcucuucacagggaaggcccagaguggacagcuggaugcagauuagccugaaggcagaggguggcucugaaggugaauggcaugaggacacagaugagguacauaaagaucaaacuggcauaugacuuauggcaugacauacagcucuggagcaguagcugagagcuuagaucugauccacaagcaugagguagcgaaggaaugauauagguuaaaagaccuuaaaacucaccccaccuucucuaacaaagccacaauuccuaacccuucccaaccauuuccaccaacuggagaccaagaacucaaauauacgagacuaugggagccagucucacuccaaccacuacagcuuccauuuaaucacauauuuucuuuauaagauggagguuguuaguuugaaucaaugauauaagggaucaauuuauuuaauaaaccuuucgagcucuacucggugccaggucuguuuggcuacuaagauaaagugauaagaagcaguccaagaaacucuucuuucccaucaauagcuccaaguauugacgggaaaaggugaacacacauacucaauaaugagugacauauauggcacguuuauaguaggguaggcccuauuuuuuccccuuugugguaggagucaaaccuagggcagguaaguauaccacugagcuauauccuagcacaacuuuggccuacaugaaaggaauauuuaguggcuggagcaaaguagauccaggugugaccucaugaagcucgugcuaggaguguauaauuagcuguaugaaggcagggagaaaugagcucaaaccacagaggugaacucugaaguucaugaucaguuuuugaacagugaugcagacuagaaggacgagggggaaggugggcuuguguuccagcuagaggggccugcuugcgcaguuuccuagcaacaguagcgguaaacaguauagaucuucagaguccugguaggcagaaagcauuugagggucuuaaccuuuuugguuuuuccuguuugcagauccuggaguggauagagggcaaagagagaaacaucagagcucugcuuuccacaaugcacaccgugcugugggcuggggagaccaaauggaaacccgugggcauggcggaucuggugacgccggagcaagugaagaagguguacaggagggcugugcuaguggugcacccugacaagguggguagcaccugcccugucguagacuugcccggucccuguuucaguguucacaaguauaggauaaaaaggcaugcuuucaauuugcugauugacuaagaaauuuauuugacaaaacuuacucuguggguuacuuaaaucaaguauuuaaacaaauagucacaaggcaugagguugucaggaagcagucaaagcauccuucacaaacaauaggacaaacauuuuauucacuauggaggcugagcacuucaaaggaaaaggcuauugucccaguggagggcggaauugugucuacccaagagacaccuuaggguauguuuggaaaaaagauauuggugaggagcaauaagauguuuaaaaugucaguguguguugccaucacugcucaugguuugaguaaauuacaagagcucagaagagcuccacagaucagaacuugagcucccaccuggccaaguucauugcaguuugcagccgcacgucagacugaaguacaccacucugcucucauugagccguagcagauaugagacaugaagucaugauugcagugccuuuggggaacgcgugucugaaauccauguuugauguccaucccuccacgcuccuuaugacuaaauaggauaauuaaugggaaauguuaauucaugaacuuuaaucagucauaagagaaguaagagcccacagaaacuggcaaacugcccuacuagaaggagucucaaagaccuacacuuuauagggauuggaaagggggaguuuugaaacacagucaaacaaagacaucccuaucauuaaccaugagaugugucuucuacugccuaacaagcucccacuuuucuucuuauugauggguuucuguuauccucugugagcuuucuguagugcgcaguaauuaaucucauguagauagacuguaaaaagagaugucuuaaugaaagaacauuuuaauugccauucacaaacucagugaauuuaauauuaguuuaauuuuggucugugguaucuaauuguguuuuguguuuucuuuaggcaacugggcaacccuaugaacaauacgcaaagaugauuuucauggagcuaaaugaugccuggucugaauuugaaaaccaaggccaaaagcccuuguauuaauuugugagcuuuucuaugcuggcugcaguccugugauaaugcuuaguguguaccacaguucugagauuuucacagaugaaccaaaaauucuaguaauguauuuccaauacuaaacuguuaauuuccucgugaauucacuucucaugauaaggaaugugaacguuugguuucuugaaguccauagcaccaagaggaacucuagugagcugaccuugcagagucuugacauuccagccuguccuuugggaagccgacucagcauuuugccuggggaaauaggaccucggccacccaaggugaaggcaugacauccaucucacugucugagauuaagauuuaugaguggacauuaugauaaugggauugcguaaugguuuuaaggaauugauuuagggauuguguauguguggguuuuuuguuuuguuuuguuuuuaaagauguaauuugaggaauggcuuuacacaaacuccaagaauaucaccaaccaaguauuuuuuaauggaaacuuacugaagccuuuagcuucuucaguguguguccuuuggucaagagcauuaacaauuauugaagugacuuaacgguggaaagggguuauguagaaauugaggaauuaccccuuucuuuuccuggaugagcuauaacccaagcacaugauaaagaaaucaggagcccuaagaugccaaaucuugacuccaggucaggacauugggguaccagcuccuuuuuccuuuaaguuugcuguugauugaagaaaaacucuugaacgauaccaccaccauaauuccaaaccuauuugaaauccccuucuaauuguugccaugaggcucagugcucuuucuuuugcuuagccaagaaaacauucuucaugggugacaguuugcaaagcagcuuggcccauucacacuuuguauagaccuggcauucuggugacugcaagccaggggaaaaacagagaagauaacacugagugcuauuuagaaggguuugguuggggauagagcuguggugugccuucagauccaauuggauagcuugccaguugaggagucagagucccacccacccaguggaucuggccccucccaccccgggauuaucuccgcuggguuugcuguuggaugcaugugaaaacuaugcaagaaugaaacuuucccagacugacaucagcugguggcaguucacuccagugcucagagcuucccacuuugcaggggaagcagcuccuacugcugggacuucgcuaggucucugggugagcacaugugcggcaucuauuuaucuauccauaccugcauaugaauaugucuaacgugcacacacacauucacaaagcagguggucaaaaagauuaucaugcugaucuuaaaagguucacauucaauauugugaaaagcuuucagaaguuguguuuccaagacaaucauuuuguuuguuuguuucuguuuuaauauucuugugacaacuaaguugaaaaagcagcaugucagaaauaauuuugauucuauauagaccucuucucuuuuuuuaaauuauaaaaguuuauuauuuauuuuaccuuuaacugauaaugugaaauucucaaaaauauguucucuuuaaaauauacaguuguaaacucuucaaaguaaacauaacaaucuagguguuauuuauuaacguauuauacaaugaugucugacccaguaugugcuuguccuauuuaagauuggaaugugagacauguugcugugaccuguuuuguuuuguuuuuuuguuuguuuuguuuuugccucauuccauauuuguagauauugugugaacuacaguauauaaugacaauaauuaagaggauauuauguggcugucacauacauuuugagaugauagaacuauauuagcuuugugucauguuugcauaggucauuaacguucacgguuuaaauaccauuaaauguuaugcgauuagcaaugaggaagaacccuuccuuaaaucugggaguuucccaccgcucuuucccugaugcauuaugauccuggacgccugucuaucucaaaacucuuaacacgugcagaccaauagguucuguguuccuuuuaaauaccagguugugacaguuuguuguuggccagauccaccaucucauucauauuuauuguaauauauuuuuguuuuguaaauacaugaaacaaaacaaaaugucauuguucuaaaauauuuguaauguauauuaaaaaggauacaaaauacuuuuagaaauauacauuauuuuuguaccugcgggaguacgaggggccagagagaugacgcagugguuagacgugcacacuacucuugcagaggaccucaguacccacacugccugugucuucagcugcagagggcucugaugcccucuuuugguuuccacaggcacuugcauugacgugcacacaccccuccucuauacacaugauuaaaauaaaauagaucuuaaacaagcaaagaagcaucccaaaccaaacaaaugagaaauggaguacaauggcaaacuugacagacacccucuaacccgacuugcuuuuaaagaucgguaagggggaagaaucugaaaaguguggaguacauuugcaccaaaagguaaccugacaagauucuauguuuauacuuucaucucccaguaucacucaugucuugaggcagacagacagacagacagacagaccccacuggucaugucugaugaaaacuguguugcaaaaggacucagcauaggaauccuguucuuacuagaauaugaauguguuuccaaccacauguuugugugcugagucagagagacugauuuaccaucgaacagaaaugcuggauauuuuuaagccugaggacagagagaacauaugcacauuuguagacacacuguuccagagcauuugagccacggcuuugcugauguguccagaccagugguuuucaagcuuccuaacucugugacccuuuaaugcauuuccucguguuguauugauuccucuaaccauaaaauuauuucauugcuacuguguagccguaauuuugcuacuuuuaugagcugugauauaaauaucugauaugaaauaucugugggagccacaacccacagguugagaaccucuggucuggcagcucaggucaguacuagugcuacuggugagaccacauuggguaagaagucagcacaaaaguugaauuucagaggauguuauccuaguucaagacauuuuccaugaugaaaacaccagcuuauaaaaugcaggucaaaucaagaguuuuuuuuuuuuuuuuaacuauucuaaaaauaagccauaaaguuuguggaauggugauauauguugguuugaaacuaaaagaguagcuaugaauacugauuuuuuuccuacuuaauaucuguuauauugacaaauacuuuaaacucugagucgugauuuuaucauuuguaaaauagauuccuuacaggucuuaugaggcaccauguguguaaaguauuaccucacagauacuagccaauaacuaucaguacugcuaaugauaaauaagacuaggugccacacugaugguuuuugagcuggaaauacauggagcccucagguucagaaacggcuccaggaauaggaaagucugcugggaacaccuuauuccuugacacuucuaccagucuccuugggacggggugagaucuggguguagaaaaugacagaugcuuguuucuguuagugucauagcacaauucuguuuaggaugcacugugaccuuagagccuccucuggggcagaugugugaccuuguugugcccuuacauguguggcgcuguaagaucuggaguuugagaaggguauuuucuguggacuagggggaggugauacuauuuauuauaaacuuacuaauauuugcuauaucagggcucagaaaaugacuacaaacuacagauuccagaacccaaauuucuccuaucucccuucuucuuuucuuguaucucucauucuuuucuaggcagaucauagagacuagaauucaucuuugccaaggcaggucauugaaaccacaccuuuuccccaaagccagauguaaaaacgaaaaucacucccaaucuccucccuuuugccauaagaguuggccaccugaaguccucucucauucucuguagaucacaaggucucuuuuccagggaagggucuugugccauaucuggagggagcgcugcacagagcaaccaagaagaaugaauagacagacccuuuggauuccucucuuaguccauuacuguucggccagucucuuucuggcccauaaucuuucuguguggcugccaaugcuucaucaaaccuaaacauaagauugcacaguacacacagacuucuugagucuucuucagccugcaggcuucugugucauuucaaacuaugaucaaauaaauuugcuaugauuuuuuuauguuguaaccugccuuuugcuauaguuguauuggccaugaaacuuuaugaaugguaaagggaucaccccuuuuuuguucccagaguuaauauaaucaacccuugguauaugcuauagaugagacacuaguaaauauguauauuaauaugaaaucaaugaauugcuuugaacucucuuaag

SEQ ID NO: 2005 - RNA, 11657 nt, Mus musculus
gggcgggccgggcuuuggauucgcgcgccggcccuggcuagucugggugugggcggcuuuuggagaaagccggaagcagcgacagccccagcuccagagacauggcgggcguuaaagguacacugcgacccucgcccgcggcuaguggguggggucgcuccuggcuccaggcugcauggcgagcagccugugugcgggugugcgaguuccugcagaccgcggccucccgaaugcgcggcagagguguuuugcggagccuauaaacgcucgcgcccacgcccacgcccgucaguucccaggcgggggcuucucccgugggcuguacguuccacagugguccccugggcuuuucaguucuccguaggucacaucagggucccacauccucaccuuccugccccgccgcaguuuccuguggcuuacagaggagccuuuguguccaggauguguguuggaaacuugguccuguuguucccuuacgguuuuucucgcugggcagaauaauuucgggcguguggcacuuuggaaaguaaccagaaauacccuauucgacgcaaccuuggggcugcaauuagaugggauuuuaacaagacuuuucuugaguguuuacuggucugugaacagagcaguaugugcuguuuguguucuugaauggugaugaaaggaggguaccgaaagauuaucacccugaucugugugaaugcagagcuuugggcguuggguggggacaaaguuacuggaaggcuuccugguauuuggauuucuggucauccgcacagagaagacuuaauuuaucucuguguuggacuuccuuucuuugaaaacuauccacaaagaccuucccacucaccaacaucuguaagauggauacaguguauacucauguggaugcacuguacauuaucugugcacaacuaguaacagacauagcuaaccauuuuggggggacuuuuguauuucaaaucaaaguaaacaugguuuacuugggcaauguccacuguaugacguauccauuugaagacaguguagaaagcauguaaaauugugucucacuacuacagaguguucaguccuggacagaaaguacaaaguagcaacaguaauuuaugggccuauguagugaaaaggaacaaaggcuaugaaguagacaagagcacaaggaaguaaaacuuugcccauaauucaacuguuauugagaaacuaugcuggagacuugggauaaaagauaagugagaaguuuggacugaguugauugccgaaaauaauuauauugcuguguaagaaaaugaugugugcucugacaguugagaacauagagauaauauaguggagggaaucauguugcuccaaaagauauguuuuaaguuguaacucccugcugccaaaugaggguguggccuuguuugcaacuagcagauguuaucaaucuaagguugccuugugugauguccuucagauaaggggggagggggaaagcacaaaguaaggauugaagcagagggccccaagauggcuugguaggaaaggcacuugcugucgagccuuaagaccugcguuugaucccugggaccuaccugguugaaggagagaaccaacucgaacagguuauccucugaccuccacacuugcacacgcaguauggugcauggcuacaaguagauagauaaacguaaauaaguaauuuuuuaaaaaguaagagaaacuggagugccguagcugcaagccaagcaguaguauagacauagcagcacugggcaaggaaguuuguucucuucagagacgccuuaauuuuagaagccuaacuucagaaccgagagaauucauucccuuuguucagagccacccagauuguaguaguucgaugugaagcuaauaugaaugaccacucuauggggggaauagaagaggcgauaguuaugcugaauuuacaggacucuguaaggcuuggguuaagaccaggauauauucaugacuggggcagaggccaugacagaacacaucuuauucuucucauuuucccaggcucuuggaggcagaguagggaggauugaagcuggagaagguaggggucagaugguagugagccucuagugacaacaugcaggcugugaacacauuugcaauggguaacacacacaaguaccuacugauguagguggaggaaggacuggaagaggcucaguuuggcagcagacagcgagcauacauccaggcuacccugcgcagaguucaagagaagacgggaguuuugaaugaagucucgguaaaaugaguuauuuugauuugcuguagagcacagcucugguuucagcccucuaagauuggucuucaagagaagaugaagcguguguugggaggguggggguggggguggggugggguggggugggagaaggagguuauuuugcauguuggauuugagcuccuucuuggcuuuggcucuguggcacaguaguccagauuagaaguggaguucuuaggaucucuugugggccggagccuugcauuuggguugaacucagcuuuucagcagucaugugugaagcgaaaagagauggacuugaauuguugguuaacuccuacuguaauuaagaaauggcagugugcuggcaagauggcuuagcagguaaaggcuugcacacaagcccagugaucucaaugcaaucccgggauccuaugggaagguggaaggagaguacugauuucauaagauuguccuguuuacaugugauauagcaauauacacccccauugaucauauacucaguuugagaagagaggggguaggcaggaauacaauuucuaaacacacacacacacacaugcacauggcuugaaggcaaccagcagaaauaaaguugugaaauuugagagaugguuugggaacagaaagaagaaguaggugugugguucgcaugcuguagguucccagcugaaagagcgaauguuguagguagucugauacagagaagggucagggcuacaagggaaagcccaggcaacuucugaacuguaaguauuuguccauuaaaaauaccauauuaagaggaaaagauacaaacuacuauagaaauuccuucgucaucuccugacaucuguauucaccagguuucuuggaagggauauuaguaucuuucuauuagacagcuucccuaaauaucuuaaguaaaagaaagcaacaacaacaacaacaaaaucuuaauaagucagugacuaauuauauuagggauuuucagaagacaauugaaaugacccaaugucuugugcuuugagauaucauuuuaucaaauaauauagcuaggugaguggagaccucccauagccagcauugguugagccucuuuugccaagcacuguguauagauuaccuaaccuaauuuccauaaacccggugaaaugggaccaucuuugucauuuuacaaguaagaaacuaggcucagagagauccagcugccugaagucauacaaccaacugguugcagaaugacuaucugaaaccauuugguggcugagaguccaccugaugggcuucacauagcaaaguggaaagggcaaauucauauguucagauguggguucaguguggguagggaauagauacaguggguggucguugggaauuguuuccuauggaagcauggaggcacucuuccaauacuugaagugauuguaguuugagcacauggagacuauuugggaucuaaucagggaaagagagcagucagcguucagaaggugucagcauaacugccuacgguugugaguucccuucaccgcuguugacaagcuucgcugacugacuguccucguuuggcaaauauagagagaacccauguaguaguggcaggcugcugggguggcaagagaucuuuccaccuuuggugguaaagugguggacagaggcagguaucuuaaucacuuugggcuacucuaccaaaugaaccagaaacuguuaggcuaaaugacuuaauccugaguucggaaggcuaggaagagacagagcagaaaaggagagcuguaguuuguuucucucauguuaggacauugauucugucaaaagaacucuaccaccauguccucagcuaaaucuaaggaccucuuaauauggcugugccugcccauuauccuggccauugagcuauggaggcaggagaaucucaaguuggaagauuuaaaagguacauagacauucaguuauacagguuguauucauuugauagucagauguaaauuaguuaaugaaguaaguccauuguuccauuugcuuucguuugugaccucuccuuauauuuuauauucaaacuuuaugugcgggggguaugcacaccuguggagguuagaagacagccugccugccggagauggcuucuucuaccaugugaguccuggagacugaacucaggucccaaggcauggcagcaggugccuuuaucugcuuagccaucugccagccccuugcaccucuuuaagugaaaauguguugaaauauauucauaugccauaaacucagccuuuuagaauguaaaaugcuuuaucaucuuuacaaggucaugcugccaucgcugcccucuagcuccaugacauuugucauccccuaaacaaaacccugggcccaucagugcuuucuggacccgucuccccuaaccgacuaccgacuagaaccuugaaccugugguuguguuuucuacagcucucguggcgcucuccuucaguggggcaauugggcugacuuuucuuaugcugggaugugcguuggaggacuauggguaaguugucuugaaaaagaaaucauaauguguauguguccaugucugugugcaguuguguguggaggugaugugucuuccucugucucuucucuacccuuauuuuucccaccuuacuguuuugagacugagggucuaagugaauuuggagcuugcuuauuuggccagacaggguagugagcuauggggguucucccgccucuuccuccccagugcuggggcuucaggugugcgccgcugcaucacacuuuuuacaugggcacuagggcuugaacucaggucuuuguguuugcacagucagcacuaaccuacugaaccauuuccccagcucucgggggagcugcuuucugggucucuguuccugucaaagccugaucagugcagcccacgcagcaguguaugaguuggugaaguccagguuaggaacucaaccccuucagacaccaguguauuuguguagagaaaagcucuuuuccaaggaaaaaaaaaagauacauucauuuaauaaauaguuguuacauucugagucuggagcagcugcaugugugagaaugaguccugcucccaggagcuugaaguuguagucaggaggaacagagagaguggacaugugcauuucucacgagcaaagacuuaguggguaaacgagucucucugaaucacaggcauagggaacgaucgguagccuucauccuacaccccgcucgaggaggauuaaucaagcagguagaugccucuuuggggcaucauaugcauuguagaggagguuacaucauuugucccagacaacagggauuagcccaaaugugaggcuagguaggagacuggagucagggaaugcuaagggaucacuguaauagaugaaacuaaauugguggcaguagguuuuauaaacugauaucaggacucaaaccaguucccaccagccgugcaggugaguggcuugaacaccuugaccuaaaaugugugacuaagaccagcuggagccaguuagugugaccucuguccuagguuuucuguugcugggauaaaauaccaugaccaaaggcaacuuagugagaaagaguuuauuucaguuuuuaguuguaguucauuuuaaagggaagucagggcaggaagucaagucagggacuggaggaggcaggaacugaaaggccauggaggaauucuagucacuggcuuguuccucacugcuugccacccugggaccacuugcugggguggcaccacacagaguggacuguggacuuccacaacaaucauaaaucaagaaaacacccuggaggcuggccuggaggccggugguucucagccuucguaaugcugcagcccuuuaguacagaugacagcuccucauguuauagcaaacccucaccauaaaauuacuguguugccacuucauaacuguaauuuugcuacugucaacgaauaguaauaaagcuguauauuauacagguucucugauauuugauccugcaaaguggucaugaccuauacauagguugaggacugcugcucuaggcccaacuuauggaaguauuuucucaagucagaaucccucuucucagaugacucuagcuugugucaaguuagcaagaaacuaaccagaaaaacguugcugaauucaaaucuacuguggaguuagaagugaucuugcaaauuguuuaaauaugauguaagcaaaagcauuuguugagaguuuccacagcuauuacuguauuaucguuuagggauauuuuauuccccuuccugacugaaaaccaaagcccagaguaccuugcugauuauacagcaguaacuggcagacauggcuguggcucucugcucugacucuugcccuguuguuccauggcacuguuguuccgggacuaauagaauccaggugugugaguucccuguaaugugcuaugucuccguaagaugagaacagcacacaucauugccaccgcgaggaaacucauugcaugccuuugcgacaguaacuugggauuuucaucugcaucagcaguuggcagccuggccaggauuuuaaggcucuacuugugcaucacagaggcagaguguggagcugaagagaccuguggucgcccagcuuggucucuuacagauaagaguuugccagucuuuggccuucccauuuuguaaauaauauuauguuuaaaauuuguauaugaaaagacuacuccaaguggggggcuucagaaaacugauacacuuuucuaggaagagugcagggcucuuugcugagagacgucaggugacaguuaugucccuuuucuguagcuugcuuccucacuggcuuuguccugacaucaccuaauagcucuugcaacaguacuuucugcugauuucuggaauauaugucuggaaucucuucacuuucaaaugaguuuucaaaugaagagcccacguuccuuguuuguacccagagucaguugccugaaggacccucccuucugcuuccugguuaucauccugacugaguuccuacaucuguggcaucaccccagccugcucagggcugcuugcuguguggguggcucugcaugauuaccaucugccgauggugugucuguuguuguucuguguguuuaugauagugacuggcugguggguuauuuucuuuaaugggugucuaacugaaggcaacaagaaugaaccauuauuuugaaaguacuuauagggaaaacccaguuggaaauuccgugagaauccuuagcaacugcagguuguuuugcuuuguguuagauuauauuugcaaucuacuacuguacaggugggguugggugcaucuagcgagcaaauguacauuuuccuuccacacuaaaugucuuuuuucccuaccuuuucaucaaguacaaauggaaugucccauucuaggcucugggauaaauggagauugacuaagacaaaucauaucucugcuguaaugaucacaaaugaugcugugcagaaagguagagaaaugcuguaggcaaggaucagcuggggucaccuucaggaagaacacagccgugagcagagcccaaggcaggcuugagaccagagagugacgagagaagacugcgguggcuguagguucagagaaugagggugacgugguccagaguggauagaggaggaagcagacauaagguagcagauaagaagccucacuuguggcucuucuaagucauuagaagcuuucaugcauacaugcacucaaggaucuuccugaagcuagcucauguaagccacuguacugcguucuguagggaaagcagaggcgcauuuuuacgauucuguccuuagaguugcucaucagggccagugaugcaggaugcagcucaacaguagagugcuugccuaguauguacaaaguccuugguucauucccccggacuacaaaaaccugcagaucucuaacauauaaaacaguuguuucucaaucauacacugaauaguuguuucuuaauauaggcugcauauguauuaguaagaaagaauauuuaucuaugcuugauagaaauagcaugucugaauuucauaauugauuaauguuuuuacauuugaaauagccauguugaaacaacaguaugccucugaguuaagauguaacuuucuuuuugguuucauccggguucccugaaaacagcguuuacuggccccuguucgucuugauuuucuacgucaucucccccauccccuacuucauugccaaaagggucacauaugacuccgacgcgaccagcagugccugucgggaacuggcguauuucuucaccacugggauuguuguuucugccuuuggacuuccuguuguucuugcucguguggauguggugaguucugguuucuguuguuuuacucuggucaggguuuguuucaagggccugugucugaggccucgaguuuauuuccguugcuuuggcucucuuuggagccguuuguagcuuucguuucucucuccuauuggucagagucuccgucauagcuucagaaugcuuuccugguuucucuuacaacuuuuagucaaagcauaugaugucuugcuuuuuccauacuaaguuauucucuauagucauucuuauauuccugccucuuaagccauggggcaauccauagagucagucaguagaaaggcuuucccaaucacaaagugaaggaagggcauaucaaaggagccagggccugacuucucaggaacucugggauguacugagggauagccagugagugacccagugcgggcuuuuguuuguuuuuuuuguuuuuugacuggcaaauaaagauugugcuauaauuuauucagauucuuugacuugccugcuuuuuguuuuuauucugucaaccacauuggccaucagaaauguacaauuuuguuuauucauuuaauaugaaacuaucucauggacaucuucuauuuaugaaaugccaauaauaaaaacuacacugucagcacucagagaacacguugguggccugugaggauguaugcuaaagaauacugcauguggggagggaagcugguaagaguuccauaggaggaccaagagagaaaggccagcugcugcuccguaagggccucuaaggccaaguaggagucugauuaaaguagggaagguuguuggaauagcacacgagugugaaaaugcaguguguggcauaaagaacagugucgugugauaaagcagaagguaagauaagagcaaggccagaaaggucucugaagucugcucagccagagccccuaaugcugccucagcuugaacuuuacuuaagcacugaggaacgcugaugcucugaacacagguggcucuggccucauucgucagccucaaguuugugguaagucuuccuacuucagccuuggggugguguuuggagaagaagcuuucauagauguuucuguugguuaacuugaagcaaaaaaaaaaaaaaaaaaaaagaaaaaaugcccacuagagggcacucucauccccagcuaugacucuauagaaccaucugcccagcuguggauuauuguuuacaguguaucuugccuagaaaagaagcaaacagauucguaacuuuccaauuucuguucuuugugaaagagguauuugcaccucauguuggaucacugauaaucuugcuccauguguuuuucuugaggcaguuacugcaaacugaaaacaaccaugagucuccucaggacgauauuaaggaugcuacuagacuuaauuaacaagcguuguggaauccauuaaacaugacccggaaguucucuguccuccacccaugacauuccuagccccuuagcagccuugugucaugcuucagugcggugucugauguagaagaauacaaccugaaaaggacuuaucccuucuuuuguguuucagaucaaguggggagccuguggucuugugcuggccggcaacgcugucauuuuccucacaauucaaggcuucuuccucgucuuuggaagaggagaugauuucaguugggaacagugguagccccuccuccccauggaaagcauugagucuuagaauuuguacuguacguauaugugugcacauguguuucagauuugaauaugcugaguuuuuuuauaccuuuauaucaugaucaucuuagggaagauguuguaaacaaaagaugaguuuuacuccuggcacacaggucacuccauugacucaaagugaauuauuuuuaucuucuagcuuccagaaagccuguuacuauggccuuguagacagcugcucacuuauccagggggucuaaaccuuuugccuuggguuaggcuugggagacacuggggcagaucuccuacagcccaaacauagguggcgcucucccuguacacuuagacucaucucauccacacagagcaucagcaucugcuaggagcccauuggggaugcagggucagacuggguaacuuugaugcgauugcacacuuggcgcacgcacauugacgggugaggagguuuguuguagaggaauaagcaucauagcuccccugcccucucuggguguugcaugcucauuugcaggaaaaaaaaaaaaaucaccugcccccugcugugaaugaguucagacuucagguguuucuaacauguucaauacuuguguuguuccucaaauuugggggaccuguucuuaggcaggaacagauaagucauccaaaaggcaguggcugauugcucagaauaagauacaaaauaaccaaaaaaccccucuggggugcaaggagggaaacuuggcuggaauggucccuacuuuaaguggagggcaggauagacaauucuuggaaaugucccucuacggugccucccaucccccaugcagcauuugguuugcucuugguggugggucuccugaaggguaugaggcaagagugagcagaggggagggagucacugaaguuacacgcuggugcacuuuucauccuugauauugaacuugaugucaccuccacaggacacacagggauccacaucauuuugguucuuauaaacaguuuuucuagcucaucuuuuuuaucuggagccuacugggagaaggaagugagaacuacaagcacccagucaggaugccaucagcgguguuuaagcauugaugcugcucgcuaaugaguguccagagcacucucccuugaggcuugcgguccaaggagucagcauccaggccagggcuggugugacgcugggaccagcaggugaauggacagaggacagugugcaauguuauauuuuggccuugugcaugacauuauguuuugaauauuuuguguacaaauagaauuguuagcguugucauuucuaguauuuacauuagaaaaauuauuuagauacuugaucauuuaacuggcauuuuuaaucaugacacuugcuauuguaauaaauuugacuuuuaacacugaag

SEQ ID NO: 2006 - RNA, 1043 nt, Mus musculus
acuuuuuuuuuuuuuuuugguuucuugucuuuuauuauuggcaucagcuggacuauauguggccuuaaacaucaugcacuggacaggaaagaaagaacgagaaaaaggacacaggaggggaacagggguagcggcgagauuccguaauuaaaaacuguaauucauucaauagguuaaguuuuggcauuaugaaaucaaacaccccuccccaccccccaaaguugcaacccaaugagagggucacccguggggcccagccagguguucugcguucccucccaggcugugacaggcagcguguggguguaauucuugugaauggucuuaacuuuucacuuucuuuaaucucuuuugcuucuuagacguuccgguucacuggggugacauaauugcggggaaacaugccggucugcccguggcaggccccuuuccaccaauugggaucugaguuauccaugacaugaaugaagucuccucugcgaaagcccagcucgcaguccuccugggggucaaagucgaagagcgccuggacguagguuggcugcuguggcaucuguucuaugucccguaagaauaucugcugguuccuggacacggauguugaucugugguaaucuaccagcucauucaaagaauuaaacuucaccaccgacaggaaauacuucccggcuccaucacggagcacccugaaguccugcacaucauuuccaaacuugacagacagggagaaguccccaggagcgcucucgcucucucggaucaggaaggccccgucaugccgcuauuugcugagcauuucuucugccuuggcucuggggauuuugccaaaaaaacacggaugugguuucauuucuauguaauucuuggggaugaagccaucuuucccauugaggucugccuuauaccaguucuggucacauucuucauucaaaaccuuaaggaugucccccccuuuugaagcucagcucaucgucagcaguagcuuugaagucauauuuggcgauggcuuccauugugagcgccgcucagugcucagcagccuc

SEQ ID NO: 2007 - RNA, 1598 nt, Mus musculus
cuuuuauuuuugaaaugggguuuuauuauguagcucugccuuccuuggaacucuuuauauagaccaggcuggccucaaacugagagaucucccugcaucugucucccagaugcugggauaaaaggucugugggaccaagccugacuuggcucucagacaugauuucuuuucuuuauuuggcaugcugggguggucuucucuaaaaucaucuucugacaaauaaacagggcucaucucuuuccuaaacaguucucaauuucuuugagcagcagguguguguagcucauguagacuccaccuuuguuguggauagccccagguugcuucauuuugaugcuaauucugcucuccugggaggggcugcaaauguggaauuagacaaguacucaagugaagucuugccuaccuucucccccaccuuaauuuguaaaauaaaggcuagagcuggugacugggcagaaaaagggaagggggaacuaaaaguugggaaaagacauagagaggggggacugugauguaggaggaggagguggaaguaaaguggagcugaagcacuuggccuggagaaaccucaaguuacaagagauaucauagauggggaauacaguaguguagugguagaucugcccaaucuaggcacgcagcuaguacucauauuaauuagguuguauuuucuuugcuaagucuuauuuggguuggagauuuaucacaacaaaaugguaccuaacauaugauuauaacucaacuaaccugagauaaaaauucacccccacccuuccccaaauauagcucaggcagcaaucuaggcugcaguggauugaaagcugacugggucugaggggccuacagagaacagcagagaagcucccuccaccaacucccagacagagaguuauggccaggggcagcaccccagacuggagcugggcuugagcagcaccuuauaagaauugcauggagggacaggaggcccuggaacacaacuggcuuugagguagguguagggcagacacacugaacugaccugaacaucuuugcccaagagagucuguguuugcuuccccauaucugccacccccuccaccauccugugucuaggacagcugaaggaagaugaaauauuguaacuugugaguuguuuaggagcccacugcccaggccugagacugagaacaaagcagaacagcccccaggcaugccagggcagggcuguuuuuaaggcauuccuaagagcaccuugacuguaaagauaaaaagguaugcaaggaccagcagggcuauauuaucuaagucaacaccaucuggccggaaccuccccucugucuauugccccuugacugggguaaagucauacaucaacugguugcuaugugaacaaagauaagcccacaggaacaaaguccugaugcccugugaucuuucuguuaauguuuaaauaagccaauagugugucgcuaugcugaauuccacaccccuaagccccuuaccccauaaaaaccccuagcuuucaagccucauggcugacauccauuaucuccugugugggaugcaugucgguccagagcuccauaauuaaacguccucauguaauuacauca

SEQ ID NO: 2008 - RNA, 58066 nt, Mus musculus
cggggcuugggaaaggugugcgccugcgcggagccggcuguuggauuccgcucgggcuguggcuucagugcgcgcucacggugacggcucggcguucuuccagagcggggcggggagggcggagaggggagcggggcccgggggauucggggaccgcggugggccuaggccgugccggacgaggcgaacggcucgguggguggagcuuucuggaaguuugccucccgccucgggugguggcuuccuccuaagcggcgcuuccuccaggcguugccggucuggccugugcgggucuccccuccgccucgccgcucguccuugugcagagcgacacaugcucuccugccccagcucgcagcauuagcgcagucggagcaguuccagggagcucauugguuuccucaaaaacuuguauucaaggaucacuuguuauaauacuuagcacucgcggugugacggggagcaacugugcuggggcaaaccuccgccagaaauguuagucccagcagaugaaaaccccacauuuggaauuuaggaguucaucgccuccuagcgucucucaaggucuuggagcccucuuaaaaggauuuaacuucauaggcaucaucccgagccaagaugcaggggugcggugugacauuuggaagcuuaagagccaacccugauaacuuacuuuuuuuuuuuuuuuuuuuuuuuaagaagcuguccaucauguguacuuagcuggaaugauuauuuuaaagugcauguccuauuuuugccaaucugacagcuguuuccauagaaacuagagaagaaauuguaguuuucaguaagaguuguuaaaacugucuccuagccaucagcagugagugcgagugagugcgcacuacuugcucauucugagauggcacuugaagaacuaaggguuugaaauguucuuagaggcuagcaauccaaauuguguaauuuucucacaucauuaauuuccuaauccuacaagucugccagcuauguuuguuggccugccacaguucuuugaagagcacacgucagucccaguucuucuuaggugcuguguaguguagugacuggcucuuugaaaauguauaaacagauuucuuuccccauuaaaaacauuuuuuuuuugaaggauuaaucagugauuacggauuaacaacuacgguuucuauucuggauggcacuugauugccaguguuagaaaugcuaaugauuuuaauuauguaccuaguguuuggagcuuuuguuuuuaccuucuauggguagacuacguuaaauauguuugcaccugcucugaaaugagcacuuuucucaugagcagauagaucccagcaguucgaauagggugcaugacauuuggaagagaguuuauuuucugaggggggauaucuauacacuagauguucugucauuuagcaguggaugaaggaggcuuggagaaggugccuuuggaacugggaagcuggaagcaacauuaggaaguuuauugaaaagcucacagauaaccaguggaaauuacagaagagcuugcuuggcuuaggauucacaaaguaacauacccuguaaacacuuaaauugcccagaaagaggaaauacuggauuccucauaaacaccguucugcccccugaauuucacguaggcuuuuuauaagacuuauaucuguaucuauucguguguuugucuuuacuagcuuuacugauugggcaggcauuuuugucuugucuuugcuuuuuaucugcuacacagaguggcgucugacuuguagcauucauuccuauaaugauuuaucaaugaauuaaugaaucaaugacuaaaacaauccuuaaccaaugagauacaggaauguuugguuaagaugaucaacuuuuauuaauuugguuggcaacauuuuaaaauagguaaauuucacauuaagacugaauuuguagcguuugcagaaacguuuguaacauuuggcaacauaaaaaacaaauuuuguuauauaguugggccuccuuugugugacuguucacaucugccuggccuugcugcagcuugccugcaucuaucacacuaacccgcacugugcagagcuguccucuuauucauuuuaauaaaaaugaagcagaguacaaauugugcuccucauaugcaccuagccacacgccagggcugccauaguggacagcacagggaacauucuauaggaagucuuauguaguguugcuuuuggcauuggacuuugcuucuccuguuacccuguuggacugaaguuuuguuuuuaaauugucuugaacagcucugugacucaagugcuagaguacaggcucgcucuucucagcuucagggcucuugcagguaguagcacguccugcuguuuguagauuagcauaucaucuugguuauggaucagagcaauguaucuuaauucauuucuaaagaaaggguuucuuccuguaggcuuggcuguccugggacucgaucuguagaccaggguggccuugaacucacagagaucccugccagcuugugcuuccugagugcugggauuaaugguaugugccaccacugcccaccugguuugauuugccuuccugagggauugcuuuagguuccuuagaggagggguugguagugaacuaaagugagguaguuacaauauaguaaaaucucuaacucgggggcccaaaaguaggaugagcugggcugagguagugagguagauuggcagggcugacuuaaagugaccuuugguuuuucuggauguuaacauccuaaggcuaagucuguauaguugggaacgugguuuguagaagauugggaaguuggaguagggagcaucccucagauugucucaugacacaguuaccauggaaauguuaacuugcacaugggucuuguacagcugccuccugccaugggaauguugagcucauuucuagguaagacagggagacugggugaagagcaggagcuaccuuagagagccucugaagcccaggcagauguggaaagcacaguagggucucagaaccaugaaggccuucaggcaucuucugcaugagucgguagucagccugucucagcccugccuuccccucccuguggucucucacauaugguagguacguuucgucguccuuuucugugcaagccugugcagagccuuuccucccaggucuagcuuaccugcccuuugugugcugcggcaccaacuauaggcccuacgugggucuuuguauucauaugcuggauacggcguaaugugaaguuuucucugugcuaagugucuaccgaugucuuugagaccaauggcuacuagggacuaacaugaccuccuggcucauucucuaaguugaggucaugccuggacaagugucugagcuuuguaacaguaaaucaucagauuugaagggaagaaauguauucaugucauuuuuauaguuugaucucuauuaaaagagcuuaaauauacuuuccuaugugaaacaguucaauuuuuuuugucuuucuccuaccagugucuuaagaacgacuucugccuuguguaacuagcuagcucacugcuuuaacacguggaauuuaguuauaacaacucgaauauccuugucuacuaauacugccauuuguauuagauaggagucagcuuccuuugauuaauauuucuuuaauucugugaaucucauuuucugcuugguaauuuuaaauugugaauuacauguugcuaaauguuuauuuuuugauucuugaguuuuuuuuguuuuguuuuguuuuguuuuuuaaauccaagauguggcuauuagaagcagcuugauccuuuagagugcuguuucucuggguguuuguuuuagucuuugcuauuggggcuagagcagcucucacauccgugcuggacucuuuggaguuccacccaauuucugugaauuacaaaugggaacuuuucccacuuugaucaaugggagcagauauugcacccuggccugugcauugugcccagaaauuaugguucuuugcaagcuucagggggauuucuuauucguaugcccagcuaguacucagcugcauagggaggccugcagagaagggaggggcuugcagagaccuugaguucucucuuuggguuuuguguuuccuucugcccauaagcucuagcugccugguccacaggcgugcccagcaucacaccuucaguuuagggcacuuauaggcguaguccuucucuuaugugugguuuggagacucaccaaagccauucucuggggcaguuguagguugagucuuguuucccaucauucaguccuucuuugccuaccccccaaguauguggaaauccucauuuuaugcauucccuuuaaaaagucaauuuuagguggcauuaaagucccucuuuucauccugauucuaaucaaaagccccauggguuuauuggaaugaguacauuaaaagucuuaaagauaacauuuuuuuuuaaguuagccuuucuaucccauuauacucuuauuacugucaacugauucacauuuguuguuuuaucgaagcuauuucuuauuuugacaaaugauuugcugaucaaauagagucccugcaacuaaaaaaaauauaaaauguuuuuucuuaaaaugaagugaaaaaauucaaguguugaaaguaagcacuguguagugagcugaggcugugugcguuccucuggcuuguccuguugaaggugcugcugcgcguggugcacugaaguacaggcaucuacccugacgcguucagcaugugucuuguuucucuccucuccucuccucuccucuccucuccucuccucuccucuccucuccucuccucuccucuccucuccucuccucuccucuccucuccccuccccuccccuccccuccccuccccuccccuccccuccccuccccuccccuccccuccccuccccucuccucuucucuucucuucucuucucuucucuuuaaaaaagauuuauuuauuuauuaugugcaaguacacuguagcuguuuacagacacaccagaggagggcaucagaucucauuacagaugggugugagccaucaugugguugcugggauuugaacucaggaccuuuggaagagcagucaugcucuuaaccgcugagccaccuugccagccccucagcauguguuucuuaagcauuacauucccaguuuguaaauacauguuuuccacagguguuuauaucuuauuuguguguguguguguucuagauaaccaagcaaaagaaagaugagccuccuuuauggacugcagucuaccaggauaaaucgguuucucucuggagugaauaaccuggccaacaggagacaguggacccccccagcaagcuguccacuggcaccaaagcuccgagcaguaaaugcauacuggggacugaacacagucagucauugucauucagugaccuuacugccuagaaacuuucuuuucuguaggacucucaaucacaaaaaaucaagaugccucucaagugcccaaagcaaggaauugggggugcuuaccuacagauguacugugcggggugauucuguucuaagacaaggagcaaggaaaguggcuggcguuccugcucucgcggccuccuguucuccaagcuguccugccguaauagaggcccggaguuuccguacaucugcaaggguucaggcugccccagucccucucuugcugcucauucugaagccagugcaaaagcuccuugcuaucaucgugggcagguaaauauacuuuggggggaaaacaguguuuguguuaaaguucaugaaguuuuauguucacauguguaucaacauauaauacuuuuuaauaauuaaacuuuaguauuuauaaaacuacuuuuaaggaaaccuuucccuaggccauauuuagcucaaaauuuaaagguaaauucuaucagucuuguguguaugauuuuaauaaucuugaaauauaauuuguugcaaauuaauugugcacaaaugugauccuuaaguuuuguugguugagauauuucuaaaagauuucacauuucuaauuauaaggauaacgggcaauauugacaaugauuuguguaacaacagcacuuaagaacauugcccuuugauuuuguggaauuuuaggcaguuggcaugaaaugaaggacuucauuuauauaguuaggugcucagccuuagccacgcugauaaagcucacaccaccauucuguuuucaggggauuuuugucacguuucucuugguaguccuuucuaacugugcacuuuauauccaaguggcuauuucucaaccccuuuuccuuaguucaugaaggcugaagaaagcaaaucugucucuucauaaaguuuugcuaaguuggcuaaauaugccgacccuccuugccagacuaacaacccagucuacuuuuauucaaaauccaagacuuucucuguaauguauuuaauucuguuguuugauguugacagaaaauggguaucuacguuggcuccugagaaacaaacucauccucacuuguaggaaugauugcuuugugaggucuaguccuauaaauuguuugaucuuggugucgaucuuacuauuauacauuuccucuuauaaucuguuacacauauacuuaaguaggcagugaugcuguaaguguuguaguaggaaaugaguauacuucauuguuuuguggcccuucugguucagucgcuuucucuguguuagucggccucggacacuaugaugaaauaaccaagauaauaagggagcgaggacuuauuuugguucaugcuuucugagauuuuagucugugguugcauaggcugggcucgcucagugccuggugugggaaugcuuggcagaggagacuuguccauuucaugauggucaggaagguaaaggcagaagcaggcaguggcugggguucuaauagccccuuugaggacaucucuccagagaccccacauucucuuacuaguuccuguuuccugugggucauaccacucccaguagugcaacaggccaagggccaagccuuugauauugaauacauagacuuuugguggguacuuccaaaugauagcagggacuuaguaagauuguaguaacuucacaaaauuguuuuguagaaugaauucuugucaagagaaauuucacauaugugugugugcaugauaaauuuuaagacuuaaaaaaaguguauccacaaggaaauguuuugucaaaauguuuucguaccuagccuggcacuuuagagaaccacuguccacuacugccagccagcaaggcccuccccagauggcuucuguaacagcucacuuuuauuacucugguacuucaccuccccuacucccccaggacgguaguggggcugcugcuucugagcagggcugcuuauugucggucagugcugagguagugccuccgguuccuugcuggagccugaggagccagugggaaagguacaguuuauccuccaugacuccaagaugcuugucugcggacuucauccuuguuaaguggucagucugggaauggcuuuccccuuggcuagguuuuucucuguaacaagguguuagaaagagcacacgcauagugauuaggcagcacuuagcauaugguaaauaggaaguguuauuagugggaguuguaacaacacugcuccuuauucuaggguuuuccuucacauuagcaggugugggaaagccuuaggaguuuuaauuaucauuuuguagagucgaugacuuuccauucucuagcugagaguuuucuuaguuaaagagcuauguguacagaagcaaagguggaagggguugguuuuggugaggugugagcaugcacuuacagacgggccauuucugauuugucacaggggcauaaggaaaugguggcaagcacuucccccuaacaagaaggagcuauuuaaagacagcgugaggaagaacaaguggcggcugcuucuuggucugagugcauuuggacugcucuuuguaguguuuuauuucacucaccuggaagugagcccugucaccggaaggaguaaacuacuguuagugggcaaagaacacuuccgacuucugucagaccuggaauaugaaguaguaaguagugagaauugucuguaacuacacugcacaagcuaacacacaaagcaggaagcuuuuuaacauacagaagauacacugcuuuuaguuuuaguuuugacacauuagucaucuccuccaaggucucccauugggaaagguguuugcacgugugcauggcuguccucccagccagccggcuccugcugugcugugcuugugcgucaugguggccccacucaggaaagccuuccccgaugcucaggcuggauccgacugcgacucagcccauagagcugagaacuggacuuuuguggucuuguuccgugcuuggcaggacugcguuaggucccaguuuuccuucccuuugucuucuuuacauuauggaacuuuccguggucugugcccuucucccuuuuuagccuaagcucugugggaccgacaaccuuguugguuuguuuguucuaggaucuaacaccaugcaaacuagugcuuaguuuuuauguaucaaauaaguaaacaugcugugagaauuuauauaccucgaaagucagguauaagauaguuguuucccaaaagucaguuuugacugaaauuuuauuguauuuucugccaauuuuuuucuucuuaaaacagaguuuugcuauguaggguuggccccucaaccugugacccuuaugccucagccuccuaagcaauaagcucgcugguaugugccccauaaucacuuguuuucugaauagaaaauaauggugggauucagaaaucucagcucguggagacauacagucacaauguguucucguguguccucaaagauggacaucauuguguuuuaguaauuacauccagggaagugcuggaugcuguuguugaauggguaauggcuucgggucuucauaugcuuggguacaaaugaacacaugaacuuagcaaaguuaucacuaauagcaaugacuuuuuugcuauaaaaguugaucuuaacuaagauaauaauuagaagaauacaaacaaauuuaaacuaugucuuaaaaucuagucuuaauaggaagacagguuugagaaaaacauuuugguaagauuggaacaaaccuugcaaaaauuuugaaguaucuucuacuauucagauaguuuaaaauacaugcagauaugaauggauuugcauauaugaauacuguauauauacacguggaucuguauguauguauaaguguguucauaugaauagacauuuuuacugcuuaacuuauuggucugugaauuuaaacaucuuauagagcuguuauaaaguacucuaauuacauggggugcaaacuaguaugcugucaacuugacacaaacuaaaaucaucugagaggagagagccucaacugagaaaaugccugcauaagauuggccuguacauagucaggauggggcaauggauugaugaaugauugacgugcaaggucccugcucauuguaagcagugccacccuuggguagguggcccugggguguauaagaaaaugaacuaagcaagccauggagaccaccaggccauucguccaugguuucuguuucagucucugcuuccaaguacuugccuugaguuccuuugaugauugacuguggacugggaguuguacgcuggaauaaucccuuuucuccccaagugguucuugguuguggugucugucacaguaauagauacaaacuaagauacagauaagagucccuugauuguuuucgaagaguuaauagaagacuuuucuuuacaacuguuaaauuauucuuuaaaaugauaauugauguagucuuuaaguucauauucuaugaagucauauauuuuaaugcaucuuaaaaaggcuaucaacuugauuugaauguuaaacuauauaguuuaugaaaauuaaguauuuguagaauauucuuaauuuucucaguauauaugagagaaucucucacaaaaagcuucagaaaaaguguuuccauguaagagaugucuaggcauuugcaucagcauuaugugaggaagugauuugcccauuagcucugagaucuuagugauuuucuuucagucucuauggaucaaacacgucauaguuagugagauauuguuccuuuuguaaaagcuuaagucaguauuaugaauagcguguucuuccauuuaguggauuuugaaaguaauuaauuucuuuugauccauccuuccuuccucccucccucccucccucccuuccuuucccucccuuccccuuuuuuuucuucuuuccuuccuuccuuuuuugguucuuuucuuuuuuuuuuguuuuuguuuuucgagacagggucucuguguagcccuggcuguccuggaacucacuuuguagaccagguuggccucgaacucagaaaucugccugccccugccuuuugagugcugggauuaaaggcgugugccaccacgcccgggcuuggcuuggcuuggcuuggcuuggcuuggcuuggcuuggcuuggcuuggcuuggcuucgcuucuccuucuccuucucuucuccuucuccuucucucuucucuucucuucucuucucuucucuucucuucucuucucuucucuucucuuuucuuuucuuuucuuuucuuuucuuucugacacuggguucuuaguaucccagacuggccuuaaauuuacugugcagcaggcauggccuuauacuuguaaucauccugguuccuggucuucaguguuuggaccacagggauguguaagcacacuggguguauguagugcugagaaccgaacuguguucuuguauaugcuaugagagugagcacucuaucaacugagcuucaguuuucuuuuuuuuauaugagauuuuuuaaugugagaucuagucagcuuuauuuucugaaguucuuaggaaaguagaaauaguucauuuuacuuggcauguagacuaauagaaaagaauaaaacuuggauugaagcauguuuauauaaaaaaauuauaauuuauuccuaugugagaaaccauacugcucucccaugaauaauucaaauuucagaaauuugaguguuuaauauauguaaauuuuugcacaguucaagauuaaaugcccaauacucaucagauacccuuccaugaggcagcagaagcauuuuguagugaaaaaucucuuaauaguacuuuuuaaaaaaaucuucuaguggauggaagaauuuaagaacgaucugcugccugagagagacccccgcuaccugacugugaaagaaaugguuuaucaucugacacagugcaaucgagacgucccggggaucucggagaccaacugggugguucaugugguugacuccccagccgucaaugccuuugugcucccaguaaggaaauucuuuaugcacguuugcuguuguugcugcuagcuugagcgucuuugaguuuuacugugagcuaauugcuuauccuauucucucugugcagaauggacaaguguuuauuuucaccgggcuucugaauagugugacggacgugcaccagcuguccuuccuccugggccaugagaucgcacacgcaguccuggggcacgccgugaguaccgggaugugcagcugcugaauguuugcuuugauauuagcaaguggaauccuuuaaggaacacagucuuuucuucuuucaauuucuucuucuucuuuuaauagaugggacguaauugccuuauucuguaccugaaaaaaugugauuagcugauuucgagaauuuuugcagucuuucguauaugauccugaauaauuaguguuucccuuaaauacuguuuuuaucaccugucucuuuugcuaaaaaguaauuagucucagacucuaauuauuucacuuuaaguuuuaaauuuccauaauuauuaacauacuuguaaacuagucagaaaauuaauuguuguaaaguuauacuacuauuuaagugguaaaucaguuuuauucuuacuauuuucacaugauggcuuggaauguuguuggaaaugccuaaaugauaugcaauauggaguuaauguggaacaguaaugacaugggccgauuaguuuacagaacuucaucuaguauguuccuucucauucagagcuuuaacuuauaaguauguauuuaucaucccugguuuuuaauauuaggaaacuaacauuugaaacgacuaaugguggccauguagguuuuaauaaggauguaaaaauggaugucuuuuuguauucauuuuugauugcuauucauuaaaaauaugaaugaaucuuuuauguauauaacuagagaaaaguauauuuuuuauuuuuaaucagaacaugcagguaaauauuugugaaaggauuagugcaugcuaaauaauaagugcaaauaguauaaacuucaaauggaaacuaucguguuuauuauuaaucuuccucaaagucuuuucaaauucuaccuaucccuuagaggaauaguaagaugaggugggccaauguuguucuuuuuugaagcaucccugauuucuuuugaucuacaggaaaaagaaauguuuccuaaauagauacaagaauaaaucuaagccauagaaauaguaucauuauacuguguucuaacuucucucaaauacuggugucauaaacacuggugauguacuaaugagugacacagagacuuucuccugguuugacaagcaugggcccaugcuugguuucuccacucucucccugugaacuuggugcuuagugugcaugugugugugcgcuugcuuguuaugugcaugcaugcaugauauuauauauauauguguguguguauauauauauauguauauauauauauauauauauauauauagagagagagagagagagagagagagagagacagacagauagaccuaucucucccuguuaccuguguguguuugaaucugugcugugucucuguuuaugccagcauagcaaacaggcgcuaccauccuauaucuacauguuaguuucaacauuuauagggcauuuucggcugcuuucaaccuguuggcuauuuucagcaagcgaucacaauacauacacacauuauucugggucuggcauagaaaguaacauaauuuaagauuaaagcuauacauuaguucagauuguaaaagcugaauguauuagaaauucaaggcauaguaagguugguuauauugcuuauuuuuaaaaggcagguuaaacuuacacaguaggauagcagguuaaguauguaguguuaaaugaccuuaaggcauguucuuuuaucaaauugacugugaggucuagaaaaguucauucuccuuggggucaagagcuuagcuuuggcuguuguagcuuuaaaauguguuaaccauuccccuggcucaaucucuggcauccagccugggccugcugucaguggaaggucaccacugccaccagcgcaagguggcgcugaugagacaagggaggcagggagcagcuuuaauggaaagcaguuaacauugagaugacaaaggcucuuugaucaacgcaguguuuucucuuuuggaaauccuaguuuucauuaaaucagcuauuaugcuguuuccuuuuucuacaaauagacaguucuaaacucuuucuaacuuggugugguaguccaugccuuuaaucccagcauucaaggaggcagaggcaggcagaucuguguaaguuagaguccugccuggucuauaaaucaaguuccaggauagucagggcuacgcagagaaacgcagagaaauccugucuucaaacaagcaagcuagcaagcaaacaaacaaaaaacaaagccaaacauaaccaaaaaaguuuuuauuuuugaagacuaauaacaguuagacucuuaauaaccauagcaagcaaggcauuucucuucauaaaugcuuugucauuuugacuucagucuuuugugguaaaacaguucaauaauuauuuuacagcuaacagcuguuauagugugauaguugguucugugaaagauuauauugaugggguccuagucugacuuugguguguggugaguaagcccaugcauuuaccuuguauuaggcauuguugugcagaauacacuuuauauagaccuuaacugguuagugcugugauucugcccgaaacucacagaauccagcucucagugacaaauaccaaacuuacacaauuaaaaacuugugucauuguacuacgccuuuauguauuaggucauaaaccccaaaacuuuuauguaaaguaaauuugaaaucuucugaguuuucauguguuagguggauuauauauauauguauauauauauauauauauauauauauauauauauauauauauauacauauauauguuuauuuuaggcuuuauguaacaauauaagugcaaugaauacuuuuauuugauuuguagaauauagugucuacauuacauaccaaaauagccuuggcuuggauuuuugguccuuuuacuaauuaauagcugugugaauugggacaaucaaaaaauuuccauuuccaugaucuaugaaaugaggcuuauugaacuagaagaauuguuguaucugcucauauaagaaacuguagcuuauugucgcugucuuuggcgaugaauaauuagcucggugaaagugguaaacugucauaaaggcauaaauggcucauagcguguaagcaaagaaaagggacauuccaggagauggcuuggaugugaggggagaaauuugggucuuugguugcugagauggcucaacaaguaacaaugaugccccaagccugacacaugucugggcuuacauauggaugcagagaacugacucccacaaguuguccucuggccucuuuguacuguggcguaccgugcccacauauauguaccacaaaaaauacauauaacaaauuaaaaaaaucaaucuuggcuuguguuggccaguugagcacacaaaauuauuuaguauggcuaaauagugucuagaaaguacaaauauguacugucuccauuugcuaauuguggcugucauuauuuugauuauucuuaggcagaaaaggcuagcuugguucauuuacuggauuuccuugguaugauuuuucucacaaugauuugggccauuuguccccgagacagcuuggcaguuuugggccaguggauacagucaaaguugcaggagguaagucugagauggucuguggugagcaugcaacucuguucgugugaagcagugugcaucagaauuuaaagucuguccuagugacaguacugaguuuagugucugcucuacccuauaggugcugcucccuuauagcauuuaauuaagaaauacuacaucugugugaugauuuuuaaggauugauuaaaagagcuacuguuccaacuuugggcuaauuaauuuucuuuuuuaaauucauaguuguugauauuacagaaagaaagccuagucagggcucccuucucuuuguucugucacugaccuacuugcugucaguggaguugaugggguuuccccuuauguauaaguaguugcuuuuuaaaauaacagaaucauaagagucgauguuaacaagggcagugucguuguuuuucucuugaaacacuaaaugagccccaccucuugagcacggcuuuucuauguaauaauuaacuggggaugaaccagggguuccgcuaguguggauucuuuucugcugagcugagccccucagugacuguugucaggagaugcuguuucucuuggcaagcccuucucaccaugcuuugugagcagagagggaugcugucagcgcugcacuguggagugggaauggcucacauuccuugccuuucacuuacgugguggcugcuacacuagggcucuguuaaaacuaccaauguuuugcucuggauuauuauugcuguguggccuuguccugguauuacaggguuuuuucuugcauauauggccccuacucaguagauguccauuuaucuugcucuccacagugucucgauggcuuaggguuuagagccuauguucuucuuacagaggagcugaguuuaguuugauucccagaacccauauggccaucuguaagcaggggauuauaugcccucuuugcuuucuuguguaccaggcauacgcacgguguacuuacaugcauggaaaaaccacuuauaugcauaaaauaaauaaaccuaaaaguaauaauuaaaauaaaugccucugcuagauggcauagugaugcacaccuauagucccaguacuugaagagcuaaggcaggaaggagguuuuccugaguucaugaauuugagacagcaugaccuuauaacuccaaacacaacuaucuccaagagucaaaaucaccuaucuacccgguuauccacccacccggucggucagccaccacucacucacucacucacucacucacucacucacucacucaggauugaaaacuacuuuuuaaaagcguuuuguguaguaccaggcacaaaguaagaacucagcuaauaggaaugauuauuuuaucauuggcucauguaauacucuguauaaaucgaggagcuuguuaccguuguuagcuucguuuugcauguugcccugugaguucuucuuguuaccguuguuagcuucguuuugcauguugcccugugaguucuucuguugaagcugaugcgcuaucggguuagcacagucgguggcacacacucagccugcccugagagcugacacucugccaugcagugcuucagcugaagcagauguagccgagcgggaaggaagucauguucugugcucacauacugugaacagcaguuuagguugcuuguauccauagcaaguauguugcuggguuuggaaaguugcucaguggauaaauagcuccuuuuuaaaaaguucugcuuaucaauccaucuccuacaaaguuuuaggacuuacugcaaauuaaaauuuaauuggaaaacauacucauaaauauaaguaauuaggaaaauuaaaguuaggauagcuguguuuuuuuaaaaauugaagucaagaaggaaauuuuauuuuacuaacuaaucaauauuuagaaaaggaaaugaagauaauccaucagagaagaaccucugcuuugugauuaguuugcucacugaaguuuucugcuagugugacuggcucucauauaccuacauuuucucgauuucccuuuagaauugugacagauuaacguuucuuggccauaguuaagcuugcaccagugugugcacuuaggcagcucucuguucagucauggagaauaugaauagaaaaggaaagaaacaauggcaacccaggcugugggggaaggcaagggccucauguucccuauugucauguuuaaaguaugagucuaauggcagaaacaaaggccacauuuacauuuuauaccuuagaggacagagauuucauacuagauuuucagugaaauuaguuuaacauacauuuuuaaauuccuuugaucaugaaaugaauuugcuuaauggaguuuucuguccuguuucuucuuaguacauguuugaucgaccauacaguagaacauuggaggccgaagcugacaaaguuggacuacagcuggcugcaaagguaaaguggacaguagcucaaauacagugucccucauacaguugacaaaaacgugugcuguuuuaauguuuggcccaagugcaggccaaacauuaagacauguacuguguuaacccauuguaagacucaucuuuauaauacuauaacaaaaugcuggacacagcucaguuauaauaagaagagguuuguccacagguacggagauucagaggcacggugauugccuccauugguucaguuguaagaauagaagaggguggcacaugucaagaucguguguagaagcaaaucaguuacauccagacaaaggaagagaaaaagagaguacagucagggaggcacaguucccuuucaagggccuguccuugccaucucccauaggagguuggggcuaggccuuuagucauaauggacccuuuggggcuacuuagaucucaccaagccauaguacuuuuaauguaauuuucauaaaucuguaauauuugaagauuguaucucuuaaaggaauggaugaaaauauucaacucucuucuccauaugaggcuguaauugguauuauauauuaaaaguccuuuuuuucaauaauuuauuuuuuuauucacuuacaucccauugcagccccauuccuccuccccagucucucccuuagaaauuccucuccccauuaccuucuucccuucuccccagagaaggaaaagugcccccuuagguaccacaccacucugggauaucaagucccaggaggacuaagcccauucucacccucugagguucagccaggcaggggauccaauggcaggcaacagagugagagacagcuccugcuccaguuguuaggggacccgcaugaacaacaagcugcacaucugcuacaaauguacagggccuaggucucguccacacaugcacuuugguuggugguucagccucugugaucccccaugggcccagguuagucgacucuguaggugcucuuguaguguccuugaccccuccagcuuguucaguucuguccccacucuucuacaagacucccugagccccgcuugaugauuggcuauaggucuuuacaccuguucccaucuaacgcuggaugaagccucucaggagacaguuacacuaagcuccugucugcaagcauagcagaguauuacuaauagugucaggaguuggucucucacaugggaugggucucuaguuuagcagucauugguuggccauucccucagucucuguuccaucuuuaucccugcaugucuuguaggcagggcaaauuuuggguugaagguuuuguggguggguuguuauccccuucccuccacgggaaguacucuuuggcuacaggagguggccacuucagacucuauauuccaugcugguaggaaucucacuucccaaagccuucuggucccaggccuccagcuagucccagagaugcucccacugauauccauucuccaagcccugucccgccccucaacauugccaaacucagucugugaggccacaggcacccugauaccugaaccacacaaagacucaacaaagaaagagaauuucagaucaguuucucuuaugaacauugauguaaaaauacucaguaaaauacuugcaaacugauuccaagaacacaucaaaaagaucauccaccaugaucaagggcuucauccuaaggacgcagcaauuguucaguauaugaaaauccaucaguguaauacaccauggaaacaacuggaaggaaaagaaucacaugcucauuucauuagaugcugaaaacgccuuugacauaauccagcaccccuucauguuaaaaguccuggagagaucaggaauacaggggacauucauaaacauaauaaaagcaauagccgacaucaaauuaaauggagagaaacuucaagcgacuccacuaaaaucagagcuaagacaaggcugcccauucucuaucuaucucaucaauauaguacuugaaguucuagcuagagcaauaagacaacuaaaggagaucaaggggauacaaauuggaaaggaagaagucaaaguaucacuauucacagaugauaugauaguauauauaagugaccucacaaaaaaucugucagagaacuucuaaaccugauaaagaacuucagcaaagugucuggauauaaaauuaacuaaaaaaccaauagcucuucuuuguacaagugauagauagacggagaaagaagcuggagagacaauaccuuucccagcaggucgaaucauauaaaacaccuuguuguaucucuaaccaaacaagugagagaccugcaugacaagaacuucaagucucugaagaaagaaauuaaagaagaucucagaagauggaaagaucucccaugcucauggaucgguaggauuaauauagugaaaauggacaucuuaccaaaaacaaaauggaauucccaucaauauuacaacaugauucuuuacagaccucgaaagagcaauucucaaguucauguggaaaaacaaaaaaacaaggauagcuaaaacaauccuguacaauaaaagaacuucuggagguaucgccauccaugauuucaagcuauauauaccacagagcaguacuauaaaaaccacauggcauugccauaaaaacagacagguugauccauggaauagaaucgaagacccagaaguaagcucacauaccuauggacacuugauauuugacaaagaagaugaaaccauacaauagaaaaaggaaaguauuuuuuuaguuaaagucuaauuguuauuagauauaauuuuuugcauguaugaaauuuuugguuauagaaaugaaguaugcaaauuaaaacuuuaaaaacauaauggauauauaaugucuucggcccuuauuacucuguguaccuucugggagggcaguguugccucuguccuauacuccuuguuucuugguccuaaggggcuuugagaggacgggaccauguauagcuguuuucccucacuuggagaagguuagaccuauugcugucgggauucaggcugagcaucugagugucugcgcugagaugugcuguggagaacaagugagggcugcuggggcagcucucugugagcugcagaaguggcccucaggcuucaccggauucgugcuguuucucuguugggaaggaccaauccuaccuaauuauuauuuuaaccaccugugauagcucaguuaucauuauuaguagaacauuuuuuaaaugaguauaaacauacaguuuauauauuaaauuaaauuaucauuuggcucuuugcugaguuuccgguagcuauuaauuauuaaaacucacuauuauuuaaacuucucauugugaauauuaaugaauuuggcucuguaaaugauauuacauguuuacaaaaguaaaaguguuccuuggugugucgaguaggaucaagugcaguaucaggcugcaugcaguaaggaguuaccaaguaagggacagagagcuggucugugugggcuacuaguuugacuucacugucugucaaguuucccuuuaagcauguuuugugcugugguuaagaaacuuugauuuaccuuaguaaauugcuuguguuuuauuucuacgaaacuucaguaauauuaguucuuuuaugucacaugcagaagugauugagguaauucuguuuucucuguggacagauaaaauacucagccccaauuauagaaagaguagaucugggggcauagaguuguaauaccuguaauuucaguaccuuggaggugaaggcaggaggagcaaaaguucacgcuagccugagcuacauuagacccugucucaaaagaguuauuuuugucuuagcaguuaauugccacuuuggagauuuguucccuugugacuagucauucauccauagcacaugaccucuguagcuuugucauagucgguacagcaaauagcucuguucuguaaugcaguuacguaauggacuugauguucuuggaucuucacauacuuguuuacauuuccuaacggucucacuaaauuauauguccacaugacacuggcccgagcauuggaugggauagguggccagugccuaacacacugacuuuccccaucuaggaacaugauguguuugucauuuauuuaguuguucuuuauagaaauauaauugacucauguaacugacuaccugucugcuucccucccuccugccguccucccuuccuucccaaucaguguuucucuaucuuauuacuaguguaauauucagauaaguuagcacaagcugauaacaggcaacuuugucuucccuaucuuuuuuuuuuucugguuuuucaagacaggguuucucuguguagcccuggcuguccuggaacucacuuuguagaccaggcuggccucgaacucagaaaccgccugccucugccucccaagugcugggauuaaaggcguucgccaccacgcccagcuugucuucccuaucuuauaagaggaaaauaucugcuuuuuuccucagcucucaugguucuuguaagcucucuuagagaccguauuagcuacucuuguguugcugugauaaaacaugaugaccaaggcagaaggaagggcauauuugggcuuaugguuccagagaguaaagagcccagagcaugcuaguaagcagcagguggggcaggggcagggggcagggggcagggggcagggggcagggggcagggggcagggggcagggggcaggggcgacagggacagggccagggaccagggcagggccagggccagggccagggcccgagagcucagcuagaacgugaaguggagagagccaccuggaauggcuccaggcuuuucaucuccgagcccccagugacacaguuucuccagcaaggcuguagcacccaaaccuccuuacacaguguacaaaagccugagccugugaacuauuccuuacucagaccaccacagggcuguccaucagacugccugccugccuuuaguuccucaugguuugggaaauguuuucuuuuuuuuuuuuuuuuucuauauuucuuucuuuuuuuuuucauuuuuuauuagguauuuagcucauuuacauuuccaaugcuauaccaagagucccccauacccacccacccacucccccuuuuuggcccuggcguuccccuguacuggggcauauaaaguuugcguguccaaugggccucucuuucgggugauggccaacuaggccaucuuuugauacauaugcagcuagagucaagagcuccgggguacugguuaguuuauaauguuguuccaccuauaggguugcagaucccuuuagcuccuuggguacauucucuagcuccuccauugggaguccugugaucuauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccaugguuguuuuguucccacuucuaaggaggggcauaguguccacacuucagucuucauucuucuugaguuucauguguuuagcaaauuguaucuuauaucuuggguauccuagguuuggggcuaauauccacuuaucagugaguacauauugugugaguuccuuugugaauguguuaccucacucaggaugaugcccuccagguccauccauuuggcuaugaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacaccagcaucugcugucaccugaguuuuugaucuuagccauucugacuggugugagguggaaucucaggguuguuuugauuugcauuucccugaugauuaagaaugcugaacauuuuuucaggugcuucucugccauucgguauuccucaggugagaauucuuuguucaguucugagccccauuuuuuaaugggguuauuugauuuucugaagucuaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguugaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucugcacgauaacaaccaguugugccagcaccaauuguugaaaaugcugucuuucuuccacuggaugguuuuagcucccuugucgaagaucaagugaccauagguguguggguucauuucugggucuucauuucuauuccauuggucuacuugucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguagauugcuuuaggcaagauagccauuuuuacaauguugauccagccaauccaugagcaugggagaucuuuccaucuucugagaucuucuuuaauuucuuucuucagagauuugaaguuuuuaucauacagaucuuucacuuccuuaguuagagucacgccaagauauuucuaauuauaaaagaguauuguauguuguaacaugcauuuguugaauuuauugagaugguuauguuauucuuuuaaucuaugaauguggaaaacuacauuuuuuaaguuacgcuaaccuuuuauuucugaaaauauguauguauaaaacguguguguauguguguauguugcaagcauuuccucucauucuaugggaacuuuuagcuuuuuauuggguucauuuugaagaacaagaguuuuauguuuuucugaaguuuaauuuuuuuacuuuggauuuaacuauuguuauaauuuucuaagauggagcucagguauuaauuuuagacuuucuuguucuuaacacaagcaguuaaagcuaaaauuuucacuucuuauuauuuuaccugaacuugaaacauuuugauacauauuuucaucaucauuuuaguaaaaauguuucccaguguccuuuguaguuuucuucucuuauguacagcuuguuuuaauucaauugaugucuagauauuuggaguuuguauaaauuuuuuuuaucauuuuuuauuucuaauuuacuuucuugcaagucaaagagcaugcguguuaaaucuuaaucuuugugcuggcugcuuuuaugucaacuugacacacgcuggaguuaucugggaagaagaacucaguugagaaaaugccugcaugaaauuggccucuaagaaagucuguauguauguaguacauucucuuagugaugugggagggccuguggguggugguccugauugaguaagccacgaagagcaagcuaguaagaagagcuucuccaugguuucugcacccgcuacugccuugaguuccugccuaaguucuuugaugaugaacuguggccugagaguguaagcuggacaccuuugcuuccuaaguugcuuugucuuggugcuauccuaguagaaaucuaaccauagaaacuugcuuuggaggaagaagcccuuggccucucuuggugacugcguguuuuacaguaacucaguggguuuuuaugaauaaauacuaggcuaacuugguuuacuguaucauucagguuaauaugcugaucuuuaggaagaagaguuuaaaauauuuuaacuauaaauguagacuuguguguuagcuuuugccucauguaauuugaagacuguuuuagacacauauuugggauuuuuuccuccuuuugaauaauuuaaucauuuugaaguacauuuaucuaucuaucugucugucugucugucugucugucugucugucuaucuaccugauucagggcacuaugacucuagcucuggcuggccuagaauuugcauggaaugcacucgcuucccaagcacuacugggauuauaagcgugugccaccacaccuggcuucuuuuuuuuuuuuuuuguccuuccuuccuuccuuccuuccuuccuuccuuccuuccuuccuuccuuccuuccuucccucccucccucccucccucccuucccucccucccucccucccucccucccucccucccucuuucuuguuuuguuuugcuuuggucucuaguaauguggguuuuguuuuguuuuguuuuguuuuguuuuguuuuguuuuguuuuguuuuguguuuuugauaugaagccccucagcgcucuagacauguuaccacucacccaucgguugucuuguuuguggccugacuuuuaccuuugcugggaacuagaaaggucucuuagauuuacuuaaauauuacugaccauggucacaggaacuuuugccacuuuucuguuuguguuaauaaaauuuuggggucccucaauggccaccagaagauaaagaggaaacugacaucggaagcucaaggacaguuuauuagaguuuaaaacaaaacaaaacaaaaacaaaaacccagggcaggccaacuguagauccgggugggggugggggaauggguggagaaagaaaaaaaagcuguacugccucuugggcacagaggucagacacaugguggacaagcagccacagaggucagacacaugguggacaagcagccagagguaaggaugggugcuuccuuuuagguuucagaccugagacaagggacugaggugcauauuuuacaccaaagcagaccuggccuccagauucucccagcaucccucagucccugccuggcaugcccugccccaaaccugaacuuugcagcccaggggcagggcugucuucccucaggagcucuucccuauauaagcuaggcauuuuagucucucccucucugucuugucuccucuuugcucucugcaugcacaccccuuucuuucguucucuuuuucucucucccucccuuccccucuccacccccuuuucccauggugacuucucuggccuugguccagugaacuagcucacccaagaacagcuucccaauaaacaaacugccuuaauauaaucuaaucugacuuaaauuggcucauuucaccugcagcagagaaauaaccuaucucuucugagaaagaguaaggaagcucaaauaugggagaagcccaaaguguuagaaagcauaccuagaaaagagauagaaagaagaaagaaauuauguucuucugaauaaauuggaaaagcaggcagauuugugaagccacuggaugaggacaagaguccugggaaggagaaguucaguuuauccuuaaaggaccaauuauucugcuuuaacaaagugagcuaccuucuuaggugcaaucccuuggccagauggcugagcuggaccaacuggaaggaggaaccuuugccuugguauuuuacaugacuguugcaggggauagauuguuuuucugguucuguuaacucaagacacagucagauuuuugcaaucuaugugcacaugcugucucaacaguuuucuuuaguaggguauugcuucuaacaccucacugucuccuggaaauggucuuaggucuagccacugaucuuaugcauccauacauuguucuguaccaggggcacaaagggucauaaaggggaauuagggaauguggaaaaaaaccaaagccaaguuuucaaauuagcucuaauccgaagcguagcaggagcuuaaagaucaguggacucuaaacaguuuuucagaaauaucauccccauaaaggagucuguuuaaaaaguaaauuucucauuugcugaucuucuucagccccacggccuuaccagcuuccuguuucuucucuuccugcuagaugccagcgugggcugugaggcagccugucaguccugcucucuugacuguaagcauuucuccauuagcuuucugucuuccaucugugaacccagcauggccauugcuccagaagcagggagagauaccuuaggaaugguuaaucuuaguucuucuacaguuuucaguguuaaauucucuucuggcuucuggguaauuuauaguuuccuauaauuguuaaguaauagcuacuccuaaucaagauuuuagcguuguucuguuguaagaucccuguaaccacacuuccuuuuccacuacugaaagcugaccugcuuuugcagaguauuucugugggacacagguguuucucuccgcaggucgaugauggccuuugggcacuucguaauuuaacuguccucuuugagaugccacccugccguccuuuagucacgauugcuaagcuugcauuuuugggauagcauuggaaauguaauugaagaaaauauguaauaaaaaaaagaaaaaaaauaauuugaauuaaaaaaaaagaaugugcagaugguguggugagccugugcuguccuugguucugucuccccggucuggauucucccccucagucuuuaccuuuaugaguuacacacaaacacuauggugaguagacagcagcuaacuccuuuucuuaguuaccucacuaaugcuccccccauaagauucuacaguacgugguuuggggagcguugauggaggaugcacagcugggaauguucaccauugccagguuccuaaucagcuauaacaaagggcaaagcgacccccacugagccagguuccaggucucuagacucagugcuagucauucuuccuccccaacaaacaccuuugcucuguuuuuacugucccucuuguccccauguuuaaucauuaacaaacauuuagaucauuucuaggaauuacuaacauuguaaauaauuuuggagaagacauuguauucauagauccuuaaacuccaugaguauuucccucccucccucauuucuuuccuuccuuucucuuucaugguugcaguuuccaaagcauacuaaauguguugugccgugugagacuuccaguugugauaauauggucuguuuaugucaagcacaaagaaauguugcuacagauguuaaaucugucuuuguuaugaaacacucaggaugaaaaaugccaucucuaaaguacaaguauuuauuuccugucaaaaagagaagcaguaugaaagcuccaaauauaguauuuaugcugcuuuuacucugugaaagcauccuuugagauaaugucaccucuaguuccaguuacugcuugucugccaggacuucgcguggugcuucgggugugcugccugcucugacucugugaaguggcuacugcugucaucauuggcuccucuuuacaagugaggcccacacagguuguguuagcuucuuuguuaaaaauacaaugguagaaguugugauucaaacagcaaugggacagagauuuguuuauuuugaccggcucauuauggaaacauauauucuguuaugaccuacaguggucucuuucuuuguugcugugguuagguaccuggcaggaagccgccuaagagagaaggaguugcggggcuuuuggcuucugguucaagggcauacagucaugguggauacaauccagcacagagguaggaaccugaggcagcugaucauacuguguccccaggcaggaagcagacaguggacaggaagugaggccaggcuauaaaagcucaacaugcacaccuaaugcccuccuccuuuuagugaugcucugcuuccuaaagacuuccuaaccuucccauucagucagcaccacuagcuggagaccaggguuuaaacauacacuuagacuacagucugaacguuauacuuuuucuuuuaaagauuuauuuaucauauguacuugaguauacugucucugucuuuaggcguaccagaagagggcaucagaucccauuacagaugguuaugagccaccaugugguugcugggaauugaacucaggaccucuggaagagcagucggugcucuuagcugcugagccaucucuccagccccugaacuuuaugcgguuaccccugcguuuauuguuaggcaccggugguguggagagcccugauaucagcguggcagcugagcuagaccacccacauauggacucugcucugcugguuagcuguuugaucgugagcacaguaguuauuuuugcuuuucugcaucagcaguuuucccuaccugggugauggugcuuuggacauuucucguucagucaaugcaauuugaguuccuagagcacuaggcuucugcuuucccuagucaacaaggcucucagguggagguauucaauacugaaucuuggaguuuuaccuaccuauuucugauacuuuuuuuuuuuucugacaaauguuccaucuuguauucaguugcuguuuuaaaugccuacaaucgguugucauucuugcucauuuaagauuugcaucugaucuuucaccaaguccuggcaauuccauguauaaaauaugucucauuguguuuccacguccacuguuagcaucuuuuaccagaaugaacuucugcuacaacucuauuauagcuuucauugacugcauucugacugccucucacuucacgccccacccagcuacacaugaugaagcaggucuggugagccagcauuggccucuggacuucuccagggcaucugggcugacaggcuucuaauucugauggcuuuuguuuucuuuugccgucuuacccaguuccgcaugguugcccuccuuuaucauaugguuuucauuuauuaacugaauauguauuuguuguacaccuugcugucuaccaaguaacuggaagucacaaugucaguaggacacagauauaacugguuaauaauuuuaacaaaguuuggagcacugugguaaagacacacaggcagguucaucccaugaaagaaugcagcagaaugauaguacuuguauccacguuugaaugacagcccaggaaagggaccgagaaagacucauuuaaaacacagcucuuugagauaacuaaggauuauccuaguguggugcuggggguggucucagggaagauuugguacagaaaauaguuugcuuaaaggugaggaaaacagggccuguccuggaauuaauaucucucuguggcugaaauauagacaguucaggaguguccauggaaagaugggacggaaaagguaggcagagacuuuguuaguggucuuaaagacuaagccuugacugagcucacagauggagacgcagggugucacagagaucuuggaacucugauuucuuacaugcgaccacagaccacaggcaggcagguuacuuacccucucuguguccugucugaaaagaggaugaugaugcuccugcuugcaguguucccuuuggugucgugggcuugauuccuguuugcgauggguaccccguacccugcaucuuuuggauguuuacugaucagaugcuuguguguauguguggauucaggugucucaugcugugagacaagaaacucucuagcguugagcuaacuccccaacccuggccugcaguucccaucagagugccaaauuaugcuaagauuugucuauaguuaugauuuguagcuuagcuuccuuuguuacccaccugugagagagcaaaugugcugacccagggacagacacccacaccuuacauagucggccugacugcucuaaguugucauuacaauucugcauggaacuugugagugugguuaaggggaccuuucugugagguagaucuguugcucacagaucugaggccaaggagcaaacagaauauagaaaauuccauaaguaacauguaagcauuucuucaaacaggcucugucuccuuaagauacuuugugccucggcucugcuguugcugugaagaugucaguuuuauaugcuuacguuuuuauuugggagagcugugaguuaucauuaugaaaaugaucagaaugcuuaauuuagaauuagugauuaacuuguaagucuacuguggacugagcauagaauaaacaguucaaaucagcugggcaaaggauauuugacuguuugauuuuuuugauauguauauucauuugucauugugaggaaauuuugacacuuggcagucauuuguagaaaugacuguauuuuuuaauuucacaagcaaccaaaccaucuauauucauuucugaguauccguacugaaaucuaaaaagagaaagcuaauuuucuuuuaaugcuucuaaauugggggcaggcuccuuggagggcauuaugugugauugcuuuugauuauuacggagacuggggaggcguggauguguuauuuguuuagugggugggagguaaggaugauaaauacacaagagugguuugagagcccucccugggagagauuguccagccccagaauugcuaaggauccuucuggaagcauuacuguuuucugcuagugaccugagauaacugugcucauagcaccaucuagugaguaaaguggguaauagcagaauccccuuuaucacagaaauaagaacccaaaaguuuaagacuccuguaugcucacagucagcuauuggauggaucacagggcccccaauggaagagcuagagaaaauacccaaggagcuaaagggaucugcaacccuauagguagaacaacaauaugaacuaaccaguaccccagagcucguguuucuagcugcauauguagcagaagauggccuagucggcuaucauugggaagagaggccccuuggucuuacaaacuuuauaugccuaaguacaggggaacgccagggccaaaaagugggaguggguggguaggggagugggggggagggcaugggggacuuuugguauaacauuggaaaugaaaaugaggaaaauaccuaauaaaauauuuuuaaaaaaggaaaaaaaauccaauugaguuccucuacucacauucacagaugaggaaggugacaaaaaaccaaaaacaaaacaaacaaacaaacaaacaaacaaaaacaguagguuauagaaccauaaguguugggcccagggaggaaaacuggagcuaacuuaacucaacuucuccuuuuacaggcagggaaacuagaguccaaaguggugaugugauuuaccuaauagcauacuucguuaguagcaagacuccugacccuugucuuccagguuagugcugagucuucaucacagcgaacgccuuuuuguuguacuuggaugagugccuagguucuuagauuacucauuuaagaaugaaucaacagcaaacaaagaaaagucuuguuccagagacauguuauauaguaacuuccacaacacacacgcugugcccaaguuuuguuuugaaucuauucuccccagaaaaugaggauuaacuugauuauucguuguuggauuugcauugagcacugagucuuaugacucaauaagacuacaagagacagaaaagaaguguguguaaaauucauccagaacuuuaccaucgguacugaccggugaaccggcacaguggcaggcagacgauacagaagauguaggcaaggacuugcaguuaccgaaccaugaaauaacaacccauuucuccucugugcuggcacacacuagguguuacugauaaguaacaauuucuauugacaaauccugagaaugacucagcuacaaguaaguuuuuauaucacguuugaucagagaagagcaguuuuaaauuauugacuggaaaaacuuguaaaggacaagugacuuacagaagaagagugacuguagacaggagauacacugggacaggcugaggcugugugugcagaugaagggagcuugcuuccgggagaugcugaggacagugcaggcaugccuucaggacggggacaccugagcccaugcacggagaaggacugcucaggugacgcuggccaugcuguuuacaguuagucucaguaauguuuauguguggguccuguccuaaguggguuacauguaguaauucuuguacuuuucauuucagccuugagggacaggcacuguuacauucuugguuuuacaaaugaaacucgacaaaagagaaguuaaaugacaugggcaucucucacugaugguggguuucucccugcuccgagaggaggugcauuccugugggaugcggaccuucuuucuuccaagcugcuggaagcaucaccucuaaaagaugccuguucuuauacauguuuuguucccuuuaaauaucauaccauucuuagcguauuuucccagcucuuggccauucuguaacaguccuuuguaguacugucagguuauugaccugccucugacacgucugugugggauacagagaggaugcuagaacaucugguucagaugcacaaugcuacuggccuucaaaaaagacuccaugcuaaucucaggcuuuuccuuuugaaggggugauggcuaagaguucagagccccuuucaguuuguacuugguagugaccauuuuggucauaggugagauagauguagucucagcuuggucuuucucugguguguugguguugggaaauguacagguuuuaaggaugguuauuauaguacuguaugccuuauggauaucauacccuguugaguuuauaaucaaauaaaagagauucauuaucaauuaaugucuuuuacugcauauucaugcauauuguuauuauacucuggauuuaacuauauccuuuguuauuuaugaauuuauaacacuaucucuuaugacuagacauagcaucuuauaauuaucauaggcaccuggcuacucugggaaagaaggacagagacauguguucuggguucuagacuggcugcuuuucauucugaugaucugcacauuaaguuucagaggguguauuugguggucucagagacugaauuguuggucuagggcacuaacuggcaccuggcuauuggaguucagauugugacucagucccucacucuccucaucugcucuguaaacugauguaaaauagcaucacucaucaccuaaaguuguuaugaagacugaauacauagucaaugcuuguagucuacuuauaguucauuuuuaauuaaauaaguagacaggauuucagucacaugucuuacugguuguagacccuguggucucgacauuccucugacucugcaguauucuagaacacauuucccaccaacaucugcccuuauuugaccugggacuugugaucaucaccggcucuacuugaauaaggaaagguagucuagaaagagccuuaucuuuucuucauguacucccacaaacuugguaaauggauucucuucuauuagauaguaauuuuaaaaaaagauuuuaugccaaguaugauggcacacacuuuuaaacucagcacuuggagccagagacaggcagagcucuguaagucuaaccccagucugguauaugagcaaguuccaugucagccagggauacauagagagauccugucuuuuuuuuuuaaaaagauuuuauuauuuuuauuuuauauauguaacuuuugccuguauguuuucuaugcaccaugucugugcaaugcccgcaguguccagaggagggcauuggauucccuggaacuagaauugcaggcaguugugaaucaccuuuuugguggugggaguugagccugagaccuccuuguaaagcaacaggugcucguaaccaccaaaccaucucuagcccauuaggcauuguuuugcuugcuugcuuguuugcuuauguaucugcuugugccuuuacuuaugcaccuguuugugcaugcgugcuccacggugcacauguggaugccuuguaggcaucaguucgcuucuaccacacaaccucuggggauuaaauuuacuucaucaggguugguggcaacugccaucagccacugggccuucuuguugcucccuucccccuuuuuuugugguaaaaauaacauaagauguguucacuuauacauuuaaauguauaguaaagagugacuuuugggaacagugucauagagcacauaucuagaaccuacuuuccagugaacaguggcugcccaccaccuccugcuguaucccucucacaguccugcccugugugaguuucccuauuguagaugccccauguuaguugaauugggcugcuugucccaugcccaguucguuuuucuuagccagguguccucaguguuuauccugcuguugcuguggcuuugucuuauggauagcacucauuuuugacuuuguuucacauuauuacuuaauagcuauauuggaauuuguauuucagucuaaaugauuuccuuuacaauuccuguaaggugaaucugauaguugugaacucccuuugccucugagacagugucuuaacuguguggucucccucuuccuaccucauaggcuggauuuuaguugcacgccaccauaucucagucguuccauagcuuuuguuugucucagaaaguuuucauuucuuccucaucuaugaaagacagcacugcaggaaaaaagccuuuugguuggcaauuauuuccuuuaucacuugaaugcauuuucaucucucucucucucucucugcuggguuucugcugagaaaucuucugauaggcaguguugaagcagccuuuuaaagagaaaugcauguucucuuuugaguugaauuugacuggugacagcuguacuuccugcucuugagugaugacaucuggaaguuuccagcaucauuuccuucaagucucuuucuaguccuucuucgucuuccuacaacugccauaaugugcuugugugugugcccucuuggugauggcccauggcucacacagggguccucucucagccuuuuugauccuguggagaguuucgaauguucugucuugcagcuuacucucuuugucccaguagaguaaccauugaagauuuuuauugaguuuucuaguuuagucauuguauuuuuaauuuccaauuuucuuuucuuuuuaaauuaucuuuguuugguagacuugguuuuuuuguuuuuaauuguuagcuugaucucacuuuuauuuuuuauuuuuuauaguuuacugaacuuauuuauuaguguauccuaaauucaauugugaaucauuuuguagaucuucauuuauuugggguccauuauuguagccuaucaaguuucuuuucaaaguuucuuuguuuguuuguucauuucucuuucuuuuuucuuuuuuuaacauagggucucauguagcucaggcuacccucaaacucaguguguaccuaagggugaccuugagcuucugacuguccugugucagcuucccaugauauaggauggcagggauggccauugugucuagguuaugagcuauuuccgaccccaggcaggccugcagcucucuucuggcugagcuacaucccagcccagugccucucuuaguugugguuauacucgcaccucucugucgaggucugugcuuccgagaagcacccuccuggcuucuacuguauucuuugauguacucugagggucagcuagugacaaacacaguggggugaugaagcuguuuuuagcuugaaauacuuuugcuaucuacugggauaauuuuuucucuauuucuauauaucaaauguuuuaaauauugccuucaacuuuguuacuuagauugaguggguaaauauuuuacuugucucuuuguuaacauuugcaagcuccccccccccaaaaguauguuuuugguuuuuuagcagauauaaaagugaauguuuauauccacuuauuaggauaauacuuugggucuuuaaacauuuuaaaauugauuuuuguguguauaugcauucauguaagggcacgcucgcacacaggcacacgugucaccguguuaaugcggccaucuaagggcaacuuucaggaguugggucuuuaucuuguuucugcugcaguguugccugcuccgggcugcugaccagcacauuuccaggugguuuuccugucugcagucucacuggggcagugcugggauuaaaggugcugcugcccuaccgggaagugaggccuucauggcuagcacuucaugcucuaagacacucguccagcucugccugaggugcacuuaaagugcuuaaagaauuacacugauuugaacauugaauugaaauugaauuucagaucauuuuuuucucuuugcuuccuaaccuugaaaaaugucuucuuaguguuuuaugagcagggaggcagcauagauguugacuggcuguugaccauaaaucuuuguuagguuucuauugcuguguuaaaacagcauugccaaaagcaacccgggacagaaaggguuuacuucauccuauacuuccuucacugagggaagucaggcagggaacucaaacagggcagggaccuggagcugauguggggccauggagcugcuuacuggcuugcuucccauggcuuacucagccugcuuccuuagagaaccuaggaccaccagcccaugggguggcccuacccauuaugggcuggacccucccauauuagucauuaaggggacauuuucucacuugagguuccuccucccccgaaggcucuagccaugucagauugacaggacacuagcagcacaacauguggcauucucuugcuuuuuagguaucacagucacacaauguaaggcuuuuuguagccacacuuuggccagucugauagaauuuuguccuuaauuuauuuaaaaguaaaauacaaaauauaagcacuuguuuccuaguauuuauagaaggaguaaauuaagaugugaagaaaauugaacagacuucuaaagaaaccucuaaguccucugauggaagauuuauaaagaauucuuagaaacacuuuaauauaguucaaaauuaaaccuuuacuuccuucccaccucaggcccuugaguuacacauccaggacaacuacugugaacaguucugagguagccuuccacagugcucuguguacuuaaguguauguggaacauauguacaugaguuaaaaauagaguuuaaaaauaaauaguguuuugaaugggcuaaauguauuuuuucucauguaguugagaaaauuggacagcuugauacacauuaaguauuuucuucaccuuuauuaaauguuuccuaauuguaucauucuguauaaaauuucuauagugaaguuuaauaacagauuauuuuuaauagaaacauuaauuuauauggaagauuucccccuuaauacauguuuuuaaugucaguuggcuuauugaaaacaggguggcggucagggcgcugggcuugcguugcugcagugaaauauuguuuguguuccgcuuuucucguuguucuguuuugcaguccugggaucaaagccagagccuagugcucuaggcauguuacuccacugcugauuuuaauucccagcuugagguuuuauucuuuuaaguaguaaacauauacuucucuuuuguuacaauggugauagaaaauuagaauaauuuugaaauguguagugacacaaaaguaaacuuuccuuccuucuucucuccugcuuccucccucucccuuccucuccuuccucccccaccuccuccuuccuuugaucucccuccuuagcccuuugaauaccuggcugaguucuuuuuuuuuuuuuuuuuuuuuaaguugaaguaauuaaacucauuguguguguuuuauuaacucuguguuuaggcaugugccgauguaagagcuaguucaguguuuuggcagcagauggaguucucagagagucuucauggcuaucccaaguugccagaguggcugucgacacauccuucucaugggaaccgagcugaguacuuggauagacucauaccacaggugagcuaaccccacuaauucuguuacuuuuuugguauagaaaaagugaauuucaguaugcaauuauuuugguuaccauaauuaucaacuauugguuucacagaguuguauugaaaagggaauuccuauuuacccacaaguccuggggaauaaauugcuauguacagcugaauuuccucaguguaaggucuacucucgugucugacugaguuguaauuaacuugguaaugucuuaaaccuugagaaggccuggagacgugguucaguugaugagggcuugccuagcauacaggaaacccuguauuguaccucuaguacuuugcaaaguggguguggugaugcacacccguaauaccagugcuugggagguggggacaggaaaaccaagaguucaaggacaucccuagcuccacagugaguuugaggucaugagaccucaugagacaugagacccugucucaaagcaaaaaaauaagcaaaaaaggaaaagaagacaacuuugggcauuuuuucaauauauugaucauaauuuggucuuauuugaucuucccuuaacuuuugguuuuggaauaaauggguauuaacucuuugguuuuuuguuuguuuguuuguuuuagccaaagucauacuacaaagucuuggcuagcuuggaauuuacgauguagacaagcguggccaagaauucacagagauauuucugcuucugccuuugucucccaaguucugggauuaaaaaugugcucccccaugucuaccucuuguuaguuuguuguuguuguuguuuauuugucugagacagucuuuaugagccugagcugucugcaaacuuuuguguaacugaggcugaccucaaacucuugagaguugagaguguagcccuguacuauuauaccugguuuuguacagugcuggggauacagcucaggcuucguguauguuggucaggagcucuaccaaccgaucugcauuuccaucucugaguggcuuagaaacuguuaaaauuuguuucuaaauuuagaaacagggaaaucuuagaucaagcuugguaucuuguaaggacccacuuuccaguuuauagauggcugucuccaguauaaccuuacauggugaauuaggaagugaggucuggagucaguuuguccauguauccauguauccaucuauccaugcauucaucuauccauccuuuauuuaauguuguguuuuaagucagggucucaccgugaagcugaagguggucuugaacuugagaucuucccaccucaguuuccccaguguuggacaacaugcauggaccacuaugcuaggacuuaugauaagagcaucuuuuaguaaggcauuaaucucauugaugagggggucgacuuucaugaccugaucaccccucaaaugccucauuuuauaagaauaucaaguugguguggauuuuaacguggagugugaaggcacagacuuuacuugauuaccuuuuaucugacucauaucuuacguagaugcuuaacaugaaggaaaaguacagcuagcaaagacaguagcgaccuaugccugauguuaucuguagucacuauucaccuaaacagggcagugcauaugcgucaccaguaauagauucuacugagggccggcaaggaucucagauguuagaugccguggcuugucccuaaagucaugaugcacagaaguucuuuuuauauuuuaauucugugcaauucuaaaugauguggcuuguuuaaacuagauaacaaauucuacuagccagcugugauuugaagccuacccuaaauucuguagcugucuuuucaccaagucacugaggcucuucagacagguuaaaacgaagugcuuuagggaggucugugaagucgucacgaguugauuggagagcaugggagcauggcuggagaagcaaauguuauuugggauccagugaggaaggaaaacagggcagcuuuuuuuuuuuuuuucuaaaaauaaaccaucccaguucagaaauuuaauuugaaaacugcagguaaauuucuuauauuuuccccccaagugauuaaauucaauuugaaagcaauaaaacucuacuacaacuuugggaauaauucagugguagaagugagaaugauaguuaguacaaggguauacuguuaauuagaacacacagucguaaagauuggaacgugcuguucuccuaggccugauuucuguaauggaagaaagcagccauguauguaagauguacgucuacaugccacaaaagacuacauucucaauaugaucauuuacuugggauguuuuuauuucucaaaugaguccaagguugaauuuuacuaauggcuucucucccccaacauguggauagucggacacccuguucauuucugaggucuacaguucaaacuggcuuuagcagacacagggcuuucagaauuugcucuccagaggucaauugaugaaacugacaaggucaccuaggaacagaggagagaaucaggggaagggcgacuuuauccuacauaggaggauaaaguuaauuguauggaggacagagccugcuguggaucagauguauggggaaaagaucaagaaagaaagacuucauggcucuaugacaggaacauaaauauugguaucuuuaauuuuuaauuuuaugugcuaaagauuauaaguauuuuaucagacucucugaaugccauuauaaaauagauuucuuacuauagcuuauuaauauuaaagcuauuuaaauguguauacauucaacagaugcugaaucacuuacuauguuguagguuuugugguggcaacuucagagagauccacaucuucaucagacuuauucuccagugaaggagguggacaggaagggagauagaagacgggaggcucuccagucugucuuuguuacgucacuaguccuguuacaaggauccccuauuuaggacccaauuuauccuuaauuaccuucuuggagacucugucccuaaauguggguauguuggggguuaaggcucaaauaauucauucuuggguauauagcuacagugugagcaaagaugggagggcuguugggaaagcacuugaaacuggaauagcuaggcuugggaguuuggaucuccagaaccuauguaaaacugagcauggucucgaaucccagcauuccuacagcaaaauuggagguggagacaggagaaucugcagaaacugaggccagguagccugguguacacaaauuguucacuuucuuuuugaaaaauggugcuaaccaacaccugaaaauguccucugaccucuaggcggugccucugucugcauucacauacauaugaacacagguauacacacacgcacacagaguuuaaaaaaagaaacucaaaugggagccuagagagaguggucccagugagcacucugacuugcucagggaugagcuucucauggagggcucugagcagagacuggagguguguccugacuugaacacucacuuuaucuuggaggaauuugguauaguauauuguucagaaaaugagcugcuuccuuccuuguuuuuugguuuuuuuguuuuguuguuguuguuguuguuguuguuuuuguuaagacagggucccuauccauuuagucccggccgucuuggaacucacucuguagaccaggcuggccucagacucagagaucugcuuucccccauuacuucccaaguacugggaucaaaggcguaugucaccauuauggcuucuuauuuuauuuuuaaauaaagaaagaaccccuaaauuagaaaaaaauacccuuacuaauuuuuauaaugugaauucugggaaaaagcaacaugcguaaauauaaucgugugauccaguaguauuugaaaaugauaaauauagguuuguaguaauauuauuuguuguugauaagcugauaugauauaauuuuauuuacuugaaauaaucaguuagauuuaggaaacauacuccacauauuuugguuaccauaacaacuugagugaaaaacugaagaacagauguugugccaaccuguugauguuucauagcguggguuucagaauuaacaguuaugcuguuuagacuuugaguuuauguacaucauaauuuguccuugaaagaaauaccuuauuuaaguauuuuauaaaauaugaauuacugugaauaacaaauuuuguugaaagguuuauuuugaaaucaaaagccuucagauuauuuuuuuucuguguucucauugacuuuccuucucccugcuguugcucuucgugagggcgcgaggggugggcagugacagcagagcugggaacauugaaucuggaauuguugugcaagguuauauaauuauaaucauaauuugaauggaauuuguuucuaaguauuuuaauuguaaacaacauuccaucucuaggcaugagagucacuugguagcaggcuguaaaugcauuaauuuuaaccucauuuuguuuuuaauccuuuaaacuuucaggcagcugggaaguugaacucauguguaaaucauucuuaugcauuuguaauuggauaaaacaaaugaauaaaucauuaauauugugcaucucaugagcacagaauguaaguguuaggaauuaccaugaaaugucauuguuggccauguguaaaaacauacacuguucaccuuacuaaaucucauucugccuggcauggagaguguugaggaagugaacagcagcugcuguaauugaaucggccucugaaucauaugaagccagaaagccugacaguaacauugucuaaacccuuaaaaacauuaggacugaaaugaguggaccauuagaaaaaacucgcuuggaaggauaaggcaagaaaggguacugacauguuuaaagcggaggugacccgccacccugccccugcaccaauaucuugcuuucuguuuucagcagaggcuuuuaaucuaaucaccaagcccucuggcauuuccccuuuuuuccuuucacuuaguuaucauuuauauuuuauggauaaauaauuucucuuuuacuugauguguagcauguagaaaaaucgcaguguauccuagcaguugguucauauuuaguuguuacuagaauuaaaugcagccagugccuuaaaaaauacaugugugcucacugcucauuccuuuuaaccuuugggaauauuguuuauggccuacaacaugaugcgugauguuuguacacaucguggaguggucaggucaagcuaacaagcagauccauggccuuacaguuuuggaggguggcagcccgugcccucacucuugacaguuucaagugugcacuguuacuggugcuuguguugacugcacaguggcucucagaacucccuucuuucaccucucugagaugcugcacccugacuccucuccccaugucuucucugcccucguggucaccauggccucggcuucugugagcugcuuuauuagauuccccugugaggccacgcugugcccuucagauucuucgguguugggcagauuacaagacuagaucguucuguuugcuuuguuuucuggaacuuugcucuguagaggaggccggcccugaucuugaggcaguccuccuuauucugcauucugaguacugcugucguaggccugugccacacugcccagcuaggacuuccucauucuucuggcagggggguugacuagagaaaguuuuguucaaaaaccuugcccuuccuucucauuccccaaagcaucguacauaggucaaagcagccuuucagccuucuuuguuuauucacggaaauuucucaguuacuuauacuuccuaacauuuggccauuucaaaagcaagucagagccgggcguguggcgcacgccuuuaaucccagcacucgggaggcagaggcaggcggauuucugaguucgaggccagccuggucuacaaagugaguuccaggacagccagggcuacacagagaaacccugucuggaaaaacaaacaaacaaacaaacaaacaaaaaucagacuucaguuauauuguaguuuuuuaaaagaaauaaaucauuuaugagguauuuuugagaaguguaauccugauucauauaaauauuuuuaauauuuauuuauauuauguauaugagugaucuaucugcguguacaccugcaugccagaagagggcaucagaucccaggauagaugguugugaaccaccauguuguugcugggaauugaacucaggaccucuggaagagcagcuagugcucuuaacugcuaagccaucucuccagcccaucauauaauuauuuaauaaaccuaccuaaauauuauuuaaaucauuaauuaaugaggaaagugguaaaauguuauaacuaguauaaaggguaauuuaacaaccauaauguaaaauaagaauuccuauaugagauggaagcccguuaaauccaaagacuauuauauagacuugcagauggaggaauacaucuauacccaagugaaguucuacugaaggaaagugagccuggauuuaucuaauccaguaauaggaacugccaccaaauagucagaaauucuaugaauccacaggacuguacaggucaaaacaaaaagcuguuucucuagaguuucucaaaacgcuagagaaaggcauuguuagguuucagaaaauuguuuccucuggcagauucaguuuuguguuuauuuucuuuauuuuuuuuuuagauucaguuuuugacaugaucuuccuucugucaguagacaccaagcuucagggaaggauucauccauucuuucucucuucuguccauucucccuccuucccucucccuaccacucuuuagccauucugaugcauaucaauaggcauauagucaauaagaaacauagcuagcuguaaaauggcucuacucagagggcagcugcuucccaccaggcauaguuugcuuccauuuccauggacaaauaucauuuucauuauuauuaauuuuaaaauaacaaaaagaaugcaaauauuuggugauauuuuuauccaaaugauaauggcucagguuaaaaucagaauuaaaauguguauauagacaugaagcuugguuucaaaaaauauguguguuguguauauguguauauguguauauguuguguauauguguauauguguauuguguauauguguguuguguauauguguauauguguguuguguauauguguauauguguauuguguauauguguguuguguauauguguguuucuguacagacugacacacuagguucagcuauuagaacugcgguaaacuacaaugagccuccuuagacuaacuuuggaaagagguaaaaugucaaaagucagauaaaaauuuauuuuagaaacuuguagagucauagcaaauuagccagguaaaggacuccaagccauaauguggcuuuacuucagucuuaguccacaaucacaaagaacaauuaccuagugauuaauuaauucuagcaucaaaauacaaaaugggacaucaacuaucugauucauuuuaugagcacggaugauuuuguuucaacaauuugauuaaaaugucuuuaaaaauuuaugaacugggaucauuaaucagcaaacaaggcagggcuguaucacaauuauuauuuacuaccagcaacuaaauuguucucacagucaguggcaucuuaaaggcacaugagaguggaaccuuugauuccucgcuuuccuaugccccugcauccuguccauaucagucugugggcuuccucuacuaugcauucagaaccuccauggcccuucaccacggccacuaccuaggacaagccaccaucaucgcuccuaguucugcagcucucucccuuucaggcucccugguucacuguuucugccaaugguuuauuuuuaccauguaaacagaaugaucuuuuaaauguuauucucuugccuaaaaccuuccaguguucuuucauguaguguagaauaagaaacuacccuguuguagcuacuuucuguugaccaagccaguuuuggggaggaguggguuuauuuagcauauaagucacaaccaucacuaaagggagccacagcaggaaucuagauccagggucugaaguguacguguguguguguguguguguguguguguguguguguguguguguguguguguguagggaaauggggugugggugcugcuuacuggcuugcuuaucauggcucauucagcuugcuuucuuauauaauccaggaccaagaguguaagaaugguucuguccacagugggcuggaucuuuccauaucaaucaguaaucaagaaagugccccacagacauacuuaaaggcuaauggauauaauuccacauuugagguuaccucuuucaccgugacucuagcaagaugacaaaaacuaaccagcacagucccauggucauccagucacaugacuuggcaccguccauuuugcuaacaagguuucccuuggcucuggucauuucacaugaggcuuguuuccuccuuacagacgcuccaauuguggauuucucucuuccaggcauuaccuugccaaagaagcuuuuucuggucccucagugucaaauauccugucauccaugcagucauucucccuguucaaacuagaaugaucuugcuuacuguugauugacuaucuucuaucuugaaauauaugguccuuguucccuguggucucccugguagcuuccacagcuucugagaugccuagugaauacuuaaaugacccuaggauaucgaauaguaauaaauaauagcuaaaaauagaacacuuugcaguagaacugaguagugcuugcacugcuuaggcgauauuagcuguaggaaauuauguccaguaaugagcaaaagugcucacaggaaguggcaauguagaaauagcggugagcuuaggggucuuugcuuugauucugccccaggugaccuuccuuugagaaggucuaaccuuugcuuuucuccauaccuuguuagguuagcagacucuucagaguucugccuuaugcaccugugugucuguggguaaggcccugacaucuuuuucucuacuucccucuugacacuugaaaaaaaaguaguuugcauuaugauacaugcuuagauaauguuuguacauuacuggucaaauaaaaaaaaagagaacgaauaagaugaauaguggcugucuguggcucucccaacuguugggaucuuuaaggcuggcugguuucacacuuaucuucagccuuccuuccccaggguucuccaaacuguauauuccuacuauuggauuaucuuucuauugucucaaaaauuguaggcucuccauaauauuuuuacagcauuuauuaaaauugauuauucauaguuuagaaucuagccugcauuuaugaaguggcccuuauuugcaaugcauagagucagauagaaaagaaaggcaguggaaggcauauucuaggugcacauggggaaaaaaaucuuauucuugaagaaaugugaagauuuauguaauaggauagauuugaauuuauuaaagggaaaagauguuaacacacugaaauguaaugaaacauauaggaagaaagccaaaaaucuagaaauucagaagauuuucccauauauguauaauauauauauguaaaauauaugaccuguaauauaauuuuuuugagaggaacacagggauaggaaaucuuuuugaagaauaguuuuucuggcgauuaaggaaacagcuugagcauuuccaaagugcauguauucagugaaagguucauuccaagaagcaagugugugguacagaauucacuagcaugaaaagaauacuggacaaaagcaaaagguucagccuuuauauuuccgaccuaauuuuacuuuuuaaaaaguaagagauuggagcauguguucuuaccgguugggacaucuucuggauauucccaggagagguauugcgggauccuccgguaguacuauguccaauuuucugaggaaccgccagacugauuuccagagugguuguacaagcuugcaaucccaccaaccauggaggaguguuccccuuucuccacauccucgccagcaucugcugucaccugaguuuuugaucuuugccauucugacuggagugaaguggaaucucaguguuguuuugauuugcauuucucugaugauuaaggauguugaacauuuuuucaggugcuucucuaccauucgguauuccucaggugagaauucuuuguucagcucugagccccauuuuuuaaugggguuauuugauuuucuggauagcagccuuguuuauaauagccagaagcuggaaagaacccagaugccccucaacagaggaauggauacagaaaaugugauacauuuacacaauggaauacuacucagcuauuaaaaaaaugaauuuaugaaauuccuaggcaaauggauggaccuggaggguaucauccugagugaaguaacccaaucacaaaggaacuugcacaauauguacucacugauaaguggauauuagcccagaaacuuaggauacccaagauauaagauacaacuugccaaaugcaugaaauucaagaagaacgaagaccaaaguguggacacuuuacccuuucuuagaaaugggaacaaaacacccauagaaggaguuacagagacaaaauuuggagcugugacaaaaggauggaccaucuagugauugccauaugcagggauccaucccauaaucagcuuccaaauguugacaccauugcauacacuagcaagauuuugcugaaaggacccagauauagcucucucuugugagacuaugccggggccuagcaaacacagaaguggaugaucacagucagcuauuggaugggucacacggccccuaauggaggagcuagagaaauuacccacggagcuaaagggaacugcaacccuauagguggaacaacaauaugaacuaaccaguacccgggagcucuugucucuagcugcauauguaucaaaagauggccuagucggccaucacugcaaagagaggcccauuggacuugcaaacuuuauaugccccaguacaggggaacgccagggccaaaaagggggaguggguggguaggggauuggggggguggguuugggggaccuuugggauagcauugaaaauguaaacgaggaaaauacccaauaaaacaaacaaacaaaaaaaaacaaaacaaaaaaaaaguaagagauuuuuuuuuuuuagugaaauuuuagguauauuuuuaaaaauauuugagagaggaccuaaucuugucccggccagccucaaacucguucuauagcugaggauaacccugaaauuccaagucuccuuccuaagggauuugguuauaggcauuuacuucccaccugguucaucccugguguuauacagucuguagguuugggcaugugcugugguaugaauccaacuuuauaguacauagacuuucucucugucuugaaacacuccuugccugucucucucuccuccuugucugguacagagcuagguuguucuuagggcugguuauguggagaauaagucagagacacuucugaguuuugcuagcaacucucggaaugcuguuccaugcuguuuuggguuuucccagcauauguaaauugcaugcuuauguugcuguuuccuaauguuccaguuuuaagccuucuauuuauuuuccacugcagagaacuaguucaggcuuucgugucaccacuuuccacacacacacacacacacacacacacacacacacacacacugcucucuucuuucccaaaugaugaaauugugauuuggguugauucagauuugguauuuuaaacuauaaacacuaguuagaaccgacauccacacugcauuacaauuauucuuccuuuccccacaagauuuauucucccuagaguuaaaaauugucgugaucuugauuuucugcuccuucucugucauuagcagcgauuuaacccuagaaggucacagcugugaguaacuuuguuguugguuuucuucagugugcccagacaugggcauucuauuauuuuucuuguguugaaaaaaaaaaugucuuauagagucuucagagcccuguuaaucugacgcuguucuuagggucagcuaagggugacuggaaccguuugcucucucugagacuugucuacaccaccauguggcuauugcacauaccccugcuguauaagugaugguuaugggucagaucauggaacgugauuacacguguuucuucuuccugggcuaugcuugagccgacuuccauuuaaaugcacagaaauguucuuuuacuuuugguugccucaugcagaccaugugagaaacugcguuguaugcuucucuguaggcucucaaacuccgggaggucugcaauugcccgccacucucuggcccagacccucggcuauuguucaggcuuacugugaagcguuuucuugaagacucggagaaagaggaccuaaacaucacugucaaaaagcagaaaacggaugcucuccccaugcagaagcaggagcagauaccacugacguauguccuagagaagagaacugcaggcugaacggaagugggugaaucgugggcuccaugagcagcacaguggaccuuuuccuuauuacgcaacuuuuaaaaaugauguuuucaaggaaaaaaaaaaaagaauguucaaaggccaagucacuuauauuauagauauuaucuggauuuuucuagguuuuuaucuuucaugaaauauuaauguguuuccaccuauuuuaaaauacugccaaugaggaaaacaucacagaauaaauugauauuaugcauuucacugucaucuguccuugccuuaguuuguagugauuacuauaaagagcuuccugcucagccugaaguggguuuuggagucugggugguuauaaagugggaacugacaaucugaaaguggcggucugugcugggguggagaggaguguggagaggggggacacuccugagggagauaguuccaggcggugcagcaggccgguucuguucagaggcacaggaaaugccucuggugguccaggugacagagugagcaguacaguaggagggagguuggucuuccugucauggugauguggggauugcgauguucccacuaugggcaucaccugggagacaggagcgagugcugcccucaagcuucucgcuagcuagcugacagcagccaggugcugugggagaacauggggggaggggucaaggugcauguccagggaagccagaaguugaugacuguguuguauaggcaaugugaguuauuuagucaguuuuauuuguacucucaaauuggugaacauagguuucaucuuuuagagggaugcuuuucuugagagaccuuaaauagauacuuuguuggagaacuagaagugcaagaaaauacuuuuuaugaguaacugcuauggaccgaggccuuaaaagauuugcuuuacucuuaauuauguaugagugggaaguauaugcagcuuuaugcgauguccaaggaggccagaaaguguauuaaaucccuagagcuggaguucuaaguggcggugaaccugacaacuggaccugggucuucugaaugagcagcacguauucuuaacuacugcgccuucucucuagcccccgagccaagcccuuuuuauuucaguuauucuaaaaucguacgaggcaaguuugauuuucauuuuauguuuaugaaugggcuuggagaggcuuaacaauguguccacuuaccagaaagaacagaauuguaucucugguuccaguuugcccauuuguacaacucucaaguaccaaaggcaaagcuauaaaaggacaaggaacaaauugcauucuugauuaucuguuagcuucuucaauacagguaaacaucagagagcaccuuguugucugcaggauggcuuucuaggucaucuuagauccuucugucaaucuccaugaaaaccuuggggucgggucaagcuccgccugauucuuaguugucaagaagagaagauugugucaguuuauguauuguuuauaaaguauuucuugaucugcacacaaaacaacaguugugagaggaguuucccaguagcuauuaccuguguucccauucuucacacuacuguaaaguuuuguaagaggcaccccauaaugugcaaagauguuuggagaagaucacucaaaggaaaacuguaaagcauaccauuugauuucccuggaaaguuucuaaaauauaacauaccauagucccaagucuuagcuuuucuucccuggaaaagcuaauuguacuguuuagacuucuuaggaauuacaugcaaguugacaccaugucagaaagagcaugaauaaauuaaagguaacauuuuuuugguauauaugaaaguuuuuaaacuauggaaucagagaaacacuugauuucaucucaggauguccuggagucucuuaggagaaauuaacuagcaguugacugugagauacauucagguucuuaaguguugcaugcuuuucauuguauaacgucuguuacugucugugcuuuuucugugacuauaacaugucgauauugaacagcuaacucagcuguuaggaucaugaagacaauagaucccagguacuaauuuaauccagauguauguauuuaucacuauauguuuauacugaauaguaccuggcacaucauugccauuuaguuaauacuuuauuuccauuauaugaucaauauaaaucauuuguucaaaagauuauuuuuaaggaacaauauuuugugaaguuucugucugauacccaagaacuaucuaugggucccaagaaauuuccucauuucuucauugguaaagcaggcacuuuaaauccucagauucuaaagcaguuauucaaugagaggugcccauaaagcacucagcguagacuagagcucugagcacaauacaguucacacuacuguuaccgaugcucacuuugugcuaugugcagugcuaaaagcacaguuggaccucacugcaacuucacauaggguagaugcaucccacacccauucccacuguaggucaagaagcugaaguuuggagggauaaugaaaacucauuuggauuaaacuauuaauagauaaggaacuuuuuuuuucuaguaagaacagauaggcugggcagugguggugcaugccuuuaaucccagcacuugggaggcagaagcaaguggauuucugaguuugaggccagucuggucuacagagugaguuccaggacagucagggccauacauagaaacccugucuugaaaccccuccccccaaagaaaaaaaagaauagacagacaaacucaaauucuaucaagaaaagucuuaauaaaacuacuaguuuggcauacaguuuuauacauagcaucacaaugucaucaaagugcuucauuuucuucguuuuuucugagcucuggcuccgaugauaucuagauggcugccagcaacucccagggcuacaugcuucaucaguaugaagggugacugcccguacagccauugaaacacguucagcacuguuucaugaagcagucacuaugguggcagcugggaucauccugaucuccuuggaccucauacauaucauccgacauugugacugggaguggggacagucuccagcacacgaacagaucacauugcacaguuggacgguuguggccacagugcaucuagauuggucagugaguagcaagccuagaaucgaacaaugucauguuuggucucuuucagcaggcaaagacacaagcucuuuuuuuuuuuuuuaauuuggccugaaaugcuuaaucugagcaaugauaauguagacuaagugucacauugcuguacuaguacguuugcauuuguagacuugcuuaacuguaguagguuuguuuuagucugaaucaugccuuugaaaccagccuacgagacugaaaggaugaaugcccucgacucauagggagaaaacugcaggaaguggguaaguugucuagcuucaccuucaagaagagagcugagcuggagugggaacgaaagggcugcugauuuguaagccacuguccuuucuguagugcugcauucucgcgaggagcgcuauugcuuccuuuuuuuuuuuuuuuuuuuaaauuuaggaugccaaacuggaaggcauuaagcaguguguguccaucacugcuggcuuguugauggcacagcugugaguccaacccucaucuucugacuccaaagccugccucucauccauauguugccacuucccuugguggaccucauaaagccagaaaggaugggaagugcuucucuucccucacuguuggacggcagggccaacacuucucaucccuuauuuaaaaguguucauuguacugcccuaugaugugugggagagaagagacucucccaagcguguccauaccuguaaaggcuaaaguccuugcugcuucccuuccauuagagccuagagcguucuuuagcaguggugagaaacagcucucauugugccucaguuucuggagcaucuugauguguaaccaggguuucucacuggccugccuguuuaggaguggagaccagugaggggcacaugugugauacaguuucaggcuuccauaacuccaugauauagaaagaccaguaguaggggugggugaaaagauggacaaaguggugcugaacagacuugagauccaugcgccggcgcccuggagcaugugaagaggcagggcuggagcaggcgagugccuggcauggacucaccaucaguguuuauugcuuugcuucucgcugauggcuuaugcucuaccuacauucaaagaugauuuacagaaguccggggccaacuccuaaggggagacuccugcuugccagaaacagcuauaauaagagagucguuugaccaggaagcucacuucaagagaaagacaugauguagucuagucaauguuuuuuuuuuuccucuccagacaacuuaaaguaaucuucacccuguuuccauauccucugcugguggagucuccccgaacuguuuccaguaaccuggcagagcuggagaucaacuucagugauaccagaaagacaaggacaguucucauggccaaauuugauuccuuuuguuaaccaaaaugucaacaacuuuauucauauuaguugcauuucucauugcugaagggaauuuaaggaaagacuuuagucuggcuuacugauugugauuugaggauacagucugucuugauggggaagucagggggcaggagugugaggcaguuggucacauuguaucuguagucaggaagcacagggagagggagagagaaagggagaaggagagacagagacagagaaacagggagagaaagagagacagagacagagagaaagacagagagagaaagacauagagacagaaagacagagagacagagggagacagagagagacagagauaugcugaugcacagcucagcuuuucuuuuguauucagucugggaccccaaacuaaaguucucuccauuauaaaggugaguguucuauccucaguuaagccuuucuaggaaaaccacucauaacacauccauugguaaguuucaaugguguuuuuaugucccaauaaguugacaagcaugauugaccauaugagacaucugaaacauguugcugacaaaaauaauacaaaacuaagaguaccaucauguuugggccacugacaccaagggcaggagguaccuacuuaaagaagaugaugugaauacagaugacaccaaagaacugccuuucuccuuucuggaaaugaagccaggguggcacaaauuuuguacuguguuuugacacauguuuugaauccacucagaguaccauuuacugagacugaugugaauaacacauuauggugguauacagcaagacaaucccauuugugguaccuuuccaaagacaucacugaggacuaacauaaauucccccuggguacuucuuguuagcaauucuaauaguaggcauggguaauaguuaacacgagaugagaggugucuggaaccuuccugaacacacaaacggaugugucugugagggguuucuguuuuauauacuaaucaauaacuguucuucaucuucucuuccagcaaacugcacuuccagguggcguguguccugcccaagaaaacgaaucaugagugcagugcucuuugccagccaguaacugaucuagaagcaaugaguacuagauuggccaauaagaaauaaagcaaauguuuuucaga

SEQ ID NO: 2009 - RNA, 3850 nt, Mus musculus
uuuaugucucucuaugucucuguggcauuaucaaugcaucuggcacuuggaauguuggaugguggauugcugaagguuuugcuuacaaucuuagagcagaaagcaaacucccugaguugagucccagucugcuuccagcuggcccuguuuuagcuugccuaagcuauuaaccucugacaucucuuccaaguaaaaauaauaacucauaccuaccucaaaauguuguccaaagaagggcauuaaucuuuuguauuauuuaaaauacucugaccaaucccugaaaaaaaauaacaagaauucaguaaaaaccuagguccuggagagugggggaauacaagucucaagauuuauuauguuuugucaagugcuaggcuggaacuuguaugcuagaacuucuauuaaugagcuuguaaaauaaauaacauuaaaccaguuuuuuauuccaaacaguugaaguuugugaaggugaagaaaugugaaguuucuuuucuuuaucuguggaauaggguuagugauucuuagaguugcugcaaaucuaaugaaaacauguaauguaguagaagaaauggaauaaaggaagcauucucagugauguucagauagguguggcuuggauggcuugcuucaaauccaagggaacaucagaccuuauagguguggucaguggaaacaucccuuggcaucacggagccuggggucagugagcuuuugcagugacuggggaacuuagacuugucauguuguucucagcacucccccauccaacagcacaguuccugcugcagggugacuguuccaugugggucucucacucuaaaccuggcucuggauccaaguggcuuuugcgcuacuuccuauuggacuugagagucauagaaaaguaggacagacaucuuauggaucuacucauaugucuugacucauaucaaaaugaagaucucagcagaaucacuucaaaacugagugaaaaauaauacaucuuauucguuaaaugagagaaagauuccugugaaaagaacucaaugaaggcuuaaagggagaagaauggauucacaaggaagguguucaagaaggcugaaauauauugaacaagguuuuaggauuuugcacuugccucaguauuuagaaaugagugugauuggggaaaaugcagaacucaguaagaauguuauuaucaugagagauuagaagaauuacuuacauaucuuggcuaggugcauuuguuuuuagguagaccagaugacccuagaggcaucuucauaaaaauauauagcaaaaaagccauuauaucugcaguuuaaauaguuguagugaauccaauucacauaaggauuuugaggcuaucauucacuccaucacacguuagacauguaucuuuguagaaguucuaaaaguaaagauauugugguuaaaaucaugacauccuguuacaucuauguagggccauauauuaagcaguuuguuuccuggggcuagggacauagcuaaguggcagagugcucgccuaggauguacaaggcccuggguuugaucuuuggcaacaaagaaaagaaaagaaaagaaaagaaaagaaaagaaaagaaaagagaagaagaggagaggagaggagaggagaggagaggagaggagaggagaggagaggagaggagaggagaggagaagaggggagaagaggggagaagaggggagaagaggggagaagaaaggagaagagaggagaagagaggaaaagagaagagagaaaagagaaaagagaaaagagaaaagaaagaggcguauuuacugauucucgccuggucuucauaacacaugcaugcaaugaauaaauaaauacagauauuuguuucuguuguucuuugcucccuuaccuauggacuugcauuauucauaucucuugaagacauuucuuuuuuuuuuuuuuuuuuuuuuuuucaguuacugcagcacuuuuauuucuuuacacaaugacguguugcuggggccuaauguucucauugaacaguagaaaaccaaaauuugucauuucuuaaagaauugaguacaaaaaaccuuacauaaauuaaagaaugaauacauuuacaggugucgaugcaaacguucccaacucaaggcaacuaacaaccgaugguggucaggagggaagaaaccagaacugaaacuggguccuaaggcucggacuuucccacccuguuauacuggcaagaaggagugguaacugguucaggaacccuugccagccucaggaaauccuggaagucugcuguugguuaauacccugcacagaucacucaguggugcucacagagauccaccaggcuggggcuuucucaucuacagcgugcucuccccagcccccaagugaccgagccacaugaacuaaggacuaaaucaagauaugcacaggguauuaaacauauaccaagggagcaguuaacuugaauacaaggucaaaaaucagcaacaaguucuacgauccagugcugauaucagauacaagcuucaaggacaaauuucuuuucaaaggcuuauuccaguuucaugaggcuagcaugagguguguacauuugccagggcaaauugauacuucaauaucagcucaugcagcagaugccuggcaccugcucaguccaucuagaagcauuugcgguggacgauggaggggccugacucaucauacuccugcuugcugauccacaucugcuggaagguggacagugaggccagaauggagccaccgauccagacugaguacuugcguucagggggagcaaugaucuuaaucuucaucgugcuaggugcuagggcugugaucuccuucugcauccugucagcaaugccuggguacauggugguaccaccagacagcacuguauuggcauacaggucuuugcggaugucaacgucacacuucaugauggaguugaaaguggucucauggauaccacaggacuccaugcccaggaaggaaggcuggaagagugccuccggacaccggaaccgcucauugccaauggugaucaccugcccgucgggcagcucguaacucuucuccaaggaggaagaugaugcagcaguagccauuucuugcucaaaauccagggcaacauagcacagcuucuccuuuaugucacgaacaauuucccucucagcaguggugguaaagcuguagccccguucagucaggaucuucaugagguagucugucaggucccggccagccagguccagacgcaagauggcguggggaagggcguagcccucauagaugggcacugugugugugaccccgucaccagaguccaugacaaugccaguggugcgcccagaugcauacaaggacagcaccgccugaauggccacguacauggcugggguauugaagguuucaaacauuaucugcgucaucuucucucuguuagcuuugggguucaggggggccucggucagaagcaccgggugcuccucaggagccacacgcagcucauuguagaagguguggugccagaucuucuccaugucgucccaguuagugacaaugccguguucgauaggguacuucagggucaggauaccccucuugcucugggccucgucacccacguaugagucuuucuggcccaugcccaccaugacgcccuggugucgggggcgcccuacgauggaagggaacacggcccugggggcgucgucgccagcaaagccggcuuugcacaugccggagccauugucaaugacgagugcggcgauuucuucuuccauugcgaucggcgaaggacgcggcggcgacggaggagcggcaagaagcgcaguguaagccggcggcggagugugagacccucuugaagacauu

SEQ ID NO: 2010 - RNA, 1673 nt, Mus musculus
aaugcuuugacuacccaccguucuucaccagaugagaccaguguccccggaacuggcucuucaucucacucaggccuaugccaaagauggaaaauuugauguggaugcuggagccuuaaugcuucaagguguagaucuuuuagccgaugcuguagcuguuacaauggggccaaagggaagagcagugauuauugaacagaauuggggaagucccaaaguaaaaaauggggucacugucacaaagucaauugacuuaaaggauaaauacaaaaauaucagagcuaaacuuguucaggauguugccaauaacacaaaugaagaggcuggggauggcaccacugccacuguucuggcaugcucuauugccaacgagggauuugagaagaucagcaaaggggcuaauucaguagaaauccagagaggugugauguuggcuguugaugcuguaauugccgaacuuaagaaauaaucuaaaccuuugacaaccccugaagaaauugcucagguugcuacaauuucugcaaauggaggcaaagaaauuggggacaucaauacugaugcaaagacaaagguuggaaggaaaggugucaucacagggaaggauggaaaaucccugaaugaugagcuagaaauuauugaaggcaugaagcuugauagagaauauauuucccuguauuuuauuaacacaucaaaaggucaaaagugugaauuccaaggugccuaugucuuguugagugaaaagaaaauuucuagugauugguuuacuguaccugcucuugaaauugcaaaugcucaucagaaacccuuggucauaaucacugaagauguugauggagaagcucuaagcacacugguuuugaacaggccaaaaguugguccucagguuguagcagucaaagccccaggguuuggggacaauaggaagagccagcuuaaagauauggcuauugcuacugguggugcgguguuugaagaagagggauugaaacuaaaucuuaaagaugcucaagcucaugacuuaagaaaaguuguagaggucauugccaccaaagaugaugccaugcuuuugaaaggaaagggugacaaagcucacauugaaaaacguauucaagaaaucaccgagcagcuagacaucacaacuagugaauaugaaaaggaaaagcugaaggagcgacuugcuaaacuuucagauggaguagcugucuugaagguuggagggacaagugauguugaagugaaugaggagaaagacagaguuacagacguucuuaaugcuacaagagcagcuguugaagaaggcauuguucuaggagggggcugcgcucugcguuggugcaucccagccuuggauucauuaaagccugcuaacgaagaucagaaaauagguauagaaguuauuaaaagagcacuuaaaauuccugcgaugacgauuguuaagaaugcagaugcugaaggaucuuugauaguugagcaaauucugcagaguuccucagaaguugguuaugaagccaugcuuggagauuuugugaacacgguggaaaaggggaucauugaucuaagaaagguuguaagaacugccuuacuggauguuguugggguggccgccuugcuaacuacagccgaagcuguagugacaggaauuccuaaagaagagaaggacccuggaaugugaa

SEQ ID NO: 2011 - RNA, 22003 nt, Mus musculus
uggaguggggauuaagaggggggaauguaacaggucccguuugcagcccaauuaggauuugggguuuuguccucacucugagcgucauuugacgcugucuggggagggcgaggccgaaaccugauccuuuaguaccggggcccguuaauguuuaaucagagaggaucuuccgauggggcucgggguggcgugaucucccggcccccaggcguccaguacccacaccccagaaggcuuccaccuucacguggacgcgcaggcugccggugggcucccguucucucucucuuucugaggcuagaggacugagccaguccuuggcuccccagagacaucacggcccgcagccccggagccaagugccccgagucccaggcguccauguccuucccgaggccgcgcgcaccucuccucgccccgaugggcacccacugcucugcguggcugcgguggccgcuguugccgcuguugccgccgcugcugcugcuguugcugcuacugugccccaccggcgcuggugcccaggacgaggauggagauuaugaagagcugaugcucgcccucccgucccaggaggauggccuggcugaugaggccgcacauguggccaccgccaccuuccgccguugcuccaagguaugggugccaggcaacggcguugcuuugggguuggggugaugcucuucgggggucuucucugcucaucuagccgucugguggucucuaagugcagcccugaggugcgggaggcgagggcaagacuuagugcucagcugcaccuuguggcacagagugaugggggaggccacgugcuaaaggcacugcggggcuugguuccaaaagugugaggcggggagcgggcuaccaguguggucaugcagaaaacguguccuccgaaguaaaguggcaucgggaggcugagaacucuaguggcacaucuuucucaacuggucauccagcagucauccugggugccuguugggguucuguaggccucgauuuagcggaagggugucaggguugcaugacuggagcacugguaggugaaugagugggugggcggggucagcuucuugagcauaucugccucuggcucugagccacgggaagcucuugcuugagcaguucccuccaaaugaaucuucccaggguuuguuccauugaggucuuuuuuuuuuuguccggcuuggaaauagacuugggguuggaggcuggagucauucacccggcucuggguggacagcuacucugucuugaucuuuuguuaaaugggaaauaaagguccuuuggugaccacaggggugaucuacggauguaaccaggaaaaagaucacuuuggaauuauggccccuugcagugggguguaucuggccacugcuacuggggcagaagagagaaugggcuucugagagagaccuagccccagccagugugcggguggguagugucaaguucucaacucgaaucaccccucccaauguuccccaagcucugugccuaaagggauguggagucacggccaggguaagaaaggacauuuuagagccaggcaugccuauaaucuuggcucucaggaggcugaagcagaaggauugugaaaucaagaccagccugggcuacauagcaaggcccugcugcaaacaaauaaggcaguuauaaccaccacagcccccaaagcgacgggcacaggaaauacugaguucccuguuuugagagaugagagggcagaagugaguguguaucugaggggcucaggaacauccuaaaauuugaucuuucuuccuuccuuccuucuuuccuuccuuccuuccuuccuuccuuccuuccuuccuuccuuccuuccuuccuuucuuucuuucuuucuuucuaugaauguuugaugggaauaaaauuuagaaugaacauaauuuuggcgaggaauuucaguccaauguuuuuauucuagccaugagauacugggaccuggggaaaggaggugcacccugucuucccggaaagcucgucccacugcagagcaccuucucaguucuguagcuuuucguuuggcagagggcacucuagacugagcuuugaagcaucacuaggagcucagcgaacgaagguggcauggaaaucuuccagagagggcgugucaugaaugaggcgcagagcuggggaaggcggagaaagaggaaggcucaagugucugcagcccuuaugcugacgucugaaaugggagcuguucugaaccccaaagguccuuugugcuuuacuugaugguaaagcuuaggucugaucugacucaagguuaucaagaauuuucaacucauuccaucggggugaauauauggauaaucagacauuugcugcauugaccccugagcugacuccucacuguccauugcucccuuucuagaaugcaagugaaguuugaauucccaauacaguugagcccgagggcuuuaacgaaaggcucuggauagagcuccucuggucaaaggugcaucuguaggaggugaaggcgcaaaguggguuaaagucaaggcuaaggaggagcuucaacauuacucuucagccauuggguguugggaaauccguggaagguuucuaccaggcgcgccucugucucaugccuuugcucuuggcucuccccucucuguauggagguguggucuugcuccuuccacggaucuucucaccuguuuccauuugccaagcacccagccaggugccgugcacacucgucucuuuugaguacccuuguagguguauccugggagugugaugggcccugcaucacaagagcuaucugggacucgaaaacauugagucacuuacucagggccaaaugccaguaaauacuggagaugggauuaaagcuugaagcauuugggucuucucugagcugcuucuggaggaagucagagguguugggauaggaaaggagcgaauuaccuuggauggaucacugaacgaggaggugugacuaggaaggccuuuggguagcagcgucagcugaguggccaggccguggauucuguaaacagaugggugugauauggaggcugccuagugcccauaccuucucuuccugcugaccaccacguuugaaaauguguacaccccaguagcacaaauagcugcaucgcugggggacuugugguuuagucacaguuuggucccuuugauauacaguuugucuauucuaucucucugauuucacuccuaaccugcaggcaggacuggaauauagcuuggagguaauugacuuucccacaguacccuguugugugaucucucuucccauagaauacuguuuagccuccugggaggaauaacucuauccaucaaaguaaugcccugggcaagaugcuuccucucccccuuuagcagugaaguguaggcacugaaggccauuauaucaucacccuuucaggccuagaaaucuuuuucggcucuaacauagcagagccauuugauucacugucugauggucauaacacauuugccucucaaacccuaucuucuguccuaacccccaagcugcucagcacugguuaccaucggaagguuuggcauuuugauuuuaugcuguuugauuacagucucuuuaugccaucgagcccugaacugaagggauuuagcagguuuuaaacaaguccuggccagcgugucccacucaugggguauuagguggucugcuucagccgucccuuucaacaauuccaaagccauauggagauauagcuucagaagagggcauggcauguuuaaaacccccaagugucguauagggaagggaacaggcucauccucuguguguauuccucacugaggaaaagcaucgucaacucuucgugauggugguggauucaaggauugaaggggauggaaauacaagaggcaaggagguuaggcaugucucaggauccuucuuuuugagcuaacagaaccucccaggauaaugcaaaugcaucagcccguaggggugcagaggaagggcuaguagggugcagaggaagggcuaguaggggugcagaggaagggcuaguagggugcagaggaagggcuaguagaggugcagaggaagggcuaguaggggugcagaggaagggcuaguagggugcagaggaagggcuaguagggugcagaggaagggcuaguaggggugcagaggaagggcuaguaggggugcagagaaagggcuaguagggugcagaggaagggcuaguagggugcagaggaagggcuaguaggggugcagaggaagggcuaguagggugcagaggaagggcuaguagggugcagaggaagggcuaguagggugcagaggaagggcuaguaggggugcagaggaagggcuaguagggugcagagaaagggcuaguagggugcagaggaagggcuaguagggugcagaggaagggcuaguaggggugcagaggaagggcuaguaaagugcagaggaagggcuaguagaggaugcucugucuucugaaucauuggaagaaucagaagacugggaauggggugaggggagcugaaggcuucaggcaaggcuugccuacuucugucucucugaagggucuaucuggugcuuucucucugugcuuaggguaggggugguuugcaaagccugaauagcuaaggugaucagauuaaaaggggcuggacauugaaugggcccaccucuccccgcccaugaacuuguuuaaaauaacacaaaacaccuuuccauugcuuuauguguaaugugcccuaugguggcagucaggagcaguauguccauguauucugacaggcuauagagaucugcuuuuugccccuuccaccaugcuuugaccccucugcacaauaggcacauuguagucuuuucuuuuguuuugcuuugcacccaugauuacccugguguccuggugugggcucccauguguguaccaggacuacauaccucucauuagauucccucuguuuugcucaggcccuguuuggguaccacacguuucaauccaccaaugauuggugcaacucaagauucaacaaggccagggccucuaugcuccauaagaaccuuuuuauuggaguucuguggagaguuuauuuggauaguucaggguucaaagcaugggcagagaaacagugaaaaauauacacauuauuuaugauuauucucaccagauguacucaggagacagaagguucuacaggaacagagugcaugcaacaagacaacaugggaaaaucugugauacgcaugcuacacugagaugaggucaugcugggguccucacguucucugcuucucuuccuucuuggggaucaggaggccuggaggcugccaggaaccuacauuguggugcugauggaggagacccagaggcuacagauugaacaaacugcccaccgccugcagacccgggcugcccgccggggcuaugucaucaagguucuacauaucuuuuaugaccucuucccuggcuucuuggugaagaugagcagugaccuguugggccuggugagccaucuucuugggcgugggacuuuccaggaaggauggacuuccauguccaugucucgacugaccuuagugugcccacugccgagaggcaggaccaguaagcgccuguggcucuugguucccugaauaacuaacugccuacuuaacuuggccacauccccaugcugugucuacaaucauaggaggacagaggggaucacaaggcagcuagcagcagagccccugccugccaguauacguuucugguuugucuacugccugugaaaaccugcagggacaaggccuggggaugcuggugacaaaggugucaaauaugucagauucuucucguuugggacaagguagugcuucuccauaacuccucugaauguugccuuucuuugcuaagaagguaaaagggguacagacuaucaccugcccucccugucuucuccccaucuuggcacuccagguucucaccucucuucuccacuggguacucucagcccccugcacacccuuaggucccagggcucagggccuugcccaggccuccagugugcauugcacaugcaccuggucuucuggccucagguuccugcucaggguuuaaacugacuuaagaucuuguuacuaaaugacaguggggcaugggccaugccacggagcaggaggacaucaaaucagugccucccauccaugcacucugcacuuuaccaagcaucgccugugacacagccuugaaccuuuccaucaagcuuacggcaaagguggagacuggauggaugguugaugccagagcaguuaguuggugcugugugcucagugcaguggggaaugaguaagacaccugaagugccagggggccggcaggugcccgcuggucagggcaacaagcucuguacagggggccauaggauuugcucuaggaacuugagcccggagucucaaagggugcacuggccucagcucagugucccacuaguuuguuuaguuuagagcagaugccacucucucccacgauuauccguaagccagauggggugaugggagccaucuuuugaggacuaguggagacuguggaauauuuuuuugaauagggauagguugagacagugucuuguuuuguaguccaagcuggccucucacucgugauaaccccaccccugcuucugggaugcuuguauuacagacaggugccaacaucaccagcugaauguugagcguuuaagcagauauuaaguaaagacacuggcagaggguaggaguccuggggauacugaagcaccuagagaugucuugggccucuaggaguggggugaagagaggaaacugaagcauggaggaagggcgugguaucugaggauguagauguguaagccuggcuaaggagcagggugcaggccccucucucaaacuaaugcagaugccuccuauuagccaaacacacuggaggcugggaggcugguugcuguggucugcagggccagugcaaaggccagggaugggagcagaggccccauggccagcacugguauccugacuggagauugacgguacuaagauuccugaccacaucccugaagcuaggcauaaccugacucucaggggagauguggagcucagaauccagagaguggaauagagaacccuccgagcaggcauauagauucaggggcuggaguuacggaacaccgugcuccccagccagagagaaaugaggacacuggccccuggucugucuucugggccccaggaggaagacuuugugaaggcuggggagguggacagucagguggggcugcugugggcugcuauuagcugaagggcuuuugaagcuaagugcauggcugucugguucuguaggcccugaaguugccccauguggaguacauugaggaagacuccuuugucuucgcccagagcaucccauggaaccuggagcgaauuaucccagcauggcaccagacagaggaagaccgcuccccugguaagguccccaguaagccuccagccuccacuugcuuugcucugcccguccucuucccaacccaccucagggcuccagagucugcacugaccucucugugcucucugcauugcuccaugcagaaaugcaagaguuuucccucaaaugccccucuccuccagcuucgcauccguguuggcuucaucccuuccugucuuagucaguguucuauugcagugaagagacuccaugaccacagcaacucuuauaauuuaacuaggguuggcuuacaguaucagagguuuaguccauuaucguaauggagggaaggaugacagcagguaggcagacauggugcuggagaaggagcugagaggucuacauuuugauccacaggcagcggaaggagauugccacauuggguguagcuugaacauauaaaaccucaaagcccgccuccacagugacacacuuccuccaacaaggccacaccuacuccaacaaggccacaccuccuaguagugccccucucuaugggucaagcauucaaacacacgaguguaugggagccaugccuauucaaaccaccacaccuuccaucuggauuggacccucuugcuucacuucugcuccaggaagagccuaaacccgacugacccacuauuugugcgauacccagccuuguagacaaggacagaccccucagcaggacagacacaauucacaucaauggcucccauuuagauaucccagcucaccuugccccuaucaccaguaucaucagcuugcuggagguucccugcaucugucaacagucuaccuagugugucuugcuuucagagauggagaaagagacuugggaagguggucuggaucugguaggacugugggugacaucgaauugaaaaaggggaaccugcuuuggaaaaggaucagagguucuguggagugugaagugucuguccccuucaaguauguaaggaagguuaauguauugcuuaaaucgacggggcauggauuugggaagauggauggaggcuggcagcugggagugucugagcuucucaggcugcuggguuaguuaugcaagcagccaggguagcccccgaggguggccacagagcucucugugccagccacaagcggggaggggcaauccaagguuccuuuuagaccuguaccucuaaaauaccuacuaggaacugaacuuggccugaggccugcuaggagguucucaaagacuuaacuguaugcccaaccccaggaugagaacucuuuaacgauucauuuuuuguuuuaauauguguguuuugucugcauguauguauauguaucaugugccuugugugcauauaucuaccaugugcaggcagugcccgcagaggcuuugaagagcgcauuuggucuucaggaacugggguuguagauaguuguuggccaccauaugggugcugggaacugaaccaaauucaucucugagagcaacaaaugcuuguagccauugaaccaucucucuaguggcccaggcugggaauuugugaguguggccaccuugggcuccuccuuccucuccuccauucuccuagcucuccuucuauaggaaccagacaugugcuacccucugcaggccccuccaccaggccugcacaggcacacacacccccuaagggucucauguagugcucacuccauuccuguuucuugaagaaucucacccacuugggagggaaggugcaggugucagguucauggcgagcuucccacccagacucaacaggggaagaaauagcccaugggcuuaccaggcccuugcaggugcaucuguggacuaggagccuguuuccucccugggaaugugucaggcagccaggaugucaggcaguccugcuaguuucuuucugucuucucaguccuugccuuaguaagcuggaagagcauauguuugggagguuggcuuaucuuauaccauaauauuguguucugaaugguccuauuguuuuacauggaacuggauaccucaguuuaccuccugguucugucauuuacuagcuacaggucgcaggcagcucccagcccucucugugccacccacuccuugcuguaagauucaauagcaugcagcuuggggagauuucccaugagccgucuaaugcgugggguggcagacagcucuguacaugagcaauaguguuaacccaggaacuguucuccucacucccacaauggcugccaugggaagauggaagcagccagguggagguguaucucuuagauaccagcauccagggugcccaucgggagauugagggcagggucaccaucaccgacuucaacagcgugccggaggaggaugggacacgcuuccacagacaggugagugugacucucacuucaucucagaggugggugaaggugggcagagguaccaccccuggagcauuaugucaguacugccaucauuggggugcuaugucagucuguccacacccucucacgugauccccguguugauugaucaggcgagcaagugugacagccacggcacccaccuggcagguguggucagcggccgggaugcugguguggccaagggcaccagccugcacagccugcgugugcucaacugucaagggaagggcacagucagcggcacccucauaggugagugacucucuggguucuacccagccaaagcuuagcaggaagcaaggucucacugucaggcagucucugucacgcacaguuuagagagauagaguugggagggucccgagaucaagaaugcaggugggaaacugaggcuugggaggggguggggcucaguccagcgggucugugggugaguacuuccccacagucugcacugcucccuugucagugcucuuacaguguugucacaugucaccugcaguagauuugcaaagccccaaggugguagaagccaguuuucccaucuguguguuuaccaccaaguugggacaccuucuuggugggggaacugccauggaucuuuccagauguuugcagguuauuccauuaguccacuccagcagggacccagaagccuagaacuucaguauguagguagggagaggacgugaaguagugcuggcucacuguaccucagcaugcugggcacagagugcgaggcuuggcaugugaccccgaggcuggcaugagaugauggcuaaacaguaagcccagccagugcuccgggugggagccugccagcaucuggggaaggagcugcuaauggcuugacugccaccaaccagucagaugcuggcccugagcugacccacacaggauaagggaaccagcuuggcuuaucagugggacuucaguuaccuuuguuuguuuuagaauuauuuuaugaucauggauguuuugucugcauguguguauguguaccagguacugggaacugaacccggguccucuucaagagcaucaagugcucuugaccacuaagccaucuuuccagccacaugcuugggacuuuagagcagucagccacugacacauuuaaagcaauagcuucugucccaucaggaggcucucgugucugucccacccacuuauugaucaaccucaguccagcuugccaccacugaaggccacuguguagaaagagaccgcucauuucccggaaguccucacccaggcugggcucuggccucuggagggcuucgugcaggagaacugccccuaccaguguguagaaagccccuaaugcaguccaggguggagugggcucagcaugaaggagcugguacuccagccuuaggcuccucuguaugaagcugggggcagggguguaagggucuaagcucaggucuacagaagcuagaggccauuuguaaucacgaaugucaccaaugcuucugugugcacuucggugucccuuaccuccuccuggugugaggggucucaccaaccaacacuuaacauauaugguccuggucuccaguucccaccucagccacggggacaccuggauccagaagguucugagagguuggcugguucacaccguguaacagaacaggagccugaagaggaacgaagcuguuaggccaggccagcugugguuaacucaggucucuagauuacaggccagcaaggguuagaguuaaauagagcaggccauuggcaaaauugaucuucacacucauucaguguggggggacagaguguugcugauguugggggaugacgucuucguaguggagagucgugggcggugcuguggagucuuuaacucccgacuugauauaaauagcacuugcccuguuuaugcaggguagauuggcagcuugugagugggugccaggguggucucugauuauuuugggagcaaaacuucaaguguggugagagggccucugagcaguccucagaggcacguggagguuucugaagccugaagcuguaaaggagguucucucauuucuggaggccuaggaauuuuccggaaaggcauaaaacaaugucuggugaggauccuaguagcuugcauuuugguucucugagaagcuggagaaguuaaaaguggaggaaauguuucccuuuuuuagggcuagugguuuuuauuuuaaauccauuauucauuugacaaauucauauguguguauauuuuggucauuuuacuccccuauuaucuuuucuuaccuuucuuacccucugaugaaccccucuucuuuccaauuagucucccaccgauuuuccugucucuuguuugauagcauguuuugugacccauggaguuucaguacaguugcuagcaagaguguuauuuacaggaacaugagcaacuuaacaguguaccucugagaaaaaaaacaacacccuugccccagagagcaguaaccuccuaguagcuccuuuagggugggcuucgugagucccucugucaucuaugauagagcauuaccaccuggugagguaacauggcuacugucaugaguccaguguccuugucacguucagaagacagcaauuugcagcacuguugccaccccugguccuuacauucuuucuuuccccucccccucccccuccuccuuccccucccccuccucuucccucuccucccccuccccucccucuccccuccccuccuuuuccucccucuccccuccccuccuuuccuuccccuccccucccuuccccucccccuccucuccccucccccugguguuccuugaauccuguaggagaagggguugauaaggauguccuguuauggcugagcauucauggucacuucuccucagaacuuugaggugaggcuucucacaccaggaaggggcaaggggcagugauguggacacagggguguaggugacaucuggaacuacaaccgacccaguuaugagucucuuuguuaacugcucuccacuuuauaaagaccaaacuugagaguagcacaaaucuguggguacccacaugaacauuuaguaggcgguuuaauaauaugaucauuuagcaaagccaguggugcuguguuugcccuggggccuaugaucuucccagccacccuuuuuuggccagguuuacaauacccuucaguggagugagccucaaauccaaccagaaagugguuguuuacccacgugauagccacaccagugggcacuugccgcuggccagguuugaacugaacucaaagguuuacagcuggguaagccuguugacuucuaucuucagccagccugcagccuucgacugugagagcucggcagcagggagcaagcuuccaacucaguucuagcuugcuuucuccauguucuagguaggguuaucuagaguaaccuaacuuauaaaacgagucucugucucucucuccauacauguguguguauguguaugugugcacgcacgugugcgcaugugugcaugcuugugugauuuauuggaaugaguuacaaguccagcucauccaacaaugcugugaaugggaaguccaagaauccaggaguuccucggucugugaggcuagaugucucagcuggucuucacuauaucccaaagaagcaggcucuaaugccagcagagggguagacuugcuagcaaggugagaacgagcaggccaagagcaaaagcugccuucuuccaugaccuuagauaggcuucucagcagacggcaugacccagauuagagguggggguuucccaacucaaaagaucuggauuaaaggugucuuccuaccucaugcaucuggacuagaagcugacaaucaagaauagccauugcauccugcaaccagugugugauauuugcagaaauaaugcaacuagaaauaaucuaguucuggggaacacucagcuccuucaguuuugagucuaaauuuaaucuaggggcagaguuauuccguuccucuugggauccguugcuuucuuucaaggcauucgauagauuggguaaggaccaucaguguuaugggagcuauccacuuuacucaaagaaagugaguaaaugacuuauauaucagucauacaugaaauacuucuaaggcagcaaucagauagguuaagcauccgagcaccaaaccaccacaaaauaacggaucacacugugucucugaggggaggagcuggaggaggaauguauaucucucuagcaggugaccugggugauuuuuugcaggccuggaguuuauucggaagagucagcuaauccagcccucggggccacucgugguucugcugccccuggccgguggguauagccgcauccucaacgcugccugccggcaccuggcgaggacugggguggugcugguugcagcagcugggaacuuccgggacgacgccugccucuacuccccagcuucugcuccagagguaggugcugagcucuucugucagaacgagggaagauggcccccuugcugaccgagcugccugggcugaaagugcuuagagcccccagaccagaagcccugaugggacucaugccuuccccauuccaaugucugugggaagcugugacccaggcagccauaccuaugauccuggccaucucuuucucccuucccccucucaggaccuggggccuuauccagucccucuucugucccuuggaaggcagaauagcacccucaguggucuccccacccccucugcuucccuagaucacccacaauccccugagccauuuaugcaucggacccacuguccuguccagucccuuacccucccccacccauugaccggcuccccaccuauaacugacccuagcgagauuggggaggacugcugcccccaaagcccucauaugaugagcucauguaauuaucuaccaugucuggggcuguggcaggcgcauucugggagaggccucucuggaggcauugacaguccaguggucccauccuuaucugggggacaccugcagagcaucugcuaugcagugaacgauuagugcugaacguguagaaggggggggcaccuguccccguucaaggcuucauggaaccgagccuucccucccugaccaccagagcuuaccagcugcuuuauuuaacauugcugucuugccugcgcuagacuuuuuaugguaccaugcagcuugauaguaggccccuuuuccuacccggucucuacccuagaaccugggcuccacggggauucaggaaauggggucuggaaaauguuggggagcccuggaggaggugagaugcagagccccccaagaagcugcauuucucacaggugaugggauuucagggggccacagugagaacugugggaacuggaguuggcuaguccagaggcaagaccugccucucccauugcagcgcugggcuuucucugcuacccacuccuuuaccaugccaggucaucacagucggggccacgaaugcccaggaccagccaguuaccuuggggacuuuggggacuaauuuuggacgcuguguggaucucuuugcccccgggaaggacaucaucggagcguccagugacugcagcacaugcuucaugucacagagugggaccucacaggcugcugcccacguggccggugagucaccaccccaccaucauccugccaccauagcccuuugacaggcagcagggucugugccugaccuucugggucagcgcuuaugcccgagggcaacugugagggggagcagacagggccuccuguggugagcagcuuugcugguguggugcagugucugagguaacucacuuaaaggaagaaguguuuaucuugucucaugguuucagagggcucagcauggucauuuggcaccuuuauuuuagggcaugacaugguggggagugugugguagagcaaaacuguuccccucaugugccuagaaagcagauggaaaggguaccccccaccaugcacuccaaugauguuuguauuaggacagaccuccaaaaguuucuguguccucccacagacugccgaccaagccuuccauauauaggcuuuuggggagaaauuuaagaaucagauuaucacaaggcccuguaaauggaguuuaauaaacucuauuauuuauuaauaugaccuggccagucccccaauccuauggauuauuuaaucagcucuugcacaacuacugagaauuacccuugagucuguuuuacuaaucgcuagacugucuacuuucuagcugugguacccaaguaccugcuguuugaaucucuccugggcuacuucugcuccagccgucccaucuggagguuucgggggcgaggaggggggcauuucacuggagcaugcgcuccugguccaucaugucuaguggagaccuccuguucccuccaucuuccucugccuucacucuucuuucuucuuuguggucccuaccugcaacccccagccccguaacugaaucucucccucucucuauucuccccagucaugggcuguagcagcuucuauuuaauugauaguuuuaaacgggggagcaaaguuuacauagcaccacugugaggaucuuguugggggcagccagaucuuagggggggggcagcacuuagcauuugaauaccuagcagcaccaggccaaccgccaacaaugcccugaaggacacugggucuacuagggaaggauacacaaauggauggaccagaaagcaguuggaguucuccuaguuguuccugaugcguguccuggcaggagcccuauauuuugggaagcagggccagccaccgcccucugugacucuguaccuccaggcauuguggcucggaugcugagccgggagcccacacuuacccuggccgagcugcggcagaggcugauccacuucucuaccaaagacgucaucaacauggccugguucccugaggaccagcaggugcugacccccaaccugguggccacacugccccccagcacccaugagacaggugagcaggauggcagggaggguacccagccccugcccuggccucacaggaagguuuucuuuccuuagcugcaguuugagggcagagacugaaaaggcuugaugguauuuuccugggaaaacagccagcuugaagccucuuuuccugccaucaacugaggcaaucccuaacaucucuggcgggugcucccuccacccuaagaccccacucaucugggccuuguugcaggcgggcagcugcucuguaggacgguguggucggcacacucggggcccacucgaacagcuacagcuacagcccgcugugccccagaagaggagcugcugagcugcuccagcuucuccaggagcgggaggcgucguggugauuggauugaggugcccgacccugucugugugucugucuaccccuaaccagucuuagccuacacugaguuuggcuggagagcagcaccugaccaggagagccagguccuaaggauagcaucugugaaaugucccaggcuggggcuggagcugggguauuagccacccauugucucugcuggaagcuuuaugauggagaugccuggagauagaacagucugccucaggccugggcaaaugacuccugucuagaguaguggggauaagcaagaugcugagggcuccaagggucccaacuaggugcccguguaccucugucccagccccgugcucuuucucacugguucuuuuuuuucuccaacucucaggccauaggaggccagcaggucugcaaggcccucaaugcauuugggggugagggugucuaugccgucgcgagaugcugccugguuccccgugccaacugcagcauccacaacaccccugcagccagagcuggccuggagacccauguccacugccaccagaaggaccauguucucacagguaggagucuaguccaagcugugaaaaaagaggccauguugauuccagaccgugguccuccugagccugagaccuggggcccauuuuaagccggucgccaucuuguccacguagugggauccucuuuuuccuuagcuuccgucugcaaaagagggugaugaugguggggugaugcggagcauagggagggggugcccggcacuguccaagggaaggcucugaggugugucucuaagggggugaaacucaguuugaauucugcacucaguagugggaucaaguuccuuaccauccugugcuugguuucuucaucauuaagugcaaaggugcaugccaugcauguagccuggugcugggacaaggcacaucagcucuccuugucacaucacugcccugacuaugucagaaacagucccaggcaaguaguagaggucaccgguaaggaccuugcaugcuguuaggggaugguggcucuccggucaggaggaggccacaaaguccugcguggauggaggauacaugcugggcagggcuugaagggcugggaaaucccuggggaaggcuggcucaguggcagauucugguggaguacaggcuggggagccacagaagguucuggagugaagggugggguuggcaaagcccaggcacagaauggaucuucagggaggcagaugauccuaguggguggcugcagccuggaccaggcaaggcucccuggaccuauugguugcaucaguacugggcucucauuugcuuuucugagugucaacagcuaagacccagggcauguguggagccaggagagccuuugaccuucccuaucugcagccuagcagagauccacuuaucagcuaagcaagccagugguucucaaccuuccuaaugcugcgacccuuuaauauaauuccucauguuguggugaccgccaaccauaaaauuauuuccguugcuacuucauaacuauaauuuuacuacuguuaugaaucguaguguaaauaucuauguuuucugauggucuuacgugaccccugugaaagggucauucuaucccccccaaaggggccuuggcccacaggcugagaacuguugagcuaaggagcuaccccucuguguagaguggcucuacugagcuccuguagcuagggcagagagaacuguagucccuaacacccuaagaugcaguccuugcaauaaauaauuuaucugcuaggaugacacacacggccucgaucaucuucauagcaucucuaugggugcucucacacucucaaugcuacagaagggcaccuaaggcuuagcagagccucgugaccacugugcaugguucuguagcuaguggugugucccuuacuuccaagacuagagucccaggucccaugcagaccuggcucaaaucauaacuuuuggugguaggacggggaagggacucaaagaggcucugaguaccucaggcugaggagcccuguaccaugcccucaacccccuucucuggcuggagagacgguguauuucuuaagaaagucaguuuccaagagguugcauggcucucccacagccccccagacggucaguggcagaggugaggauccagggauccugacgccagcaccauuucuacucggagcugucucucuuucccaagcuucagacuuaaaagaaagagcguuaguugggaccagaaagacaagaaguccacaaaauuacagagucugagcugcauguucucuguucuaggcugcagcuuccauugggaaguggaagaccuuaguguccggaggcagccugcgcugagguccagacgucagccuggccagugcguuggccaccaggcggccagugucuaugcuuccugcugccaugccccagggcuggaaugcaaaaucaaggagcaugggaucucagguccuucagagcaggugaaggaguugggggugguuggguacguuggucuugugugugugugugugugcugcccuguguugaggggguccaugugucaggguagcaggaugaguuaggcagcuuuuccuguuguaggcacagcaugugugcauuuguguauggcaggcaggcaggccugguuucacucugguccaguuaaacaaggcuugcuguccaccccugcugcucuuugagagcaggugugaugguggcaagcggggaaagaaagcccgugugugccugagcacuuucugauugguuauuuaccaaacaaaccugucgggaggcugccgaggcucugcaaagucuggacacaguguuccagaugcugaacaagugaaggcugaggggaaggaagaguccugggaagagucugaggccaguggcuggccuuucagagcuugaggcaggaguaucccuccucuauaaagcucugggggcggccagugugaggcuagacgcugcucugccaaggggaaucucagcuccacuguaucagugagcacaggcacccagagaggcuggcuccuggcugggcggaggugccugcuuggcccaccacgaguguccauucuggugggagaagacaguaagcaaagcaaguuccagagugccaagaggcuaacguggaggaaaauggagcaggcagagggguggguugagacaccauuacacaagcuuaggaugacaagccauggggccaccacuaggaacaauguuucuggcagaggaaacagcuaaggccaagaggggugauaggaucauccaggccccugcacugcuccagguccagggggugagggccuaggauggagugggagguagggagagauucuguaaccagagaugcauguaggugauggggaagaauggguucaggguuucuguugagccucugaacuaccacuaaguaggauggauggcuggggaggcaccgacuuuggggaugugaagguggcugaguuaaaugucugcccuggguuacuguugggugcaccccugcuugggucugagaggcguggagcuggcuuagacagccacaagucucagacauaggccgucuuccucacuguccuucucuggacucuggcaggucacuguggccugcgaagcaggauggacccugacuggaugcaaugugcucccuggggcaucccucacucugggagccuacagcguggacaaccuguguguggcaagaguccaugacacugccagagcagacaggaccaguggagaagccacaguagcugcugccaucugcugccggagccggccuucagcaaaggccuccuggguucagugacagccucaggcagggauggugcuugaggcugggugcagagauaugccugcauggcucucuuguagccaaagguggggagauucugcgugggagaacuuggugucucacccuggguacccauuccugguguauggaagcaccuccuucacggucagggggccugugcuuggcuuucugccaucagacauuaagcuguagcuggcucuggccagcugcuccaguguaccagaaccugaggaugcucgcugcaaggccucaguucucaggccuuaggguguauuugucuuucaggaagaucauaauggacagagauccuuggagguucaaagaccaaguaccagacuggaaaauugagucugaaagccacaaggacagucaacucacagccagcucacauugcagacaccauuuugggcucccugauuaaaugcagaucaguucugcacaccuccagggguggauccagcuguaaggccauaccuauaucuuccagauguccucaucugcugcagggcuuuggcccugcucaggauaaugugcuaugagcccucaucugacucucaguuuguacuggagaaccauacaggacuuaccgcaccuuaccccauccacuaccaugugcacugacuggccucauuuuaugaaggaagagacaggaccagagaggcgaugucacacagccagugaugucaggacauaaauucagaguggcuggcccugaauaaugccaggcugggcagcgagaggacaggcuauggcuugcuccuggaccuauacucccuuagccccagucccacagaucagguggagacuggagugacagagggcgacuguaccaaggccacaccagcugaccagcacaccucuauccuuuugagcucuucugucuuuuuauaguaagcuuccuccaccuguguugcuuuuguaacuugauauuuaugcaggguuuuguaguuuuuauuauguagugacuuuucagaauaaaagcagcugaugugacugacugcauccgacucag

SEQ ID NO: 2012 - RNA, 28078 nt, Mus musculus
cuagcguccaggcuguacuuuauuuuacacaagugguggccccagaaccacagggacaugaccuggagaguaggcacagugccugaggcugcaagagccaaauacagggauucaugccuucuccuugguccccaugaccaaauuaaaaaaaaaaaaacaacaaaucacacagcacacaucgccacacccauccccuccuuccuuucagcaacagccaauucagcuuucuagccaaagacaguggcuacaacugaauuuacagagaaccaugcagccaagaaaccagagccacggaggggagaggcuugcguugacuucccacaugugcugucccauagcagcugagugaccccaccaagccaccgugugguuggacacugacaggacaggcgauaagacaaggcugggacccagaacaccaugcuuggaagacgaccacuuuucgggcaagauauuacuggagccaaacacuaaccugaggcuaaugugacucaaaaucccuucccuccccagguccuggggagugucuguggagggcuggauuuugacuauuuugggugacacagguugcuggcaucauugccacagcuccaggugcuuugggauggaggcuugacuugaggaaugauggcgccuuauacaucacacuaacuaaccuagcucgcguugaccauucaucugcagcaagcagggucaucagucugcgagcgagugcacaugcgcaaggaugcacauggaccacuaggagagcccaugccaggaauacaugcugcucagacagcaaagugagguuacuuccuucacaggccaaauggaugaggugauucugccuucccacagcccugagugcaccagccuucacaggacacaguagcacugugcaguaucccaagcccucggccgcaucagugagcauccuucagcuaaaauaugauucuaaggguccugggcucugccagauaaaugaaaacgacccaggagcuggcguggcgguggagggaaggaccacugauggacggucccuagcuaccaccuggaucauuuaagcucccccggcuuucaacacgaggcuuucccaacgucuuaagacagacaggcuucaggagcucuaauguuccaagugacaggcgagaaaacugcagccucuggaggggcagggguggugggggaggagugacugugaccagcucagcucuggaguucuggcuugccuuccagaaccugauucccccucagacucuggguuuccagcugggccaggcaguucugaaggugggggcucuacaaccaaccacucuucaucaacaaggcagaaggaccucagaggccccucccuugggaacggaaauggagcuaacuuucucugagcuuaggauuuguaaggcacugaaauuaacuagagccggggggggggggggggggagggggggggagggaacaaaaugggggagggggagaugagugacccuggaugcuuucuuucuaaccccagggaggguccucacaguagcaacagggcagaugccccuuucucacucaguguggggaccgccccuaagugacacagucaugagcaugugcccccauugugacucaguggacucuagaggaggccuggauggugggaguuaagaaagcaaagcccaggaaagccaggcuucccaccuugagaugucuuccaggagcaguccugagugggcucagugauggcuggggcagcucgagcacacagaaguagggccaggaugguccgaagauggcagagaggacuuuggaguagaccuggcuuuggcacagcacauccugggccugccugccaaucagaugcccccugccccacccccgaggccaaguggaaggcugacccuccuuugcccucucggggcugaugcaagcuaugcaggugaaacuccaaggcaacuccuucaugguguuggccaaacccgugcaagggugaccuguggggagccugucuggacucagcuguuagauccaaagcaggagccaggcgugagguugcauggaagcagugguggaagcccuuaguguggggugacauccagcagguagauauuuuuuuuuuuuuaccuccuuucacagaugaacacggggcacacaggggccaggugacuagcccagagucagucacacagcuaacgaguggcuaaucugggccugggacuuaggucugucugacuccacgugcuuccacuugcccgagccacccuggaagccaucgggcugccucggggauguggagggguuucuuuucugagaccugggaaagcagagaagccggagcgagcgagggagagcagguccaugcagcuggcuccccaggugcccugcucagugccuugccgccuugcagaucuugucguacaccucagggaaggcguccuggcagcccagcugcuugcgcagcuugugguacaaggagccaucgaacaucucccagaauuccucgcgguucauauagcaaucggcguauaacauuuggaaccugcaugggagggaaggagugcggcggcggugaggauggacaaggugggugugaggccccugugucccccagaccccgggucacuuacccgugcacacuccgcacaaacuucuccagcugccucaugcaggaccuggccucgaagugcuucacacguggcuccccguaugccccgauguccacguagagcucugcuucaucucccuugggaugcacuaguccuggcuggcugggcaggaugaaugggcacagccagaugggguagaccugagugagaggucagagaaacagcuuggucugucuuuucccagcagguagcagacccgggacuagcucacccacauccuugcaaacgggaacuuugacuuuguaacccacuagagggucccaggugcuugcuuccagcuucaguucucccuccagcccugccaaauacuuccauauuacggggccacucuaaagcagcuuaucaggguacuacaguuccugggugggcuaagauccuaauuguauaguuggagaaaccaaggcccagagggcagauacacagaugggugggcgacacagagcuagggagaagaccuggguuccaugggaccacgcccgccuggucacccagcuuacguggaugucauuuuggaagguaugcagggccugugacaugcacuucaugggcaccagcauguccugcaccacguggugcugcucguacagcuugcguagcgucucgcccugggucagcuucaggagggagaucuugggaggcaccauccagccgaagagguagcggaagaugggguuguugccgaaagggaugauguccuaaaagacagagauggcgauggggaggaggaggaggaggcaggggcagcuccucaagccacuagggacagguaacuccagggugcacgccccucuuuauaggaggagagcuagggcuugauucccaucucgcagguuuaccaacuauaauggccuuggucuaguuacuuagcuucucugagcucagcuccuuugucucugacaggagagacaaacagauacugugaccaguaacacaguaaggugacuaccauuccagcuuucaagagugagucgagccgggcgugguggcgcacgccuuuaaucccagcacuugggaggcagaggcaggcggauuucugaguucgaggccagccuggucuacaaagugaguuccaggacagccagggcuauacagagaagagacaauucuuaagagagcuugaacaauuuuucuuucuuucuuuuuaauuggauauucucuuuauuuacauuucaaauauuaucccuuucccugcuucccucccucccgggaacacccuaccacauccucccuuccccugcuucuaugaggguguuccucuccccacccucgauuccccuacacuggggcaucuauugagccuucuuaggaucaaggaccccucuucccauugaugcaugacaaggucauccucugcuacauaugcagcuggagccauguguacuccuuuguugauggcuuagucccugggaguucuggggguccugguugguugauauuguuuuucuuccuaugggguuacaaacuccugcaauuuuucuaaggucugcagcaaggacaacucucaccagguaaauggaaucuagcuccacaucgagccuuccauuuaguuugcacacagccagccauucacauucuccugcuuccccuggucucccuggagauccugacaggcagaugucucuaaugccagcugcuuccucagccacacccuuagcucccuagcucacaaaauuccucccagcucuaggccuggcuaccuuccuaagucaccaacgugcagaggguaccacagccuccggagccuugacaccaaaggugggugucagaaacaaagacauucauggcaugguugcuguucugugacgcucacuaugguggcuugaauaugcuagguccagagaguggcacuauuaggagguguggccuugcuggaauagguguggacuuuuuggaggaagugugucacuggggggugaggguagggcacuuugagacccuccuccuagccacguggggacagucugcuccuggcuuucuuggauaaauauguagaacucucaguuccuccugcaccaugccugcuuggaugcugcuguguccaucuugaugaugauggacugaaccucugagccuguaagccagccccaauuaaauaaauguuguccuuuaaaagaguugccuugguuauggugucucuucauagagauggaagcccuaacuaagacacacucucuccggaguguaggguacaggacucuagacagcaguggagcugggacagagucagagggagcucccgaagauuccccaagaaugggagcccaaagcugcaaugaaugccaacugcuaaaagcccaguagcaccccucaggcaucccuggagucagggcucuccuaugagagcgcccaaccacuguccaucugcuugacccacacagcaggcagaguuuaaccaccagcuuggcucccacuguugugcguugagcaucagaacacagcaaugcaaccaguaaggccacagagcuguagaaccacuuauuuaagcagcucuguauuuaugaacacuuagaucauugagagauuaucaguaaagauccuuggcacaugucuuugcccaucaacauguacuucugauguuaaguuccuggacacagacaacucuagauuaaauauuguggguagcuuuaagggacccuacuuuagauccuugcaccaucuuguacucugaaacuagaggugaacacugcucccuacacacuugacagcaaugugcuaucccaggucucugauguuuccaaggugaacagagagacaccaugagaugccugccuguuccugauucucagguccauugguuuguaucagaugaaacugucagccacagaaagucaguguuuaaacacugcucuucuuuuugccaccuccugacacauccuuuggcccuggcuuuacuccuguccuggguccugccaauacgcagaagucacucauucccuacaagggaaguaauucccucgggcucuuaacaacucaauuguggcuugcaucuggccugcuauuggccaccucuguucugaugggcuggcugcagagucccagggaugagcaaggauccccgaucuccuuucuuaucuaugauaaucccacauacuagcuaacaauggaacucacucugagacaaggcuagcccugaauucagagaacucucuaccucugccuccugagugcugggauuaaaggcgugagccacugcccggccuagugcugcauucuuaggaacaaaaaauacacaaguaggaagaguuaaauacucucagauugauauuuaaaagaugaauggcaaaaugcccacugauaacguagaauuaauuuuguauuuacuaugcaagcaucaggacaggacaaaggaaaaggcguuacguuuuaguacgcucgcucaguggcacuauaggccugcuuugugugugggccccacagcuuaccuagcuggcccuggacuuugguguugcucagugaugcaaguugggaagcugggaggugucugggcaagucaggcugagaagagggaugggcuggcuuaucacccagcaugcagguucacuggguucuuucaaagcucuuuucuacugggagcaaggugaagaaggcggccaaugaaaggguggugucuaggagggaaagccugcauucugaaaauuguguacaugugucccuuaucagaaaggucucagcuuccggguaaggucuauaacuccgccuagcuggguguuccacccacuuccccagggacauucagaacugggucccuuccucaggaagccacccauggcagaagggaguuaguugcuucaucaggcaaggaggagggaagaaaggccugaucuaggggcagaagugugggcaaaguccacggaucucaaagggcacacucuucugaaggccacccccacucggaccuccugugggccagcugauacuuuccuugugaccaacagcauagcuucuccugauacccggcccuguuucccugccgcccggcauuccuaaguccccaguguaaacuccaggugagcacacacagcugucaacacuccuguuccuuccuguaaaugaaggcggcuuaggacaguguucgcuuaacagcaccaaagauauggcaagucucauuuugagcacagacugaagugguuuaaaagucuaucucaugagaugggggcucagugccccucagcuggaguggguucaacuaaaugacacaugaugcuaacaugugggguauggagggggggccggaaaccaugaugugguaggcacacugcagcaucugcagucucucucuggugaucugucaugggcgaggugucacuuugcugugaugaggcucaaggagcccgaggagcaagagcuuccuucauccaucacccucccaucccucgcucucacggaccccucacuugagccugaagcacugcaauccgccugcccuacuucauggcaccauccgcucacccacacucacggcuaccgcuuaccucacauucguggcuaucgucacugaggcgugggccaccguaucccccucacagcccccuggcacgcugcagcucugccuuuccaagucugggaccaccgcugccuucauuugcacucguacuuggugauuuuaauucucacagauaugaucuauccacacuucgguacccucagcuccccggcucguuuugccuuuaucuuccagcauucuuaucuuuacugagcugaguuacugcucuuaaguccuaucucaggcagcacugucaccauggugauccaaccucagagccaaaccagucccaggauaucuuuucccagagccagugguaccacaugggauuaccucggcagcagagcucgauuacuggaguagaagagcuuaaaauaucagcuaguugguccuuuaagaauguuccggagccucagacgaccagugucuauauuugucuacuccacaguuccuaucauccaaccuccccuagagguggcccgcucuacccacccggugucacuuucacagcgugaaaacccacagccacacacuggccuugcccugagcgcacagucaccagucacaggaggcugaauuccguggucauucccagacaaugaacuuucuauugucuaaggggcaaguuucaugucacccuucucaagcuguggccacgcccuggcuggaauuccuacuucugauuucacugggaaauuacaggcaaccagaagaagggaccaagcugugcccaacuccaggagccuguuccucacuacacaugccaccaagaggccacccaaggcuccauuccagagcccccacccaacaccgucauuccucucaucagccccaggacacauaaccauguuggcaucucuccugaaaacaaucacagaagcaagcaucuuucuuagcgccauccucagcuucgucuggcuccuguccccugccugggucuguuuguccuguuagaaguagccucugagauugguuuccaccagcccagucuuccaccugcuauucaaagcugacucuaucccuucaucucacuuaggacucaaugcuuuccugaaggucucuacuuggcuaugguuaagggcaccuucucuuucgcuggcugcuccuccccagggcuguagggcacccaggcugggcguuuuuaugcgccuacuaucuuggcuuuaaauaucauuugcuagaaagaagaaaaggccaggugugguugagcucagcaucuggaggaaguggggguguggaugcaggaagaucagcuacauaaagaccaugaugggcuacaagaccuuaucucaaacacaacacaaccaaacacaaacauuuccccuacaaauucaaaaacauuucucugccacuggcccauauuuaaacacauggccuuuaucucugcugagacccucugauucucaaacacacaguugacuggcuaccaauucagggcccaaccugcauucccagugaaucuaccuucaaaagauaugcucagggcagaauuucccguguccaucaugugccaccuccacccacccccagcuuccugucacaguuaggggaccucuuucaccaguucuugggucuccagccuugaucucaugccaaucugucuggcaauccuguaggcuggcucaacagucaguccuuccugggccucaggcugcuuuucguccccauugccucccagacaacagaaaucuuucaucucuucuuccaugaucacucaguccccaaccuacucaauucuccauccagcuaccaaucaauucuccauccagcuaccaaagauuuacuuuucuuucuuccuuccuguuuguguguuuguuuguuuguuuguuuuuugagacaggguuucucuguguagcccuggcuguccuggagcucacucuguagaccaugcuggccucaaacucagaaauccaccugccccugccucccgagugcugggauuaaaggcaugugccaccaucgcccggcuaagauagucuuuaaaaauaaaaacuaggacacaucaccuuccugccccaagcccccacugacuuccuaucgcaccuauaauaaaguguaagguucucacuugaccuacaaggagccaugagaccuagccucaggcuaccgugugaccucguucugcaucucugcucuagcuaagcaaccuugcugugucucagacauauacagcuugcagggaccagaggacagacuguuguaggagacugcagcuggcucuugcuucgaacaguaugugccaaauguucaacccaacgcaagaguuacaaccucggagugccagggaggcaauagauugggagauauagagaggauuucuguuaucuugcauuuguuaauacauuccuaagcaugacugagacaauagauaagccgggauucaucuacaugaaaagcaugugcgucaucacgcacugccaaaacuaugaagagcagcgugcaggauggaagaaauauuuguagaucauguaucugcugauggcucagcaucuugugugaagauguguaaguaugugaaaaaugcacacacaucaacaacaaaacacaaacagaccaggaaaauugaacaaaggcgcucaugagauggcuccguggauaaaggcgcuugccaccaagcccgacaacucgaguuuaauuccugggacccacaagguggaggagagaacugauuuuuauaaguuguccucugaccuccacauguacaucauguuacacacacacacacacacacacacaccaaaaaugaaugaacggacuaaaaauaaaaaccagccaaagaccccacaaauggcccacaggcacucgacagacgcucaacaugaagggaucaauaaggagcuacagucagauaucucuggggcaccacggcacaucugaggaugauuguaaucacaauagcuuacaaaucagaaaguaagucuuggccaggacaggaagacugggacgcugccagaugagauguaagcaucauaauuucauaauuacugugggagacaccguggcaggaccucuaccaguuagacacacgauucccauucuccagcaacuccacuuccuguguuuguguguccccuagagagugugcaaaaugcguccuugcucagugggcacgagguuaacgguacaaagaaaacaucugugguccuaugaaggugaagcuaaacagcuucauguguguacugagcucucugaacuaugcaccagacacuaguuaauucucauggccugccucuggcugguccucugcccagagacuccccuggagguucuguguggccuguccaggggccacagcaugcaccaucuccuaagguucccacucaucccuacaacauagugacagacuuauguucaccuccaggcucaacuugacuucccccucuugcuuuggccccacacagagcuagagccccucugcucggcaaugguaacacuuccaggaagauaaaggucuaccuuuucccaaagugaggcuaacacacucagugugaauggugaaaagcaaacucuucccugcagccggcuguccccaggccaaaucacagcaacugcucugcuggaccacacgggcgagaccauuuccuucaccagagagagacagagaacuguggccgcaauaugaauggccgcuguccuaagagccagggccugagagagccaagccucaccuggagcucccagaagaugcugcgcgugugucggugguaguagugucucaggggaauguauucgaggcccucccgguuugucuucagguaguucuccacaugcuugaagaaccagggcuuguaguaacugccaaugcuauucagcugaaaugacaagagggcauugugaucaggccacacaggagccaccggggagccaccagggagcaagagcgauccagccgcugucuaaugcguuuggccuuugcaaagcucugauaagucaauuguggccugggagagucuucaaagccaggcagguugggcacagcagggacucuccugcaaaaagcacacacucagugaaccucaggguuaugcacagggccaugcagccagcucaggcaguauggggggugggggggggggcgggggggggcgggcgguuaguggcucuuguccucauuagaacagagucaauguucacggugucagugauaacgcagggcucugcacagguuaguuccccgcuguccuugcuaagccaguguggaucacccuuacugcaauccacggccccugcuccagccaaccgugacacacuucccuguuuucccggggcuggcaccaggccucugggcucagcacuuucccaguauuuuccuucucuuggagggauuguccuagguggcuaauguccuggcugugggcucuguauccuugaauccuaccuggcacacugaacuaguagugccuuacagcccucagagggucaggcaugaucugcuggaugccaagaugaccgagcugcucagaccuugggcccaacuccucugaacugaauucugggcagguucucuugggaagagagccaagcauggccuagccauucucuaguugugugaaguggugcaggcuacucccuaacccuguuuucuaugaaugugaauuaacaauaaaauauacauucauuuuuuuuuucagggcuuucaauugcauccccgccccccgcccccccccaaaccaaaccaaaccaaaccauuaaagcccaaacuaagaccauacuguauacacuauacuguucuaucucugcuggucugcuuuucccacguacaagccacgaggcugaucuuuuagccugugugucucacuuucuauauggcaagauggagacacugcugacuggaauggcuguguagguuaaacguauaacacagggcacaucuagcaugggcguggccuacaacaucuguuccuuggccucccgauggccuuuccuucugcagccagcaccugcgacuucucugcguaccacccucuuuggagccuccuuugcugguaggcacucugcggggaggagagggggagccacaguuuugcacaagaguuuguuugcccaagcuggcuucccuguagacagagguaacagaagggggccgaaaccgacagcaaacagagcaacuugaucuaaggcagugggggccaggcuacuugccuggcagaggcaucuacuguguaauuaagucgaaacuuggggugucuggguccaagaucuucaggaaacgcugugccagagaagcucagaaaugguaacuaaaccugcuaagcaucacucaggacacggagcagcugggaagccuaggcgacugcagaagcucaagcugacuuuaacgcauccacagagagcgacccccagcuuggcucugaaguggguuacagucucacaggaugagagccucacccuggguggugccaccugagggccccucaugguacuuggcuggcccaugugacagcaucuacuccuccugucccgacuccguuugcacuugguguccuggucuuaucugcugggacaaauggcaagagacucuggccccuggucuuuccuaccacuugacuugaaagagcuccugaaagggucucgggaccuuugcucucuccucaggaaguucaggggucuaaacccgucaggagcugagcgaauccuucuaaggacucaugcugaugguaccgacucucggaccacacugaagcuauuuugguagugauggguggcuucucuugacaucccccucccucagcuugacaccguggacagccucuaaggaaaugcccuagagaagcugcaacaccucuacaccagauaccccacaggcgauuacggguggggggcucacaaugacuaggcuugaggcuagagagagccagaacacuucaacucuacggcuacuguugcuaaugcuccuggacgcccucuuccugacacauuuccugccuggaaucaaugcuguggucacugcuaaauucuaggaguuuccacucagggacccaugugacucggagggcggagacaagaauguaaaccugcuuuguuuguugggcaucucuaggagucucuaccucucacugggucucauuuccuaauaugaagaagggacaguuccccgugacuuuugagucuuuuucgaaauauauuuuacugaagccagagccucacacauauuagguaagcaugcagccacugggcuaaaccucuagcccuccguuucaaugaaacaaaaacaaauuuuagugugugugucuguguuuguguguaagagaggauaacuugugggaguuaguucucuccuucugucacauaggucccagggaucaaauuuaggugucagccuuggugcgaaguagcuacagagccaucuugagggccccgauuuuaaaacauuuuaaguauauagguauagaccaaaugccuuaagacaugccaauacuuugaugaagagcaaauuuuuucucacugcuuuaaaauuaauuaaaaacaaaacuggaagcaaguuacauugccaccuaaggacagagagggagggcauuugcucaaugaccuguucugaaggcauuacacugacuaaggcgggacaaugcuuauccacuugaacaaggcaaauuugaagagacagucacagguaagggcagccaagcuagaaaacccuguaaagauauguucacccucaaaaguaacaagagagcuacaaaacaaagagggacuauuuuuaaccuuaucagauuggcaaaaaucaaagugugauucucucucucucucugcagcuggcaagggaugcagccaccugcugccggacacaggcacgcacgcagcugcccgacugaggcccguguggccucccucccuccuucccucccucccucacguuucaggugcucacaccugggcuuaggacuccauuucauucguacauguugguaggaaaggagaagagagucuuagauuuucagcgaaaggaagugcuuaucaggccaaguacucugacacacaaccaagugacuguauagaaaaccagggcacgcacagccacagacacugaucaauggagagaaaacuguggacgugaucaccccagggggugaugggaggcaccuuaacuuccuuacaugagcaacaccgacacccuaguucuuauuuuaaaaagguuuucuacacgcguaagggggaaacaaaugcgggaccauuuugggucacguaugugagugagucuuuuauuuguuuagacuuccaggucucuuaccauaggcgcgcauccugucuggauggagggaaaaagaaaccugcuauugaaaauuacuugguugcuggguuauaguggcacaugcuuauaaugccagcccuuggaaggcagaggcagguaguucucugaguuugaggacagccagguuuacauaguaagaucuagacuagccaggacuaaacagugagaccccgucuaaaacaaaaacaaacaaacaaacaaacaaacuccaaaauauuacauagugauucacaccuauauuuccagaacuuacucagaucauagcccuaaguuggagguuagccuggacuacccagugcgcuccaggucagccugagcuaguagguagguaaccuugucugaaaauaaagacuaaaacauuacuugcuuguuauguguaacaauaaguuacacauuacucacuuguuaugugucaaauguuaauaaaacacuaaacguuguauggugaaagcugaggugugcccauuugaucuggaggaaguaucaaggcaauuacuccaucuuggcucugccaccuuguagaaaucuaaauuagcccuuggagcaucgguuucuucaucuaugacaugggcugucauuagacaacagguucugucuauaagggaagcacgugacuggcggguggcagcaguggaggagauaggccucuuauggccccucacauuucugaggaagccuguuaccugcauccugguggaccaugccacaugaagcagucuaaauaggcccagugccugcccaccuuucuuccccuggccuaccuugcugggcucuacgucguccgucaugaccccugucaugaugacagccucauccagggaguacagcaacccuuccacgaagugguucuccagccgcugggacucgcgggugaauuuuucacagauggccuccaggccccgaacaggcucaaaccgcagcuugacauacuucuuggccgggaugauccggaucucggcagccaccaggaagcccagggucccacaggaccagggcacggcauagaacaggucugaguuuucagacugggagagagaauuggcauaggcugagagcuugaccugauagggcagcgagggggcgcagggccuggacuggauucccgccuguugcuuucaccuguauucaauuucccucugcaauuucugcuucacgugacuuuaaccuccuacugcucccuguuucagagaugcucagguaaacagcauccacuuccugcugcugaggccuaggcccugaagcacccagcaaggucauaacuagaacugccugaaaaccccagugggaggacuaagggggcagagaggggcagagugcagggaacaugagcugggucccuacuagagucaggguagccaggagacaugaaaaugcaaauuccccuccugagcuggcuggcacuaaaaguaacaauaccuuuccuggcccacuuuacccuacacuuaagagucuggcagaacacugcccacaucugauaggagcacgacuugaccugucucagucaaggcucccuggaaagucggcuacuccagcugggcccagguaggcucucccaacucugaagcaguggcuguugguuagauucuuuauaucuaaaugagcccccccccccccaagaauccagccuugggcugguuuacgcauaggcuacuugugugccaguguaacaaauguaccaugguggcaggcaggauggggaacggugaaauagaggacuagacaaggacgcucugaggaaggcggcagaagccucuggcacagcagggcugucaccaaauccagucccugggcuacucgcucaucucacuguccccagcacagcagcacgaacugcagaaacugcacccaggcucuauggcaggauucccccagagaccccagcauguucuccauccaguucacacagcugucagaggagaaaccggccucagagaagccugucuuccuuucuucucuugaaaacggacagacagggcucagaugagucuguggaagaugggcugagccaaugugauuuuagugcuuggcugacugggaucuuuugaucccagaccugaacuccugagcuaguuauccuucauccggcucucuucugguggcugugauguacccaccuugaacccaauuacggagguuuaagucuuagcgguguaggauuuacuaucugugugacccugggcagguuauuaaccucucugagcuuuagcuuccuagcuggcucuggguaaucuuaguagucaccucauagguugugaagaacauaaacaccguaauguguacaacguguucuuaacagcgucuacgcccaucuaaggacagcccaagaggugcccugacaaugaagcagugcgaggagagcuuccucccugacucgcuggucagccgcaaugaccccaccucugaacuuaccggugugcagcgcacaaagcugccgucugccaggaucagcucguaggcagugcaaauguguuggaacaggccauacuugugggacgaugacucgaugccugugcccaugaucaggcccccugcagagacaugucugucagcagggaaagcuauagagugcuggguggggcuggcggaaacggggcugcuaagauaggacauuccccauccaucaguuugaggggcaggagugagaggucuccaggauggucaccacccucaucucugaccagacuuagaggauuaaaaaaaaaaaucuguguguggccgggcaguaguggcugacaccuuuaaucccagcacucaggaguuugaggcagggggaucucugugaguuuaaggucagcuugguuuacagagggaguuccaggacagccagggcuauacagagaaacccugucucaaaacaacaacaauaacaacaacaacaacaacaacaacaaaaaccaguguguaaagucacucuaagaggaagucuaaugaagagagguuacuagguggcaggagcuaugaccuaugggaagaucauagccuuggauaagagcuuugguggccacagacccuacagggagaggcaccaaacucauucuguguuugagacugguauaacuggagugauggacagucacgaggaagcagaugggaugagaauaucugaaccacucagaaauggagcaaggcuauuucuggcccaaacgggagaguagccagcaaugaagaagaucugcgguacggaaggggacccguguuccucugcugcgauccugccgugaacauggagacucacccacugugaggucaucaagcucaggcaacacaggcaggguccagccaauggaguucagcaaagcugucaccugacccauagacaccaagggcuccacucgaacaaucuguagacaggggagaggcugggucacuguccugccuuuaauuacagagaauaugaucucugguucugaguccacuaguguugaaagccauccucuugaagaucuccuaacagcugggugugguuacacacacuacagcugugugugguuacacacacguguaauaccaccacacaacaaauguucaguucaucuuccuagauucuaggagaaauauuaauuuggcauugacagcagagacaaggaagaaggcaucuaucauccagcuuagcucuucacuucccagcgacaaccacgaagcagaucugccucucucuccauaugucugugcugcucuuucguaugcuuugauacaacacccauacacacacguacaaacccacacauacacauauuaauauuuagcauggggggggguguuggagagacggcucagcaguuaagagggcuggauacugauccaaaagaccuggguuugaucccagaauccacauggcagcucacaacccaguucaaagggcgagaugcucucuucuggccucugcaggcaccaagcauacaagggauacacagacgcguacguaggcaaaacacccagauauaugaaaagaaauuauuagcauuaaagacugggggaccacucaguggauaccacagguacuaggacagaaguucagacucccagcacccaugcagaugccugggugugacaaccugcccggggcaugagaggcagggacaggggauccucagagcaaguuggcuagccagaccugucaaaccgacaagcucuggacucaagugagaauccuugccucaaucuauaugauugagaacaauuaaagaaagcauccaacuuaaccucugaccuccacaaauaugcacacacaucagcacauguauguacgucaacauagaugcaaauaggcacacacacaugcaaaccacacaaacagaucuuaaaaaauuuagcacaaggggcuggugagaugguccagcaguuaagaacacauguuucccucagaggaccugaguuugguucccagcacccacauggaggcucaaagccauccaguuccagggaaccuaacacugcccucuggucucuuugggcacagcacacaaacauacaugaaguuauaacguucacacacauaaaauaaaaauaaacagaaauuagcauuaaacuaugaacaucaucuuuuaucauuaaggcuuuuuauaaaacugauuuuucauggacacgccagugagcaaucacgugacuaucuacaugcugagacacagcaccagggaccagaauacugccccggggaaaaaagaaaaaagcagagugaaauacauggaacaggaguuuucaagaagguagacacaggccacaacaguuuaccauaccugagagacgggacaaacuaggaguucugagaagacccucaucugcccagagugagaggaaccuuuguggagccuguaucaugauuuagaggaccagcgcuccagaggaccaaucagaaaggagcugacagcacaguggaccaaucagaaaggagcugacagcacaguggaccaaucagaaaggagcugacugcacaguggaugagaauacaguucugcccaggcccaaagaggauagcuggaagaacugcaaagggcaccucagcgucuucauccagguauggacugguauauacgaauucagcuacugccugaggcugaggccaggcaacacagcccagagggaagauuacagguaaagacaccaggaggucagccagagcaggacacaguuaccuguuccuauaagcuagccugggaaaacggauucauggggucuagggcagguccugagaauggcuugccucagugguagggaacaauuagcucagauuaaaugguacucugguccauuucaagaaaaucaagacccaacaaggaucaaauuguuuccaagggauuuagccgccuccuggaaauauaaccuugagacuuguggaaaugcaaugccugccacccacuaggaaaagggcagagugucccaacaguccaguuaaaaguuacaggcaugcaaagagguaggaaaacacagcccauacugaugagaaaaauccaucaagcaagacagaccuaggacugacagacaauagaauuagcaaucagggacaucaacuggauucuccuuauucaaguaguuaaacuucagggccagcgagagggcucagcaaguaaaagaacuugccuggcaagccugaagaccugaggucaaucucuagaaauugagacuuuugaaaaugauucucuugaccuccacaugugugccagccauagcauauccaugugcacacacauacaauacaauacaauacaauacaauacaauacaauacaauacauacauacauguacaaaaauauuagcaagacccagugucugaaaugaaagauauaguggacugggcuaaccgcaaacuggguaacacagaaaaaaaaaaugcaguggauuuauauguauaguaauagagaucaucuaaagugagacugaagaaauaacuugaacaaguugaagaggccaaauacaccuguaauagcagucuccaaagaaggagaaaaaaaggaggcagggaaaaaaaagcccucaaaguuucuacaaccagugaaaaccuuacaaaauuugaacccaagaauuaugaagaaaaccacaccaaaaacuuucauaauaaaauuuaucaaacccagugauuaaaauacauuaaccgcuggagaggagggaaagccuaucuagaggguugcuaucccucccucccucccuuccucccucccucccucccucccucccucccucccucccucccuccuaucuucuuucuccucauuuccccuauauaguccuuuccugguuaugccuguguagcucuggcuguccuggaacucauucuauagaccaggcuggccuuuaccucaaccacuaagccacuaagcccagcucugaguuuaauuuccagcauccaugcugggcgacuuacaaccaccuguaacuccaggaucugaugcccucuucuggccucuuuggagacucacacacaugugugcacacacagacacguaaacaaaaaauaccuugaaaagaaugcauauuuauauauacugugauguauauaagaaauguaaagagguccuuuguuuguuuguuuuuugguuuuucaagacaggguuucucuguguagcccuggcuguccugaaacucucucuguagaccagguuggccccgaacucaaagggguccuuugagcaaaaggaaaacaguggcagacauaaaucucuagaauagacugaaaagacaguaacucuauagacaaacagauguucuuauauuuaaauuccuuuaacaggcaacuggucauuaaaauauugauauaauacaguguggagcuaagaaaaacguacacaguaguagaaagggugggaggaaggcaauguaaguaugacgucguaaggucuuuccacggugugugaagugagguaacaucacugcugugaagaaaauguagauuggaaacccccaggcagagcuacggaaggacgccagagaggacgcucucacagacugagaugagaagacgggagaaaaaggaacaaaugcacauaaauagacaacacgugacauacuccagccgccacgucaaggaagggcaguaggaccaacggucuuacaaccucaauuagaagacagagagaggggcugcagagauggcucagcgguuaagaacacugacugcucuuccagggguccugaguucaauucccagcaaccacaugguggcucacaaccacauguaaugggaucugaugcugucuucuggugugugucugaugacagcuacaguauacuagcauacauaacauaaguaaauuaaaacaaaggcuaaauaaaaaaacagcaagacccaacuggguguugcccauaagagaaacacacucuguuaggucaaccguaaauauuacaaaauuacacaucaugccaugcuaguuuaacgagauuagcgacuagugucaucacuaucggacugaguagauuucagaacaaagaccauaacuaaggcuuuuuaaagagguaaucuccgccaggugcaguggucacacccauccucccagcaucugagaggaggcagcagguagaagggugauacaucuuuucauaauuaaaaaaaaaaaggaguuaaucaaaaggacaucagaaaaaauaaagaaacauguuugcuucugccuaguagagaaguaagugauagagcuguagagauagauuugggcaagccaaugagcaaugggaucucgaugacauuugucacucccaaacaguucauucacgugaguguacguacacacacacacacacacacacacacacacacucuuaacuuuuuuuuucccuuaaaaaguugaaagcacucaauuuucuggcaacagcuaaauuaaaucagaaguccaagauagaaagaucuugcuaaauacuugaaaacuaaacauucuuguaauaacccgucaaaacacauagcaaaagggaaaucagaaauuauuuuuuugggggggugagugacauggcucaauagucaaguccugauccuguaagauggaaggugacaacuuauucauucccgaagccgucuucugaccuccacacucccugaaugagugguaaaguucugguuuucagaagacaagccauggugcuaggagacaauauggcaugauuucagauuuuaaaaaaauuagcaaaaaauaugaaugggccucaccaaagacaacaugcuggaggcugguuauguauauggaaggaugaccugggucuucagccaccacaaggagacgccaccccaacacacccugagaauggguaaaacugagacccgcuacaacagguucagcaguaugcggccagcagcaggcacacaauacccacggcacuguaaagugaaacuucuccuuaggaaaacaaccugaccguuuuccuuaaacguaaguagacagcugccugucaggggacucagccauucuacuccuaggcauuugcccaaggaaagacuuuuaaagacuuacuuuuauuuauuuauuuauuuuuagaguucuuauuuuaaucuaugugucugugugcgugggcacgugugcagguguccugagaagccagaaucuuucuauccagagcuggaguuacagguggcagugacccccugauggaggugccaggaaccaaacuuggguccucuccacgcacaguacacaugcuuuaacuggugagucaucucucuggccucuauuuuauuuuuauguguuuaaacuauguguauacgcaugguggaaccccccugagcuggagucguaaacauugugagcugccugacaugggaacugaacucagguccucugaaagagcugagccagcucuccaguccaaaagaaauaccuugcauguuuauagaaagccuguuuguuacugaccacuuauuuuguaacagcuucaaaguggaaaaagcagggaugcccaccagcaggucaaugacuaagcagacuggccaugcaaaagauacuauguagcaguaaaacccuuuguaccagggacaucaauauggaugcaucuuaaaauacucauuagagaacccagacccaaagaguauacacugaaugauuucuuucaauaguauccaaagucuaacacuuauuuauaacagcagaaagagaacacugcuaaccagaggcuguggguggaacgggcagggagggguuuggggagagaauuacaagucugucugugugugucugugugugugugugugugucuguguguguguguguguguguguguguguguguaauggcgggggugaguguucuguauuuuguguauuuugauaaugguuucacuggugcagucaugucaaaacucaugucaaaauuuauuacccaacugcguacuuuaaacauguacgguucauugugccaggcaauaccaacaaagcugucucagagaaggcacagugauaccaguacuucggccggggucucacagugaugaaauaucaccaggugaacacaccgcagucaaaaccacuccugucccuggauauugcaacuuucuauuaaaaugaaagugcaauccaaaucuccgcgcuggagaccucugaugacauguaagccgagucccccuuuccuuaaguuacguguugagaagaagaauaucuacacguuaucuuagcuaaaaggcccagaagcauuaagaaguaaaauuaguauguggggggaguuaggggguggagguggggggugcagagggcagcaguggcaaagaguguguacuuuugggcuagccaaccaacaagccuauaccaaauuccccucgccagcuaccuuuguagccuaccagcauacuuucuuaccaggauggauagauaaacaggguccuuuugucucucauuuuugccugggauuucuccaucccuauuuuuuuuucccuaacagaacuaagacaaucaaaagauucccuggaguucucagcuugccuggcugacuaugggcagacuuuccuccuaguggcuacagcgcucggaggccaacaaugggagguagagacuugcccgauggccucggaccuguccacucugggugaacugaacucauuucccaagagucacucauacccggggcagugcugacccgaccccagagccaaggacagcaugugcucacuccguuuugucacuuuuuugggggaaggaggggggcaguaccugggauugaacccggggccuugcacagugcuagguaaauguaaacgcuccaccacugagcuacgaccccagcccccucaccuguuucuugguguccaccuccaggauguccaucagguugaucaugauguucuuaugggucuucuuguacuuuccgacucgcagcgagacagugagccagccugggcgccccgugcacaugaaggucuuacugcccuguuccuuccauucccggaccuguaaccacaggauacgacucagcuggcuccaucugggagucccagggggauggacacacagcccuucuuucaggaugagggagcugggaaaaaaugccuuuacccaggccccauuggagaggauggugacgcugagggcuuuccccugugcagucucccuagcucaggacgucaacagaacagccaauguguuguuacugcacgaggacgaaugcaagaaagcccuagagaacagaguccuccaaagacaguaaguggaaagcccagggaaggcuuucuagcaguagcagagcagucauaaacaugauuaucaucuccaucguacaaucacccagugaggcaccuacuguucauugucugguuagaucucuucaucucaggaggcugggugacacacccccccuuugcagaugaggaaacccaggcaagauaguuuguaugagguuguacaccccaugacuggaaagacccgaauucauaaccaggacugaacaagccgagcccgaaagacagagagcugggagggagacagaggggcuuaguccauggaagaagagcguauccagugccaaguagaugccugcugucagcauccacauacgcuaacucauguaccaauuugacagaggggacagggaaggagcagccagucagugggaggaaagacuuuggcaaaacuuccacacuggagcaagaaggugcagagggugaugcacuaaugaggaauagaggaagcuguccugucccugcggacggacaaggcaggcgugaugcauugcuguggucagggcacccaagcaccaaccgguuccucuuccucugcuucuagugauuccucuccccccacccaggcugacugugcccugcuggccacagugacaguuuuaggaacaggacugugagcccaguaggcaaaccccuucugggucugguuccaggagggcacucucucuuuacugaggugguggcaacacuggcuggaucuaagccggaaaguguuggggauuccacaggaaaacagcaccccacuagaacggagccaacucaagggaaggaagagccaagaaugacauggcaggcaggaugaagauaaaugggggaggggguccuggguucaguuaugccucagccagcuguacugaucuaacaggcauucgcaaacauacucugaccccaagggcagcugucagauaacagucacugucuucuagaacucacagggcauccagcagguagaugcuguucaggacacaagcuaguguccuuuuuacucaaaccagcuucaacuaaguuuugcaagagucuggucaagggucagugggcugcccuggagcugucugucagagggcucaggauggggaggggcuuuccucugauucagucuggcagaaaugcaggacuaugaguccccggugggaagacaaagggugaauuccaagaccacccagcucugccugacccugcagugggagacuuuauguaaacagagugugagggaguggauuagcgguugcugcuggaucacacaggcagaaacuaucaagcuugggacauugaugggauuuggggguuaaaaaguucuuugucaaauccucaagagagacagaaaggguccagaaaguagguaacuauuugggaagcuaugguaagaaacuaggcaugaggcaacaaaaucagagaugggauggagacacaaggcugaggggguugagaguucaggcucuuaccgaagccaauguugacugccugccuuauuuaucgguugugcugucuugggcacaugacucacacuuugaaccucauuuuaguaaaacugguacuagacaccaggaggccguggacuguaaacugcacacacgaguggcacagguauggcguguagggccccauuguuccuugcgcauccuuccauuuaguuuagguuaacaaccucucacuaauacacucuugccccaaggggagccgucagguaacaguccugucuucuggugcucacaggacauccagcagguaaauaaauggcaaauagaaccugcagacagacccaaggaaaauggugcagguggggguggaggugcaaagugauucugaucgaugcacccucugcaucuccucucccuggguaaggucuucuggucuggaggucacucugccuggcaccugcaggcuaagccuguggugcucagucugcagcauacagcaagaaguaaauagaacaagagggugguugccaugcgggcagcggcaggaagcagacgcucucugaagccugaugcaaguuagagaggaauauaaggagggcaaagggagcccaugcuaacccuggaugagggggaagacgcuucacugugaagagaagucuuagccuuggugccggcuggccuauaugaacuccucaucuacuuacugggacgacuacaucuggaugcagaaucugcugcacauuacacggaauugggggcugauccugccuuuuaaucucucuuuaaaccuccauuguaaaaggauccgaagcaccucggaccgcaaaacaaacuuucaccucuuuccugcauaaggcuccucuccaaacugacuuucuaaccuuuuuccucucaugacugugcuccucagcuuccuacuucugcucagccaaucucuccacuuggaucuccccccuccccauuucccagaaccaccuuccagaggccauuccuccuuuggaauguggggggccugaguuaccugacuguugcgcacuucccgaggguuuagggucccucguuuucuaggcacugcgcaugcccugcaccuagcagacacuuuauaaaccuaggguuaggguucuguuuguugccccggugcuuuugcugcuuccguuucauccuuggacagucccuucccccaucacacgccagguccuuugcgauccccacucccacgcccauuccuccggccccacacgcccccgucgcccagagaaccgcuaccccggcgcacagccgcgccccgcgccgcucaccuguuucuggaugucccgcacgcgcugcucgugcaggcgcggcgcacugcucagcuugaacaccacccaggcgcgcacguaguaguagauaucgaagaugagcgagagcggcagcaagaagaggcacacgaacacccagcgcugguggaugagaacgaacuccaaccccuucacucgcacccagagcagaaagagcagcgcgcacacggccagcgacacggcgggcuccauggugucgcggcgcaccgcgcggaagggugcgggcucgcgccgcccgucuccuucgcccgcuccgcgcuccgccggcucagcgccugccgccaccgccccgggagccuguaagucgggcccgccgccucgc

SEQ ID NO: 2013 - RNA, 1574 nt, Mus musculus
aaggaugagggagaaagguuggcucaguuuagucucacaggacuuaugccuggccugggaggaggccauccccacagccuucaggauccagcugccccagguccucugcagagugggcacuaagcuccugcacaccaucuuucaccuuuggugggcugcagcuaaucagacuuuccucggaucacuuuggagguuuuagaagccccagcugaaagggguucacuuucugcugacuuuucucugaggcuaguccucgguggucccaggcgaugcuugccagaucccuugugauuucacuuggaaggcuggagggagcuacccaggcucaguuuacuuauucaagucccuugaagcaggcauagaacccaaaaacugucuuuuuaauaugcccguaugaaugcugaggguacggggaaaccugaacugcccacucccauccugggagcuucgagagacaugaauuuacuuacagccaacucuaggaugucuuccuugucuuggaugacaaguuggcagccaugagauccauucucaauaguucccugagugucuaguaugugccagaccucugauccaaggcuguggaugcugagcagacgaaauaggcccugcagccacaggauuugcauuccuacauagaaaaccucuacauugggacaagauagcaccaccuuggcccacaucagcuacugaccacugccuaggagaccauaagauuuggaaggaggcaguucccaggagggggcauacuugugaaucacuggcggcugaggaugauguuagcacugcccucccaggccagagaggguacguggagugacagucucugagucagugauacaggguaaaggccugaauggagaggagggcaagcauuggagacagugugagcucugagcuggguaaaguuuggagcagccugcagaguugcaauggagcaucucugccaaaagaggaaguacaagcgacuggguagccaagccuccagagaccuuuuagagguggcaauucagccaaaaucaggucugauguuagagugagcuggcccuaacuccagugccuguuuguguaucuuucacuuugccaucuacacccacccuggguccugggaaccagaccucuucaaacacaugcaacagccagguccuagcuggcuuuucccgcuccccauggggaagcacccucugcaagcauccuuucaacuuucagguguccugguggguaagagccuuaaggcacuaaaggaaugccaucugguagcuggggccucagcucuaccugcugggccauacagucucccagcaggggcuuucccuaaaaagauuggagguggggaggaugaaccuaggagagccugcugucuccuucccaggcuggccccauuuuucaguucacagggcagacagagcaaggccagcacuuccugucgaggaugcugccaccugagagcaugcuccaugaaucuacuaccucaggccacugcucacccgacccauuuaggcuccaucuuucgggaguugagcuuuuuguuuuugagaccggguuuuucuguauagcccuggcugucccggaac

SEQ ID NO: 2014 - RNA, 10995 nt, Mus musculus
ucacaccaaugcaauacuaagacuuuauuuccauagagacaccagaccgugggagaguggaaggcucgcccaggcuccagcaccaccgucccaggacaugagcucuucugaggcaggaagguaguagggcaccaggcuccagaaaguucuuaguucacacaacaccaugcaaguacagagcuaaaaacuuccugaacgucuccggcuggaaaucaacaggcccaacagguuccuggaaaaaaacacagaccauuaggauucuacuaccauuucauggcagcaaaggaaauggaucacuuccucagagucaccagugccuggcgagucacugucaucuccugcaucaucucucggugaacaaggacaccaaggagccggugcugcauauaggcaggguucccagcaccugucagccaugucaucugcugacacugcucugaccucacuccagccaccagggaaugacaagaacccccagucuacuauacugguuugcagguuccucucucacugcuggaggcccaggagggauguagaucuggcuccuaaccaagaaauuuccaaucagguauuucacugacaagaaaaugugacagaucucauuacagaggcaauaggaagaggccaaggugucuguguguuugacugacucacggacuuucacacacgagggcaaguaggaagaaaaaggaaggagguuuagacagaagagugcauucgauagcacagggguacgaaugaaggcaaggaccagggcaagauuagaacccaagcccauggugguggggcucagaagcugaagcugaaacugcagaggucaaguaggagcucugacccaccauggaguucauaaucuaggagaaagacuagggggagauggcaccagccacugaugggggugacuggcaacugggugugccacagggggguggggccagagaagggcccagacugcuacagcauuucaaggggagacacauugucuggcuggagaaguaccacggaacugauuuaaacuugaaaggccauucaaucccccaaguacacuggcccugcgcggggcuuagcgggccacacagccaacagcaccaugcucugucuauccugucauccucagagugcuucucguuacaucauagccugagcugguuuagacaucuuuacugccacuauccagucaucaggguggaaucucagccaagccccaaguguagcagaaacagggucacaggagaacauccacauggcugucagggacuucagugcccucuggggaguuuagcagucccccaaaaggcagcaauaugacugugcuguagcagggcccagcaaggcccugaagcagguggggagcagacacaggaacauucucccacaggaggaaccgaaggcagggcaggcgaugugagugcucagucccuagacccccuaccagaccaggcccaacugccaggagucagcgcccuguuguaaucaccagcuggggcaccuggacuuaccaccaccaccuuuuuuuugaugacugggcgacaccagaagugccgguaaaggagcuggucugagucuguccauaccaaauucuugacgcccucgcuagaagccagaucugugguguucaacugcagcaccaggaacuggaagacacggccaucagugcccacgcucugcacgacuauuggcugcuccaagacuuuggcuguguucuaaggaaaguagacagacauacaaacggaauagugcacacaggucaagcccacgccucccuuuaaaacacccacuugcuuccguuuuauggcuucaccucagagcagguaaggcagaagacagagcuccacagcccacagcccagccucucuucaccugacuaagcaccuccuccuguagccuggccgcccucaccuugccgcccucaccuagcuuggccuucucugccucaaggaucccagaaucugcccugaaacuccagagauaacuccuacagcucacuggcgauuacuggacaagccuugacguucaggcagacgcguugggagguuaauggugggaauccuucagcucgccaccuuaccugauaagagugaugggcuaucaaaggcuaguccagagguuuacccucggaccuaucauucaguucucacuccaucugacagaugaggagacagacucaacaugguaaccugacuugucuccagucacagagaacaugcugccaucagucuugcucuggaggcucuggcaucacuggguacuucugaaagcccuacugccugcucugcagucaaccgaguuucacuugcuuacugcaacuuacagugggccguuccugggggauguccucccggcacgucacggccagggccugucugaucucaugguaacaguaaugacacaacaguuacgagagcucacccaaaugcccagguccccugccugaccuuacucaccgcucucauaaauacaaguauaugccugcuucucaaagaagcugagguuuggagagguuuguucaagggguggccugaggcaugaggaagucaggcaaucccacuguuccagucugcacgugguagcccagcauaccugacgggagaaccucuucucuucuguuucuugucugagcaacccuauggcccgccucuguacacuucguaccaaugcagccugcuacuggccuaagaagcagagcauucauacugcaaaaaugcugaucuuagccccuccaggguucaccugacuuuaggacuagcuaauggaagucccaagugugggccacaccagggcugcuggucuuauaaauaccuguucuuagcugcauaagagauaaauaaaaagugaaguacaucuaaguguuagccgagauuccauauugacucuucuaucucccucuacagaucaauaaaacugcagguaguacauacauuucucagcaauuuuaccuuuuacaugggggcucuucccauaacugcgcaacugcacagccccaggaccgauuuguaccuggagacgguggggaggcuguuucuccuaucuaucuggguagcaauuagucagcacugcugggcaggcccuucuggcaacagcuggcagacugcacugagccugugggcugggacgugggaagugguugcuuccuuccuccgccuaaacugagggcagcacauccuuuugaagccauaggaaucacagaucaaucucugcuuucuuacucaugagccgugggcucaugggugauuuaccuaagguuacagaguucaggaaguauauaggagaaagagccaguugcccaccaccccucccacaucaagaucuaagaaggccacacgaggaaccacagcugccaacuuuucugguucuguuucuuaccaugauggggacucugggggcucucacaugcuggaaggguacucuaccacugaacuauaccuccaacucacacaggagcauaaaucagccucacacuuuagugugggguuuccauacuaagcuugcaugaacuucacuggagggcuucuuaaagacugacugacugacugacugacugccugcugagucccaccucagagccucugauucugugggucuggaaagcccgugucccucaagcucccccaugagguccugauaccccuccagaacucuaguuuaagaaucacugacaucaacagcuuguuaauaucugggaugugucaggugaucacuauaggacaguuaaucuacuccccacucaugcaaccaacgaaacgcagccccgccaauacccagagcaggcagggugggugcaaucugaaugcccucacucucaggaguacuuugggccuuagguucuaauugggaccugagagaacagcaggagcucucagaaacgugccuguguuuccaccccgguaccccaaccaggcuuuuuccccauuuugagacaguucucuaugacaaccucucacccuccaaucuacaccagcuaggucuugggacuucaacuuaauauuaaagacuacaaccaagugguaucuugggucccugagcugagggugcucugcuugggcuaucugcaaggcuucacuuccuaagccucccgagagugcugugugcuccaguucugacccugcagagcacacuggcccugcagagcacacugguauauggcccugcagagcacacugguauauggcccugcagagcccacugguauauggcccugcagagcccacugguauauggcccugcagagcccacugguauauggcccugcagagcacacugguauguggagcccaggcaaccacaggcuuaugaguaggcugucccuuguuccuguccuuuccccaugcuuccugcuggaaaaugcaggaugaagugauuauucccugucauccucuggcauacuggaaaggggagaucuaaaugacaccuagagagccacugugucuggacagagcaccagccccaggacaggucagcagguugcuacaaguuaagcagaaguacauauuccuacaauuccuuagucaaaaccacagucaguuuccccaugccauucuuccuggaaguagucuuuauagcaggaggccaacuggagagaaaguaguuucauuucuucuccacacacauaccccauagaggagccuggccugggccagggcauuugcgaaagcaaacaggagcaucuuagcccuuaguuguucuggaagaaagcguuguggccguaaauuggccuuuuccaggaaauacaagguguggggauggggguaaggauagcccuccuggaacccugcaagagaacagacagaagagugaggagacauagaacacaaccaggcucacagaugucgggauggcuacugaggagcucaggcagaagccagagguggcuggaaaacccagaaugcuuucaauguuacuaucuggcuaaucccagacgaugcuugccaaccugcagcagguacuuccuacacacauccuaacuccauccauuugugauuaucuaagcgcacaugacagugauacuaaaacauggagagccauggcugcuacgaaggcagaaggcaguacucuaucaggaacaaaggacuuggcaacuucagacaagacugaguguucacugucaugucaugauccuauucugaguggcuaugaauaaaucucuggugagcugggagcuucuagaguaggugccuggaaugggugaguguggugaggaaggagaagccgcuggggacaugggcucugaaaaucacagaaaggagagcccaggcuucccugcacaccaugauccuugaggcugcuccacucagaagccugugugcacugagcucuagacaggaagugaggggagcgcaaguggaggccauagcugccugugaggugcucacaauguagaggggaagaucaaucacauccaagcagagaugcggcaaggcagugugacucagggaccgaccgugagaagauaaaggaaaaggcccugauugauacugaagucugucauuucugggaggaagcaauuccuaacgugaagugcaaaugauuaagaguuaggaagcaggcuagagagauggcugagcgguuaagagcacuggcuguucuucccgagguccugaguucaaaucccagcaaccacaugguggcucacaaccaucuguaaugggaucugaugcccucuucuggugugucugaagacagcuacaguguacucauauaaauaaaauaaauaaaucuuaaaaaaaaagaaagaaaagagagaaagaaaggaagggagagagagugagacagagagacagagagagaaagaagcucaccaagaugccaagccuucuuuuaaaaaaaaaauuaaaaaaaaaaaaaagaggaagcacaggcugccacacagauucuagaagguaaugcauuuguauuaucaacccccagggcuguuaaguuuaucuuucucuaaaaaaaaaaaaaaaaaaaacggaaggaauaaaaacauaucccuuucuccacacugcuuaaaauccaaagcuuugcuccguaccugugucaucuuucacuucauaaacguggcauucuugaagaucgaugguaggagauaugggauagaagguuucaagaacaugacuucugguagcuucaaccuccucccuggaggcaaugacgggcaggggauccuuggcacucaguaugguacuacuaguaccucggaccugaaggagaagagacucuaaaauagggaaaaagagauuagucuaacugggucuuuguacagcucucagaguaagaagccuucacuacacacaaaccuugaguccagucuguuauagguucucugggugaccaaccuggucacagagcacacacauggcauugggacaauaauucugagcccccaagagaugaggaacuaucauauucuuuucuuggggugcucuucugauaaaucucaaggcuccugacuccugggcaucuuucaucuuccaucaacuccaagccagggauccaaaaauaagccagaauuaaccuuuccucucgaggagcccuuuaggcagcaaguguugcuaugggaagcacaagccauauucagacacagcccucugcgaagcccggagcgccuccugaaggaagcaacuccuuaagccugggcaguugaagcaccuaggaggcagaggcaagcagaucucagcgaguucaaggcccgucaggcugcacagugagagugcuacaaaacaaccgccaaggguaucugaaguaggagcagguggaccagcucacucuccaucaccgggcuggacuguacauguacguguucagcagcagccuggccucuggccacuagaaaguccaccuccauccucacucgugccaucuggguccaugaucaaagcuggcuucagacacugccaaacgccucacuguuucuggugagggcaggagccugccaggcacugaaaaugaagacuagcacgcaagagcauggaggcacaaaccagggugagcugaacaugccacagagagcaagaggcagagaaggagacgugccgugagcaggggcagaggagauucuucaaacccaggcaaagacccaaacucuucuuaacaacggagcgagaaaagccaggcggaucacagagccugggggaaguuggauuaacauguauucuacagguggucagaggaacacacacagcuaacuaaucacugaauuguggauaugugaguauguggaaaugucaccuguacuguucccauggggaagccacaugccacuaccagacgaaauguguuuggagagacuguugucagcacccugaguggcucugaguggcaacugcccucugcaggugccuggguuucagaaagagucaaagcucgguguaaaggugauagauuagggcuguuguaagauuagaaaaugguuuggucgauggcaugucauuuaauuagcaugcagucucccaagauauguaaaaaaaaugaauguuacaucugcagacagauaaauucugcaguaauugcaccucaagauuaguuuccuaaggcacuuccuguuuccuuacacaaaugccuggaccucuccuaaccuuggguuuuagauucuccccacagaucacuguagugugguuucuaauucaauucccuccacaucucuccuccagugacagugcaaaauggggcaguuuaauuagagguaauacuugacaaugggccaacaaguacucuccauuaaugaggugcacuaauuuccuuagcggugccauuaccucugccaggcugacugcuugccagaaguccauaugcagagggggagaugagaaaaccgacuaaacugauaucccaagucccacauauuccaccgcgggguucccugcucccuaauucuaucaguuagacuccuggacugacacugcugucugaaacgccagcaggcacugccaagcacacagcaugugcagauaggaaagcuagauaccaaaaagcucuacgggacaaacuuagugaucuggggaggggguuggcagaacaggugacacagcuagggcuagguggaggccacagcacagagggccuguugucccaugacaagugacagugcugggugauuugcucugugcauacguggcccuggagggugcaggaguaggaaagggaagcaaagcuacagauuuggugagggagagaccagugugccccaccauguccccggcuguggcauuuacacacucccgcaugcucuggggacucaacagacacagucagccaucacugguggaauaaagucuuagaagcagguaaaaacagaaacgagaaaguugggccugguggugcagacuggaggaucacaagucugaggccagccugugcuaugcagugaaggguauuucugaaggaagggugcuucugaacccaaagagcauguagcaggaugagagggaugggaccuggugguggggcugacaguaagagagauuaagacacacaaauaaaaaagcaacaacaacaaaaagcccagcaaggccuucugguauauagggugaccuaccgcgguuccaggugguggcuaaggugcaguuuugggcagagguccgccuggcuagagaagggugcuugagaaucugggauuuacacagcuguaugaggcuguccacaaugagugggcuuggaggaaagaagagauauuuggagacuuaaagcaacauauaacucccaacacuccucaguuaucuuaucuggaggaaacuuaccaguaagucucucucuuggggauguccucaguggagugccaaagccgggcaugggagaugauauccaaaacacgcuguucuugguucucuaugugauuagcuggaucaucaacaagacuaagcacuuucuuggggaggccuucuauuaacuuggucuuaguaagccagagagccugcuucaucccugugggacaaccaaaagaagagagagagagagagaggagaggggaggggagggcucaggaagagauguuuaugccugucagggagcaccagagaaaaggcugccucaagggacucugguuuuguuuuugagauaucugaaaaccgaaacuuccaggugguaagagcagaauacggggaaugagugcuuaaaaacaggaggaguucaaaccaugcucaagacagcugaguucccugcugacuccccacagagaaaucaaagcugugagacuaguucaguggauaccagcccuucaaauaaaaucccagcucugugauguuuuucugcuagcaaucucaagccauguuuuauggcucucuagcaccuaacaaaauauaaaguauuuagagcugccauuuacugaaugucaccuccugugccaugaacuuaccuacaaguuagaugggauucugacaugaagggggaaacuuggacagacugaguuugcuucaaguugccuaucuuuaagguaauacagguaagaggagaaccugagacugucuaccauaaaguccacagucucucuauaaccccagucugcuucucagggccauaucucacaaggguuuauugggauuuuauaagaccucucuguacauugagaaaguguaggauagaaaauacauuuucagacugguucaaugaaugcaaucuuaacuucugaucuuuuuuccuaaagcacgguuucucuguguagcccuggcuauccuggaacucacucaguagaccaggcugacuugaacucacagagaucuuccugcuucugccuccugagggcugggauuaaaggcaugcaccaccaucuccaggugcaauccuaacuucugaaacacauccauccacuaggcauucguugucaggguaaugcaaaggggucgugucugugagauccuucacagcaccuccugaguucacagaaaaugguuaauggccaaaaauaucagcuugcaggcauagaagugggccuuuuaggaggcuggccuauggcuaucgauuuuuccaaacuuaugacugauucucuuaauuuggcuccaaaccuuguugggucucuguauuuccuaguuauccuuuggaaucucugcucccacagacuucaguuguuuuugguuuuaggaucuucccuauccucauccugauccugagaggguucaacucuggaaaacaguuccugacacuccucuuaagaaacagaaugacuuugagacauugauguaucucccccgccuccccacaggguuucucuguguagcccugacugucuucgaacucauucacucuguagauuaggcuggccuccaacucaggaaaaggcucaagacauucugaccuguuauuaaguggguagacuuuugggugcaaauccuuucuuugaaaacauaucccaggccuauuuuaacaaaagacacccccagaaaaggagcguuguagaccugcuuuauuaucaccucuccacgcauggagacaaauccccuccucucugcacacauucuccauugcucccuuucacaaacaccuugaucugacaacucuuggaagccggguguuacucuauucuacuuccagaggaagaaacuuccccaggcucggggucacugcugagccugggacagcgucuccucccguuuguccugagaccucacccuccaggagucggcaacgcugguggaagauguagcaggguucuuccuuguacagagucuguucguggaucggggcggcacgguggaagcgugggucauuccagccgcgcucccacggcgggaagaucggccucgccagccacgggacgaagugcuucuugcccucguagguaaugggcuccagaccggggaucucguacacccuguccagggggcgaggcucgggcuuccgcguggagcgcacgccccacucauacgccccacguuucggagucccguaaccuccgaggccgagccuuccagagccagcgagugcccgcagagcgggcccggacgccaaggccauaccgacuccguuucuacaaaaccucuaccuggacgccgccaucuuugcccgugcagggacugcugggagcca

SEQ ID NO: 2015 - RNA, 20074 nt, Mus musculus
cagaccacgccccucaugccggccccgcgcacgcgcgccuacccagccgaguucuuuuccccccccaccccucccugcugguaccucagucccgcggcgccaggucgcccccagccccucccucuugccacccucugugugugucccacccucacgggcuuuguggccuagguugccgagccgcuucccggucagccgcucaguggaggaaggagccgccagugaggugcagccgcucgcugccccgggcaggggcacagguagguggcggccgcgggccgggccgcucgccgagccucaggcagcgcgugggugcgggggcggagugugaggggcugggggaggggaaaggcccuagggacgagguagagcucgcggugggaggggugggaggaugaagagguaggggugccugaggugggcuuaagggugggguccgcggcgucccggguuagacugagggugugugagaauuuaggguucugggcgggagagggagcggauuuagcuuagguggacuuggggagaagcuugggugggagugccgggaaagggggaaagaaaagggguugaggagugcaccaagggaaggagcuaggguuggaauagggggagggguggggcgggggggggcagggaagaaacuaguugaggccguggauugggaaguuggagauagugaggcgugaagaaaggggaaucugaagguugaggacgcaaaaccgggaaagagauggggagacuagggugcuaagaggaaccucgauggugagaggaagacucgugaggagggagagaaggaugggggcuggagacgggucgcuagaagacagguggaggcgggguugagucuuuugaggggcacgggagagucugggaugugaggaagauggguagaagaucugggagugaauggggaagguuagaauuuggggggugggggacugaaauuuuuucuguuugaaaagcuaaagaguggguaaaacuaucaagaugugggagagauuagcuugcucuuggacaaaguaugggcccggauaggacaugaguuucugcaguuugggggagaaggcagguagggaaguggcaaguuacagggaaaaaagaaguagugggaaauugaauaauggcggugacacagaacaaugaagauggauuguuaguugguuagagauacuuuggaacuacuuucucuucggauuucuuccuauguuaagaaaaagucuuuaaaaaccacuacauuuucaaaugagccaaaggugucugcagucuugagaugaagguaguggguugacagauguuuuccugguguguggauauggcggauuucugcccuggcagagugaagggggagcgcuucauccuugagugagcccugguucuguuuccacccacucuuccucagaugaccacuguuuuuuacuauagucccugcccucuuaacucccaguuugagccauugugaguuccagagagaucaaauggccggugauguuaauuuugaguguuuuaagaauauuuuuaaggcugauguuguauuuuuauucuugagauacaagugggaagaucuugugcuuuggaauuacacagaccugugauugaauucaggcucucucacuuaggaguugugagccuuaaguuccuucauuucucugaggcucuucauccauaaaguggcaauacugaccucauaggaucagugauugcaugacaucauuuuauguuguaccuuacagugcuuguuagcuuguagguauauaaaaaaugguagcuuucagucacaucuggaaucauuauuguugaucauuauuuuggccuacuuauucuuagaagacugauuuauuaagguuagguguucuuucugauuuuugguuuugguauuuuuuuuccugaaccauaggcucagcucacaguuuuagcacuauuacccugaugccucucuccucuuuccucucuuugucuggaauaauuuuaugcuuuuugcuuggaagcuggauucaagguuuuaaaacuuauguuugguugucaauuauuuuauccuucucucauuuaaagauguuuuacagaacugaauuuuuaauguaccaagguuauauuucauuuauuugaagaaaugauaugcuuugugcuaacuuuagcuucacuaauguaaugugaaugcacugcuguacauuuuuaaugcuuuguaaugcuuagguagaucacagagcuguuucucuguagugggcuagaacaccgccagucagccagucacucuguuaaucugacccauagcugcaagagaucuacacugaacauuguuaucuugcagauacauguuaucuuaacuuuccaguuuaaaagagcacuuccaaccuucacacccccaggcaagaaaaggcucuugucuuuuaaggggccaguuuguagaggccaacaugaauaauagugacgggcaagcaauauccaggagagaagcuuuacccuuuaugguucuuaaaguugaaaguucagacauucauuuaauccuuagaucauuuuauaguacauuacaaacuucaggaaguacuuuauuggaagaaugcaggauguuuuaaaaaaaaaaaaaagguuaccaugcaugauucccuaaauuaagaguaguucuucaaauaacugaagaaagcaaagccuuggauuauugccuggacaaaugauguagauauacucuucaguaaauacugaauuuuuacaucauuuaaaaagagaauacuguuugauaaguagucugaagaugugauuuaguccucacugugccccuguuuuugaaggguaaaguugccaggaggggcagaguaagggauuagcauccagacucuggucccacgcuacuugugcccucugcuggauggaaucauacuucuaguuuucaugagacacugucauccauucauuccguuuuacuccaaaguuugugggacguuagagaggagaauuaagagcagugcaaauauguaaaaccuggguuuucgucuuucuguccuccucaucaguauuaugguguguugguccauuaagauacauuaucuucauaggauuugcccuucugcuguuacaguuagauuguuaggcuagguguaguggcuuaugacuguaaucccaguauguggaaagccaugguagaaggaucucucugaguuugaagccagccuggacuacaugcuaaauuucuggccacucuaaaauggugauaaugauauguuuucuuuccuucauuuacccacuugaucauuucuugucuagcaaauaauuuguuuuuaugccauacguaguauuuacuuucugauaccuagguagaguaggcucugacguucuagucugguuuuguuuuuuguuuguuuguuuguuuguuuuuugagacaggguuuuucuguguagcccuggcuguccgggaacucacucuguagaccaggcuggccuggaacucagaaauccgccugccucugccucccaagugcugagauuaaaggcgugcaccaccacugcccagcuugagguucuagucuuaaagaucaaagagcauuuucuuuuucuccagguuaggauuaaggucugugaggucgaaggggcuaaaugcuugcccugcugaaagaagcuuuuauagcaaguggggagggcaucuuuucagcagcagcccuuaaaugcuggcaagaauaugaaguguaagaacuggcacuaugacaagacuuuaaaaaaaaaaaacugguuuuuacuuuaguuguuuuguccucccucccccaccccccacauaguaccaguagcaauauagccccaucaucugcucugcuucuaccaccugcagaaggggcugacaagugggggaggagccugcagcuguugccuggaagaggagcuggcuccuagcaacaauaucagcaggcccuucaacgcagcacuaaaucuaccccuuugaggucucauucaguucagcauauaucuguugagugcuuacucaguacuaagcaccauguucggccugagaaagaaaaaaacucacagcuuuggguacaguaacaauugaacauaguacacagugcuaaguguugucuaaaaggaaacacugggugcuuugggaaaaccagacagacauggacugguacugggguuggagaaguuucccaggagaaugcugagugaugguugagcugaauguuaaugaugaacaggaaauagcuaggucaggcagaacaaccaaaagcaguaaacuaagcuaauuccagugggucaagugaguggcaauuuacccauguagcauugggagggccacagaauagaacauaguagaugagcuggaaagggugaggcuccagggcuaggcuggucccuccuuucugaugugcuuuauauacauaauuauucucaggagaaaaaugagcaguagugauucccacaaauaggaucauugcuugaucuucagagacucagcauuuuugucacuaacuuaauuguuugcugacacuuguaaguggcuucaggccacauuguagguauugauguagaaccugacuugauauaccuccaaaagucaaccaaagucuuugagggauaguuucagaguuuuagaaauacugcuaggagccaggugugguggggcacgccuuuaaucccagcacuuggguggcagaggcagaugaaguucgaggccugccuggucuacagagugauuuccaggacagccagggcuacacagagaaacccugucucaaaaacaaaacaaauaaacaaacaacccaacaacaacaaaaaaaaagagagagagaaauacugauaggcugacauguuauuaaaauccacauuucccccuuucuuauuguagaaaugauaaucggaugccuuuauuuaacauagaaguuucuuguguaauuugaaaucucacucaagaaaauaguauuuauuauaauucuugaugcauaaugucaccagugggauuaaagaaaaacauaacugcuuuuugguuuuuaacuuaccucaaagugcuuggacagaaucugaacacuggaagacuguaaugauuuuauuuagccuuuguuguggaggccuuuauuuguaaauucaagacauccuuuugcucaugguuuaccuaaggcuuauggaacuuguaaacuaguuccaugacauucucccaagggacugcacuguaccagaguccuguuauggagucugaauuaaauguggucuuucucucugugugcaaagcagcuaagacagacccagaagccaaucaauaagacagugagccaagugcaacaaagagauguguggaaagugccaaacccgcuagcggaguuacuguuuucuguguguaaacauuuuuaauuccagaauucuaguggguucauaaugucugaugaaauaguguaugcuuuguuuacuaggacucaguguugggcauuuaguugaugcuccucguugcucugcuaacauaagcugugcugcugugagucuacuuugaaaagaauuguugcuggcauuuuuuuguaaauucugggugaauucuccaaaugaaauuugagcucaaaguucugaaagaugaguagauuacuaaauaggugagaaaaaugcaaaagaggcacuucagguaaaaacaguagaacagccucauagugacaaaguucucagcaacuggugagucuugcuuuccugguagugguaggaucauaaagcugugggcacagcaaggugaagcugcagaugacauucuaauuggauuugccuccacacaccuugcuuuuacaguugcaaccaaggcaauggcuuacuaccucaacucagaagcccaccuggauccagggcccaucuauguucgagaaaaugggcagcuacacauggucaaccuggcucuggaugguguuaaaaacagccugcagaagccacgaccauucagacucuuucccaaaggcuuuuccguggagcugugcaugaacagggaagacgacacugcacagaaagagaagaccgaucacuuuaucuucacguacacccgagaggggaaucugcgauacucugcuaagucccucuucagucuggugcugggcuucaucuccgacaauguugaucacauugauucccucaucggcuuuccugagcagaucgcugagaagcuguucucugcugcugaagccagacagaaauucacagagccaggggcagggcucagggcguuacagaaguucacugaggccuacgggagucuggugcugugcucgcugugcuugcgaaacaggugggugguaguauucucucucguuagcuagugaguacuugaguggauguuuagccugucaagccccgggccuuagugggcucauaagcucuaccaucagauaguacuuucaauuuugaacuuacacauuuaaaguacaggucauuuugaggggggcuagggaagcaggagggggaucaguaacuuuuucucucuucaucucauagacaauauuuagcauuauuuugaaaauguucuguaaggauuagcuuggcuaccgccgcuuuuccaauagauaaaaauacuuggcaaccaacuucucucuuuuucccuuugagauauggucuugcaauauugcccaggcugguagagaacaacuaggcucaccaggugaugguaguccacaccuuuaaucucagcacucgggagacagaggcagguggaucucugaguuugaggccagccuggucuacagaacaauuuccaggacagccagggcuacacagagaaaugcuaucucaaacaaaaacaaacaaacaaaaaggacacaaacuguucuguucucccccucaacuuuuagguauaggcauauaccgucuugcucccuuggagcucuuuucacucguaagagaauacaggaaauuuaugaccugccaaauaucucuugauauagccuugggaauguuaagauuaguacucagaauucuugguccuguuucaguuuuaagaacacuagauauugacuguuagauuaaaagguaacauuuuuaaaaugcaugauuaaaauuucaaacauccugaaguuuggaaaugcucagagaaguccccagcaccccagcgugucuccucacagagcagacuuuuccuuguuacucauuugccuuugcucaugcacuuuuuguauuuauuuaaaauaauuauuucauuaucauuuaagaaaacuuugagaacaucuacuacuuuuaaaaaaguaaaaaugacccuggcaaacaguucaaaccuccuguuuccuuucccagagcccaaccacuuuuuuuucucauuccagagauacuuugaacauuuacaucucuguggcuuuccaguuugucaaacuggcaguguggaugccuacauguuuuauauacuacgaaccuuucuuuguacacacaauuugaaaaucauuuguaaucaauauuguagacuuaauuuuauaauguaccaccugaacuuuuuuaugauuaaaaggcaguuuugcauuaauucauuuuuugugugugugauacugaagauccaauccaggaccuaauaauacuaggauaguguucucucugagccacauuccccaacccaccaguuuaccguucagaugaauaauaaauacaaccuauaaaaugaagccaacagcacgccuuuaauccuaguacucaggcagagguagguggaucugagugugaggccagccugcucuacagagugaguuccaguacauccagggcuacagagaaccccccccccaaaaaaaagagaggccaaacaagauguauacuauaaaagagaaagcaauaacagaaaauauaaaacucauaaaacaggaagaaaagcguaacuagucuuuauuuaauugguuuguggaguuaaugaauucaccccaggucagguugcauauguugcuuuaaaaggauuaggccagaggacaccgagcagaaccuuggacuugcacaaagcaggcauuuccugaaaauuaugugugcuguagccuacaugggauugcugccaaugaaaggaaaacacuuaucuugcugaaugacaaagccaguuuauuuaacauuuuaucccuccaccucccuucuuccuuccuugguaggaucuuguacuagcucagguuggccuuauacugucaaacuccugcucagccuccugggugcuaugauaggcaugggcaaccuugccaugccucacuccuuacuuuauuccaaguuagaggggugaaaagcagaauuauguauaaagacuccauauuugagaauauauaaaacuaaaaugaaaacuuuacaguucuaccacaguauugauguucaaaaacauacuuucccucauuagacugcgugcucuacagcugguguucugcuuuccugcuuucuccauuaucuuuacagucuaaagaguucccaugcuuuugaaaaugcuguuugucccuaauauucuauagucucauugguuagauugugauaauaacacuuuaauucacauuugaugagcauauuaauaauguaagcagcugcaguaacaaaacaauacgugaguguaacauuucugggaaguaguuugcaguguguauucuuuuuugcagcuugucuuccaaaugaccucugaagacccaaacgguaaagaaacaacagaauacacacagauauuuuagugcaaaucagaccugagauugaauucuuuuuauuuuauugugggagaagcagcagagacagagacaggugggggagggagugagaggagacagcucucucuccccacuuuaugugagcugucaaccucagguugucaggcuugaaucauugggagcugccacucuaccugccucagccuugugcccuagauuagcaucuaguacugucugugccaguccucagccuugaguuccgugauguuuuuuaaucacaucacacaguauuauguucuucaacuuaauuucagaguuacuaaaaauucuuugguaauugaucaaaggauguguguuuuccuuucucuaauugccaguaacccccuaaauccccacuaacacuucagaacugagaucagaagguagaaagcagcuuuauuuucagugcagcuacaauagucuggguaaguuauguuuacucauguacccagcugagcucugucuccaggcaguuuaaacuuuuccauuuaaaaagagucccagcaccucagcccacuuaccuaguaggcaaguugucgcuuuaacaguaauaauuucauuugguuauaggaaggaaagagcuccgccauucuucccuucugauuagccauccuuuuuuugaccguuaaacuccugcagaguaagagagcugugcucucacuaaucccagcacauucuucugcugcagacaucccaggcuuccagaggaaaguggaugagaaguggaugcucuggccacugucaggccucccuaguauccuaggaaccucuucucuccuguucgcucacaccuaaucccuuucauguuuuccuguugaccucauuagaaauagaugaacaaguagaaggcagagcagagcccagccaggcuguggaaugucauuuugaucuguuccucuccagaggccucccugaugcuuccugauaacagcuuggcaaggugcuccaguguaauuaagucacuuauguucauaguuugccuuaauaagcaucuaaaugagagucaugcuguagcauacuuucaggguaguuagggcaacagagccagugguguggacgggugcucaggcuugagcuucaguagaaagagaaaaugcgaugugcuaggugguuuuuuaaauaccuuuuaguauaugcagauuagagugugggcucaugcuuguaauugaaacaggagacuuuuaaucaaguccagccuagacuacagaguaaggcccuuccucaaaaaaggaaaaaagcaaaaaaaaaaaaaaaaaaaaaaagagagagacaguguguaaguuuggaaauccccagguaaagcccagcuaccgccaaggucugauuaaugacagacaggauuuuuaauugacuugccuuugcucagacucuucuguuuguugguguugauucuaucaucuuauacaaaggguuuuuuugagguauuuacaugugauagaaucaguguuaugugcuuauuuuuggcccuuuggaauaaugucauguugucugugacacaaagucacaaccuuaaaguuugaaaagaagaugacaagcuauugauugcucugcacaccgcacagguauuuggugguugcagaaaagcuugaagagaucaagucuuuccgggagcugacccgucuagaccucuccuguugcuggcuuggagaugagcaugagcuucuagaacaccucaccaaugaagcucuguccagguaccagcccauuguugcuuggaaacaucuuguugauuuacugauuuacugauuuuuaucuuauguacagagaugguuugacugcauguauaucugugagggugucagauccccugaaacaggaguuacagagcuuuguaagcuuuugugugggugcugggaauugaaccugggcccucuagaagagcauccagugcuccuaacugcugagccauccuccaggcccugucguauuuuuaaaagaacaguccaguagaaucauuuuaaggaaugucacuuacuuuccuguauuauuuacuaaaauuuuuuuucuaaaaacacuuucaacuuuuguucauuugguauagcaguauagauuggaaagcucuuaggaaagauaauuuauuuguucucuuuucuaaauaaccuuauuuuuuuugguuuugguuuguuuguuuuuguuuuuuuuuuuuucgagacaggguuucucuguauaguccuggcuguccuggaacucacuuuguugaccagguuggccucgaacucauaaauccgccugccucugccucccgagugcugggauuaaaggcgugugccaccacgcccggcuuugguuuguuuuuucaagacaggguuucucuguguagcccuggcuguccuggaacucacucuguagaccaggcuggccuugaacucagaaauccgccagccucugccuccuaagugcugggauuaaaggcaugcaccaccaugcccggcuaaauaaccuuucuuguuuuguuuguuuguuuauuaguuaaagcauuucuuuguguaacagaacccuagcuaucccagaacuuacucuguagaucaggcuggccuccaauucacaaagaucugccaggcucugccucccuagugcuaggauuaaagguguguuccaccaugcccagcuucuaaguaaccuuuguuauuauuuuuuuuaagauuuacuuauuuauuuuaugcauaugacuacacuguagcugucuuuagacacacccgaaaaggguaucagauccuauuacauaugguugugagccaccaugugauugcuuagaguugaauuuaggaccucuagaaaagaagucugugcucuuuaacggcugagccaaguaaccuuuauuuaaccuguaguagucaaaaccaucaagauugaaaaauguugucccuuguuuguccaguuuauuuguccuaguuuauuauaguaagugauaaaaaaaauuggggcuggaaaccuggcucauuggguaaagucacuugucauuaagccugauaauucuugaguucaaucccuagaauccaugguagagagaaagaaccaacuccuucaaguuguucugacuccccagucaccauggcauaugcaucucuaccccugucuacacacagacuaaauauuuguaacaaaaaguuuacaaaaauuugggggcuggagagaugguucagugguuaagagcacugacuguucuagaaguccugaguucaacucccagcaaccacaugguggcucccaaccaucuguaaugugucuaaugcccucuucuggccuacaugcauaaauggcaggcagaacacuguauacauaauaaauaaaucuuuuuuuuuuuuuaaauugggacuggaaaaauggcuccauguuuaagaacacuuacucuuggagaggaucuggguucaauucccagcacccacaugauggcucacgauacucuaauuccaguuccaugggauccugugcccuauucuagcuuccucaaguacaaauagaguauacagacaugcgugcagacaaaacacuguacacauaaaauuuauuuuuaaaaauuuacaaaauucaagaauaucaauaggaaagaacaguuguaagcagagcaauauuuuagugagauuugggugaucuuuuauaauauuuuauguuuuuaagugaaauguuucaaaguauguucucaaacauucauuaagggcuggagagacggcucaaugguuaagagcacugacugcucugccagagguccugaguucaauucccagcaaccacaugguggcucacaaccaucuguaaugagaucugaugcccucuucugguaugucugaaaacagcuacaguguacucauacauaaaaaaauaaauaaaucuaaaauaacaacauucauuaagugauacuuuuauggcuuuuguuucucuagugucacucagcuccacuugaaggauaauugcuuaucugaugcaggcauucggaaaaugacagcaccagugcgggugaugaaaagaggccuugagaaucuagcgcuguuagaccugucuuguaaguuacuggguguuacguaaguuacaguaaugucuggagauuggcuuucggggucaucacuccccuaugugaaggauaaaaggcaagcuggccuaggagcuguuacaguccagugacaggacugaggccaguggcucuuuacuccugacccagugccuuuugcagcuuaccaccacuuccuacagagaggaaaaggcccuucagauuucccaggacacuuagcauauagccagcagggcccuucugucauguuaaaaguauacauacggauauuugguucuacuuugagucucugauccauagugucugucagcucuguucaguauuuaccuacuaaggagcagaauaaaucacucucuugguaauuuaagauuaacuugacuccagugauaggaaguuagcaguuugagaguccaguaaauaccgccuguggcaagguggguugguucccagugaguagaaaccgaagaggcgaggacagagggugguuuuguacccuugggcaauuacuugacuucugagccuugguuuuggccucuguacaguaauguugcugaauccccuggcauacuuccagggaagcuaccuauucagugacuaccuguugagcaucugcuguaucgcugccaccgugcuuaggauuccuagaggaaacagcuaaagcaguacucugaugugaaaaggcgcuguguaagaaaagcuucugacaaacgagauagucacagugguuagugauggccccuguuugucaguaccugaaagucuucucaaacugaacacaugcccugcuuacuucagaggugaacugguggcgagcaggacaguguguaccauuucacugguucuguagcuccucagcgugugggguaacugucuuaauccucuauuuuucuguucaucagaguccuagguaguuggacugugaaggaucuagugugguugcuucauguugcaaguagaaaaaauaagacuucauauugaauucacucggggacacucacgcucccugcucauuggugccuagcugcuuuucccugagcuuacuguggggguuuaccaacaguuaggacagaaugcugccuuguuuuugaugucuagguaacccugagauaacagacgcuggaauuggauaccuguuuucauuuagaaaauuaaauugcuuggauaucucuggaacaggacuaaagguaaggcuuuuggucucucagccuuacaggcuuuaugauaugggacuucgcuucucuuacaguuugaaguuuagaaagagcuaguauuuaugauggucuuguuuuguuuuggagguauagaguuacuaugucacccuuccugggcuugaauuucccuuguagccuaggcuagccucaaacucauggcuguccuuagcuuauugaauauuaaggucaugggcauaugucaccaugcccagcugguuugguguuuuggugugguuggcuagcccaggcugguuuggaacucaugauccuccuggaacucacuuuguagaccaggcuggccucgaacucagaaauccgccugccucugccuccugagugcugggauuaaaggcgugcaccaccaccgcccagccuuuuuuuuuuuuuuuuuuuuuuuuuuuuaaaaccauaccuaauuuaugguggucuuugcuacuaaaaacaaguaagaauuggaaauguauucauguaucugguguuucucccucaccaggacaucaaagccguuaaggacaagcuccgggcaaacauaggccuuguucacuccaaagugccuuugaaggaauuugaucauaguaacugcaaaacagagggcugggcugaccagguaugccgggcuuuucacuacaguuaauacagcuuuucauuuuacuucuagguaccuacaugucaaauaaacaugaaucccuuuaauacuuuuuugccucaauuguacuucucaccucaaucaucaauggugauaaucuguuacugacccaucuacuuaaggagauaguaguauuggaagucagaucuuaacaugucccugcuuugagagacugggccucaugccuaggaugccaucuuauucugcaaauaauugaggaaauaaguaaauuaaugcucacuaagcaaaaaggaagaagaggaggagaucugaucuguugucucacagugugcucuauuccagagaguuaacuagugucacgcuguaaagguuucaagucuggcuguucuuuuucuuuucccagagccuuuguggggagucucucugaucuuuuucugucuugccuuuugccagugaaagaucuagcuuuugaauuucucuugacuucauaaugcccuucccgggugguaaaguauagccuugaauagaaagucaaaagguaccagguagauagcagcucaccuguauggggcaccuuucaccuucagacacuuaacuguugauuccuggcagaagcauggaagacuuuguccugaguucuuccuuggcucugagccagaaggcauggaugguggagaaucuauccaccagccugaacauaguaucacuucccaguagauaagaaggaaggccugugucaaguguuucagaaccauuuggagcuggcuccagauaggcacgguucaguaauugccaauguggaccccaaguuccauccuaggugcaucuguuagauacauggcuguugccaagaccuacagguugguagcaggugacaggguggaaagacacaggucguggagucagagacugagaguugagccucauaaacucaguagcuagcuugaggaaacauugagucuucuuuacaaaagcuaggauuucucuuugaguuuuugaagaccaaguaaaacaccuaagaguguggccuugaaguaaguaggcuggaccaguguagcuuccugccaucaccugggaccuccagggcuuugagaaagugguuuccuagccuccuccugauccuugcaggaacuccagccagacccaucccugaaaagggagguaucuaacaggaacccacuuccuuuucugucuccaaacuucucuacuucuccugcuguauucuacuucccuucuuuuuaaagaaaucaaugaucuaugcaaguuuauuucaaugguaagcccuuguuuauuuauucuuucagucuuauuccugaaagccuucagcuuccucuaucauauuuauuaucguucccuugccuccucacccucacauucccaguguccccuucuggugaugcuuucuuucucuguguaaugucaguuauccuuacucaagugagucccucaccgccuggcaucuguguucucuguguucuuagcucucgcacuccuugcugccuuccuucccuugcagucugguuuuggccucuacuguuuuacuuuaagugucucuggaagcugccagguagccucguguucaccuuccuuggcuuuauaugacauuuaauauaaacaugcaugccuuggagauuuuccugucuuagcugauuccuccuucccuuuuauaccucuauuucucagugucaagaaaugauuacuaaucuaucagaagccauuuauauucccaaauauuaccuacaagugucuucuuagaaccucaaagucaguuuguccaaacuugcuuucuuuuucuguauucacaguuagcccuucuucuguugcuguugcuggaaggacagugucuuuauuuucuaccaagucaccaaauugauuuaguccauuuuggcuucccuuagaucaguacccauuguccagucccuggaaauaccauugaaggauccauaacuaauacguucugagugcuuucugcauaauagauacugauagcccucugugcaguccuuguaacagcccuguggaauacacaccauuacuaagcucuaguuaacaugucaagaaagugaggcucagaaguuaagucacuagcaaugggcuuucuggccaguaaaugugcucuuaugguuuguaguucuguuugucuauaucuugagucuuacuguguaucacagacuggccccaaaaucacaguucuggaacuauguguucuaccauacuagaucuguaauacuugaacugcucuguauccugcaaguauuuuucaucauuuauaguuauuaugaucauugcauugcauuaguaagaaguaucaaauguaaaguucuuguuacucaaaauauguugaaauaauuacugacauuucauuccgucauauauaguuuauuauguccagucauauuucuaaagaaagcagcaguagcuaauaaguaaaauuacauuuguaacacguggcuauagaaauaugggcauccuacacacacaggagauaggaguuauuacagauguauuucaaggcauagggucugggauauguggaagguacugugacugugauuuuagcuuuuaguguuuacagcugugcaguucaugcagcucacuccuagcuuagagcaggauggaacugggcaggagugagcgcagcaggauaccuacagcauacacauacauaguuuuugacaaucugauuugauuguuuucuuuugauuugguuugguuauuuguuuuuuuuucaagacaggauuucucuguguagcccuggcuguccuggaacucagaaauccgccugccucugacucccgagcgcugggauuaaacugauuugauucuuaugaauaaaaguuaucaguagguauguguuucaggaaagggagcaaagacuagcuaagaggaacaguguuugccucccugguacaaaaaaaggaaaacaacaaaaagaugagaaaaaagggaagaugccaaggaacaaugagacaaguuugagauuaaaaugagguuagccgggugugguggcgcacgccuuuaaucccagcacuugggaggcagaggcaggcggauuucugaguucagggccagccuggucuacagagugaguuccaggacagccagaguuacacacagaaacccugucucagaaaaacaaaacaaaaaaagacaagguuuuguuuggauuuaaguuuuuccaaauuccuuucagauuguucuacagugggagcgagugagcguggaagccgugcggcagcggaaagauguggagccucgaaaggcagcucaauacuucugugagaaauucuauguuuugaaguuuuugcucucggguuuuuacacucuuaaaauaaucagcccaucuucucucuguaggaaaguuaauuguagcaguauuaacuuacuaugaucacucagacaagucauucccucagcauagcucaugcugcaagcaccgccaucaggaaggcuguugcuuauuacuuauuuguaucugucucacuccaaagaagacuuacgguggcacaaaagaaagcagagcacagacagugagugucaccaacagaugggagcaggacuaggaaugcuguucagugaccaagggcuccuugcaugggcaaggccauauauucagucucaaacaugagaggaaaaaaaaagacuugugagccaggugcccugcaggauacagguggguuuaacagaaugcaguguuuauguacaagggagugugauccagucuuagaaagcaaggacauaugggauaaaaagaugguuuucucagugguuaagagugcgcaugcucuuccagaggaccugaauucaguuuacagcagccacaugugguggcuuacaccaccugaaacuccagcuccagggcacccaauaucucuggccuccuggaugccuccauuuauugcacauagucaaacacuuacauacaauuaagaugauauaaauuuuuuuuuguuuaacuuuuuuauuauuuauuuauuuauuuuauauacauuggugcuuguauaucugugugagggugucagauccuggaguuacagacagcugugagcugccaugugggugcuggguccucuggaagagcagccagugcuccuaauugcugaggcaucucuccagccccaguccuuuguuuuuuuuuuuuaaaaagguaagggcguuuugacacaugagcauugaagacgugcuacaugagauaaagcagucaugaaaggacaaauacucuacuaugauugcuccuuugugagcuuccuagagcaucagggucacugagaaagagaaguagucggagggaauaaggacuuucuacugaaugcuuacagacuuuuaguuuauaagguaaagacuucugugggcugguaagauggcucauugggaaaggugcuugccaucucugcaaaccuggcagccugaguuuaaucccauuauggaaggaaagcacugacuccaaaaaguugucaucugaccucuguaugcacggugccauaugugcgugcacauucacaucauacccacagacacaccguauuggaggcaguaaaauguucuggaaaaugaaggcugcagcucgugcuaacauacugucuaucacgcacaaggcucuggguccaucagcucugaaaacagaaacauucuggagauagguuaagauguucauuuuugucauuuuaaacaaguacuaagugauaggcugaaggaaacaauaacaaaaucagaaccccagggcacaccagauacgauaggggcagaggucagagucagguccagguuuucaaaggagaaaagaagccaacagcuuuuuagcuuugagggugagucugacacugucccuuuauaugcauuauuuuauuuaucuauuucugugucauucuagauuuuuuuauucauaggaaauuaagaaaauugguuauuguuagacucacugaacccaguaagugcccaccucucccucugccgugauaguguaucugccacuccugcugccgggcauucaguccagaccaccccagggccuugucuuaguccuggaugguaucagacuuuggcaggcccuggcccacgaacacagaaaacucacccauuucuuauuucuacagaccagaaucgagcucgcacagaaguuacaaggaaauguccccucgcagagacccacaugaacucuucuggaaaacuccaguucuauagggaggaggcuccggacugccaugagccacuguugagccaagaaucaaagaagagcaagaagagagcuuucaaggagucagagcaggagcagagcucgccccagucggccaagcagaagugugugugucuggcuguggaagauugggauuugcucaauuccuacugacugacacauacagucgaccucccccaccucaguacgaggaggggagacugcuggugauuuucuuuugguuuggauuuaccuauggcauuagcauagcaagcagauauuucuacuuuuguggugcgggagggaaggcuauggacguauguaauaauuucuaauguauauuuucaauacauaguaauuuuuucaaauaaacucuuuugcucucguugaauucugcuuuugaauugcagauuggagccacaggagauagcaccaugugaacua

SEQ ID NO: 2016 - RNA, 1300 nt, Mus musculus
uacgcugcagccaauuugucaucccagugacugauaguaaagacuuugaagcggcccucaccacggggcaggguaguuuccccuauaaagacaagcagugucgaucauuauggauuaaaguugcucuguauaucccugcuccaaacagccacagagagcaguaccuaaaugccugcagagagacuucugugacuggguuuauccaguggcccagggcagcauguccucuguccuccagucacccaggggccaggccucggagcuucuaggccucugcaacuaucaggucucuggugacuugaaaagcggcgaugagggagcucagcuguaucuucucacuggugccaacagaaagucuguacucaaugucugccauuuuggucaauaaguguauccgaacugaagauggaaagucaacucuguguacaaacaagugaaccucggucagaaugucaugcagcgccaagcccuucagagucuucagcuccaugauauuuuuguaggcgguggugaaguccugauugagcauccaguccaguauauuggcgauguccgucuugaguggguguccggugcacguguagacagucuccucugucaccuucccaaaggccauauugguacucugcaggauguucaaagcccuucgcauguccccacuggacagagugacaagggccuucauuccaucuucacuuauaucuacauucucuucuuguacuacguguuccaguugagggaccaugagcuugggugucggagggccaaaucggaaccccgugcaccgugacugcaaggcagggaugaucuuggaccgguaguuacagaggaggcaaaaccugguguuuucugugaacuucucaaucacccgucucaaggcauucugggcauccugaggcauggcgucggcuuuguccaggaucacaagcuuaaacccuuucuugaagauuguccuugugcuggcaaagcugaggacuggcucccaaacgauaucccucggucgucagaagcauucagcuccaagaccauggagccgaauucuuuaucuuuguacaguugcuuggcacaggccaggaugguggaugucuuuccugucccuggagggccauagagaaguagguguggcagguggucuucacugaugaacuucugaaugguacucagaauguccuggugagaaaugagaucggucagggucuguagccgguacuucucaacccagggcagguuccgggcccgggccaccgcccgccgcugcugcgaaggcgccgccgcugucaugacugacagaugcugcagg

SEQ ID NO: 2017 - RNA, 2319 nt, Mus musculus
agguagagaagccugucuagaggcacagugcuaguaacuagugcagacagggaacgcagaccacucagcucugagacucauagcuuccugaagagcauuuccucaaguggccuggaagagagccacuccuucacugguagucccauucaguguuccugaggagcagacacgauggccucggucucacucaugacccccaaguagaggaaucgccuuccuuugugccaggaaacagcugcaagagaaacuuuuaaauuagguuugcucuggggcugugauaagcuagagggaguuucuggggggugggggugggggggcggguggcaaagagaagcuaaagagaucuguuaaguaugaagguuggaacaggcugggaagcccaaguguguuguguuggcacccucuucuggcuaauaagggcagagcugcugaaaaugguucuuagcuuuuuaccuuuucaucuuccugagccacccaugccaagggaauccuguguaucuaguggcccuugggauaguaacagcuucacccucccacacacccuuugaagggggggcucaaggcuaacaagauugguguuuuucugugcuaacuuuaguguccucugaccuuaaggcaggagggaagaucuucguugccaccuccccugucccaucaccuccuccugguuccuggcagcuaagagugacaagcggaagcucuugucacacacuucauucucaagcucaaguccuggggacugaggugugcuuagcaccuuauuuucgaggucucugcagaaagucaacuaacugguuuagcaagucaguccauaaauaucuggcuacuugcuaucaggccagaccgagaugcuggcagagcagagguagaggcagagacagucccuguauccccugugugacacaguaauugcuagcgugaguccuggauccacugcucaugcgccacgcucacuuacccagggacagucucugugagccucaguuucugcaccugccaggagagaucaucguacaaccccuuaaggucucugagaagagucaggcaugcaacauagcauggccagugaguggagcuaaguuuuuuguuguuguuguuuuguuuuuucgagacaggguuucucuguguagcccuggcugucuuggaacucacucuguagaccaggcuggccuugaacucagaaauuggccugcuucugccuccuaagugcugggauuaaaggcaugcgccaccacgccuggcuggagcuaaguuuuaaaagguugagucagggagauacacagugagguggcugcagucuggugugauaacaaauauaauggggggggggggccagagacuauuaacauggcucccuccugugucuccuuuccugcaggcuuacuucuuugaugcuccagagauggaccaccucccagcagcuauaaccacucccaaccagacaguaacagcggccaaauccagcuaauggggaaagcaggugguggcauuucaucucucaggguaugucacaaauaggaagguacaucaguucugcauuaccaucagggaccaaaggcuagacccugagcuuguagacccugggguagcggggguggggggggagucccugcucuggugaucacacccaccuucucuauccccacuacacuguccaguagcacagaaggauuucuuccauauccuaauugucucagugauuuuucugcauucugugacgucuccgacugaucucugaaaccaguguuguccucucuugaaggaccccuggauuucucugaaggcuucuggauuucugugcuucaugugcucagggccuuugaaguuauuccucugugaaugguuagcugagcggguuagagugugcaagagagagauccaguuucauaacuuauuccuugccuccuguucuauguucuuaguaccuuuuuuuggcugacaaguucucauauagcccaggcuagccuccaauucaccguguaccugaggaugacccugaacuugaacucuuguacuuaguucauccuccugccucugguuccgcagaugcuaguguuacaggugggugugucucaucauguccagugugccuuccuuuucccccuuucccugugggcgaggauugaaccugaacccagggcccguacaagcuaagcaagugcuuucucauacacccaugaugacuuuggugcggagggacacuuacugauuccguuacgguuccuugugccaagcauagcugggucugcaccuggauuuuaguuuuauaggacagcacacauuggugaagggaagcaaggaaggccgagaauggacgcg

SEQ ID NO: 2018 - RNA, 48565 nt, Mus musculus
cagcaccgucgcccuuuguuuuugacgcccagauggacccugcuucggaaggacuuuuuggacuccagaggacgcuuccucgagucacagcccaccuggaggcauguggcuacggggaaguucuggccgguugagucuguucaggcgaagcugcggagagauggucuggcggcuuugcagaacccugcccaggcagcguaccgggcagccccagcuggguccucccggggccuuccugccuuugaacagugguggcgggcggacacucuguccccggcacgcuugagagcgggggccgccaucuccauggccacggcugcgagcgggcccugcgccggcgggucgccgcgggacauccuuuggcgcgugaguuagcgagccguggcgcucccugccucucuggcggugccugcgcgcuuggcuaaaggggccugucuuggaggcgcuuuaggaauagcguguagggaucugaccgccucggggauugggugcaagggugugugggcguccccgaguggaaguuaggucugggguguugagcuggaguccgaaguggaaguuugucagcgugguugggauggcccgaauggaaauuugguggaaaaguuguagagcaaaagguuagugauucgagcuaaugcauaauaaauggcuugauuccuugggcuaggaaacgggaagggcugcucuguguugaaagaauguggccuuagcagacucugggguuggggagacgcuaaaccgagcauauauucaugguuuauuuaagacagccuacucuaggcuucagcuaaggagagcucaccuccuugcauccauucuguguuugggggguggggagugggcgcaaggagagaaguaaagagaaugcaaauaguagugguucauguuaauagccuaaauggagaagcaggauuugcaugucugaguuagaguaacugacuucuugauugaagaguuguguuuaauuuuagguuuuggguuggaggauaguuaccagcaucguuuggucaguagugcuucuacccgucugcaucacagccuuuauagucuuaagcagcaucaauuuauuccacccuauacaguggcugucagguaaguggugauuuuuaauuacugucuguauugacauuaaaacauuacguaaaggcacucacucucugcauuucugcacucacagaacugucauuuuuguuauauaaaaucaguaagugugucagggauuauguaugaugacaggacagaucauuagaagacuacuuauauacacagcuaggugugauggcccaguguccugggaggcagaggcaggacgaccugaguucaaggccaaucuggggcauauauauaguaaaucccuagaggugcaguaaaaaagaaaaggaagccacacaaguauuuauccuuuugucuuuuccuuaaaaaaggaaaagaaaaguuggcuuauuuguauuuuucauguguauaaguauuuaacuuguauauauguauguucaucaccacgugugugccuggugcuuauggaucccccuggaagaguugcagaugguugugagccaccaugugggugcugggacugaacccagguccuuuggaaaagcccucugcugagccaucucuccagccccaguucccuugucuuuucuuguuuuuccuuucccugccauccauuuaaaauugcagaugggaauugugacugguauuaaaaaaaaagucuaaucuagcuaguuguagcacauucuuauaauccaacucuuaggagaguguagcaagaggcuccagagauccuggcuagccugggauacauauagagaaacuauuucaaaagcaauaagaaaaagcuauacaguuauuuaaagaauacuuuauucuuauguuguagccaacaaagagaagagaggccaaaaacuaaagaaugucagggaagacuuaguacaagucugcugagacagaggagauggaaacaggcuggaugcuuauuggaaucuuuggaugugaaaauaaaaugaugauguuaggagcuggaaagacgcugagaggguaaagugcuugcugcuugaguugaagaccugaauuuagauucucaguacaaucaagagucagcugugugaugcauauccuaaccccaguguuguggcucauuggccagccagccagcugcugagcucucgguuccgugagagacccuagcucaaaaaauaaggagagccacagaggaagagagcuagugucgcuguggccuuuacaugugugugcaugagcaagcacacucauacaagacucauuaugguccaugaguucacugaagcacaaauuaaaaaaauuaaaaagucauaaagguacagaauagguuuugaagucuugaaaauauucccuaagacuaaaaaacacaaauuacuuugggagauuuuuuuucucaauaauauauuccuuauuuuucuuauaagaaaguguaggccaucaaggaguuagaauuuguugucguuguuguuuggccuuugagaauaucgcuacuaagcgauacaaucaugcuuuagcugaugugugucauauuugcugaaucaugcaggacugaugaacauaacccauaagcccuggcagagauggcagaugauuaauuguuggagaccuaggaaaucugggauuaauuuugguuucugaauucuacuuugaaaauaauugcuuucauuauuaagugagucuauucagccagcaugucucaugucucuuucuuuuguucauauuuuuagauaguaacauacucauaguuuaaacuuggaagcauguugguuguugagugucugguuggguuuuguuguuuagacuaacccuuuuuaggacugguaaguuacacuguuuccacauuacuuuuccuuagcugaggcacuaauugccuuuacuauauaaaguucagaaauacuguuuacauuuugaaaacaaacuuggcuuguuacuaugguagcuuuccuaugaugaaauguuuacauaugguuguauuuucucuguuagcaacaucugugugaauuaaaagaaauucuaauaccauuuuccaguacccaaaacaaaaucugaauaauuuacuuuggaguucuuguguugauguccuauuggaccugacagcagcauacaaguaaauucuuaaaaauucuuugaaaguuaaaauuauaguuguagagucuguugagauggcucaaugguuaaggauguuugcugucuaaguguggagaccugggcuuggaucucaacacucacagaauaaaccagguaucccguagaugccuguaacgccagcuaggagagaucuagugcccucucaggcccgugccguguacacagauacauuuaacguucacaaauacaucugcauacacaaauaaaugaaguuaaaaacaccauaguuguaguucaaauguugcagugugcugaacacaacugaaaaacugaaugagcaucacuaauucauuucucuuguguuuuagauucuugcaaugacuucuauaguucccaagucaucuuucaccuccugcugcuggccguggucauuauaauaauaaguauuuucaauguggaauucuauacagguagguuucagaauuuuaacuuucuuaaaaguuugagcaucagaugugguggcacaugcuuguaaucuuagcacugaguaggucugaaggagggucaccauaaguuugaggccagcuuccgccacauagugaguuagacaguuagccuagguuagauggcagauuuugucucaaacaaaacaaaaauaauucaucuuacuuagggcagacuuuaagaaaugugugcauagcuguauucuguuauccuuucaguuguacuuacaauuacuuugguguuucucuuuugaagagacauuuagaccuuucaugauagucguuuaugagucugcuguggggaagcuggguauauaaagaggucaagucauaaagacagaguggacuguuagugccaggggcugcagcacaaaggggucaggagggccuggggcaacuugccagcagugugacuguccuccugucucagaacugugcauuuaaaaaugauucaaagguaaauuuuauuuuauauuuugccacaaugaaaaauguaaaaccuuuuauuaguucacagcuaguguuaaagcugugaguuaguaaaugaauuauuagauaauucuuguaagguaggggacuacaucuggacugaccucaagguuauaacacuccugccucagccuccugggcacugggauugcaagcaugugccacugcauuuguggcuguugacuuauuuuuucuuuccccaaauaacaaagucugugguuuuauaauaauuacagaaagcugggcuuucccuugggcgcagccuggauuccagaacagugcccacuuggcuuguuccuucucugccuuuccagauucccgaguggucacuuacggccuuucugauuauuuaucgcuuauucauguauuccaucuacuuauaguuuuugcuguaacaucucuuaacucuuuaguauuuaaagaauucuauauuuaaaaauaguguguaaaauuuuaaguccuuacuggguauuguaauacauauuauuuuucuuugcuuucuuagugcuuucuugguggcuaggucucuuugucuagucagcccuguucagaaccccuuggcuuauggccugugugcucuuucccucucuccucugcuccugggccuucucuauguagggccaggugagggcgcucgagucagcauuuuuaguuuacuuuauuuuuauuuuuauauuuugagaccaguuuucucuguguagaccagguugucuuagaauucacucuguagaccaggcuggcuucaaagucagugaaacuugacuuugaauaaauaauacucaaauuauuuauuugaguuugccucugccuccugagugcugggauuaaaggcguucacucuuguuuuuaaagccucacuggucacuuggcucguucuguaggaguaggcccuaugugccgugcacugggcaggucugagggagcacagagggccaucuuugacccaguguggaggcugccuagaggagcugauggcucaucagacuuugaaggaggaguuguguuaggcagacaaagaagagaaaugauuuuucuaggaagauggagcuugaaagaacauugagagacauggcaggguuugccacguuaggaaguuagucacauaauuggcuuuggggacauuuuugauggggaagaggagguguuagccacaucuuuccuaaaaugccaagcccccuguugcccacacugccauggcuuuuccuugggugaccuaaaggaagguuauuaccugcugugucagggagcccagggcugccggggcucaggcacaaacgcccuuuacccuuucccacagcuguccaccacgccacuuccaaagagcucuuuggauuguuggagagguccuaaaacuaccuguguaggagcgaguauggaggcucaguggguuacagagaaccagcucuaaccucugcacauaccucacugcaaacaaaugacuggauguaaugaaaaugccuauucagaguuggguguaguggcgcacauguccgugauagcgcuauaaacacuugauauucauuauuguaaguuucgucuuuguggcuuauuuuucacagauggacucuuaaugaaucucaaauguugaaauaaaggcaauuuggagcuaucuucuaaauuauuuauuuuauguuacuuagaaaaacgucagaguuggcauuauauuagcuaucagggaauacuaaguuaaagaaaugagccgggcggugguggcgcacgccuuuagucccagcacuugggaggcagaggcaggcggauuucugaguucgaggccagccuaguuacagagugaguuccaggacagcuagggcuauacagagaaacccugucucaaaaaaccaaaaaaaaaaaaaaaaaagaaaauaggaaaaaaaaagaaagaaagaagaaagaaaugaacaggccaauugcaugaggacacaucuguagucaggagacaggcaggagaauauuuguaguucagaaauguccuccacucuacaaucaaguuugaggccagcuugggcaacaugagcccuugucuauaagaaaaacaaacgaaaccaaggaaguugaagugaauugugucaaggcccuaucucgauucucuagguuuucuuguauguguauuucuuuauuuucaagaguuuugagguuggggucauuagcuggagcuuucuguaguggauuuccgucgguugguugugucuguggugcgagggaaggcgcugcuccucgacuugaggugccacacuuagaaagcugugcugugcucucugcaguugugcccuccauauccggcuccagacuggcccugauagcgcggauccugcauccccagcagcucacgcacuccuucauccacgccgcgaugggaauggcuguggcuuggugugcggccaucaugaccaagggccaguacagcucucucgugguucccugcacuggaacugagagguauggucaaguuuucuucuuuucuuucuagaaagccuguuauuuaccaggucaaaggagacccguggagaucacuaguguugcacccuguuuuccagacucucacaggcauuccuguuucuguguaucaaguuguuaagugauauuuuauguuugagaaaauuagcaaaauucucaguauauuuguguguggaaggugcugugugggcacuguuggguuccugagggugauucagggacagucucugagcugccugacaguugagagugcugggacauagcugcagagagagagggaggaggagagggaggcacgguccaggugagucaggagcgggcuguccugauuuagagguuagugcuccccaggucugcagucuuuccaggcauccggaggcccugagaagguggccugguuaggagagacuggagaagcucagaucgucagcaccuccacuagguccaugcagauuauuuauaguuccuuaucagaugcagccagcuugccuuuggagcaagaugacuguuucacacauucuuaccucagauucccaaggugacagcaguagugacaaucccuggcgucaggggagaauacuucaguauuuguuugcucccguuuaccuaaagugagucauuugguuagaauuuggggcauuucuuaaguuauuaacuuggaauuuugccuucuggcaaauagccuuaaaacaacagugauguguuuucaacuauuaauagcuuaacuuuuucccucagcuuagauagcccugcugcucagaccugcuugaaugaauaucaucuguuuuuccuacuguccggagcauucaugggcuauagcuauagucuucuguauuucauuaacaacaugaauuaucucccguuuccuauuauacagguaagauacaauuugagcauuuccuagcuaucauuugguaauaucaacacugucaugucuguguauggccagccucacccgauuauuucaagauuugaucaguaaaauuaaaauggccugaccgccaagcucaggcccaugaaggugcaguagcacagaugucuguaaucccagcucgcucugaggucagccagccuggaggauagcaguggagagaaccucuccuacacaguuuaacuucagaguguuugagggcuaagccgagcuuccuuccccgcugccucucuugggaggcugcucccucuuuccuggucacuagucccacuugcugggacggagcaggcugugccaucaggggaaguguuguggagccaccugcuuagggaugugcacgugauuuaagaacacucagccauugucucagacccuuuccagaacaagacauggcuauguaaauaaaacuccuucaccugguuugagugcuguaguaaaaacuaugcuucaguuaggguguguguguguguguguguguguguguguguaguggacacaugcgcacaugugugugcuugcucaccuggguguguugggaccagagguugauguugacugugguccucaauugcuuuucacuuuagauuuugagacagagucucuuacuuaauuuggaauuuauuaacuuggcaaagugggcuccaggaauccuccugccuggugugccuagugcuaacauaggcaugugcugccauuucugucuuuucacaugaguggggggaaucuaaacucaagcccucaugcuuggauggcaaaaccuugacuaagccaucuucucagcauauucacugguuuguuuuaaacuaaacugaaacaggugagggucuuagcaguuaaaagcacuuggcauacaaguugaugaucugugcucagucucugggucccgauuucugcuuguguuuuuauguacuucauuucugcccugacugggagaucuggacauggugagaagaagugaggcauaaagcagucauguagugaugagaauguuguccuugaggaggggucgcuaggccuugucacaugcccaugguguuggugagccgagcuggggacaacagaucugugaggaggucacguccucaccuucugcagcugugagugugagaacaacgcuuccgccuagggccgcugcucacugugaagaggagagacaguggaugcacucacagcaucucaaggagaaaaccuccguacaggaugccccgugguccauggucucaaggccaagcguaacagauacagagaaggggaaagagaaagugcuggagaaaauaggacacuccugaacauguugcugggccuugaggugaaguggacgucuauuuuacagauagacguugaucacaggagcauuaguugacguugcugauaaguuauuguaucuaccauauagugccaaauuuuaguacuuauuuuuauaauuucuuuugauaaaauuuuggguucuuguaucucaaaaguuuauucugauaugauaaacuuucacuuuagauuaacuuuguaagauuuucuuuuugaggcagggucuuaguaguagacucuggaucuuccugccucagcuucccaaguguuaguuacaggcgcgugcuaucgcgccucgcuuuaaaauuuaacauuugaccaaaauagacauuugggacauggcuuguagccacacaauguagucaucugucaggugcuguccucugaguacugcugggcagggcaguaguggggggauugauagggaagaaguagaugugagaagacaggccacucccuuccccugagcugagccucuaggaugcuggauaccuguaaucacagacuucuucuuuacuuacuuuauuuuaugugagacaggguguuacaauguagcuuacuugucccagaauucauuuuacacacacacacacacacaaacacacacacacacacaaacacacgccaaauuggccuugaacucacagacaucugccugccuuugccucccaagugcugggauuaaagguuugggccacucugccuggccuacguacuuuuuuuuuuuuuuuugguuuuucgagacaggguuucucuguguaacccuggcuguccuggaacuuacuuuguagaccaugcuggccucgaacucagaaauucgccugccucugccucccgagugcuaggauuaaaggcaugugccaccacgccuggcgccccccaccccuuuuuaacaagcaaaaauaaucauuaucauuaucaucauugucacugucauaauuguuuuugguccugccugucagccagcuuccuaagaauaauagaguuuacacauuguacauaucacuuaggguuuuuuuuuuuuuuuuuuuuugguuuuucgagacaggguuucucuguguaucccuggcuguccuggaacucacucuguagaccaggcuggccucgaacucagaaauccgccugccucugccucccgagugcugggauuaaaggcaugcgccaccacugcccggcucauuuacuauuuuuuuaauguaaccuaugagaaaucuaaucagcccauuaguuguuuugcuuuaagcgugcuuaauacaauuaaaaugcucaugucagauauuauuuuauuucucauaauauuacuaugaccaccaccaacugcuauuauuuuagacaggguuucccuguuucccuggcuucccugcaacuggauauguagaccaggcuggccuugcauucagggagaucagacugccucugccuccugagcucugggguuagaggugugcaucagcacacccugccuagauuccuuuuuuuuuuuuuuaagguugauuuuuuaaaauuccauguuugugagcagguguguacauuugcauccaggagcccugaagaaccuggaaagcccuugggauuuggagugacaguugugaggugccugauggggguucugggaacugagcauaaguucuaauccccugaacugucucucuagcccccguaacgacaagagugaugggggaacgucccuaauguuaauauuuacaaaggcaugagcuuccuaccaacaugccuugugugcaggcacugaccagaugagagcuguagagcgcugcguagcaucuaguauguuguaugcaguaaauagccaaggcccucuaaaaccuaacuggaagacauuugagcuugggagcaaguggaggcaugguggaugcucgugaugccaagagcugcuguaggagauguguccuugcuguugugaggugauagguggcagcaccagugccuacguggaggaauacaguuucaugucuguacucuggaaucuuugacugcaacaguggaguggaagcuguacaguuugugaccacauagacaugcuacaaucaugguaccaaaguagcuuccaucuguuacugcaauucuaugcuuuucuuuagcuucuaaacuuccuuaaagagggucaguuccauuagcauuucaggaagaggaggaagcagcuagccaauguuucugaagugugguuugguuuuuuuguuuguuuuguuuuuuguuuuuuucgagacaggguuucucuguauagcccuggcuguccuggaacucacucuguagaccaggcuggccucgaacucagaaauccgccugccucugccucccgagugcugggauuaaaggugugcaucaccaugcccagcuuuuauuauuuuuuuaauaugguaauuuuuguuguuauuagaauugucaaguaauaagggauugcuuuuauuuagcagcuauguugauuuugcagaugauuggagcgaugugagugcuucuguugcagcauccaggaagcuguacaugcagaugccugggcuggugcuaccaggcgucuacggggaaguuagcacagaguccacaggguccaggcaggguccaugcagagccgucuguaggacuauggacucaggcuggccugcugggaguuggcuagccauucggauuggcuguuuacacucuucaguccuuggauuugucaucuguaagaugagacuaguuaucucccguuagaggguugugagguguaaaugacuuaagcaugaucagaauaaccugguacauagucagugccaggaaaacagucucugccguugccuucuucccuuuacucauggauuugauuucuacaauuuuauucucaguaguuaaccacaaucugacucuacuaaacagaaaauuccacaaauaguaaauuuuaaucaagaacuagacacgaguguuuuauuuuuauuagauguuauuguuguuuuacugaaacauuuuuaucauagguauguuuuauacguaggaacaaguacaguauguauaggguuuggugcuaccuguccucuacuaggguuugggauauauuccccauggaaaaagaggggaauauaucauauguuccugaucaauaacaucuuaugaauuaguauuguucuuuucuuauuucugaucuuaguuguauaguguuaaaauuguuuaauuauuuaaacaucagaauaguuuuuuucuacaguuuucuaaguuacacgugugugugugugugugaaugugcacaugcacauagcuuacucuuuuuuuuuuaaauauauauuuuucucaaaaauuguggucagaacacuuaaaaacuacuuucuuacaaauuuuuaaauaugauacauuauucuacaaacaagguacauaacagaucuguaaagcuuaacugaaacuuuguaucuuuugaccaacaucucuuaaaucuucuagcuccuauuuauacuacagaaaauuaucauuuuucaggauuucuaucaguucagauuugucuuuuuaagauuccacaugugagaucauugauauuucucuugcugugccugccuggcuucuuugaacaucaugcauuucaggcucauccacguuuuaaacaugauuuucugauccuuagaaggaaaccguauuccgucaauacgcuguacuagguuugaaugcugccuuuucuggagacaguagccgcacacuuugauguggcucagucuaagaugcucaacuggaacucugcaaauugagcaacuguuucauagcuuacucuuguacuaugcucaugugggcuagaacucagaucaucagguguggcaagcaggcaucuuuauccacugagccaucuccuaggcuuuuuuuaaauuugauucugggugguggggauugagccaggccucacacgugcuagggaagcauggagcuggagcccucccucacuugcucgcucagucugaaugucugggucucaccugcugugcuaguuaguccuucaccaggaugaugcugagugugucccuucacauuuuucuuguuguuuuucacagcaguacaaauuuuugcguuuccggagaucucuccucuuacuaguuaaacauagcuguguggaaucccuguucauggucagaaauuucugcauuguguauuauuuuuuugguaagaauuucuacuuucuaauauaguuuauuauuagcucauaauguagaaaaagucagucacaagguuacucuuuauugaauuaauauuuuuuauauauauuuauauugaucagcccaacugauuucauuguuugaauugucaggauuugguaagggaauuuuuuauuaaaggaaaugugggguguguauguguguguaaaauacucuuuaaacacagagaaauccauuguguugcaguacuaaauaaauugugagcaauuacauucaccucagaaaaacaggcaguacaacucaggacagaaagcuguuguagaggcugagagcagggcaaaggggagcugcucgggggcggggccagcuguucacuccugcauggggagaacggucuggagaucugagcacagcagucugcaccauucaagaugauaaacguguuagagccagagagcggcugcaagaguugguucucuccugucguguggguucugggaauugaacucagguugguagacuugguggugagcucucuuaccugcugagcuauaucucgcugccuugaagcuccacaacuacgugcuuugcucucacaagugagaggcagggugagugacuucuuaccuguagacuugagguuauaauggaauuggucauaguucaugauacacaucuguuacccacacgcuuucuguacugaaaagcuggaagugcugcacacaguccgucauaguugucuugcuuaucguaguugucauaguuguuuuguuuuaauaaccauggugacuaagacauguauauuucagagucguacaagucuuccaggauuuagaaauuauuuucuucucuauuccuagucagauaguguagcauuuuaacugaggucuccuuguguacuugaaccucauaguuuaaggcauggugaagaguuuuacuaacuucucaugaucuucucuuggucuuguuuucccaggccauauucccaaagcauggauuagcacugcucuggaccuucacacagaugagugagucaagucugaguggaccucuguuuccuuccuuuuacaguuccauacuuuguagcagcuuuguuuagguuuaucccuuaccuucuuuuaauugaaauaagaaucaacagacgagagggugguacuugguaugacaagaaggugcuggcuccugccccugcccauccuguuuauagguugaaaacuccacucuguugcucauccuuagcugcuguggggucaggugaaggcuaagcuuucagugacuguucuuccuggcuuccucaccagucuguccugcgauggacuuagcgucucacgcuuaguuaaguuuggguguugaaugccauaugcucucuuugugccauugcauuagucugcaguuaguccaaaaccaaagggagagagccuccgccucccucccucccucccucagaccucucccagacauagaaacagugguccgcucuguugcugugccaccagguaccuucuguacuaaaggaaggugagcuuucugaguugcugugucuuuugucauucguuaugugucagauuuuauccuguugauccuaucuuugcuuuauuaaaaauaaauguaauuuuuuuuaaaagcuggguugugguagcagaugcuuuuaauuccagcauuugggaagcagaagcagucagguguguugaguucuacagagccaguuucaggacagccagggcuacacagagaaauccuuucucaaaaaaccacaauuaacuaaauguaauuuuuuucucauagaauuuuuuaccuaccuaccuuccuaccuuccuuuuuuuuuuuuuuuuuuuuuuuuuugagacaggguuucucuguguagcccuggcuguccuggaacucacucuguagaccaggcuggccucaaacucagaaaucugccugccucugccucccaagugcugggauuaaaggcgugcgccaccacuguccgucuauauauuuauuucuuuaguguguguuuguguggccaccagaggccaucuuguggcgcucucuuuccacuauguucgcuccuuuuaccacguggacccuggagauugaacucaggucgucagacuuggcagcaagaccguuacccacugagcccuaacacuggcucucucgaugguuuaacuuuugaugauguagugaugguuuaaccgucacauaaauacugaagaaauuugcacacuagucacauguccaagucauuccuuugcccuugcuugagacgucagucauauggugaaggugcagccagguggaugccugaggggcacugcugcagucaccuuacucagugugugcuccacacacagccaaaggguucaccuaagucgcauggaggugcauuccugcagcccuaggacuagugaggcuuuuuagcauucuaauaguuucuaaaaguuguuuaaaaugcagagaccauuguuuuugcagcucugaacccgucuauauggcgcacaugaagcugaugugucugauccagagguccuaaccauguuuuugagacugcuggccuugcacuugagauccuuuugacucccuucuucauuucuugugugcuggaugacacacaggagccaccguacccuccuccucacauguuuaauagguuuaaggaguugccaugaaucagcaguaauacuuugaccuguccuaaguaguuaggccuguagacacugcucuggucuccacaguaagugguacugcaggcccagucccugccugccugagguuuccccuuccucugaggaagugugagggaaagcgcuccagugaaguaccagcaaguagggugugugucuuuggcggaauccuugucuuugccauggaguuaaugguacuugcuacuuucauaggcaggcucacaggccucuugacacgauaggcggucuccugaacgucucauuacucuaccacgucuggcuguguggcgucuuccucuuggugacuugguauagcucauggauacucuucaaaaucuaugccaccgaggucaguaguggaauuuucuugucacuacuguuauguuucagaguauagaaaguugugcucaaagccaugccacucuauugguuuucaguuugaucgcucacucuguguuucugggggacagaguuucugcaaauuaaacagggugguauugaccgugcuuacuuagagccuggcuuucuuccugggauuuugaguacaagguaggccuaaugaugcuauuaaaguugauacuguuaacauauaaauaugugguuauauaauauuuacuuuuugaaaaacaucuugaaauuuaugcugaagaaaugauucugagaauagaauuaauauggacaguuuuauucuauguguaugggcauuuuguguguauauauauauauauauauguauguauguauauauauaugcaccacauacaugccuguuguauggauccccugaaacuggaguuaauauacaauuaugagcugccaagugggugcugagacuugaaccuggauccucuagaggagcaaccaguacuucaaacucucaauguauuugucauagaaguguuuuauuugaucuuacugucuuuguggucauuuucagugguuucacaggauuaauagauauuaguuuaauaaaauugggacugugacacuuuagaaaguauauuaauuuuuguuuaaaaccuuauguguaugaguauuuugccuacauguguaucuauguaccacgugagugccuggugucuggaucccagaagagacaguugggucuccugggacuggaguuaaggacacacacccuugcaaugcaugcacugagaaucgaaccuauguccucugcaagagcagccagugccuuuaaucacugggcugucucucuagccccacacaguagcacuucuuuuuaaacaaugcuuuuucaaggagcacugaagauguugauuugauuguauuuguuucuuuauaaugucagccauugcuuacugacuaaagcgaggucaggaacagaaaucccgucaugucacauuaaagaaugugucugauuacauuaaagaaugugucugauuguauccgacaggcgcauguguucccuguucagccgccuuuugcagaagccucagaugaaugccuuccuaaagucuuaaacagcaaccccccacgcaucguaaagguaccacaagcgugcaucuuaggacuucacaguuaucuuugacuuaccuuacagaauuagagucacagcauagcuaggcauuucgauauauuuuuuugagggccuagaauagugguuuucaacuuguagguugugacccauucacagggguugccuaagaccauccugaaaacccagauauuuacauuaugacucauaauaguagcaaaauuacagcuaugaaguaguaaugaaaauaauuuuauggcuggagguccacacaacgugaggaacgugagggucgcagcaucaggaaggucaagaaccacugcucuagaaucuucuaguauugguauuguaaaaauuaccuacuugcuagcuagucuuuuuuuuuuuuaauucaagugauuaaauaugacaguaaagcaccacccuguguauguaccugcuauguguguauguuucccaggauggcuuugaacucuaggacucauguuguccuugugucucagcuuccugaauagugaugagcacggccgugugcuaccacacuagcuaagucagcuauugaucauaggagacguguaagaugcaccucucucgaacagaaggugcuagccaacuaaaugcagagcguagacgaaccauuccagcuaguccagcaggaacacuagugugcuuuuaaauugcuguaucagguagugugauacacaagaugcuuguaauucuaaaacaaaucauaaucauaaaaguuaaauaaguuuacaaaucaaacuaaaaauuuuguuugauucagauuauaauuugaaauuguaaaggaaaucuaaguauaacaggauaugucuuacccuguuaaaagaucauagugccuuauuuauauuuuuugguuuuugagacaggauccugcuauguaggccagguuggaguugauuuugcaauucucgugccuaagccacauucuaagugcuaagauaacaggcaucuucuggcgugcgcagcuggauuaguacuuuaaaaucaguuaaaagaaauggagcccaguguuuuuggcauagucuagagaagcauaaacaaguaggaaaaugagcuauugcagcacuaauugcuaguaaguguuagccauucguuuggccacuuacugaaucuuuauuagaaggucaguugucaggugcuguggguuguguuggguaggacaaugacuaagacacaugacagugcuagguuucuacuggcaagagcaguggcaccaccgucuccccuggucccaguaccagacgcucagaacugaugcuuugaagaaauaaagaggcuuguccaggagaagguagcuuuucggaaagagcaaaaaaugaguguuuuguguguuaggcccugccauuggauguagcaguagugagcaaggccaugucccuguuccuaugggccucgcacugcugaguagaagcagaugaggcagcaggcacaagugcuguggcccagaucugggggcgggggcgggaccggggcaggaacuuauaggaggaggggguauuggaguuaacccuacagaccugaaaaaaaaaaaaaaauacagagcucuguaguuccuguaaguagccagagccuagaguguguggggagguagaggcaugcaugagaguuagaagggaaguugugauuccuuggauauuuaugugccuacuuuuuacauaugauuuuguuaaagcuuuaacagucugucuuucuuuguuccuuuuaguauuuggccuuacaggaccugaugcugcuuucucaauauucuccuucucggaggcaagaaguuuucagucucagccaaccagguauugcugagagucauagacuuaauugggcucgugcgugcucagagugccccagagccuuugaaagagagguaugguuuguccucacugcaccucugagaccuuagaugaacacuggacugaauauuacauggcccaaguggugacacugcugaguagauuuaugucaccagggaaaagcauugauuuguagauauucauuuuuucuuuuuuuucagcuccuuaaauaccugaaccugaagaaauuguguacuaagugucuuaucagaaaaguucaaccuaggaaucuuagcucugguaaugccauugaggacuuaaaaaccaggugacuuccccuagaugggaguaaggauuggaguccgauuuaucuuuugacuccauggacguagcucucugcuccugcuagguuacgcugccucccuuagaagaaaaguuagccagaaacuggauuuguuagugacugagggugacuuuggcaggccugguguucucugcugugcuugccaagacuguacaagcucaagacugacuuugccagaacucucaccauguuccuggcguggaacugguccagccuaguccuauccccagugggaaagaaagggccuggguaaccuuucaucugcuuucuaauuagcucucaaucauuuugcaaagcuugccaauucccagacuguaaaaagaucaucuguaguuaaaugugauguggaaaugaaacccaguuauauaaaaauauaauugaucagagcugcuuucuuuuuagcgcugagaaauccagugcuggguuguggagaaaacgaggccgcugugcuuucugucacacuugggcuuucugucacacuugggcucuucuucugcacuuuguuauucaagcaacuacaaaauagcaugugcuucgccagaggccugcucuggggcaugugauugaagguuaauuagaauaucacacagcuccuagcuguccggaguugcaucucagucugaugaggaucuugugugugcuugcugguuaggcgacggucccugcacgugguaggaaaggaguguguuucagagggaucugugugaugaggggcugagugacaugagaugggaggaguuuacagugccuucugcuguucuuagcacgccauggcacaugugacaacucuuaauaggcaaagggcuugggaaucaaagacaggugaggguguuuguuuguuuguuuuucuuuaagaaugagaacuauuaguucauguuaaauaacauaauggcccauauauaagaucucuaaguaugaaaaauugaaucguagaguugugugugcuuaauuuugguguaugaauuuuuugccuuuguuuguuuguuuuuguuuuuugagacagcguuucucuguguagcccuggcuguccuggaacucacucuguagacaaggcuggcuucaaacucagaaauccuccugccucugccuccugugcugggaucaaaggugugcgccaccacgcccagcgccuuuuuuguuuuuuuuuuuuuuaaauauacuaaaguuuaaaauagauuuuaaaaauuagaaagagagcagggcgugguggcacacgccuuuaaucccagcacucgggaggcagaggcaggcggauuucugaguucgagaccagccuggucuacaaagugaguuccaggacagccagggcuauacagagaaacccugucucaaaaaaaaaaaaaccaaaaaaaaaaaaaauuagaaagaguaaaggucauugucaaacagccaagccacuccuagagacagcauaacaaaugcuggcugcuuuuuuuaaacuuuugagacauggcuacauggcugcccuggacuuagcucuguggccucaaacucagagauccaccuggcugcaccagcauaccugguguggauauuggcucuuacacauagucucuccuuuauuuaucuuggaacguguuccaagauacucaauggugcuuaaaacuguggaugguggugaacucuguaucuguugcuuccuaaugcauauauaccuguauaccuaugaugaaauguaugaauuaaacaccauagggaugagcagcaauaagaagaaaauacagcaguuauaauaauguacuaugaugaaguugccaccaucucuggugcaguggggccauugucacauaaaguagggauguuugagaacaagguugugcugcuguggauugcuuagaggguaaguuaguggcugcuagcaugaguguguuagacgugagggugguuaaauguccugggagucaguuauggagcagcgcuggauuaugucaugcuguucagaauagcuguuuaaaauguaagaaugauuucuucuuggauguuugugcaacuguuaauugggaggagcuccuauaaauggacauguaaggaaaccccgugaauaggcagguaguauagcauccccuggagguaccguuaugcauccuagcuuucacugcccugguucauuuuucacagacuuaacaaucuuaagcauugcuagugaaguaauucuggucuuaaaaaaauauggccuaguccuuggcuuaguuuuggcaacuaauuuaagaguaaaauccaaaguuuugcuugcaggcuuuugagcaaauugauucagccaaguaguucuuaaauugcuguguuagguggcuugaguaacaauaauagcuuaacugagaaaguggguuuucuugcugacugccccugccccaagcuuugggaagagaauauggguuuuuuuauauuuuaauagguguuguuuggcuaccguagguggacauccccacaauuggacugcuauuucgagggaguguuugaaucuuuuaaaugauaugacucagaaacugguucucuaccaagaagcugcugcuacaaaugggaggauguauucaucauacucaguggaacccaagaaacugagcucugcaggugacuccuaguccuacacaaaggggaauguauccguuuccuagggaagugacaguaguuaguuccuggcuaauugcaugugugagguagcuauguuuagcauuuuucuccuugcccaucuuuuccauaaguaugauguguuuuguuaguaguuaaaauagggacgcagagcagacuggguagacugacgagguaaagugcagauggugaguucauuugacagugcuuagaggacugagccccgggagugaacagaaaacauagguaucuacaggcuggugacgcaagccugacaggcuggcuuugauccuggagcccacagugaaaggagagaacaacuccuaaaaguugucccaugaucucucugcaugugccugcucuuaagcacauacucacaauacuaaugcauggaacaaacacaucuaaaacuccuugagugguuucuggauuacagaaauaaaacauagacauugggacuuaaaucuaaauggaagccaucuacugugcuuugguuuaaagccuuaagagggcggggaggaguguagaaguugaaccccugagugcugccugccugggccaagcuuucuuaucaccacugcauaugcucuguuacagaagaaacugcuuuucagacuccaaaaccuagucagacgccuuccgugccgccguuaguuaaaacuucacuguuuucuccaaaauuaucuacacccaauguuucaaguccuuuugggaccccguuuggcuccagcguagugaaccgaauggcuggaauucuugauguaaaccccuucucugggucuccccaaaguccucagcucauaagaagaggaccgaggcuguggacucacacuucuggugagggcuggcuacuuuccagguuuaaaguuguauaguuguagcuuagacagcuuauguccucaucucauccuuucucuuuucuagaucaacaagugucugcaauuucuaacccaucuccuugcgccucuguuacugcugaggguaagacagugagacagcccagugugaucuacucguggauucagaauaaacgagaacagguaggaagacgcaucuaugggcuuuauauguauaugugagaucuccacugggagagaggucagagcucucacagcaguagcuuucuguuuguuuuaugcuucuggcaucagauuggcucaugaaaucacccauaguugaguauuuugacuuauacugcauuucauaugacuuaauucuuuaagagauaguugaguuaggcucugggauagacagcaaguaaacaaagccauuucccauauguuuauaucuuaguaggggaaguagaugaauaagcaaguauauuacucuauauaucuuuauaauuuagaacugaauuaaugucagggcuguucugggaacuguuaagagcaaaaguugcuucaugcugaaacaugcuauuaauucuaagcuguauccugauagaucaugcccaagaugaggaaaauauacucaaaggaagauaauuuuaauguguuaaauguuauauaggaaaagcagagccaguacgaaaggcaguacuuaaaggcaggguauaguuuuccauggacugcucagaggcgucucauugaagagcugacgcugacugagagcagcaggacggaugggaggugcacguacccgcaggagggaggauucgccaucugugugaggaacaucggaaacugugugucuugagcucagcgagggacagugguggggacagugcuugguaggaggugaacucccagaggugucaggaaccagaguugaggcagcacuggauggugccaaaacuggucccuccagugagcuggaaagccaccauacuguucugaccauaggauguuauaauguuacuuauauuguggaagggcuuuucuaaagcaggguugagguaagacuuuuccguaucugaaguuugacuccuaagcagcauagaagcugagaaccaguguuaaaguugcugcagucgucacauagugggaguggugggugugaucguggggacugugauagcagcuguaagguauggucaagaucugugcucaugccaacguaacaggauuugcuuauaauuugcuuuuuguauucaggguaaaguuccaguguuuccucuaaggcuuuuggccugaggcauaguugcaguugauuggggcaauuuaccacugauuccgaaggcauugccaguggugaaggggaaagcugaaguuugaucuugggcaugacaaaucugagauaucuguguauaaagcaaaagauuagauguguacguggaacauaguuggaagccaugagguucagacaguaaucaaagaaagccaugagacucagugcuguugaguguagaaggaaagagcucuaagcuggacccuccacucauuaagggucaauagcaaaggggucuaaggagcagcaacugaggcgaguuuuuuuuguuuguuuguuuguuuauuuuuguuuuuguuuuuuuuuuuuugguuuuuuuuuuugguuuuuuugagacaggguuucucuguguagcccuggcuguccuggaacucacucuguagaccaggcuggccucgaacucagaaauccaccugccucugccucccgagugcugggauuaaaggcgugcgccaccaugcccggcgaguuuuauuuucuuuggaaucaggaucuccucagcugcccagguuggccucagacuuccucuguagccuagccaggcagucuuugaaccccaguuucugagguuuauagggcugagccaucuugccuguguuuugcaaaguuggugacaggaguucuuggguagaggcggcuggauuaggaggaauuugggcgaggaaauagaaccuccaaagaagccagucucucacacgcuuuugcuuuuaauggugagaaaauggcuuguaccuguucagaguugaggggucaaggacuugaaagaaucuucuuuucuugagugggagaaauagaaacauguuugcuggugaaaugaugagguuaguauagaauagaggaacugcugugacaccaguucugguccugcgaguuuuuguagugacuagacaguucagccuucuacauccugugcuuuacuguggcugugggcgagaggagaguaagucagcgggcuuagagucugauacagacacuuacauuuucuguaaaugucaccuuguaggaaaugucuuagggaaguuugagguguuaaagggccagcaguuguaucaaacugagggaaaaaaaauagguuucaaaacaaaacaacuacccagacagcuuagauuuccuuuuauuauggcaaggaucuaauugguguccaguguaugugcaagggagcacagucacgguaagauggcucguuguggguauccagucgguagcacagagguguuuacuuaguuuauuguaaauauuguucagggcuacauuuuaauuuagaagacuucuccaggaagaacuuagaaauguguacugcacuugaguagacuugaaaguauaaccauguucauucuucuuauccaacucagauuaagaauuucuugucaaaacgggugcugauaauguacuuuuucaguaagguaagacuauaaaauuacagcuugagaaugggagggaggagauuggugugagauggaugaugggaucggacuuagaagauuuuacagacgcucccugcaagccaugcuggcaucguguccucugcccagacacacaugucaccaugguugcugggcuuggccucugugguggcuccugagacugcuggcagcuuugugcugguuucagcuuugacccuuucaugcuggcuggaggcacguccagcuuuugggugcuugcuggcucacuuaacugcucacaucuuuguggccuguuaaaaaggagacuaaguuagaggauagacguugaaauguugguggguuagaaaguuguauuuuaggccacagaguuguuuuaugugccagcauggcggcuuccauguguaaucccagcacuccgggugcugaggcaggaagauggagaguuugaagugagaccuggcaacuuaugaaauccugauccaagaaacgcaacccuaaacucccaaacaaacaaccuuucagcuggcuucccacuuguuggagcugucucugggcaguaaaucuaaguuguaaaaauuaaagauuuauuuguguuuucacuuagaugcagcaguuuugugucaaucguuucucaagcagaaccucuguccacacacagggcagaguacuuuugcccuuagucuucaugccuugccucuuugugugugcaccgcaguauuagugacugggcuguggaguguaucacacacaagcaaaagcuuucauuacucauuuuacucucugaagccaaacagugauggggaaagaauugagcaauccugauaggaacaggggaauagaaaugagagccaucucagcuucuucccuccaggggaagggaagggaaggucugucuaaucaucaguugccuuuccaaaaacuagucuaccuaggaccaucuuuuagcaacaagggucuuaucccucaccaagaagaugagaauucucugaaguuuacugcagcucuuuguuuccacaggggaaaaaggcuuacugugagugccuuauguaugccacgcacuuucccuuaaauucccucccauaacucuaacacugguccucuuugcuccucauuuuauggggaagaagaaaguuucugcuccuagcauaaaaaccuuucccucugugaguaaaagcaaaaaucuacuuugauucuuauucugcaagagcuguugugugguguuaggugcagacaguggugagaagcacuguaguagcccgcccagucuucggcagauacuuacaaaaaccaggguucuugguuuuaguuuggguuuugagauggucucaauaaguugcaguuggucuugaauucauucucguagcccauguaggccuugaacuucagaucuuccugccuuugcuuccuuaguaacugggauuacaagccugugcagcccaguucugccagcauuuauuuagaugggccaguuguugcuucauaaugucuaacccagggcagauuaaagaaagccacacuggguuccuuuuuauuggguugaacguaguagacaguuaugagacgcaacccuaguuaggcuguucucucuccuugagugaucaucaugcugguuuccugagcugggaacucuuccuuuacauaaggacauuuggauguucucuuguacuuagucuuuagauaagaaauuauuucaguuuaaaauuugggagacagcugugagucuugcugcuaaagaccacacagcugguacaauggcaguuuuugcacaggggacuugacuuagagauuuuuguucuauuuguagcacccagaggccuccauucaggcuguuuuuucagaugcccaaaugcauauuugggcuuuagaagguaaguaguaucuuugaaguauaaucugugacuguuacucuaauuaguuaauuuugaagucuguucaugaaaggucagcucugguauuggguuuuuaauccuugaauuuucagaaaauuuuuaucuuuguuuuauagggauaacuaacugucuuauuuuccucccuggccugccaguccuaggcacagaaguggggccucaugacugcugggcaagcaccccugcugagucucagcucucagccugauagguuuugauuuggguagaauuuuucuuguacauaaagaaguugaggcuguaagagucuuccauaucuuucuauguaauuaaagugcaaccaauagauaaucuuuaccuuaagguugcuuucauaggcuaugaaaacgugauuggugaggaacuguuucuccuuauuaguacugccucgugauacagagacccacgccauggaaauguccucacagcugucaggccuucuuuguuucaguguuuuguggugcuaaggcaucucuaucugaaugcugcuuauuccaugugcuguccaguuuuguauuguagcucuuuuauaauucccuuuauauccagacuauuagcaucuucccaaguagauauauuucagauggguuugucuaauuuuaauuuggcguuccuguuuucucccccucuugaggucugucucacuuaguagcagcgucauuuacagaagauagauuuggaguuguccagaccacacucccagcuauccuucauacgcuguugacucugcaggaggugaguaacagugcucggugugagugcaggcugucccccagugcccagugugagugcaggcugucccccagugcccauugugagugcaggcugucccccagugcccauugugagugcaggcuguccuccagugcccagugugagugcaggcugucccccagugcccauugugagugcaggcugucccccagugcccauugugagugcaggcuguccuccagugcccagugugagugcaggcuguccuccagugcccagugugagugcaggcuguccuccagugcccagugugagcgcaggcuguccuccagugcccagugugagcgcaggcuguccuccagugcccagugugagugcaggcuguccuccagugcccagcgauuucuccaggccggaacaaaacauguuggaagugaaaauccccuucugacccuuauagucuaaaagagagaacaagaaaaacuuuacuugcuuaaaacuuuuucgagaaacugaagaagaaaauauguuacugugugugagaggcuuuuggaauucagguagauaguccaggcuguuuuguucaagugcggggaccuguuuuugggacaggagcucauguaucucagaccauucagacuggccuuaaacucacuguaugccaaggacagucuagaaugucugacccuucugucucuaucucccaagugcuagagcacuggguaaaagccacuguacuccacugugugugugugugugugugugugugugugugugugugugugugugugugugugguuguuguuguuguuguuugguuuugagacaggaucucaauguagccucuguuagagauggaacuaucugucuccucagugcugggacuaaaggcaacugcuaccacacccagcccuuucugaauuuaagugauuuguuuuauucuaucuuuuguuauuguggcuaugggagguauaaaaaaggagcuuggggcauauggaaauaguguuugaguguaauaggcucuuuauaggagguguuaagcuuggcccaacgaguucaauuguugcaucuuuuggucuggggagccauuucagaaaggaggaagaagcuugcuccauaguuacucuauuuaaaauuuaguucauaucaccacuuacucaguaaaaccagugacuuuuucuccucuuuuuuuuuauuuuuuauuuuuuauuauuguugcuuuggauauucugaguuuuguauuuugggggcuuuuugagauggagucuuaguagguagcucacaugacccaauaaaguccuaauccucuuagccuugccauccaagguagggauuauaggugugccccacccacucccagaccaacacugccaugcaguagagcagcuggcacucgaacaugcguucuguccuuggagcaucuucauuuccaccuuguaaaaugagcagucacucugaugacagacgaggaggcucgucagagugcagggauguaaucugaguuuacacacaaacccccgagagggcagcgcuaggacucggcccuggacuaccugcagggcgcugacagcgugguggcccuggaagaacagcaggucacauccaucauccuuccucaccuugccgaccgccacgcccaggccacguaggauucuugagagagugauucuguccuuuuggcucaugaucuauauaguguguuauguucaacuaaggcguguguguguguguguguguguguguguguguguguguguguguaaauaauagaaacaagauuccugacccagugcuuaacuuugcuugcaauguauuuuaauauuuuguuguuuaauuuccuuaaaaaguaccaacuggaacucacugaaauugagcauacaaugcugugagcgagcauggugaccucacugacuacauagagaucucucugcccuacaaguguucugugcuucgguuauuccggucacaccuaccccaucauugggauucuagaaaaaaaguagccuacuuauauuuguugcaguuauucauaccugugagugggaagauaaaauuucagauuugucaaaaagucagcccuuuccuugaaacacaaaggaguuuagauggaagaguuggaggcagaggccugugcucugcaguugagagucagggacagagaauaggacuagggggcugacacuugugagaauucaggucccuuugugaggcuccuguugaagucacagauauccucaggccugacccccagcacuacugccugcugugccauccuaccaguccaguaguguucuuaaagcccuuagggcuaggaaggaaaucaauuauauugaguuguaguuaucaagauacgaguuuaugcuaucuugaucugugcuuucugauuguuuuaagugggaggcucuguccaugaguucaugcuuugucaucauuuugaagcaguugggugaauggugcuuuuagauaacuguaacagcaauaauaggaugugaagguaguggugacaucuuuaaugcaguaacugcuuugaugucccuguucauaauuaaagucaacacuaaauuauaauuuagugcuuugggaaggaagguaaauguagaacagcccuuucuccaagcccagcccucugugcucuugcaucacagagcauuuuccugguuccuugccuuucagcuccugccuuggcugagggucuucccucuccaggucaggccuuacagucucuuacuucagccacuuuaguaguagaugcuaucuacaucuuuguguuuuuaaguuccccauccccaaacugucaaaacauccugcaucugcuacccacccauucuuuucccaguuguuccugacuuaucuucaggccuuugucauuccuuacugcucccaccaccucuuacccaagauccucucguccugacuagacacugccauuucucccuugugccaucugccuuaaagccacuguagauuauucuguuuucccucaagcgugacuuacaugacuguucuuugucuugaauguacuuuucuuucuucuggcucugcuguguaauucccaugucagcacucaauuaguagaacagaagccaggauccaccuucucauuuucuuauuccuagcguaugauauggccuggcuagugacuccuaugauauggccuggcuagugacaggugcuuauuaagaugcuuguuggaugucuguugaucugcuugauuacuggauaagcaagugaagccaucucuucuggguguugaauugaauggcaauucagaugcugugggcugauuauaaugacugcuccuuauuucaaggaggcagagauguugugccagucauauuaguucucuuuuaugucucugguuuuauguucugugaucaagaaaguaacuugcagcuuaguaacucaaggcaaguugugcaguauuagcuucuggcuggcuacuaaggggcauuugugagguacuagucugucugacuucucauuggcaauagcaucagucauuuagcugugagccuuuaaaggcaaaacggaaagaacugggaggcucucacccaggacugggggcucuccccuuuuaagaaagggcugggagacucucacccuuuaagcaauucaaggucaaagaauggagaaaugguuauccugauaucguuucugcuggaggccaggucaucugauuuaauuaaccuguauccuaacaaguauccagcuacuuccccaagauuuugauuagucaaaauagaaauucauuggagagcauugcugaguuugugguaguuaauuuggguagggaaacagcugccaucuugcuuaauuucaguaauuguugucuuuaaagaggucuuuagagguaaaaaguugugggcuaagauguuuuuuguuugugucuccccccacaccccgccauauccccccaagacaggguuucucuguguagcccuggcuguccuggagcuugcucuauagaccaggcuggacuugaacucacaagagaugugcuugccucugccucccgaguacugagauuaaagguaugugccaucaucaccuggcuauggauuuuaaguuuguauauauguauuuguguguacgauuuuuuugaggcuaggcauggugguacacauuuuuuaauuuuagcauccuggagguaaagacagauggauccaugaguucaaggggagccugguuauauuguaagguuuagaacagccaaaacuacagaaugagauuuccuuccuuccuuccuuccuuccuuccuuccuuccuuccuuccuuccuuccuuccuuccuuuuugaccuaguuaugcaggcauaaaaucucaguucuccaggaagaugagaaaggaaaauuguaacuucauuccucaccuugguuaaaaaaugaguucaaaguuagccagagcaacuuaaugagaccuagucucaaagaagaggaucaagagggcugaggauuagcucaguggugaagcacuugccuguaguaugcccagaggcaaagcccugggcuacauucucuagcaacggggagaaaagucacgggacaguugaguggccuaggguauauucauuuaucccaugcaacccucagcaccguccguccuguucaucuggagagcgcgguaccuuaaauguugagagucaggagaccugcccuguuuuuaucucauuaucugcaagugagauuuugaucuuggaacauugaaauugauuuuguucacagauucauucauccaacaaauacuccgcuaucuaggaguuaccauggaaugacauagaguaggaacuacagacaggauucuuguccaguaggagccuguaggcuagaacuaaguacuguuguaaggacucagcgcauagaaaugcaggaugaugacagaaccuaacagauaauucugaacugagauuguggggcacgugccuuugguggagggcagagggcaauugucaggaguugguuuucugccaccauuugugugucccggggaucaaauucagggcagcgagcuugauagcaaguaccuuuauccguugaauugucuugauggucccaaacuaagauaguuuuggaaaugagagguagaaaggguuccuuggggauaaagagguuagaaggaagugagggggaaaaauauucgugagggccagggcuuuaaguuugaagguguguuaguuaaaacuguuuucuccucacuaugacuuaggggaaggagggguuguauggguucccaggcaaacaguacauuaugguaaagaaggcaugaugacaggagcagcguguccaugcuaccaaccaaaagcacagaagagguuuccagugaucauacgucuuuccuuuuguccuccuuauuuagucuggacaucacuacgucucuggcaugggguuaauucacauucaaggaaaguagucuuaucucuggaaacccccacauguaaaaguagccugauugucaucuccaaggcugccuugguuugcuaaccuaagcccaguccuggaagcuuccagucuccuacagucuaaucuagaccuagacuuuuagcuucugagacuugcugcugaauacgcguacccuuuccugggucuuucuaaacucuaguuggcugauucaauucugcuguucuggcucaaacuccucuugaacugacugauucagucgccuccuuucucuuagucuuaccugaauugcucugcuuguccucauacuaacuuuggcaaucuguucuaaucuucuggcucauucucauuucuugauucauucugucuaccuaugucuagcuuguuugcucuucaaccugucucucuaaaacugccucucucucuucacuacccauuaauuagauuuccuuuccucuaucuucucaugagaguugggcagauccuauucugucaaaucuuucucugauucaucgcuuugucugccacucaauuagacaucacuuucaaacaugggugcuuccuucugcaaacuaauuuuaccuucguuguuugggauuaaagauguguaccaagaucauguccaccuuccagccagaggggaucaagguguuugcuaagggcugaaccacaccacaacuagaaacagguuuuuuucaguaaauaacacaauuucaggguucagugugaacaaauguccuguaacacccugauagacagacauacccugagguaugucaccugauagacagacauacccugagguaugucaccuagguguuucuuaaucccauaaaguugucagugaaaauuggcauucauaaaaaucccagagaguuuucaccagaauccugcaaucaggguguauaucucauuucucuagaauuuuauguaguuugacuuaacauagguacaguacucagaaggaaaugguuuauaaaaauguaacagcuugggaaguuaagacaaggcuuguuuugugucacugaauuuuucuugaaagacuacauauugcuaugauuuauucaaucaaaaucauacucaguaaaugguugagucagaauuggaaaccaggcuuuuggaccccaagucccgaguaguccauguaucagauuaccucuuuagggcuuggcaaagguguacguuucuucacuuaagaaggaauggccaucugacacaagugccagagugucagaucuggagucaaauaggguuggguuuuauuggggaaggcguuuguugcauuucuuagcauucaagauuccauucauuagaagcuacgucuccaugucggaaauuaugaaaugcacaaaaggauacauugucugagugcucacaucugggugauugaguaguucucgccucaggaguguggagggucaauccacucuguguagcacucagguaucuggcaugguuaguaagagcuuuuucucgugacuguguugucagcacuccugugcagugcaacagagcugccacaucaacaccaggguuugucccuaagaaguuuuugggggugccaccagcaacagucuagagcagacagcaccaaauucauagccaggccuuacugcuuucugaguggccagccagaauaauuaguucugcuuucugagaucagugucaaauccaugaagagggaauacaugucaguugucacugcuagagugcucggugcugacgcgcuuccagugucugcucagucagucgggugcucacacaagcaggcgggugaacuugcuccugagcaacuacagaagagcagcgugcugguuuaaagucucagggaugugaccccugggcucacuggucagccucuccaaccagugaccuccagcuccuaguaagcuuaaacagcuaguaacucaucaaacaguggcugaggaaugccaccugagguugacuucuggcaccugcacacaugguguuuuagauuuugagguuuuucagauuugaaaauauuuggguagacuuuaguaauugggggaucccucaucugaaauaucucggaauccauuuuggagcauuucagauuuuaaagcauuuugacucccaaaauuuuagauugggauauucauaauccuguauuuuacagaauuaugagguuucucaggaauaauuuagcuauaagggucuagaaugguuucuuuaccuguugagacuaugguuaaauagcaggugcuauuaacaugcacauagcuugccgcauggcugcuuuagccgguuguuauuugagauggugcuuuggaagcgcucaucucaguugucccuuacgguagucaagucaucacuacugagagugcuuucacccacaggccaguuugucuccuuggagacuuuagcaaugugugagaacacuucugauugccuuuauuuuggcuuuugcuaauguaugacuggaaauguaaguaggcaguuacucucauaauagcauucucucuguaggcuucuuugggcccaaaguauaaguagugguaaauuuuuucugcaagaguaauugcccguuagcgugcuguguuggguaucacucuucauuucagguucuugcuucuuacuugagagucuccucacgcauguggucugcaugagagcaaggcccacauacaagggaugcuuguguggcauugacugaggaguauuuuucucuauacuacagguacugcagagauuguuaugaaccaccguugccuagauugaaccuacauucaaaagcuugaucuuagcugcuccucaccacauaacuuccauuguccuaaccauacuuaaucacuugagcuuuuuucuuguaauauuuuaagucauucauuuuaacuuaauuuuaaaaggaaacauaacuauuguuaaaaguagaaaucuaguuuggcuuccuauagcuaggauauauguuuaagauaguaugcugucucaaaccauaucauaucuugagaauuuagauuuaaauucuuuuuuaaugauuuauuuguuuuuauuucaucugcauuauuguuuugccugcaugugugucuaggugaaaugcccuguagcuggaguuacagagaguugugagcugcugugugggugcugggaauuaaacuuagguccucuugccagucccuaaagauuauuuuaaguguaccacuuuagacuuauacauaggcaaacucuguuaugcuccuuacaguaucugagguagguccccuaggaagaaaaugaauauuuuaucuucugugacguagcuaagcauguguggguaaggagaugaggacuauaaauaacuuaugucaggucaggucagguuuuucuaccagaugacagaguuuaggucaguuuuugccccccagaggaacaaaacuuuuagcugucaguggguuuuggugguggaggaggaggaggaggaggaggaggaggaggaggaggaggaggagguggugguggugguggugguggugguggaggugguggugguggagguggugguggugguggugguggugguggaggugguggugguggugguggagguggugguggaggugguggugguggugguggagguggugguggagguggugguggagguggugguggagguggugguggugguggugguggugguggagguggugguggagguggugguggagguggugguggugguggagguggagguggagguggaggugguggugguggugguggagguggugguggaggugguggugguggugguggagguggugguggagguggugguggagguggugguggugguggugguggagguggugguggagguggugguggaggugguggugguggugguggagguggugguggagguggugguggagguggugguggagguggagguggaggugguggugguggugguggugguggugguggaggugguagugauggugguuuguuuuuguuuuuuuuccagaauuuuggggauaaggcaguuaaaauaagaaaagacaauggguuuaauuucucuguagauacuauuguuuugaagucccugaaccugagaauucccuguccuuuguuaugcauggauguuaauaaggauuagagauggugagaauaauuaguucauuucuuuaacccugaugcauuucuuuuuugagcaguuuuaacugaagauuguuuuggacuggaguaaaugugugccugcuguaaaagcuuuggcuccugaauuuggaucuuuagggcccaggagaaaagcccggcauggcucauauggcuguaaccucauccuugcuggagagaggauaagauaguaagauggaaagccacugagggaagcaagaugggaaaacuccaaguuuucacaagugugcacauucauacacucauguguacaugccccauacacacaagagauuggugcuuuugugguuuuauuccuuuuuuuuuuuuuuuuuuuuuuuuugguuuuccgagacaggguugugguuuuauucuuaauuuggagccuuucaaaaaacaauuuacuuacaaaacuucaauaaagucagucucuugcaguuauacauuagauggagugacuccuuuuaaaauccaaggacaguggccccagugguggauuagaccuuuacugccagugcucaggagguagagcaagguggaccucuggcuuagaggccagccuggucuacagagugaguuccaggacaaccagggcuacagagaaacccugucucaaaaaaaaccaaacaaauaaaaacaaaaauucaagggcagguguauugugagggcacagugauuugacauuucuagucguuugaacaauuuguugcuauccuaagaaauauuucccuauuaauaauaauuucccccauuucggguaagaauguuaaaauuauauuuguacauuuccaagaaacuauguaagaaguuuggacgcaggucuuuaugguuaucauucauaaaggacaguugguagugcagaucuuaagacgucuucagcggagugugcuggugcacaccuuucauccaucacaugugaggcggaggcagaggcaggcugggucugcagagcaaguuccagcauagccaggaucacaucgagagaccccuucucaaaagcaagcaaacaaaacgcuccguauggauuuuacacguggauggaugcuuugccugcaugugcaugugagcaccauguguagcucauugccuguguaggccaaaagagcgcauugcguccgagugcccagaagugggguaacaugacugggagcugccguguuggugcugagaaccacaccugaggccucugcaagaacagcaaguugcugagccaucgcucuagccuugaauucaggguuuguuuguuuguuuguuuuuugucaaaacagcaacaaaaaucuugugcugaugguggcaguggauggaaugcugcucuacuuagcgguugcuuagacaaagcaggaggacgcagucgggcagcagcagcucagcuuugugaagcuguaucaacagagugcagcuguuaauaauucaaauucguguugauuuauuuuacuuagcucagucauuuuacugugaucaguguacaauuuuuuuuuguuuguuuguuuugcuuuuuucuucaagacaggguuucucuguguagcccuggcuguccuggaacucacuuuguagaccaggcuggccucgaacucagaaauccaccugccucugccuccugagugcuggcauuaaagguguccgccaccacgcccagcuguggacaguuguuaauaagguauuuuuuauccuuuucuucacucugucuuuggaaauccaguguguaucuuacuguagcucaucugaguucagugcugucacauuucaagugcucggcagcaaugucugaauagcaguugaguucggcagcaugguucugaaauuuaaugauugggacauugauuaucuuuuaagauuugggaaucaagcauggcagcgcaugccuguaaucuaccucaugggcagcucagacaggagaaaugcucguuugaugccagccaguacuacauacacauugagauauagacuagcuuuagaaacauggaaagaagcucuaacuaaaacacaggucuaggaagauggguuuguaaagcacuugcuguuuaagcauguuacguaguucaaacccauguaaagcugaguggcaauguguaucacuuucauaauuaaaaauuaaaauuauucuauguguauagauauuuugccuacauguaagucuguauaccauuugcaugcuuggugccuacagaggccagaagaggguguuagcuucucuggaacuggaguugaaaagguuguuagcuguucugugugugcugggaauagaacauuggucucccaagagcagcuagugcucuuaacucugagccaucucuccagccucaguguauagcuuuaaucucaguaugccuauggcaagaugagaggcagagacuggaaaauuccuggaagucuguuggccaucuagcuuggcguauacagugagaaacugucuuaauguggagagugcagucuugacacuguccuuugaucugcgcaugggcacuaugucauaugugugauucacauacaugauaaauaguucugacagaauaauagucuguauguguguauguguauauauacauacauacacaugaaaacacacacgugccagccauagacaaucuauuuuuuuuuuaaagauuuauuuauuauuauuauauaugaguacacuguagcuguucaggcacaccagaagagggcaucagaucucauuacaggugguugugagccaccaugugguuuugaacucaggaccucuggaauuugaacucgggaccucuggaagagcagucagugcucuuacccgcugagccaucucuccagccccgaacaaucuauucuuaagaagaaagaaaaauauauguggauucccacuaguaagucacucagcagcaagaacaauauuuuauaaguucaucaucuauucuucagagacuguacaugccaguuucccuugaucuuuuaugguauuugugccccaaacuuaauuuaugagaguauggaaauuaguggagauguccagauaaggauggggacuguggugaagucagugugguccuuguaucagucccuugguuuguauuuauaacccugacggugcauaaaauaaauaaacaaaucuuuaaaaaagggagggagggggcuggagagauggcucagugguuaagagcuccaacugcucuuucagagguccugaguucaauucccagcaaccacaugguggcucacaaccaucuguaaugggaucugaugcccucuucuggugugucugaagagagcaaugguguacuuauauacauaaaauauauaaaugaaucuuuaaaaaaaaaacaaacugccgggcagugguggcacaugccuuuaaucccagcacuugggaggcagaggcaggcggauuucugaguucgaggucagccuggucuacaaagugaguuccaggacagccagagcuacacagagaaauccugucuuaaaaaacaaaacaaaaccaaaaaaccaaaaaucccugacaguggaacuauuuguaacuauauugcaaaggaaaugucuguguuuucuucaacaaaauccuaaaauuuuaaacacuaauugcauuuugauuguacaaacacaacagaacuuuuggugaccuugaauguauuaggaauacaucuucaauuuuaaaucaguauuuacagaugagauguguuucagauuuuucauggcagcuguugggcagcugauugcauacagaggguaguuucccauuucaguugcaucuuaccuuuaaacugaaaaaugugagccugguauaguagcccaggccuuuaauaccagcaagcaggaggcagaagcaggggagucuugcucaggucagcuuggucuacacagcaaguuccaggccaccaggacuaaagaggaauacucugguucauuuuuguuuuuauuuuugucucuagacuaaaacugaaaaaugcuaaagguuugcuaccuuuauguucugacuuauauuuguauauucauuucacauugucaugucauucuucugucaguguuuuguaggcuacuaugugugucugcgugugugcaugcaugcauguggauguggcacuaagagaauccaggagguaguguaaccuuagacuacaaaaauagcaaguuuacugcauccagguaguaaguaacuaaugauggcugagaaaaucacagcgagaaucacgucucuguuaugacuugggguuacuuaauauugcucaaauguuucucugaacacuaccucccauacugccuaaaaguauuucaaguaugccccagccucaggaaaugcucuaauaagugauuguugcgaaagaacaaaugauuggacuugaaguuaacauggcagacuuaacauaugcauuaaauuuuguuccuuuuccaaaauucuacuauuguuaaaauacauaaauccauaagcaggguuggaaucaauagcacaguuuguggagcuggaaagcagauguugaguuguugugcuuagcagauuccagaggcagguccuacguuggcagugggaaagcucuggguaccuuuccaaccaagguuagguuccaaaagagggugaauccgaaaccaguugggcugccaccuguucuguucccacugccaccuagguucauccccuagagagcaggacaugggccccgccugacagaggccugccagugugggcauucugcacaagaugaguucuaaugaacacuggcccagccuuucacacaggcucgugggugacuguccccagggugaucuagggacaaagacuucacgugacugagguggaguucaccucagagcccagcugaucacuguuagcuccuugggagguuccauuugcagucaggagcugagcaucaccagaucugaggaaagucucuaauaugacugauagagaccaaaagcagcgaaaggguggaaaguauaagaaaacaaaagaacuaucaucaaaauccacaggaauagggaauguuuuacccuugagcaaaaauagggugcuaaaaugggaaagaacaacaagaugacacacaagggcuugaaaaaugacaacaggacggcuggagcaguuuccuuccugguggcuguaucuuuggugugaauaaaugugugugaugugcucucacuggcuccagaggccagugacucucugccgucagaggcugacguccucaccucuaccuuuugcuccucugacuguaauaguuguguuauuuuuaaauucuauuauuugucuuuggccuuuuaaagcuuuugcuuccuaucuguugguuucacuguguauggccucugcucaucacaaagaaagagaaaaggaugaaagucacucugucaccagugacaaacagcauggggucuuggggcucugcugggucauggaacuuggggugucccagaacagguguuuuggaaguauugugauuggucacuaaagaacacacaugucuuuguagauguauaugcaaccaauaauaacaauuucauuuguuagauugacuuuuuaaaauuuauuacuuaaaacauugguguuuuccuuuuguuuuuugcauuuguuugcuuaguggguaugugcaugcagugugcuuguagacgucagagagcagcuuuagagucagaucgcuccuaugugggcugugagauugacuccugugaacccgggucaucuggcuuugcugcagugucuucacccaccgagacaucgcaggccuucucgccugcacggccuuucgugauagucugaacuaauguguuuucuuucuuucuggucuaggcugucgacaaguacuucaagcugccucaugcuucuaguaaaccaccccgagcuucaggaagccuuguggacacguccuacaaaacauugagauuugcuuucagggccucccugaaaaccgcuaucuaccguauaaccaccacguuuggugaacaucugaaguaaguuacccauccgagcacacugcgggccugcccuuaggaguucuccaagagcuaauacgagaaggcuugugcauugaaaguuuuuucuagguccuugaugggccucugggauuaagagcuuacauauggacuugguaugaccaucucuggggauuucuugcaaaugacaaaguuguaaaauagcaaaugugauguguauaugauacauauuuuuuuuaaagucaccaaagauccuuaaaagagaaaagaauccuuagugccuuuccaaaaaagaguaucaaaaauaauuuucuuguuacauuuuggucaggaagcuaagccuugguucccuggaugagcaggauauuccauaaaugaggcuguggcgcuuugugaaucaugcuggacaaacaccggcagaucaacaccuucagaaacugaaccagagagaaaccacaaacgccgggccuguuuauauuuaguuucauugguguuuacugcuuugcucucaugaaaugcucuggcuggacaggaugaaggauacuggcuuccuaacuaagcuauguuuauuguaauuagacaugagcucuagaaggcaggagaggugguugugccuugcuguaugcaggcagcaaacagaauacuguauacugccugcuuguuuuguuguacuuccguggcacaaggcaguaguaacagcagauaguccuggcacacaucaguugugugugagaauagaaaagaacuguaaaugacccugugucauugagacauuuauuaaauugccuaaaaggaaacaaaaaguauguauuaauguccagacccaugcuguccaauacaaugaccaugaccauggauuguagcuuucuguuuauuuuuuucucaacaauuuagugagaggcagggguuauccucauugacacagaggugucagcggagacacagagcaguuaaaucuugucagaaaguauguuugugcuagaacaugaaccuaacaggaggucuggcuugcucuuaaauaucuaucuucuuugcauuuccagcacuaguuugccccuaaguugccagguaccggggauaaggacucauuagcuaagagagcuggcagauggcagauggagguucugccuuucucuuccuccgaggaaagccagauuuuauguuuaacuggcaccgaugagcagagccaggacagugguacaggggagucgcucaagcuugugggguugucugguuacagacuuggcugucuggggucguggggaguuccugaagcaucucagccagggccaggccacacagguagucaguuacagagccaggauucacaccagaucuugcuaacucugauucuagcuaaugucugcacucuuaaucagugagccccuuggccccuagaucuaaaccuguagaugguguucaggccccuacuuugcuuuguuugguguugauagagaaaaaaaugggaucaugcauaugugaaaagccuggaauacauuuuauuaugacugcauaauaccuaauuauuuaccuggaguucuacccugagaaccagaugcagacaagguaaacucuuuauauuuugacacagggucucucuauguaguccuagcuguccuagaacuugccauguaggccagaccagccuugaucuuagagauuugccugccucugccuccugaaugcaggaauuacagaugugagccaucauagcuagcuccguuaguucaaaauuagacagauuugguuuacuuccaacuaacagcgaaaucaaguagcagagcuuagagcuuagggcaagucucuaccugcuaguagaggggagagugauggggcaaguugaucguuaguggccccguuggagguuucuucauggucaggaagcagagaugaucaugaggcauuguaggauaauauguagcaaaggcauucaaacaagaauuuugugguacugaaaagggugaucuucagcugucuggaguuuuaucauucagugaugauucuauuacuaauuaagaacuagaaaacugccgggcgugguggcucacaccuuuaaucccagcacuugggaggcagaggcaggcggauuucugaguuggaggccagccuggucuacagagugaguuccaggacagccagggcuacacagagaaaccuugucucaaaaaauaaacaaacaaacagaagaacuagaaaaccaacauuuuuauuguguucaauuuuuaccccaaaaguuugcaaagaaguuguauacuacuucuaggguguaucuggcugccuucugccaaggugaugcagaguggagggacaaccucgucccgccauacauagugcacguucaaagggagaaauaaauccaagccaccaagcuguuaccuuugaaaacgauuaauggaaucuauuguguuuuaaccaaacauuuuaguuuaaaggauuuuauauuaaaggcaauucaaauacuccacaauucaaagauaauguuugaaucugguuugaauaaaauaauaaaauccagaaaauguacugcagggccuggaacucugcacagcagguuccguaguagagcagguuagagcggugccugcacuugucagucugcauuugcucuggucuuugagaagguaggaacaugccauugccccaugcaagcccuugccuucauuagauuaaaaaauguuuucauccuguuuuuucagaaguacuaaguaagugaagauuucuauucauuuuuaauuguuuugaaaaauauugacugugcgcucugugguucacuuaaugcagacuaaagcuuaugcuuugcauuuauguuucauuuagcgcugugcaggcaucugcagaacaucagaaaagacuucagcaauucuuggaguucaaagaauagugaaguaauauaaacuguguucauuacccugcugauacaacuacagaugggacaguaaauguugagcauucuuggaucagaagagagcggacuaauuagacgcuuccuuugucguggugcuugcuuugaaaacuauacuuuaaugggagaaaucauggaaagaaauucucagcagaauaaccgaaaacugccuuuucuguacccagugcuuuuugugugugugguauaauaaaaucuuuauucaguuuuacaggagcgucuauggcagccgaacugucucuugcucauauaacuugauaaugauuauucacaauuguuuguagaauuuacuuuugaaaagaguggagccagcucagaaguuaaagcagguggucuuucccagcugcucuaagagguuagcucuuuguaaacucucaaaauacauaaacuuaagauuaguuuguuuacuaaaggauaaaaaugguaacgguggagaaaaacucacaguaaaaauguugucuacaggacauauuuuguuaaucuguuagguuguguuuuuguuuccagggacaaauuaaauuugcaugauuguccaaaaagagucucgauuuacagauguuaacucuauauaaaggaauguagaaaaauugaaaucuuaagguacacgacuaagcauucacauucggguagagcaacgucucugaguucacugugugaugcuaguggaggaugagggcaucuuguuuccuagccaggcuugcuugcuuuuuugaaauaacauuaaacaguuggcagagguuuucaaaugaggggaaaaggagaccuggaaacuucccuuucccuacgguuugucuuuaccaggucaaauuauguugugagucuagucugucuucacaugggagcagccucugcugugcuaacuggcuaauaaaaacacaguaggccaagcuuuagagccaaaagcacauagucaucagauaggcaggugaaugucagaggcucuccgcaggagcggguacgccccggauguacuguacaggcggucauuuuaugacuuaugagaucauuucuuuggagaugaaacaugggagguccugcuggcagauauucauuggaccagcuuugggccaaauccuccuuuauaaauccuuuucuguuaucuuuuucuuuaaagucagcacaguauuguauaugagucuuaaaugugauguguaugccuagccuuugucggcuucauuaauguauuacaucuuuacaguaguguauuuuagccccagaucuacugcccauucaaccagcacauggcaaauuauaaacgaaucccgcuagccuuaaaaaugucucuaugggacaauuccucaccuuaauuguuaaguuuugggucuuuuaaguccccucucuaccuugugugugaaguucucuugauguguugugaaaguuggguuuccaguguguugguuucuucagauacucagaggagccuggcuagauaacagaauuaaagccauaggccuuuuguguuugcuggcugccucugacugaagcauuucgggagacaaaucuaaauguuguguuuccauaaagaacuguggcauguguguagcucacuaaagagagcauucauuuuaacuuggacuuacuccugugaaaugucugguccaguuuagguucuugccuuucccacuuccucugggugaaaguauauuugauagaaauaugaaucuuucuggauguucugugucugagguauugaccacaccaugucugccugcuggggagcaggacacugccauccccucagaccuguacagucccuggaaggugaggggucauucuuuuucuccauuguauauuggugggcacucuuuuuuuuuaaaggcaccuuuccucccgcaugcaacgaggacuugagggaggccagcaggagagaagcguuggcuuuggugaaguugcagccugcugacgugauggccugaaguuagccuucacaagccuuugucccuguuaguaacaccaugcuccgagccccucugugugugucucuagugggacauacaaagccacaggcugcuugugcagagugacgggacacucacccuuauccuggugaguaggcauggagaagucccacucguuccugugcuugguuucuucagcaguguuuuguaugucuuccuguuaguauuuauggcagucugcuuauauccuucuguauaucaucaguacugaauugguagaaaaauaaagugacaauuccuaacugagacuguucaucaaac

SEQ ID NO: 2019 - RNA, 16992 nt, Mus musculus
ggaggcagaaagaauucugggauagagccaggcacgggaagauucacaggggaagaugugacgagggggacacuuggugccugagcccagguaagcagccauguggcagaauggauuauuacaguuaugaucuagucagagaagagccuagcuauauggccaauuuauacuuugagucuggaucuuauuucugagagcacggggcugggaggaagaaccagaccuaacucacacaaggaccaguuucacucauccuacucguaggagagucucaggucuguacugcuggaagccaagagaaucaggagcagaaggggggugcuuacugugugccaggcaccugccagguacuggugaacucugaaguuagggaagacuucugggggagggggaggggggaggggaagcggcgggggcagccucccugcucacaggccucuggaccacaucucacaacucucgcuccuuauacaagcuaaagauaccaacugccuugagccagccugcuccccaguaaaccaccccucuauggcuugcauggaggugaagccaccuaucaugcaaucauugcuugcacuacagaacaaauucacuccccuccaaguagccaguuccucugggcauggacguuugggagagucucgucuacugccugcuguggucuuccuccugccaggagcagguuagaggucccagagcuuaaauccugccucugccccuaugugaccucaugcaggcuacuugccugguauauauaauguacucuuagaugaggaaugugagacuuggcccugaccauggagugauggccaccacacugcuccuuaagguauacaaagccuauuacauauagauccucgcuugacuuggugcugagaaaugaaccuaaggccucacgcaugcucuaaaacugaacgacacuaucuaucuaucaucuauccauuuauuuuggagacaggguaguagaucacucugucgcucaggcuggccuuaagcucacuguguagccaaggacggucaugaacuucugacccuccuccuacuuuugcuaucaugccugauaucaugcagugcuagggauugaacccugggccucgcgcaugcuagguuagcacucuucuaacgagcaaccuguccagucauuacuuaguucuuacagcucuccugaaguucagagagggacaagauggccuacaucacacaacgaaugaguagaccuacuagguccagugcucuccagcagcucaggguacuuccucuaaggaaggggcuacagugggaauucagagcuugauccuggucaguccugugaaauaaagaggaguacucuuucaagagccucucugagccaccgugaaacucuaacagcauaaaagaugccuaaggcauaaauuaccggacagggcaauagccugggggaacagauaaaaccacuacagggaguccagagacugggcuccaguccugucccuccauccuggcucugugcuuggaucggccuggguuuccccaucugucaaacacagcacaaggauuccugccuccuucccaaugccagugcauaccugccaaaccuagcuccaucuugccuucugcccagacagucugugaucacuaccucugccaggaaggcucaagaggccgcugggcacacagcccagccugucucauguugcucuccagccaggccuggaccuagaccacacacagggaaguauguugaaauagacauggagguccucgggcauggcagugcacacacaugcagaugagcaugcaugcgcagagauacacucagccgcuuauacucgcaugugugccccacacacaccaagccacacuguguacacacugcagcacacgggcugcauacccacacacgcacagguggcuuccugugaugcucacacacuacagacaaauaugcagagauuugccugccucuccugugacagccagauggugggauucucccauugggcuaccauuuaaugcucuaauuaauuaaaaaaaaauccuaggcacccaagaccuggauuuguuccaaaugucucaggcauggcccagccauaggccaagggaggcagcaggacuuagggugaggggaugcaccuaacaggggccccaccccuuaccuugccaagaagcaggcaagggccaucugcugcuacaacucaagcugaggaaagauuacacuguaacauuccuggaucuucaccugaugggggggagggggcucuguuucugcugcggggggggggggggggggcgcagcagaggucccuuagauugcacagcaacuugaaauguguucaccaacaccgagguggacugcaggcuuagaggcagauccaaggcugucuuugcugaguccuacugcgcauagagccugcgugccuccgugggaggacucugaaggggaugugucugugcauggcagucugcugugagccaggggugaggcagagcugaggcacugagcagaggggcugccaagcuccgugcccugggcuccugcacuccagugaggcagucagcuggaagcagucaggugaccugaaucuuccagggagccgacuccucacccuccacacucacgugcacgugugcacacacaccaccaccaccacugcacaggccaugaggauggaggaggguacgggugaguggggaagagcaucguucacccuacaaaccuuucccaacgcggccuuugcuucugagacuuugggaaacacguaguaaauuuaccgccucacuuaugaguaaucugcugucaggaacucugcguaagugcagggcugaauaacaaggcuuaauuaacaugaauguugugacagaucucaaccugaguggggaaaccccuagauccuguacccaagccccugcuagcucucgccucucuccugcucaugugggaggugagaggcuccccaggggccucagggauacugauaggcaaaaugaagacugucucuaacacaggauuagggaggagauuggggucuugaaggcagagagagaggcaaagagagagagagagagagaaguccaggaugucagacaccuugaguauccauuuccaacagugcugucacacagcccugagagccagacgccaggcccccaauccucuguccuuucauaugcccuaugaccuuaggugaguuuccccaccuuugggugccgcauagaguaaggccacuaaguagccccuguccacugugcccaucaguucucaguccucugaggaagugaccacuauggcccugcgcagacaggacacccugacccuaagggggaagcugacccagucaacucccaugcuaugugacugacuaugguacagugggucacaguauggcagagugaagcgccggggccauccauaacacucacugaaaagaacaccuccaagaauccaaagagccacaguuuuggggggaaagguuaggcccuggggcugucuuggguugugucuagaccuagcaacaguguuuguggaaugacuugguaaaagacauggaaggaagaaggguuagugggcauuccacuagggcagccccggagccuguuucucagccacugaggcugaaccaagcugccgcagcgguacccagaguacucagccagugucagucaggcuguggggagcagacaacagugccugcaaguccaggaacaagcaugucccucacucaggaugcacacuaucuuccacuccccucagcuguccagcugagcuggcucgaggcagaugcacuguaauuuaccauuaaugacugucauuauuaauaauaacgacggggcuggagagaugguucagugauuaagagcacugauugcucuccuagagguccugagcuccauucccagcaaccacauggugacucacaaccaucuguaaugagauccgaugcccucuucuggugugucugaagacagcuacaguguaacucauaaauacaauaaaccuuuaaaaauauauauuaaugagaagaugccuaggagaccagggccuuagcccugcauacaucuuugguuauuucagacaaaucaccuaucaguuuaaggaccuuggguuccaucccaaaguggacuaaccacacacuggccuaaccacacacuggcuucagagacaggaggggcccugagcccuagguccucaguuccagaugugaaaguacacagcuggaacuuggugcuagagaccugcucgggaaugagcuagaggauagacagaguccagagccuuauuaggccaggggcccccaacaagccccagcacacccaaccccugcuccaggaggcccagccccuuaccuucugaaugcacaccacacccaaguaaaucacucauuacuuucuaccucacucaccuccucugugaagaagggauaaaggcagcgugagcugaaaaggcgcacgugagaaucgaauaggugagacccaauacaagcuaagggcuuaauagagaccacagcuuggggacccaacccuacaaggggucacuaagaaacugggaagacucaggggagucucaguguucacagaaaugcucuaagucaggaagaccagccagaggccuugguggaccccaaggaagccugggcugccugaggccucaggacaaacagaaagaacauucugagagcucaggacugcauaacgaaggagcaaggcucaccucagaagcucugcaagcuaagaauucauccaccuacccacccaccuagcuaacccaccuacuaacccaccuagcuaacccaccuacccacccaccuagcuaacaaguaucuccuggccacuguguccacugggggugggagagagccauucuugcuuguugaaaccacccuaaagaaacaagacacaacaaaggaaucagaucaagcccaggucaggacuauccacucuuggaaugugucagggucuagaaggaauacaagggcaggaaggcagcaugguaaaauccagauggcacaccuagggaugagugcuggcccagaaggcauccugcuugcuccccccaccccugccccgugcucucugugauccaaaggccuccagucucaggcucuuccuugaccacagcucagugccaguccccagagcccccugcccacucccagcacccagugaagaaagcuacaucuguccuugguggggagggccaggaucacagccugucaaggcagauggcaggcucacccuuugcccacucuccugccccacaacauccacgcguaacccacccccaaguuccuggggaacaggcucugaggaggccaggcagccagaccaccagcugcuuccccucccuacacaaaccauggacacaaagcacccuccccccagcucugcucgccuguggugacagccucuuggcaccagcucuccccucccuccaucugucaugaaucggugcagacaaacugugagaaccaaagaggaagucaguggcaaugcuguguggacccccuccccucucccugccuucccagcgcucccguccccucuccauuccuccuguacuucccccucaucuuccaucugucuccauggucccuacagaugaggacauugacagagaagguaugcagaaagggugaggacaggcuacucggcaacaccccugacaggcaccauggccauagcauagccacccucuugucuucccuucucccuagccaucaagagaugcugagaucgagagcucaguguucccaucuguauaauggguauuauaauuucuuaccagccccaagggcugucaugagcuucaagaccacacauggaaagggcuuuuguuccacugugaagcuucauaggagacagauggccugugucuuuguuuggcauugucuaggguuucagugcugccuuccccugggagucaugaggccacagcaggauuugauggauaaauguccugcagaguacccauagcaagaagaucacagguagaccauucagggcuacagagucuccccauaauuuugagaggugagcaggguaagggugaagaaaccaaauagccaucauaugcugugcuggaggcagacuguguaucaguaccugggaguccugguccccuacacagcacccaggaugcccaaccaugccuaacuucccacuaggcucuuagccucucugcacucuccaaaauguggaguagagagcagcaauuugguuuucaagugagccaugaccaacuggcuucccaaguaccuggggaaccccugcuauugggcuccaggaguggggagcagcagucaggacuugugggggugcgggaaggcugguccaguguccagaggagugggggcuugcuuccugagaugcgagacguuuauuuuuaacccugagacgguucugagcagaccagaaugagugagucacccuuguguaggguggcacuuggcagugacaagcaacaggcaaacauaauuuucacuggaaaagcaagcagccugcuggcuggucccuccugugagagucccugugcagaggaaacucuggucugacccagccacaacauauaggggaaggccauggguccuccaucacaacauauagggaaggucauggguccuccaucacaacauauaggggaaggucauggguccuccaucacaacauauaggggaaggucauggguccucuaccacaacauauagggaggaggucaguggcagaggcugagguucugaggagauaacacauagaacaggagccaguagcccugggguagggccacauaaccaaacucagggaacauuggagggagaaacacagggcucuagucuucuucacgcuucccuggaacucucaguaauccuaagccuaacuucaagugccaagagagcagacagacugcaggagguagacagcacaggguacaugcacggcccagggucacccuccacucacccugauucucucuuccaccacaggccuuccccugccccugcucccacgggucacauacacacugugaaccauagauuauuauuagaccaucauagagcaacaaggacaggaauggagagaaaccugcaaggcgagaagugugucagaggagcacccuggaaacggugggucuaccaguaaagcagggauggacuucaugggcgagagggaagagcuuuucacagggagauggcuggagcacaggccuggggguuggggcaggauggagaccugaggccacagaggaggcaggugcaugguaaguugcaacuggcucugaacauccucugaggaggcugccaucucuaaggcaggcaaggaagaggacagccuugucccuuucagagugccccugcaaagcagagguuagauaggaggcagaagaccgaauucaaggacauuacuuccauggagucugggagggugaguguacugggggcggacaugaacugacagguggcagacguuggggggaagaaucugggguaccacaacaaaugaggaugcagggaauggagauuuccagcuggagcgccacacucacauaacuguaccauggcugucacagaccugggcacugcuacccaggaagcuaaaccuucuguaggaugucaccuuggccuccagacaaggcacaucuguccucaggaagucagucacguuacaggaggcaggcaugccaacggcaucugaggaugugcggccugugggccccucacugaggucaaagagcuggagaccuucaaguagggugagccucccugcacuggggcaaugguaggguggagaggaagggauccagacagggcuugagacaggugggagcagccucuggaagcagaggcuccuaaaucggcuagacgcagaaggcaggcaggggcgggggacugacugaaaacaccgucuuggcagagagaguagugggcagucagcgaguuuucuguuucaggagguguuagacccuaccccuggcugcugagagauuccuauaugugcuggccagaggcugcuucaccacccaagggccaaagcuugcucgggacuuucauagggacaucucucugaggccaggcauagaggccuucagcagugcacgaaagaacaacuugggccucucucuucaaccuuccccauucccaaggauagaaugcugaggccgggcaggggacagaggacggaggugaggcagcccuucagcccugccugucacacucuguaucacaggccaguguccucucuaagggcccaguguccuucccuuccugggcacauccagaguuagggccagacguguaaccuccucugcacaccacccucugugggucccugaggcucugcacucauuucuuaacaagguuccuggaaggacucccucuaaacugggccaguaaguuccagccagggccacaaggauuuggaguacuaaagacucuuucugggggcuuccuggcuccucccaccccauucaacagugguacgggaggcaggcacucucucucaggcacaggauaaaaacagguuuaaaagaugucaaggcuuguuccuguugcuucugcuucuauaagagaucccacugucacccagagguaguucaugacagguuccacuccugauggcuggacuucccagagagauuaggcaauuugcccagaguugcucagauacaaagugucgaagguuggacuuggccucacuagugaguugaagcccugagaaggauuuucacaccugggcucccgacugggccaugagcuaagcugagacugcuaggcagggcuacuuaggagcuggggcugcaguucaauugcugcccauaguggcucaaauacuggucugugaaacucucccaagggagggccauagcuuuaccaguuaagucacaagaaagggcagcuuccugggucuuaggguggggcugagacccggggguugaggaggagcuugcaacauagucugguucucuagcagcaacaaggguucaggccuagguuuuuggagagagaagucagcacagaacuuaggggcaggaaagacccaggccaccgagaaagaaggaaaggcaaaaaguggacucaugacugaaguccacacgugugaccuccaacccaugguguauacucaugggaccacacuguuucuggugcuuuccacgagauaggcauuacuuaaucccuacaugggacagucugggguucacguucaagggacuuacccagggccgaggcuggaaccagcugacagugcaaaccaugauggcucuaggaccagcuggaucaguccuuaccagggauguacacaggugaggcuggccacuggaggagacagacagccuuucaccggcagccaauacaaaggccacucuggcuagcucacaagcaugaagucaccccaggagugaaaguacacaggcagaaagagcuccaaguagggauggaggagguggcucaguaggcaagacacuugcuguagaagcaccaagacccacuggaaccccccccccaaaaaaaaagcuggccguggaagcacgucauggagccuguaaccccagcacuggggcagaagcagacagacccaggcgcucgcuagucaaccagucuaaccauaacagugagugucagcucugaagggaagaagagcaacagaggaagucaaccaauauuaaugucugcauuaacacacauacauaccacaccacauacauauacacuccccaauacacaccacacucauaccacauacacaucacacacacauauacauaccucauacacaccacccacguaauacacaaaccccucacacauacauacauaccacaccacacacacccacauaaacaccauacacauaccacacacauauauacuuaccacauacacacguaucacacacacauacacacaccacauacacacacacacacacacacacacacauauauauauauauauacacacacacacauaccacauauacaucacacacacauauacuuaccauacacacauacacuuuccacauacacacacacacacacacacacacacacacacacacacacacacacacacgcuguugacaugguuuccucuuuuuguguaaguccagaccaugucccuucaggguuagggcagagccucuaggguccacaggguuggcucucgcagcuccccauucugugucuggaugugagccuccuugaagccuccauacucaggaccugacucuggugaacuccagcuucuaugaacuuccugaauuucagggaaaacagcagaauccuagaggauuugugcugaguauggccuagagguaccccacuuccaaagagaagauucccccaagagguucacggaccugccacguggccacuuggcgagaugggccugcagccuggcccccagcuguggauagcuaccucaguccucagagaggagccagacagcacaucgcaggcugcggcccaggcuguggcccaggcugcagaggcacaggacaggcuaggaacagauugcuggcgccugucuaguuacaaauaaaucccagacacaacagccugggggggugggguuccuugguuugggccaccuuggcagggguagaaggaagagugucaccuugguuuguccagaaugcccacuucacuccugguuauagucaaaagaagggacuuuuuuuaaauaaaaaauuuuauacacuauauuuugacauacucuuuucccuuccccugaucccuucccagauccuugccaucucccuacucacacaaugucauguccuuucugucucuagaacagaaaaaaaaaaaaaaaaaaaaaacccugggcuuuaaggaugaugggcagcagaugguagaccaaggucuaggaagugggcauggagggggcugguuugaaugucccuggauucaggccaucaggaaagcccacgcugccuccagccacucagccagguaccuuaaccugggccuggugggaccuuccugccucucaucagcugccaugucccugauaucccccuggacccacugugaacccaggguaaacuagcuccuggggccaccuagaagaugcccugggcuccacagcagucaggaugggagugaccgcugaggcacuauugcagccuggccccuccuucccuccgggcagcugaccuacaucuaacucuccugcuguucucccagcggcugcccucuugcugcgcccuuggcggaggacagcugacguaugcaggaaucacguguucaggaaggucuggggauguucacccacuggucuucacaccuccaugcuguggcugcuucaggacggcaugaggggcagacaagccucgagccucucugucuguucucuucccuccaucaccguacuuauccaacccagccaggagcacgcagaggggaaaaagaagucugcgccuugcggcugaguucuggacccuaaaaugcccaacugcucucucuacaggcccagacccauaucuagcucaggguagucucccauccucccaggcuugcuccagcccugagcucagacccaggcaggaguuugaugcucagagggcccugaagugcugauaaagcaaggaccaaugaaugaagagagaaaugaaguucagauggggaagccacuuguccaagucacacagccaguuugggaaagaaacagaauaaucauugcaaagcuaagagggagauggguucuacuaauguguugagacaaaugaagcaaucguuugguuauauuguggguuuuuuugguggcuaaguguccuugggccaggacacaguugcccuuuaucucugcucugugcgacccagauauggcuacuuugucugugucauuggggcugggacaagauggcccugugcuuaggauccugugggcuggcuggacaccagggccauuagggcauacagggguguuccuaagaugacgucaucuuuuguuguuugucucaguauuauguauuuugcuuuguuuuuguuuuuaguuagagucuagcuauaaagaccaaagaauuuaguaauguauguuacuggcaugggacacuguauaugaugagaaaaugaucugaauaacaggaccucauuuuucuuuuagagaauuacuuccguguaaucagaaaaggcuauuucuguaaggaaaaauaaaaacgaauaaacagaaucaacugaagcuguggcuccagaacuuccaguaacagaggaaguccugugaggcuccuuagccugaaauuccucuucagggcagugggaccuaugcacugccuucgucggccgcccaggugcgugucuauggggcaguacugagugugacaggcuggugacaggaaacugauagaguaaugggggugaaguuccuuguaggacggucaggccaguguccgggguaccgccgggggccacaggaccacucccauggcuuuggugggugcaguuucccaggaagacuuuugccuguuuguccugccauguucuagaaggcaguguuuggggcuggagagacagcucagcaguuaagagcauguguuccucuugucaaggacccagguuugauucccagcacccacauggugguucacaaucacccauaacuccaauuccaagagauguaacacccucuucuuacccccacaggcccuaggcacucguaugguauauacauauauacaggcaaaagauucauacacacaaaauuaauaaacccugaagauuguaggcagaggcaguaaggggucaugggaacuggguggacggugcugggucacuuagucaucaggacauucaagaguccugauaggaucucagaguccauacucccaaggcccaacucuccuagcuaugggucccggacuggcccccacugaacagaggccaccagaaugguggugagaagcauagaguugguacugagcagagucccccuauaggcaccuucucuucuccccuaagcucuucuugggccuuuccagccccagggugggugacauagcagcuuguagcaggagaaacagcugcaaccagggguccuuccugauugauggccaagggcaccccagggcuaguauugcucaggagggagccagcacacccuaugacaaggacugaccgaguaccuagaauacuuggaaagggaagcuggggcacaccuaagggauccgacacgcucuccugacugaugugugugaacuggacuccuccuuccggcuacagcagaccccacagccagaaggaaguccaaccccugaccagucagcuaacuuagggcaagcaacuuugguucuccgcguugucuucuacaacaugcaaucucauacugccaggccuugccuagaggccuuguguuaaguaagacccagcaaagagcacucaggaagccauggacacagaacaaaucacuuuaccaugcuugccagacauccugagaggccagguagggcccagccaggacaguauaugccugcaguccccaauaccagagcccaaagcucugggguguggcaggcauguuuaugucccuuagcuagacacagaacagaggcacggcgggugggugugcaagagugggaggggguaugucugcuuuucuuccuccaggcccacucaggagcggaacacccugcuccugagaaugggcccugacggcaccagaggucuggcagccaggaggcagaguccaggugaagcugugacaacgagcugacauugcuuuccagggccacugucagguucuccuuucucaauggcacagcuaacaaaagcccaccagucuaggagagggggccugcguugggacuccauggggucuccagagacgaucccuuccaggcccacuccccaggacagaaacuuuuaccacagggagacaagccugggcaauguguccuuugaccccaacagaguggacagaccugagagagaagcugauuugcauuuguaaucauagcacucagguggcugaggcaggaggauuauugugaauucaagaucagccuggucuacagagugagaccaugucucaagaggaauaaauaugaaaagggacauuaguagggacaggagagagggagggagggagggaggaagggagggagggaggggggagcuaaggcagucauuuuuacauggcagagcuccagcccagaagcaccaggccauaugcagcacacagccauuucucucuaagccucuguuuccucuuuuaaaacaggaauaagaauuaaacagagauaagaagagcugaagaaaauaaacugcccaacacacccacaggccaguagccaguaccuguugcuggagaucuccagaggaagguaucuguucuggagucccugaugccaagcacagggcuagcaguaagaaagagucugagaggacaguguaaggaaagguacccugggagagguggcgccugcaccuccagagacccagccacuuuccuggaacaaugagggccuuggagacaugaccauucacccugggccaggagaacgccaccugacuauacccugaagggguguuuguuccaccagcucucugggaccuguucuuccucuaucccugaggucccucggauucaccugcuaccucauucuccgaggaggaaagcugucagucagcagcagcagcagcagcaaggggggggggauggugaggggggagacacagccaugagccagcuacagccuuggaaacugaggggacucucacccaggaggggccauggaaagcccaagagagagccuucagcacccucaaguccugcuggaagaauccagcggcacagacggcuagucaagccuggagccuguggcagugucacgguauaacagacucagcuagaaagagagaaguaagaggcugcccaccaggaucugccccucccagccccagccuacuuucagagaccagccacaucuguaagauucauuucuuccccagcccucccugaauacguucugcaccucuagguauccuugaagccaccuccguuguggcuguaccaucaugcacuaccugaagccacacauaccaccaccaccaccaccccuacuggagccacacccccugcuggagccacacccccuacuggagccacacccccugcuggagccuucagaaacucuuguuguggaguaggguuuggguggcugcuguaguagcaaccuuagagguguucagcugaguuucgcccaccaugcuacccacugccacccaucauucgccuccugcucacugagcacauuucaguuuaccacacaucucuaagaaggagacacuauugucaccagggccauucagccagaaggggacagcugaguuuaucugauucagggcugcacagaguugggauuucaguauuccugaagucccuuaccucagccugagggaacagaggcaccuucuucaaagagaaaguccucaucucagcgguucucaaccuuccuaaugcugcaacccuuuaauagaguuccucauauaauuacaauauuauuuauuauacauuaugauauuacaaaauuauguuguaacugcuucauaacuguaauuugcuacugcuaugaaauauaauguaaauaucugauaugcagaauaucagauccgugacucccccccccauggggucaugacccacagguugagaaccacagggaacgcagggagcaugggcgggaacaguguccugagaaagcaagcagcacacacaaaggccuggaggugagaagcagaaggcaggugacggagcugcagcgguggcggggcucagagaaggacgcaggaaaaggcuggagggcagcgggcacaaggaacaaagaagucacagcacaggcuccauccucagguggcacaacagcugagacaggaaagccaagguucagagaagaacagcucuuugucaaugaugucaucuauccaaagggacaaugaagcugggccuggugucuugguuaacuguaccccacagccaaaugugugcuacaucacaagccaggaccuguagccaaacugucaucauucauaaggccaccaccaggcaagcucuggaaucccuguggccuggccaggaccaucuagugggccugaagccugggaggcugggcuauagcagcucuucacugagugggauggauggauggcggcagagagcuaaggcaagggaaaagcaggugaguacagagaaggagcuuccugauccaaucucccacaaaacaguccagcacuccaggagcuggggcagucgggagucucacacaccucaggaugagaaauggaggccuggggggggccugugcaggcuccguggcugcaugccugaaugcacacugaagcaauuuuacuuaaacacacuguuccuuacccccucugagcuucuacaagguggagauggcucaggccucccaggcucaaccaucuuauagacugaggagcaccggcagagagaggcacauggcccgggcuagcugccuggaguucccgaaugcuugacaagugugaauaggugcuguguuugaugguccaggagcaaaggccuggccagcgaccagaauccccaccucugcucccagacgccagaaagcaacaggaaacccaggccuacgugaacccacaggcuggagucccacccaacuuccccuggcuggagcccuagggcgacagacccuuccuccgcuuugaaggcaccuugggaacugaagcuccagugugcuucccuucccuagcccgccagcugugggccaagaacccucccugaagcuaaagaucaagaccucagugugaguuccagagccaaggacaagcuguaugacuugagucggguuaccucucugagaacugguggugaccucuguagcaugaggucugucccaccuuuuguguuuguugagacagggucucacuauguagcauuagugggacugaaacucacuguguagaccaggcuggucucaaacucaaagacauccuuuugccucugccucccaacugcugugauuaaaggcacgccccacuguacccca

SEQ ID NO: 2020 - RNA, 7675 nt, Mus musculus
agacgucauuuccgcgcgccaccauuacgccaguauaagacguagaccgcaggccgugguagugucauccguuccuaaaguuccguccuccuugucccuugcgaggcauggagagugacuuuuaccugcguuacuacgugggccacaaaggcaaguucggucaugaguuccuggaguuugaauuccgaccugacgguaagagcggccucccggcugcgggcagugggaccggccccggggagggcggagagaaggcgggcugcggaauguggcgaagcgaagcaagggacgccgaccaccgugcuguugggucgugaaagaggcauucuuuugucggcuucauugguucuuucucuucauccgcuggcgauucuccuucguagcuuuuuaaaaagccagguugcuuacauucaacaaagauuuaauguccaucugagaaugggcuguuuguuuuccagucuggggacagagcaacaaaaauaaauuuuccccucucguggaacauguguuucagagccggaagaaaccacagcgaucucuuguaguguggagugaucaaaaaguaaggucgcuuuuaaagagcagucugaggagugugaauuugaauuaagccguaauugaaaagggaucaauuuuugaaguacaggaagaaaagcaucuacaggaguagcaagugucauaggaccucaaagagccagacauauccagguggucacuggggugacugagagacaguaguagggggugauguuagucaagagccucgcuauacagguguuuguagugcuugcuugcauacagcuuccuuaguuuucaaaguccuuucccaacccaguugaacaucagcauguucuucucugugcagcuaagauagcauuaaaauuccuguuuacagcugagaacguguucuuuugcuacaucauggcagccuuuucccgggacucuaguuuacugucagguccuucuucuguuguucaguaguuucaagugaaguaccaaaaacacuacuaucacagcugggaaauggguugaaacauucgauauaauuuaggcaaagcucauauucuuuggaggguaauggugcuuuguucauguuuucuaauacguugcauucuuuuuuuuuuuucuuuuuucuuccgaagguaaauugcgauacgccaacaacagcaauuacaaaaaugacgucaugaucaggaaagagguacagaccuuuccuucacuacgacuuagccuuugguuucccauugcuuauguucucucugguaaugaaagaugaaguguaggaagcgagcacuuauuucuaagcagcuagauuauuucucugauucacuccccccccccccccagugcugaaucaaaagcuaguaaguguuugaaaucugugugucuugguuuguacccucggugugccccauacugaccaugugaccucaaaacaaguucucuggcugaacuuggucucuguguuuucaucuguaaaacaaaggauaagaaaaccuaccugugacucccaaauguuaucauagaauuaaauauauuagucccuaguacauagacuaugaagacagcauugacuuugcuucugaagaggaaacggaucaggggaaagucucaaccucgaauuacgcucuuuagagcuaaaccauagacauuuacuacuacucucccaccucagagcccccuccugauccacacacuggggaguggaagaaggcgggggauggggguggcagcguacucauagaugagcaaaucauuuugccuccuuuuacuguggaaacccaucuagguucagagugugaauaaccucguucaaacaauauguuguuuaauccugauuauaaaaagcccaugugacaaaguauucugccauacuuucaaucaggaaaaucauggccuagauauuaaaucugaggauaguuacucuugcuuguaagagauaaugauaggcauuugggcauaucugaaucucaguaaaggucauguguuccauucugcugggauuucuacuauaucauuaaggauaugacaguaugucuucauacaauuuagcaguuaauuuuaugccgaaucagcaucauaucuuuuucucuuuguuugguuuggguuguuuguuugcaugaccuagugcuccucagaagcaguugguagagugcuugucuucaugaggcccugggcuucauccuuagcaucacagaaacugaucaugguagccauguuuauaugucagcacuggggaggugaaagcaagaagcucagaaguuuaagaucaccaaggccaggcugcgaggcaugaaaccuugucuguaagcagcaggguguaucaguugucuguuaccacuauaacaauauaucugacagaggcuauugccggauuauugucaggaaugauacagaccugcaauuccaugacuuuguaguugaaggcauggggauuagaaauucaaguuggacucaguaauggugguggugaugguauaagacuuuuaucacucgggaggcagaaugagacgaaucucugaguuugacgacagccugauauacagagcaaguuccaggucuguacagagaaacucugccugaaaaagccuuuuuaaaagaaauaauuaguucauagcaaguuugaagccagugaggcucagugaaauucucaaaaauaaagaagagauuauuuagcucaucacuccagagguucaaaauccaaacaccgcugcaguagugagaauggguguguggccacgcagugaccucucucaccaggagagaaacacacagacauuggaggcccacaauuccucugcugauaugcugcaaugaucuaagaacccaccauuaauucccaccucuucaaggucuauaccauuucccauaguaccacccugaggaccaaaccuuuagucacauaaauggaguugggaaggccacacugaaaucauguccaagccauagaguaaagguguaucucuguccauuugcacugcuauauuaaaaugccugagacuggguacaaagaauagauucaccucucagugaauuccaaggcccugucagguugguuguguggugaggaccccaucuguucuauauggugucuuauugcuguagccucccaaaacaaacuuuguucuucacaugacaaaggggcgaaaggggaccagauaauucccuugccuccucugcccuugagcccugaucuuuacuaaaggcugugccucucacucuucucacuauuacuuucugaguuggauguuguuggggugcggugguuugaaggagaauggccccuuuaggcucauacauuuuaaacuugauugcaggcuuaugugcauaaaagugugauggaagaguuaaagagaauuauugaugacagugaaaucaccaaagaagaugaugcucuguggcccccuccugaucgcgugggccggcaggugagugcuuuauugacucuacuuuguacuucuuacaaagaggaggaggacugcugcucuaugggaggaggggucccuacagaacuaggaauacccuguucuagggaaucauuaauuccauguugguguuggggauggaacucagguccucuagaugggcaaucaguguucuuaacugagccaacuucccaguccuuuauuaccauuuugauaacuaaaaaaguacaagauaauuccaccuugugugcuacuuacucuuguauuccagacuucuguagucuguguuucuccugucuuguauagccccauguuucuauccuaaugcuagggguguggaggcgggggaggccuaauugugguggcguacacaucuaaucccagcacuagagaagcagagguaggcgggucucuguggauucuaggccaaccugggucugcuuagcaauuguaggccaaucaaaguuauauagugagacccaucucaaaaaagcaaaacaacaacaacaacaaaaaaaaaaccaaaacuuuuuuuuuuuuaaaggaaaagauuuauaaaucugacuucauuaaaguuaaaacuuagcuaggaagccgggcgugguggcgcacgccuuuaaucccagcacucgggaggcagaggcaggcggauuucugaguucacaccuucaaucccagcauucaggaggaagaggcagguggaucuugaguucaaggcuggccuggucugcagagcaaguuccaggacagccaggacuauacagagaaacccugucucaacaaacaaaaaaacucuuaaaaguuguuugauaaaagacauuaagacaaaguugaaacaaaccacagacugggugaagaugcuuggaaaauguauuuaaaccaauaaaaagauaaccugggguaggggaaauguugcaaagguuacaaguagacaguauauagauucaaauaauagccagcaaacacagaaaaaauuuacagcugcaguuguaaccugcaaaaguaggagaacacuuaaagucucacccaggucuucaaaggcauagaaggagccacuacacugcugguaggaguggaguguccgugcagccccaucggcagccauguggauaggagcuaacagagugggacuucagaccuagccccagggcuggcacaaauguuuacugagcucagcccccagaccuagaacauucuugccacaucauuuauaguaacagaacuugggaacuuagguccauucaguaaggaaauggcauguugagagcauuuacguguugagcagcucaacgaggguaaaucuuagacacgguguugaaugagaaaggacauauacacgugugcuguggccauuuauuuaaaaagcaaguggaaggaaugcacagcaguuuuaggggcugucagaauagagugggcgacaggcauuaaccuguguuucuuuuaaaagauggggauggggagcagcagacggaucaguggguaaaggcccugagggcgcaccuggcgcuauguucaauuuccauagcccaaguaaaggaguaaggagagagcguccacagguaguccucaucccuccaugcauaugcaugccuacaugcauagaucuuacacacacacacacugcaagcacaaagaccagagugugguugagcccucguccuguaugcuuggugaaugaaccaauacugucugacuuugagagagauauaauuucuucuuuuuuuuuuuuuaauguuuuuaggagcuugaaauugucauuggagaugaacacauuucuuucacaacaucaaaaauugguucccuuauugaugucaaccaguccaaguaagcaugcaugacauuuaucaucaguugugucuguuguuggagauucaaccacacgaggccagcagagaaagaugugcagacauaacacaaaaguggaugguguggccgggcgugguggcgcacgcuuuuaaucccagcacucgggaggcagaggcaggcggauuucuaaguucaaggccagccuggucuauagagugaguuccaggacagacagggcuacacagagaaacgcugucucaaaaaaaaaaaaaaaaaaaaaaaguggguggugugguccuccucauaggggcuccaggucacagugguucaguaucauggaaggguugguuucaggaauucugguacuagagucuuuagugcuuaauuuccuuauauaaauuagugucauguuugcuugaagccuauguacuucccauauaagucaucuuuauaaaaccaaauucugggaaauagccguuauaauguaucgcuuaggaaaugauaagagaaaaugucugaacauacaugugacaguuggaaaccccauagaccuaacuauauccacucauggcugagcccacaaaugcagauagaguugggccaguuguauuuucagaaguugcuucuuguaguuaauguaguuacuacuucucagugacauggaagaauaaauagugacagcugcuucucagugacauggaggaauguguagugacaaccagaagaggaaaugacaugaggccacacagugcugugugacccucacugggcgaacagcuucucugugcugacuguucggacuagcucaucuuagucuuggugaaauuugaaaucuugcaucuaaguuuuaaaaugcauguugccaauggugugacuucuaacacuaggaugugauucuauuugcuauaaagaaccuuagaauuuggcaggcucucugcuuucuggacacacuugucagugcugcuugcuacuuuaaauuuucuucuucaacucuuagaacaauagauggucauuguagaaaauacaggagcuauagaaaagagaaagggggaguucuuucauauccuuaauagacagccagugauaacaucuuuuugguuucagaaaggcucuuauuaucuagcuaugacuguccaggaacucagcuauaguggucaggccagccuugaacuuugaauagaagcaugugugucuccucugcccagcucuaccuaacaucuccacguguaaugucuuagucuuagagagcaccaggagcugaggcagguggugcaugcuuguaaucuccaguacucgggaggaauagcgcagaagaucagcucacgcugcgaacccgagauuguguuacuuacuuugaaauacccugccuuuaggugugguguggcucagccuuagcacacaccuguaauccaggagcuuuccgcuugaauauuauaaacaugauuaagucgaccauaggccaaaaggcagagcaaucaguugacagagagugaacauaggaaaaaacuagagaguaacagggaguugggagagcugagaggugcaggacguagaagggaggggcauccaguuugaaggaggagcuucggagacgcuucuaggacauugguugaugaggaacgucagcugggcgcuuucucugccccucugagcuuucacuccaguaucuggcucuuggaggcuucauugauaaaaccaaacaauucagauuuuguuuuaaagaaacaacauaggaaucucaugauugagccauucugauguguguauauauauaacaagacccagccucaaaaacaaacaacuuuuagcccccucacccuguguugggguggagguagaacucuuuguuuagguuugugguacuaggaguugaacauagagcaucuauccaucacugaccugguuuccagcucuauguauaguuuuguuuuaaaagcacaagagacaaaaucuguuuuagaaaucacaguuuuuccccuaaacuuuauauauuuucacaguaaaaacagcauggcuuccuaauauaucauuuuaguaaguggcccuuguuaauggacaugugcuuccucaggguuuauuacuguaaauaucuuuauaaggagcauuuuuauaguaaucgggguuauuaauuuuuuuuugguauuugccaguuuuccucugcuucuuaaacauuuugguuuucuuuuguguuuuagggauccggaaggcuugcgaguauuuuauuaucuuguccaggaccugaaguguuuagucuucagucugauuggauuacacuucaagauuaaaccaaucuagauauuggauauuguggacacaaggcgggugggaguuuuuaguuaccauaauuaggauuuuuuuucuguauauuggggcaauuuuuauaaacaauaaaugaugaucuuuaauaaaugcgauaacaucuuuuuuuguuauuuuucuaaaca

SEQ ID NO: 2021 - RNA, 729 nt, Mus musculus
uaaacaaaauguuuacuuuuaguuugcuccucucagugauguggugagguugaauggaaacccuagcacaagauacuuaaggauaaauuauaguaauaauaauuauuauuacuguuaugcacuuucaucaaaggcucagcucugucuagugucugagccaauccaggccauuguaggagcagacauccucaccucuaauagcagcuggguccaagaauuagaauugauuuuagguguguuagaugugaacucugacucaauuaguaccacugguuuucagcugaaacaguccacugacuacacuugugucauggccgucagccugccuacguccuacuaaucccaacuuaggacuggaguggagaggauccuguuccuucuuccacuagccuacauacagcugagcacagaauaauaacccagaaccauuaugccucuuccaucagacucuugucagaaccacuugauguaggccuagacccuggcuuguugccaccacaaccaguuauccagaaucauccauccucauuauacucuuugaacauugcgcauuggccagagaaguucuuuauccuuguuccuagguugucaccuucccccucuauuuguagccuaagaaaaaagaaauugacauucgcuccuaggcaguucuauacaugggcucuuacuuaaugaaauccuaugaagucaguauuaguuuuuaucuuuguuuuacagauaggaaacuuu

SEQ ID NO: 2022 - RNA, 17102 nt, Mus musculus
aagaauauuauuaucuggugaacuucauucauuccauccaguuauaucaaguguauguauauaagauuuuauaaaaaugugcuuauguacuguuuuaacaaacacagcaaguuagagagggaacugaugcuugucuacuaggcuagcgaaccacuuaaauauagaaaacuaauuugacuagacuuagaagaaaacuaggaaauugaaaugauaacuuuuccacacaggaauccuaauuucagcguugcucacaaaacuaauaauccuguaaaccacuggaggcaacuuucauuuuucuagcuucguguuucucuuagacaucaggaugcuuaauauaagaaaggaacugaaaaauauuuccucuuucuguuuuuauuauugcauauguguaaguaugauguauguggaugcucaugaagauccaagcacuggaguggcuucucauucccccaucaucauacccuggguaucaaauucaggucauuaggcucggugucauuuucugauuuucauuuaaacucagauuauacuacuaaagaguaacaaaaggaggcuaaugagguuguucuaauuacagccuacuaacgaaagccgggcauuucuuuuccuaugaaaacaauuuuaguguuuuucaaguguucuaaaaucaaauuauuggagcuagagcaagagcucaaugguuaaucuccaugauuugcugaucaaucaugaguggugaugacuccagaauccaugucagaugacucaugaacaccuguaacuuagccagcaucaggggauucaccaccuuuuccuggacccugucaguacauauacauacauauucagagacaugcacauauacauacacacaaaucuuuuuuaaaaaucucaguaacaaaacuaauauuauugcauuuuauauaacuuuuuuuuuucuuuuucaagacaggguuucucuguguagcccugauuguccugucucacucugcagaccaggcucaccucaaagaaaccugccucugccucuugaguguugggauuaaaggcuuguugugcuaccacugcacgcccuauuaauuuuuuccuaaagcuugcaucagcacaaagacuauauacauauguacaaucaagauguagaacauacuucuaagacuaugugauaaccaaaguacuuuaaagcuacuauucaaagguaauauguaaaacagauaauagaaauuugucccuaaaaucuuaucucugcaaacuugugguuucccaaauuggucucuaguaguaaacaugccauacucaccguuaugucaucuguuaguauuaaauagcagagauacuauguuuccugcugcccauugauccagauucuacuacauugaauauaugcaggaaagguuucucuuaaaauauuguugggaucuuuuuacuguagguuuguuaccuaaaucuaccuuaauaguaaauauuuuuugcgcaguacuggugguacuugguuggccuguggcaugggucaugcagcaagaguuaucuuuacaccuaagucaccucagcaagaaauaagcuuugaggaauuuuagccagaccugagugaggaugcuuguauuuacuuuuaaaagucacaagauauaauucuaucuauaauccauaauaggucuuacaauuuuauuaauuuauguaucaagguuagaggaaucacugaagaauaugaaagcacaacuguuagaauugcuauaaaaguaccccagucaacagagaacaauagaaauauuuauccuguaaccagauacgguucccugagaagcuggauccuaauaaggcugcugauauuuauaauuucuccuaggaguagaguuacaaagucagucauuucucccaucuuaaaggagaaaagguaaguacaggcaaaaggagcuguucuaguuaggaucuuaauacucucaaucaaguaucaguuccuauggacuugugucuuugauuucucuuaccuuugugaauugcuaauuccaauauuuacgaggugaccuguauuacuagucaaguauuggcauugccuguggcacugcuguuuguucucauaucuacucauacaaagucucugggcaucuaaauccuccacgacugucaguuguagccuagaucacuauguuggacuccacuagucccuauuuucuccccuauagaaagaccacaacugucucauacuuacuaaauugaguguguuauuuucauuccuaccacaacccuuucacucccauaccuucuaaaagcauucucuuauguuaucuagcaauuuaggucaaaaccagaaacagugcucugcuucagccuguguugagauuacaggugugaaccaugauaccuagcuuguaugaaggauguuaaguguaaucauguugaauuguuuaaugaaccugaauuaaaaaauucagaaaaagcuuuauguuucaauguauucuguucuugcaaaacuacuaacuagguauuuuguauguuuauugccacuacugcuguaguaauuccuaaugagaaguuaggaauuacuauguuucacuaccuggguguuuacauaucauguuuacauagcagcagcauaaaccagaagauucucaaagcaguuaauuauagagaagaaacaaaaagccagagaaaaugagaacuguggcaaguuuaauuacaaaugaaaggaucacaucuuuuuaccucucaaauucccaggucuucuugacccugcuaaguaugaauaaccauaguggguuaggccaaaacuugaccuugauuuggucaaaaacacucuucaaagcuguugguuauaauccaaagagauacaaaacuuagcaccucuguaauauuaaaauaaaaacaaaacccaacaaaagaagaaguugauuuugaaaaacccaaaauacucauagcugccugaagaggagaucuugaucauuccacuuaaacagaugcucucauagccacaggaggucauuuggaccaaagucaagaugcauccauuacucauuuccccuccggcucuucuuguggcuuuucuuagaccugaaauggaacagaugaaaaucauucaauuaaguagcaaauaagaugacacagaguacaggugacaucaacauuagauauaauguggugguuuuagugacaucucccacuuuuuccuccucagugcugggauuacagguuuacccagugcaauuuuacuuguauuuguguauguuacaugauguugaaugugcacauauacuugagugcauaugcaggcuggaagcugugacugucauaucuacauuuuauuuauugaguccguuguccaguugacaacccagucaccuggaaaaaaggaaucucaacagaggaucuguccacaguagaauggccuuggcuaugugugugagaacgugucucgacugagguggaagggcccagcccacugaggacauuaucccaagguuguugggcccaggcuguguaagaaagcaagacaguaggcagcucuccuccacagucccugcuugaguuccuaaagugaguuuccucaaucaaggacuggaaacauaaggacaaggagugaaucugaaguauaaucugaaagaaauguguugcucugggucaugccauuuaucccagcaacagaaaacuagaaacuagucuagauaaccagucuaccuugaggauccugucucugcuuucaguauugggauucaaggaagucaaucgccugccuggcuuuuaaaaagugguuucuaaggaucuguacuuuaaaaguacuuacuuugcaacggggcgugguggcacacgccuuuaaucccagcauuuggggggcagaggcaggauuucugaguucgaggccagccuggucugcagagugaguuccauccaggacagccagggcuauacaggguuaguacuuacuuugcauagcaaguacuauguccuugaagccacugagcuccauggaccuguuuuguuuuuguuuuucaggcacuuggcuguuaaguuguagaagcugguucaguuccuagcauccacauuugguggcucacaauaacugcagucccuggggauuucauaccuuugaccuccacuggcaucugcacucaccucagauacacacauauauacaauucuaagcuggguaugguggcacaugccuuuaaucccagccgaggcaggcaaaucuguauucaaggccaggcuggucuacaaagugaggacagccaggacuguuaaacagagaaacccuguugggggguggguaaauucuaggaauuuucagaggaaaaaaaaaagccuauuuuuguccugugauaacugcaaauacccauaucaaacaaaauuucucaucuuaguaguauuugaaaccacacacacacacacacacacacacacacacacacacacacaugccagaggucuacauugaaugucuucuaaaucacucuccacuucauuuguugagacagucucucccugaauuugaaguccucagacuggcuagacugauuagccagcaaggucaagggucucucuagcacuaaaauuucaggugugccuggccuugaacaguugcuacagacugaauucuaguccucaugcuuucaugacaaguacuuuauuuacccaauuaguuaacuugccagcugcauacuaaauucuuaaaguagagcuuuagcccauaccuuucaggagacuuugaguggcuucuaugucugugacuacgguggugaccuagggaagaaaaggucauugucugaguguuucaguucucucacucugaguaccacccacccauccuugucucccccccccccccccccccccccguucccucccuuuuuggccuauucugaggauacuacuuacucucacauaucucuauacugauuguuaguuguggcagggaaugcaauaaugacaucauauauccagagcauuauggcuaacuggacaaaacuuuaauuaccuuacgauuuaaccucuauuauacugguccuuauuugugcaauuuggauaaaaaacugaaaucccauuucuguauaaugaagcucagaaacgucuaaugugaacuucugaauuccaugucccucuccuuuucugcuagguaguaguccagcuuggcauuucacguugcagaagucuuaaugcuccuuuuagauuuaguuacuaagacaagcaauaaaaggcccaaauacuacaccuggggauuuagagcgggaccugugucgucugucucuagaccugcuccgauggcgucguggacucuugcuccuaugccuuucucuucggggagaaggacuauggaaaaagaacaguuaguucagcacguguuuuacaauaccaccauuuccccuuucaaaacugacuugucagaaaugauuaaggaccuaccuucuucuuuuaggggaucuacuccgccuguggcaaaaggaagagcagguuauuguacuggauauugaacauugaaaaaauaaaaccuuuuucuuuuuuuuaagagggagaaguguuggggucugaacacuguggcuucugauucuuguucuaugucugaaauguauacuucuacuucuaacacuguuugaccaugcaacuuauuuugagcagagugauaauagcaaaugugcuauaaauacuggaaaaacauuuacaugaaaggaccuauuggcgcuugaauucuguuagaaccuagccaauugaaccuggugaagcauaggagguacagggaucggcuguagccauucauguuauggccccucuauacuaugugggaaauacauaaucagaaaguaggugagcaaauauaacugagcuguauauccaaguccagccuaauucacuggugacaaacuaaguaaagaaaugggauuuuuuguuuuguuuuauguacauaggugugagggugugggaucccuucgaacucgaguuacaguugugaucuaucaucugggugcaggggaagugaacccagcugggucuuccagaagagcagccaguggacuuacauacuuagccaucuguccuagccccaagaaaaguuuuuuuuuguuuuuuuuuuggucuacccaugaaguuuuaagggugaugguucaguaguaauagggaaacauaaacacuggcaaaguauuccagcccuaccuucugggagaacgacuccggcuccuccuguagcgcagugcaggugaacgccuuggcuuguccaaaucucuguagcuucuucuucgauggucaggugauggcacucuuucaagcuugagaagagauagaugaauacuggcuuuuauuaaaggcagucaugaagaaaaugguuacaguucccuuacuauucugucccauguauaucucucaagugacuuuacaacagugauuugacuacauagguugguaguucuagugacaaaaaaauuaacgauauacaguucuccaugaccuucuuauugauaacauuaucuaucaacugccugugacugacuacaguaagaaauaaggcccauuuucuuaggaaugugaaauagauuuaaguucaguacuguuaaaugcaaagccauaguggauuuuaagcuuuaaaauaauucccucuagcucuaccaaaagugucuguagcaguaggagcugggcauggugguguaugcauuucauccaagcuggggacacugaagcagguggauccguuaaugaguuugagaccauucuggucuauauaauuccaggacagccaaagguauauaacccaucuugaagacagacaacaacaacaaaaauaaaacaaaaaagcaccaaaccaagaagggaaagagaagcaaaaguguaacaauaccuagaguauuaucuauauacagcauauacaacuuggaauuguaguaaaaaugucaaacacauaaguggaggaaaaugaggauaaaaaaauaauaccgcaagggacaggaacagaaaauuccauguugaggaaaaauaauuagauuacuguuuuaucaauauaaaacccaauuugagguuaauuuuuuaguuuuagagauaaggucucacugugcaacucuagcuggucucaaacucacagagcuguuucugucucucuagaggguucaaauuaaaggcaugugucaccacgccaagcauuucuuauauguccuucugguucuugcaguguuucuuagaauguaauugcaaaugcuuuagagcaguuacuagaagcacucccacauuuccaucauuuuaauggcugcuuaaaaaucauuucaacaaucgaccugacuccuuacauccugacugcugagguggguuguuuuccacuuuucagcacuauaauuauuaauucugacaaaauaugacuauguagcagguaacuucuccccuuaagaguauguucaagcauguuuuguccaaguuuuuugauagcuaccauucauuuaccaauuaugugggaauauaccuucaugaacacaaaacagucuucagagaaaaguacuguacuccuccuugcuuuacagaagacaagcaaucuaacgcagcaguagagacugaguguaccucagggauagaauaugcauucagcauaagugacacuguggaugcaaucaaucccuaacucaaagggagaaaaaucaggacaauuaagacuauaccacuacuaugacagagaagagguauucaagccaaagggguauuugacaccaaagcuccuaauuuuaguaagaauacagcauucuuauuuuuuaggcacaggccugugauccuacuauuccugaggcagaacugaaaugucuugcuagucuuauccacacacuagagcucucccuguccaaaaggaacccaaaaguaauuaauccacaaagaauguaaaaaggaaagguuaucauuaauuuacaaacuaaagcuuacaaaauaagggcuauuccuuccuuccuucccagccuuaccacuuucauacaugccuuaccuucucaucuuccuccuccucuuccucacuagacuccacaucauccauguccucuucuagggcacuaacucgaggcuccaguugcucagcuucuuccagcacauaccguuucuacagggaccacaacgucaacagucauugccauuucuuccauagccugauccuaacagaguuucugggguugacagaaaagccuuggaaccacagcucugguaugauauuaauauacaguggaauccauaugccuccccuuuuaaaaaagauuuauucacacaauauguacucacugauaaguggauauuaacccagaaacuuaggauacccaagauauaagauacaauuugcuaaacgcaugaaacucaagaacaaagaccaaaguguggacacuuugccccuucuuagaauugggaacaaaacacccauggaaggaguuacagagacaaaguuuggagcugugacaaaaggauggaccaucuagagacugccagauccagggauccaucccauaaucagccuccaaacgcugacaccauugcauacacuaacaagauuuugcugaaaggacccagauauagcugucucuugugagacuaugcuggggccugccaaacacagaaguggaugcucacagucagcuauuggauggaucacagggcccccaauagaggagcuagagaaaguacccaaggaguuaaaggggucugcaacccuauagguggaacaacauuaugaacuaaccaguaccccggagcucuuuacucuagaugcauauguaucaaaagauggccuagucagccaucacugggaagagaggcccauuggacuugcaaacuuuauaugccccaguacaggggaacgccagggccaaaaagugggaguggguggguaggggagugggggggaggguauggggggacuuuugggauagcauuggaaauguaaaugaggaaaauaccuaaaaaaaaaaaaaagaguaauucuaaaaaaaaaaaagauuuauuuauuuacuauauguaaguacaucauagcugucuucagacauuccagaagagggugucugaucucauuauagaugguugugagccaccaugugguugcugggauuugaacucagaaccauccaaagagcaguaggugcucuuaaccgucgagucaucucuccagccccuccauaugcuuuuuaaagguccccuacaaacauaaacagauugcugaagggaacaaguucauuuucaauuguuucuauuuccuguggucuuauacuguaaggucaauacauugucaaucaauuugugugucaucaaaaauguuaccuucagggcugaagagaugauucagcuauuaagagaacuugcugcacuuggaaaggaccugaguucagcucgaguacccacaugguggcucacuaguuccaaaggauccaaugcccucuucuggcauucucugguagaaggugaaaauugauuguccucuggccccuauaugcccuggcacauucacacacccccagcauuaauaaugauuaauuaaaauaacaugaaaaguaaauguuuuaauuuuauaaaggcaaauuugcucauuugugugugugacacaaauacaugagucugcaaauacacaugccagcuuacccaugccagaauagggccacagugucuucuguugcuucccaguuuaguucagugagagacaagucuuuaccugagcaggaagcuugccauuuuggcuauacuaucuggccagcaaguucuaaacaucugucuguuucugccugccaagcuuggguuauagguacuuagcagccaugcuuuuuacaugggugcuuggggacuugaacucagguccuuauguuuacagaucaagcacucuuaaccacugaaccauuucgcuaacacugggcgguuuuuguuuguuuuguuuuuguuguuguuuguaggguucuuugguggugaggcuuauuuguuuuuugagauggucucaccaugaaggcuuaguuguccuagagcuagagcagguuuccaagugcugggacuaaaguccagcaccacaauuauuaugccuggcacaauaaacuuucgguaagguuguuuaguucuuucaauauuuuacaauuuuaucugugaagcacauaugccagaguguacauguggaugcuagguuagcugaucuguaagcuuuuggcauuauccuccgucuuccuucuguguggguucuaaggauaugaacucagagugucaggcuuguacagcaaguguuuuacccacuaagccauuuucucaggccuaaagguucuccuuuuuuuuguugcuucaugaauaguuaucacuuugggugugaaggaagaugauaaacaagacacaagacguuuaaaggauugaguguuuucuuucucauucugagugaucuuucuucuguuucuuagccuagcuuaccaauuugaaaaaacaauacuccagguauauuugggauaagacauccuuuccucuauucauuuucaaagccuacccaugaaacauuaccugcuuuuaucucauucccuacccuuuguaaauuuugguauaaggacuuauuaagacaacucuuaaagcuucaguguuucaguagguauuuguguuuaugugagaaguaaaaggugaccuuugucucauaccuguagccggggcaaaaugauaucacagacucucucacugugcaggaguucauaaaugaacucaucuacaugcaucagcacaaacucuggaagagaaaaaugacuagauuaagcaaccugcaaaugacuuaguuacgcaaagaguaaaagaaucaugaaaguuuaugugaagcucccuacgugccacaccuuuccuuccuuccuuucuuuuggagacaagaacugaaaguagggccuugugcuugcuagugcuucaucacuauguuaaauccccaaccuuaccuuaccacuggacuaaguccccaacuuugugccuuaccucuuuaaaaauguuuacuuacauuuauuauuuacauauaccacgcccaugcacaagcuuuugcuacagaauauauguagcagccagaaaaaaacuuuccagaauuuauccucuucaaccauaugggucucagccuugacaggagguaucagcccagucaagccucuuuagaaagaaacuaagagaugaaugaggggucuagagagauggcucagugguuaagagugcugacugcucuucugaagguccugauuucaaaucccagcaacuacaugguggcucucaacaauccacaaugagaucugacguccucuucuggggugucugaagacagcuacaguguacuuagauauaauaaaaaauaaauguuuagguuggagcaagcagggcuaucugaagcaagcaaucuucauucccagcaaccacaugauggcucacaaccaucaguacagcuacaguguacucauacacauaaaauaaaucuuaaaaaaaaaaaaaaaaaaaagagagaugaaugaggcuguuccagguagcagaagcaaaaaacaggagacagaaacauaaaggcagacacuauuggucuugaauuaugucauauagucuugacuagauuagauaacucaagaaucaucauucauguuaauuuuaauagaucacuuaauaguaacuucucccacuaauccauaauguccccaaauauacuauauuucucuuuuagaggccuguggugagauagcugaguaggucaaagcucuugcuacacaugccugaugauaugaguuugaguccuagaacucacaauaggaaaagcaaaacaaaacaaaccccaauaacucucagauuugucugacuucuacacaugcacaauagcacauacgugcuuacaaucacaauauagacaaaauauuaaaacaaaaauauuuauuuuuuuauaacauaaaaugacaauuuuuuagaaucuccauagcaauauuaacuuaguuguauggcucaagugacuucgcauaccucuaucacccuacucaaagaaaguguaauuaagucuaguagugagugggccgggauacugcucaacauauugucaugcacaggaccaccacagagcaucuuagauaccacagucauguugcuucuaguucgugagugacauaacaccuggcauauuaccaacucucaauauauauguuucagugaagaaauaaauuaauaaaaguuuaaaguauaauacagauugagaauuccuaaggaguauuugagguuucuggauagagaugaucaauugauaguuuauaugaccauucuaaaaucuaaaaugcccugaaaucugcaauacuuucguuuuaagccauuuugaauaggggaauauucaacucacacuaaauuguuaaucuucuauaucccgaagaagauaggugucucuccacuggagagucucugauuauauuacuagaaauccuuccucagcacagguguaucuccaaggccaaggccaguagcccaguggcagagcacucaccucacaugcaugcugcccucccuagguucaauucuccaauacuauucccucccaagacaugcaugguagugcacucuuguaauucccauauuugagaggcagaggccagagaaucagaaguuugaagucauucucagcuacaguacagaguuacauguccucaaaacaaagcaaaacaaagauguagcuacaaaagauagaaacagggggguggguaugggggaccuuugggauagcauugaaaauguaaaugaggaaaauaccuaaaaaaaaaaaaaaaaaaaagauagaaacaucuccuuggauaugcuuaguaucuucaguggagucccuauaugaguaacauagguccacuuagucuacagaguacagcauaguguggaaacaauccuagagaagcagccugcaggggaaagaaugucaagcuguaggauuuggaaacuaaccuugggcaggcuaacgcagguuuuauaaagaaaccauuuugaagcuucuacaucuuguggauggagcauauguggaaaauauaucugacuuaagucaguguuuaacaugaaaugcagcagggaaggaaggcagccauguucccaagggguuaaggcccaccaaggcuaaggcuuccccugacggaagggacacagcgacaaugcccaugcacaggaacacucagcgcgugugaaaacgagugacaggccaaggaacaacagucuagagacuuggccucauaccuccauuucgguucuggcucuugauuuuucgauagucauuguacaaaggcuccaaguacuuguagcaaucaauugcaguuccugugagccgcauguaaagugcccccagcauccggacauaccuaccagagagaguacagugaaacagcaggccauuucaagacuuccugaguuuuauaacuggcuuuucucaugacaacagucgguaaaaauguuucuugguuuuuuuuuuucuucuuguuaucagauaaagcuguaauucugaagauaucguagaacagaugauggcuaaaauauggagaccuagucaacuuccuaaucuaccgaucacgagcugugagggcuugcuacauguuguucaacuuucagguauaucaucuguaaaacuuuacagaauuagccuaagauuccaaaaagguaacacuuacaacacaguaaacauaauauauauuuuauaauaaugcuagaacaugcauacauaggcacaaauguagguucuagauaaaggucaaagucauagagguuaaaauucugauuucauaaauuacuaacuuuaguaccagauauugaacguguuuucucaaccucuaaaauggagaaucugcuaccuaauguacuaccuuggugcaauaaauaaaugcaagaaaacuauaguguuaucaacaguaugagcauauguucuuacuaaguuaauuucuaauugucuuuuuuaaguauuaucccuccuuuuucaucucauauauccaauuccuuacucaaaucuccauuugaaauucaagcuucaucaugugagaagaacaguacagcaaugaauaugcauucuggcaggaauccuaagugaagccuaguacucaggaggcagcggauagaggacugccauaaauacaagauuagccaggacugcauugugaggcaauaucucaaaaaaaccaaaccaaaccaaaccaaaccauccucugaagccagcuuuaccucuccagcucacauuggaggaaucagacucagcccccuggcauuuuucugcccucaggcuugaucucagccacagaucuaugaaucacuauaugugaagcccuuaaaacauauuuuguucggcauaggaucagcuaauauaccugccuccuacaccugccucugcauuccuagagaauagauaauaugaaacagcuaauuacguuuacccuacauugauaggcuuuaaauaauuaaagaaauucuauggggucacagucaauagguaacaaagucuaaauaagauacagaacuaaccuuucaacuaacaucuuauguuguaugacucccacaucugauggcuaccaacauauggcuuugaugagaaucuguguguauguguguauguaugcauauguacaaauacuauguguguauacuuauuuaauuugugaaaucuguuugggggaagggggaguuaggucuauguuaccacagcaaacaaaauacaaguucaagggcaaaagcguguggaaaugaaacacaacaguccuauuaacaaagccaauucugaaccacuagaaguguuguacuuguuaacauacucacuugaaaucuucauuuuuuaugaacucaacaaugauauccuucucagguugaaucugaagcauuuucaagguuaaacacaaaaaaggaguuggcuuuauguuuccaccauacacaccaccaacgaacuuuaacuccauggcuuuguccacuacaaguucagcugaaacagccaaaaacaaagugacauacaucuuagacauauuaaaggcuuuaguuuuucuuggccuuaguuuuucuugguuggaagguuaaauagcuaaagguuuagaguuccuaaauagucaauaagaauuuaauauuaagagaacaagagcuuauuaauaacagccuuaaaaaggaaaaaaacaaaaaacccugagcauggugaugauugcucagucccagcacucaggaggcagagguaagcagaucucugggucugaggcagccuagucugcagagugaguuuuagaacagccagggcuacauaugccuggaacuacagcacuacagagagagacagaccccucgucccagucuccauuaauuguuuaguccaucaaggaagggugggacucaugaguccucaaucuuuauacaacaaauuaugagggaaaaguccucuuauuacuaccagaugcuggucuggggugguguacaacuuuaaugccggaacucgggagacagaggcaggcacaucucugugaguucagggccagccuggucuacagagugaguuccuggacagccagggccaggacuacacagagaaacccugucuaaaacaaaacaaaaaaacaaauaaucauuguccuggcuuccagcuaaggauaaugagaacaaaaaagagcuuaagugauuuuacaugcucaagaaccacagccagagucacaccaggugaagcugaacaaagcuacgacagcugacagagagccacucuaaaaaacuuaggagccagcgagguggcucaugccuuuaauccuagggaccagaaggggaaggcagaugaaucucuguguguucaagagaguuccaggccauccaaggcccccugucucaggggaaaaaaacaacaacaaaaaaaccccaaaacaaaacagaaaccuaaaggacuaggggaagcaggucaaaaaugaaacuacugacccauuuaagaacagcaagaauuuuauuauaggaauggugaaguuccuugaacaucuucaagcugcauuaaaggaacccuuaucuggucccugagauaaacaaucuaggacccagcagacuaucaauaaauaaauaaacaaauaaauuaauuaauuuaaaaaaauggaauggcucaaaaaaaaaaaaaaaaaacuaaagaaauccuucagcaucaagaaagaccggucaagccggguguaguggcgcacaccuuuaaucccagcacucgaaggcagaggcagguggauuucugaguucgaggccagccuggucuacaaagugaguuccaggacagcaagggcuauagagaaacccugucucgaaaaacaaaacaaaaaaaagaaagaccggucaagcaggacgugguggcgcacgccuuuaaucccagcacuugggaggcagaggcagaggcaggcggauuucugaguucgaguucgaggacagccuggucuacaaagugaguuccaggacauaggacagccagggcuacagagaaacccugucucggagcccacccccccccccccccaaagaaagaaagaaagaaagaaagaaagaaagaaggaaagaccggugagcccugcggugcugguguauuccuugaauuccagcacucgggagacagaggcaguucgaagccagcaguucuccaggacagccagggcuauuacagagaaacccugucucggaaaacggaaaagaaaaaagagaaaagagaaaaagaucgugucagauuugucugugucccgucuaguacaaguccaggcacagagcaguuuauaugaauaguugacauacucuuccaguaucacccccaaaggguccguccuuccucacucagacagaagaaaccacccguaagccgagacgcgggcugcgcgcugucgcucaccuguaaguccaaaacacucuucuuuccaguacuuugauucauagauucgcguccggaugaucuucuccaccagauacugaggguuggugccauggaugcugugggcauccuucacuguacgguucgccauuuuagaacucuuucaauucuauuuccgucggcuugcuuaauacgucacauucaguauuuauuuaaaagaagggaaaaaaaaaaaaggacuaccggaggcuagggaaacauuaaggaaucccuugcgaccgcggaaagccaccagcuucguaccggaagcuguggcguagaacucuuucgccggaauacgcacaccccgcaccagagagggcccaagcaaauuggcggaaguacg

SEQ ID NO: 2023 - RNA, 17102 nt, Mus musculus
cguacuuccgccaauuugcuugggcccucucuggugcggggugugcguauuccggcgaaagaguucuacgccacagcuuccgguacgaagcugguggcuuuccgcggucgcaagggauuccuuaauguuucccuagccuccgguaguccuuuuuuuuuuuucccuucuuuuaaauaaauacugaaugugacguauuaagcaagccgacggaaauagaauugaaagaguucuaaaauggcgaaccguacagugaaggaugcccacagcauccauggcaccaacccucaguaucugguggagaagaucauccggacgcgaaucuaugaaucaaaguacuggaaagaagaguguuuuggacuuacaggugagcgacagcgcgcagcccgcgucucggcuuacgggugguuucuucugucugagugaggaaggacggacccuuugggggugauacuggaagaguaugucaacuauucauauaaacugcucugugccuggacuuguacuagacgggacacagacaaaucugacacgaucuuuuucucuuuucucuuuuuucuuuuccguuuuccgagacaggguuucucuguaauagcccuggcuguccuggagaacugcuggcuucgaacugccucugucucccgagugcuggaauucaaggaauacaccagcaccgcagggcucaccggucuuuccuucuuucuuucuuucuuucuuucuuucuuucuuugggggggggggggggugggcuccgagacaggguuucucuguagcccuggcuguccuauguccuggaacucacuuuguagaccaggcuguccucgaacucgaacucagaaauccgccugccucugccucugccucccaagugcugggauuaaaggcgugcgccaccacguccugcuugaccggucuuucuuuuuuuuguuuuguuuuucgagacaggguuucucuauagcccuugcuguccuggaacucacuuuguagaccaggcuggccucgaacucagaaauccaccugccucugccuucgagugcugggauuaaaggugugcgccacuacacccggcuugaccggucuuucuugaugcugaaggauuucuuuaguuuuuuuuuuuuuuuuuugagccauuccauuuuuuuaaauuaauuaauuuauuuguuuauuuauuuauugauagucugcuggguccuagauuguuuaucucagggaccagauaaggguuccuuuaaugcagcuugaagauguucaaggaacuucaccauuccuauaauaaaauucuugcuguucuuaaaugggucaguaguuucauuuuugaccugcuuccccuaguccuuuagguuucuguuuuguuuugggguuuuuuuguuguuguuuuuuuccccugagacagggggccuuggauggccuggaacucucuugaacacacagagauucaucugccuuccccuucuggucccuaggauuaaaggcaugagccaccucgcuggcuccuaaguuuuuuagaguggcucucugucagcugucguagcuuuguucagcuucaccuggugugacucuggcugugguucuugagcauguaaaaucacuuaagcucuuuuuuguucucauuauccuuagcuggaagccaggacaaugauuauuuguuuuuuuguuuuguuuuagacaggguuucucuguguaguccuggcccuggcuguccaggaacucacucuguagaccaggcuggcccugaacucacagagaugugccugccucugucucccgaguuccggcauuaaaguuguacaccaccccagaccagcaucugguaguaauaagaggacuuuucccucauaauuuguuguauaaagauugaggacucaugagucccacccuuccuugauggacuaaacaauuaauggagacugggacgaggggucugucucucucuguagugcuguaguuccaggcauauguagcccuggcuguucuaaaacucacucugcagacuaggcugccucagacccagagaucugcuuaccucugccuccugagugcugggacugagcaaucaucaccaugcucaggguuuuuuguuuuuuuccuuuuuaaggcuguuauuaauaagcucuuguucucuuaauauuaaauucuuauugacuauuuaggaacucuaaaccuuuagcuauuuaaccuuccaaccaagaaaaacuaaggccaagaaaaacuaaagccuuuaauaugucuaagauguaugucacuuuguuuuuggcuguuucagcugaacuuguaguggacaaagccauggaguuaaaguucguuggugguguguaugguggaaacauaaagccaacuccuuuuuuguguuuaaccuugaaaaugcuucagauucaaccugagaaggauaucauuguugaguucauaaaaaaugaagauuucaagugaguauguuaacaaguacaacacuucuagugguucagaauuggcuuuguuaauaggacuguuguguuucauuuccacacgcuuuugcccuugaacuuguauuuuguuugcugugguaacauagaccuaacucccccuucccccaaacagauuucacaaauuaaauaaguauacacacauaguauuuguacauaugcauacauacacacauacacacagauucucaucaaagccauauguugguagccaucagaugugggagucauacaacauaagauguuaguugaaagguuaguucuguaucuuauuuagacuuuguuaccuauugacugugaccccauagaauuucuuuaauuauuuaaagccuaucaauguaggguaaacguaauuagcuguuucauauuaucuauucucuaggaaugcagaggcagguguaggaggcagguauauuagcugauccuaugccgaacaaaauauguuuuaagggcuucacauauagugauucauagaucuguggcugagaucaagccugagggcagaaaaaugccagggggcugagucugauuccuccaaugugagcuggagagguaaagcuggcuucagaggaugguuugguuugguuugguuugguuuuuuugagauauugccucacaaugcaguccuggcuaaucuuguauuuauggcaguccucuauccgcugccuccugaguacuaggcuucacuuaggauuccugccagaaugcauauucauugcuguacuguucuucucacaugaugaagcuugaauuucaaauggagauuugaguaaggaauuggauauaugagaugaaaaaggagggauaauacuuaaaaaagacaauuagaaauuaacuuaguaagaacauaugcucauacuguugauaacacuauaguuuucuugcauuuauuuauugcaccaagguaguacauuagguagcagauucuccauuuuagagguugagaaaacacguucaauaucugguacuaaaguuaguaauuuaugaaaucagaauuuuaaccucuaugacuuugaccuuuaucuagaaccuacauuugugccuauguaugcauguucuagcauuauuauaaaauauauauuauguuuacuguguuguaaguguuaccuuuuuggaaucuuaggcuaauucuguaaaguuuuacagaugauauaccugaaaguugaacaacauguagcaagcccucacagcucgugaucgguagauuaggaaguugacuaggucuccauauuuuagccaucaucuguucuacgauaucuucagaauuacagcuuuaucugauaacaagaagaaaaaaaaaaaccaagaaacauuuuuaccgacuguugucaugagaaaagccaguuauaaaacucaggaagucuugaaauggccugcuguuucacuguacucucucugguagguauguccggaugcugggggcacuuuacaugcggcucacaggaacugcaauugauugcuacaaguacuuggagccuuuguacaaugacuaucgaaaaaucaagagccagaaccgaaauggagguaugaggccaagucucuagacuguuguuccuuggccugucacucguuuucacacgcgcugaguguuccugugcaugggcauugucgcugugucccuuccgucaggggaagccuuagccuuggugggccuuaaccccuugggaacauggcugccuuccuucccugcugcauuucauguuaaacacugacuuaagucagauauauuuuccacauaugcuccauccacaagauguagaagcuucaaaaugguuucuuuauaaaaccugcguuagccugcccaagguuaguuuccaaauccuacagcuugacauucuuuccccugcaggcugcuucucuaggauuguuuccacacuaugcuguacucuguagacuaaguggaccuauguuacucauauagggacuccacugaagauacuaagcauauccaaggagauguuucuaucuuuuuuuuuuuuuuuuuuuuagguauuuuccucauuuacauuuucaaugcuaucccaaaggucccccauacccaccccccuguuucuaucuuuuguagcuacaucuuuguuuugcuuuguuuugaggacauguaacucuguacuguagcugagaaugacuucaaacuucugauucucuggccucugccucucaaauaugggaauuacaagagugcacuaccaugcaugucuugggagggaauaguauuggagaauugaaccuagggagggcagcaugcaugugaggugagugcucugccacugggcuacuggccuuggccuuggagauacaccugugcugaggaaggauuucuaguaauauaaucagagacucuccaguggagagacaccuaucuucuucgggauauagaagauuaacaauuuagugugaguugaauauuccccuauucaaaauggcuuaaaacgaaaguauugcagauuucagggcauuuuagauuuuagaauggucauauaaacuaucaauugaucaucucuauccagaaaccucaaauacuccuuaggaauucucaaucuguauuauacuuuaaacuuuuauuaauuuauuucuucacugaaacauauauauugagaguugguaauaugccagguguuaugucacucacgaacuagaagcaacaugacugugguaucuaagaugcucuguggugguccugugcaugacaauauguugagcaguaucccggcccacucacuacuagacuuaauuacacuuucuuugaguagggugauagagguaugcgaagucacuugagccauacaacuaaguuaauauugcuauggagauucuaaaaaauugucauuuuauguuauaaaaaaauaaauauuuuuguuuuaauauuuugucuauauugugauuguaagcacguaugugcuauugugcauguguagaagucagacaaaucugagaguuauugggguuuguuuuguuuugcuuuuccuauugugaguucuaggacucaaacucauaucaucaggcauguguagcaagagcuuugaccuacucagcuaucucaccacaggccucuaaaagagaaauauaguauauuuggggacauuauggauuagugggagaaguuacuauuaagugaucuauuaaaauuaacaugaaugaugauucuugaguuaucuaaucuagucaagacuauaugacauaauucaagaccaauagugucugccuuuauguuucugucuccuguuuuuugcuucugcuaccuggaacagccucauucaucucucuuuuuuuuuuuuuuuuuuuuaagauuuauuuuauguguaugaguacacuguagcuguacugaugguugugagccaucaugugguugcugggaaugaagauugcuugcuucagauagcccugcuugcuccaaccuaaacauuuauuuuuuauuauaucuaaguacacuguagcugucuucagacaccccagaagaggacgucagaucucauuguggauuguugagagccaccauguaguugcugggauuugaaaucaggaccuucagaagagcagucagcacucuuaaccacugagccaucucucuagaccccucauucaucucuuaguuucuuucuaaagaggcuugacugggcugauaccuccugucaaggcugagacccauaugguugaagaggauaaauucuggaaaguuuuuuucuggcugcuacauauauucuguagcaaaagcuugugcaugggcgugguauauguaaauaauaaauguaaguaaacauuuuuaaagagguaaggcacaaaguuggggacuuaguccagugguaagguaagguuggggauuuaacauagugaugaagcacuagcaagcacaaggcccuacuuucaguucuugucuccaaaagaaaggaaggaaggaaagguguggcacguagggagcuucacauaaacuuucaugauucuuuuacucuuugcguaacuaagucauuugcagguugcuuaaucuagucauuuuucucuuccagaguuugugcugaugcauguagaugaguucauuuaugaacuccugcacagugagagagucugugauaucauuuugccccggcuacagguaugagacaaaggucaccuuuuacuucucacauaaacacaaauaccuacugaaacacugaagcuuuaagaguugucuuaauaaguccuuauaccaaaauuuacaaaggguagggaaugagauaaaagcagguaauguuucauggguaggcuuugaaaaugaauagaggaaaggaugucuuaucccaaauauaccuggaguauuguuuuuucaaauugguaagcuaggcuaagaaacagaagaaagaucacucagaaugagaaagaaaacacucaauccuuuaaacgucuugugucuuguuuaucaucuuccuucacacccaaagugauaacuauucaugaagcaacaaaaaaaaggagaaccuuuaggccugagaaaauggcuuaguggguaaaacacuugcuguacaagccugacacucugaguucauauccuuagaacccacacagaaggaagacggaggauaaugccaaaagcuuacagaucagcuaaccuagcauccacauguacacucuggcauaugugcuucacagauaaaauuguaaaauauugaaagaacuaaacaaccuuaccgaaaguuuauugugccaggcauaauaauuguggugcuggacuuuagucccagcacuuggaaaccugcucuagcucuaggacaacuaagccuucauggugagaccaucucaaaaaacaaauaagccucaccaccaaagaacccuacaaacaacaacaaaaacaaaacaaacaaaaaccgcccaguguuagcgaaaugguucagugguuaagagugcuugaucuguaaacauaaggaccugaguucaaguccccaagcacccauguaaaaagcauggcugcuaaguaccuauaacccaagcuuggcaggcagaaacagacagauguuuagaacuugcuggccagauaguauagccaaaauggcaagcuuccugcucagguaaagacuugucucucacugaacuaaacugggaagcaacagaagacacuguggcccuauucuggcauggguaagcuggcauguguauuugcagacucauguauuugugucacacacacaaaugagcaaauuugccuuuauaaaauuaaaacauuuacuuuucauguuauuuuaauuaaucauuauuaaugcugggggugugugaaugugccagggcauauaggggccagaggacaaucaauuuucaccuucuaccagagaaugccagaagagggcauuggauccuuuggaacuagugagccaccauguggguacucgagcugaacucagguccuuuccaagugcagcaaguucucuuaauagcugaaucaucucuucagcccugaagguaacauuuuugaugacacacaaauugauugacaauguauugaccuuacaguauaagaccacaggaaauagaaacaauugaaaaugaacuuguucccuucagcaaucuguuuauguuuguaggggaccuuuaaaaagcauauggaggggcuggagagaugacucgacgguuaagagcaccuacugcucuuuggaugguucugaguucaaaucccagcaaccacaugguggcucacaaccaucuauaaugagaucagacacccucuucuggaaugucugaagacagcuaugauguacuuacauauaguaaauaaauaaaucuuuuuuuuuuuuagaauuacucuuuuuuuuuuuuuuagguauuuuccucauuuacauuuccaaugcuaucccaaaaguccccccauacccucccccccacuccccuacccacccacucccacuuuuuggcccuggcguuccccuguacuggggcauauaaaguuugcaaguccaaugggccucucuucccagugauggcugacuaggccaucuuuugauacauaugcaucuagaguaaagagcuccgggguacugguuaguucauaauguuguuccaccuauaggguugcagaccccuuuaacuccuuggguacuuucucuagcuccucuauugggggcccugugauccauccaauagcugacugugagcauccacuucuguguuuggcaggccccagcauagucucacaagagacagcuauaucuggguccuuucagcaaaaucuuguuaguguaugcaauggugucagcguuuggaggcugauuaugggauggaucccuggaucuggcagucucuagaugguccauccuuuugucacagcuccaaacuuugucucuguaacuccuuccauggguguuuuguucccaauucuaagaaggggcaaaguguccacacuuuggucuuuguucuugaguuucaugcguuuagcaaauuguaucuuauaucuuggguauccuaaguuucuggguuaauauccacuuaucagugaguacauauugugugaauaaaucuuuuuuaaaaggggaggcauauggauuccacuguauauuaauaucauaccagagcugugguuccaaggcuuuucugucaaccccagaaacucuguuaggaucaggcuauggaagaaauggcaaugacuguugacguuguggucccuguagaaacgguaugugcuggaagaagcugagcaacuggagccucgaguuagugcccuagaagaggacauggaugauguggagucuagugaggaagaggaggaggaagaugagaagguaaggcauguaugaaagugguaaggcugggaaggaaggaaggaauagcccuuauuuuguaagcuuuaguuuguaaauuaaugauaaccuuuccuuuuuacauucuuuguggauuaauuacuuuuggguuccuuuuggacagggagagcucuaguguguggauaagacuagcaagacauuucaguucugccucaggaauaguaggaucacaggccugugccuaaaaaauaagaaugcuguauucuuacuaaaauuaggagcuuuggugucaaauaccccuuuggcuugaauaccucuucucugucauaguagugguauagucuuaauuguccugauuuuucucccuuugaguuagggauugauugcauccacagugucacuuaugcugaaugcauauucuaucccugagguacacucagucucuacugcugcguuagauugcuugucuucuguaaagcaaggaggaguacaguacuuuucucugaagacuguuuuguguucaugaagguauauucccacauaauugguaaaugaaugguagcuaucaaaaaacuuggacaaaacaugcuugaacauacucuuaaggggagaaguuaccugcuacauagucauauuuugucagaauuaauaauuauagugcugaaaaguggaaaacaacccaccucagcagucaggauguaaggagucaggucgauuguugaaaugauuuuuaagcagccauuaaaaugauggaaaugugggagugcuucuaguaacugcucuaaagcauuugcaauuacauucuaagaaacacugcaagaaccagaaggacauauaagaaaugcuuggcguggugacacaugccuuuaauuugaacccucuagagagacagaaacagcucugugaguuugagaccagcuagaguugcacagugagaccuuaucucuaaaacuaaaaaauuaaccucaaauuggguuuuauauugauaaaacaguaaucuaauuauuuuuccucaacauggaauuuucuguuccugucccuugcgguauuauuuuuuuauccucauuuuccuccacuuauguguuugacauuuuuacuacaauuccaaguuguauaugcuguauauagauaauacucuagguauuguuacacuuuugcuucucuuucccuucuugguuuggugcuuuuuuguuuuauuuuuguuguuguugucugucuucaagauggguuauauaccuuuggcuguccuggaauuauauagaccagaauggucucaaacucauuaacggauccaccugcuucaguguccccagcuuggaugaaaugcauacaccaccaugcccagcuccuacugcuacagacacuuuugguagagcuagagggaauuauuuuaaagcuuaaaauccacuauggcuuugcauuuaacaguacugaacuuaaaucuauuucacauuccuaagaaaaugggccuuauuucuuacuguagucagucacaggcaguugauagauaauguuaucaauaagaaggucauggagaacuguauaucguuaauuuuuuugucacuagaacuaccaaccuauguagucaaaucacuguuguaaagucacuugagagauauacaugggacagaauaguaagggaacuguaaccauuuucuucaugacugccuuuaauaaaagccaguauucaucuaucucuucucaagcuugaaagagugccaucaccugaccaucgaagaagaagcuacagagauuuggacaagccaaggcguucaccugcacugcgcuacaggaggagccggagucguucucccagaagguagggcuggaauacuuugccaguguuuauguuucccuauuacuacugaaccaucacccuuaaaacuucauggguagaccaaaaaaaaaacaaaaaaaaacuuuucuuggggcuaggacagauggcuaaguauguaaguccacuggcugcucuucuggaagacccagcuggguucacuuccccugcacccagaugauagaucacaacuguaacucgaguucgaagggaucccacacccucacaccuauguacauaaaacaaaacaaaaaaucccauuucuuuacuuaguuugucaccagugaauuaggcuggacuuggauauacagcucaguuauauuugcucaccuacuuucugauuauguauuucccacauaguauagaggggccauaacaugaauggcuacagccgaucccuguaccuccuaugcuucaccagguucaauuggcuagguucuaacagaauucaagcgccaauagguccuuucauguaaauguuuuuccaguauuuauagcacauuugcuauuaucacucugcucaaaauaaguugcauggucaaacaguguuagaaguagaaguauacauuucagacauagaacaagaaucagaagccacaguguucagaccccaacacuucucccucuuaaaaaaaagaaaaagguuuuauuuuuucaauguucaauauccaguacaauaaccugcucuuccuuuugccacaggcggaguagauccccuaaaagaagaagguagguccuuaaucauuucugacaagucaguuuugaaaggggaaauggugguauuguaaaacacgugcugaacuaacuguucuuuuuccauaguccuucuccccgaagagaaaggcauaggagcaagaguccacgacgccaucggagcaggucuagagacagacgacacaggucccgcucuaaauccccagguguaguauuugggccuuuuauugcuugucuuaguaacuaaaucuaaaaggagcauuaagacuucugcaacgugaaaugccaagcuggacuacuaccuagcagaaaaggagagggacauggaauucagaaguucacauuagacguuucugagcuucauuauacagaaaugggauuucaguuuuuuauccaaauugcacaaauaaggaccaguauaauagagguuaaaucguaagguaauuaaaguuuuguccaguuagccauaaugcucuggauauaugaugucauuauugcauucccugccacaacuaacaaucaguauagagauaugugagaguaaguaguauccucagaauaggccaaaaagggagggaacgggggggggggggggggggggggagacaaggaugggugggugguacucagagugagagaacugaaacacucagacaaugaccuuuucuucccuaggucaccaccguagucacagacauagaagccacucaaagucuccugaaagguaugggcuaaagcucuacuuuaagaauuuaguaugcagcuggcaaguuaacuaauuggguaaauaaaguacuugucaugaaagcaugaggacuagaauucagucuguagcaacuguucaaggccaggcacaccugaaauuuuagugcuagagagacccuugaccuugcuggcuaaucagucuagccagucugaggacuucaaauucagggagagacugucucaacaaaugaaguggagagugauuuagaagacauucaauguagaccucuggcaugugugugugugugugugugugugugugugugugugugugugguuucaaauacuacuaagaugagaaauuuuguuugauauggguauuugcaguuaucacaggacaaaaauaggcuuuuuuuuuuccucugaaaauuccuagaauuuacccaccccccaacaggguuucucuguuuaacaguccuggcuguccucacuuuguagaccagccuggccuugaauacagauuugccugccucggcugggauuaaaggcaugugccaccauacccagcuuagaauuguauauauguguguaucugaggugagugcagaugccaguggaggucaaagguaugaaauccccagggacugcaguuauugugagccaccaaauguggaugcuaggaacugaaccagcuucuacaacuuaacagccaagugccugaaaaacaaaaacaaaacagguccauggagcucaguggcuucaaggacauaguacuugcuaugcaaaguaaguacuaacccuguauagcccuggcuguccuggauggaacucacucugcagaccaggcuggccucgaacucagaaauccugccucugccccccaaaugcugggauuaaaggcgugugccaccacgccccguugcaaaguaaguacuuuuaaaguacagauccuuagaaaccacuuuuuaaaagccaggcaggcgauugacuuccuugaaucccaauacugaaagcagagacaggauccucaagguagacugguuaucuagacuaguuucuaguuuucuguugcugggauaaauggcaugacccagagcaacacauuucuuucagauuauacuucagauucacuccuuguccuuauguuuccaguccuugauugaggaaacucacuuuaggaacucaagcagggacuguggaggagagcugccuacugucuugcuuucuuacacagccugggcccaacaaccuugggauaauguccucagugggcugggcccuuccaccucagucgagacacguucucacacacauagccaaggccauucuacuguggacagauccucuguugagauuccuuuuuuccaggugacuggguugucaacuggacaacggacucaauaaauaaaauguagauaugacagucacagcuuccagccugcauaugcacucaaguauaugugcacauucaacaucauguaacauacacaaauacaaguaaaauugcacuggguaaaccuguaaucccagcacugaggaggaaaaagugggagaugucacuaaaaccaccacauuauaucuaauguugaugucaccuguacucugugucaucuuauuugcuacuuaauugaaugauuuucaucuguuccauuucaggucuaagaaaagccacaagaagagccggaggggaaaugaguaauggaugcaucuugacuuugguccaaaugaccuccuguggcuaugagagcaucuguuuaaguggaaugaucaagaucuccucuucaggcagcuaugaguauuuuggguuuuucaaaaucaacuucuucuuuuguuggguuuuguuuuuauuuuaauauuacagaggugcuaaguuuuguaucucuuuggauuauaaccaacagcuuugaagaguguuuuugaccaaaucaaggucaaguuuuggccuaacccacuaugguuauucauacuuagcagggucaagaagaccugggaauuugagagguaaaaagaugugauccuuucauuuguaauuaaacuugccacaguucucauuuucucuggcuuuuuguuucuucucuauaauuaacugcuuugagaaucuucugguuuaugcugcugcuauguaaacaugauauguaaacacccagguagugaaacauaguaauuccuaacuucucauuaggaauuacuacagcaguaguggcaauaaacauacaaaauaccuaguuaguaguuuugcaagaacagaauacauugaaacauaaagcuuuuucugaauuuuuuaauucagguucauuaaacaauucaacaugauuacacuuaacauccuucauacaagcuagguaucaugguucacaccuguaaucucaacacaggcugaagcagagcacuguuucugguuuugaccuaaauugcuagauaacauaagagaaugcuuuuagaagguaugggagugaaaggguugugguaggaaugaaaauaacacacucaauuuaguaaguaugagacaguuguggucuuucuauaggggagaaaauagggacuaguggaguccaacauagugaucuaggcuacaacugacagucguggaggauuuagaugcccagagacuuuguaugaguagauaugagaacaaacagcagugccacaggcaaugccaauacuugacuaguaauacaggucaccucguaaauauuggaauuagcaauucacaaagguaagagaaaucaaagacacaaguccauaggaacugauacuugauugagaguauuaagauccuaacuagaacagcuccuuuugccuguacuuaccuuuucuccuuuaagaugggagaaaugacugacuuuguaacucuacuccuaggagaaauuauaaauaucagcagccuuauuaggauccagcuucucagggaaccguaucugguuacaggauaaauauuucuauuguucucuguugacugggguacuuuuauagcaauucuaacaguugugcuuucauauucuucagugauuccucuaaccuugauacauaaauuaauaaaauuguaagaccuauuauggauuauagauagaauuauaucuugugacuuuuaaaaguaaauacaagcauccucacucaggucuggcuaaaauuccucaaagcuuauuucuugcugaggugacuuagguguaaagauaacucuugcugcaugacccaugccacaggccaaccaaguaccaccaguacugcgcaaaaaauauuuacuauuaagguagauuuagguaacaaaccuacaguaaaaagaucccaacaauauuuuaagagaaaccuuuccugcauauauucaauguaguagaaucuggaucaaugggcagcaggaaacauaguaucucugcuauuuaauacuaacagaugacauaacggugaguauggcauguuuacuacuagagaccaauuugggaaaccacaaguuugcagagauaagauuuuagggacaaauuucuauuaucuguuuuacauauuaccuuugaauaguagcuuuaaaguacuuugguuaucacauagucuuagaaguauguucuacaucuugauuguacauauguauauagucuuugugcugaugcaagcuuuaggaaaaaauuaauagggcgugcagugguagcacaacaagccuuuaaucccaacacucaagaggcagaggcagguuucuuugaggugagccuggucugcagagugagacaggacaaucagggcuacacagagaaacccugucuugaaaaagaaaaaaaaaaguuauauaaaaugcaauaauauuaguuuuguuacugagauuuuuaaaaaagauuuguguguauguauaugugcaugucucugaauauguauguauauguacugacaggguccaggaaaagguggugaauccccugaugcuggcuaaguuacagguguucaugagucaucugacauggauucuggagucaucaccacucaugauugaucagcaaaucauggagauuaaccauugagcucuugcucuagcuccaauaauuugauuuuagaacacuugaaaaacacuaaaauuguuuucauaggaaaagaaaugcccggcuuucguuaguaggcuguaauuagaacaaccucauuagccuccuuuuguuacucuuuaguaguauaaucugaguuuaaaugaaaaucagaaaaugacaccgagccuaaugaccugaauuugauacccaggguaugaugaugggggaaugagaagccacuccagugcuuggaucuucaugagcauccacauacaucauacuuacacauaugcaauaauaaaaacagaaagaggaaauauuuuucaguuccuuucuuauauuaagcauccugaugucuaagagaaacacgaagcuagaaaaaugaaaguugccuccagugguuuacaggauuauuaguuuugugagcaacgcugaaauuaggauuccuguguggaaaaguuaucauuucaauuuccuaguuuucuucuaagucuagucaaauuaguuuucuauauuuaagugguucgcuagccuaguagacaagcaucaguucccucucuaacuugcuguguuuguuaaaacaguacauaagcacauuuuuauaaaaucuuauauacauacacuugauauaacuggauggaaugaaugaaguucaccagauaauaauauucuu

SEQ ID NO: 2024 - RNA, 36608 nt, Mus musculus
uaguggcgcgaaaaguuuucuccugugccuucaguucuuagucagcugagagcugggacuacguguuguagccguggucucccggaggagccagaccuggacgagcgagcgucccccagcuacuccagugccuggacugcaaagcgucggcgaggugagugcgggucguuguccacggacugcauacacgugcaccuagggccgucggugccggcaccgcucgcaagccuguaaaccuucucgccuccccggagcuccaggaacacuuccugcacugaaggagaccucggagaagcggguggcgccggcccucgguggggagccuaaggcuuuggcucuccgcgugcacugcuucugaaaagcacucgcaaccuuuccucuggaaccgcggagcugguguugcucuccgcuuuacuggugauuccgcccagagacagacuuucucuaagucacuuucugggacuuuggcgucuccucuccacauggcuugcccuuaagugagcuuucaucuccaaucacuggagaaaacaucuaauggcucguauucuacuuucuugggucuagccuucucuuaacaauuggagaaauugggaguucuaagcuuugagcugugagauuccugucacgaggucuuuuuaguuuuccauagaagucgaauaaucguaauuauuuucuacuguaaugguuuuuagacauuuuucuguguagagccggcuguccuguagcuugcucagaaccaggcuggucucgaauuuagagacugccucugccucaggcccuagaauuaauggcaugcaccaccacacccuguuuuuucagaauuagauuggggaaggugcgggagggggguucaaaacagaguuucucucuguagccccguuuguccuggaacacuuauagacacacaucucagcccccucuccugagaggcuccuccagacuguuguugcuaauccuuccuauagacaaguuguuccucuggcuucaggaugaaguucuggggacaagucaaacuucuuggaauccauuguuucaauaguuggcuacaguaggaugggcauugguuuaucauaccguauuuucucuuagucugauuaucuuagaacagugcuuagcacacaggccucaaauaauauugguugaauaaaaagagauacuauuuuuccauuuuguggauuaggaaauggguccgguggaccugccacucugauugggaagcuguauauauuacuguauauaauaagcugccagaaguaaauacuauuuucacaggugauacgaugauacauaagguaagguagcuuauugguaucugacuguucagacuuaacuuguacaaagauaacaucucccuuucauuagcaaauauuuauuauugagcaucuucuaugaauuuacauuguucugggguuacuuuaaagauuuaaaugagguacaugugucaagaguuugggcuuaacuuuuauuaagguuccuuuuauguuuuugcauuggguaugguuccuguacuggguucagacuugugguguccuuccauggauaucgcuagaagucaaacucuucucuuugccaaaccaauccuccuggcuccccaguccauucaccauuuuugcugauaaucaaaaucauuuugcugauggaggggggggguuggggguguguggaagaguaguugauugagcuguguauuagcauuucaacaugcuuuuauaugagugucauuccucaguggaaaguugaugaauaauuaggauuucuggaaagaaguccuaaggacagcagguagcaggccuuuuguacuguaggcaucuaacuugucaucuuuucauuuugugaggaauccuacauuuugugugcauguguuugccaacuuucuguugcuaugacacaguacuugaaaaaaaaaacaaggaagauagauuuacuuuggcuuacaauuucagauauuucugucuagggucauguuaggacaagauaagggcaccccaaaggcuugucccuaaggaucuacuccuuuuaccuaagucauguauguggcuauauaugaaguaugugccuggugucuccagaggccagaaggagguguccuauuccuuggaacuguaguuaaaguugguuuuaagcugcugugugggugcucagguucucuacaagggcaacagguacucuuaccauugggccaucucucuaacgccuguuuccuugauuuuaagagauuucaaaauuucuaucaucucccaaguagcccaucaauuugugaaccuuuaauccauugaagaggucagauacucugugagccaaucaguucccaaaagccuaucacauggcagcccuggcuuuuaucaggugaccuuugggaaaauacaauuccaagcuacaacagugcaaguuuuuuaauaguuugauuaauuuuguuguucuauacuacuaaugggaacacuuugguucaugucuuuucugauagguauacgaauuaccgagucauagagugggcauacauccaagaauuuguaugaaaguuuuuuuaguuuccaaaaaugacuauauaagguuuuuguuguuguuuuaauuuugagagaggguuucagugugucacccuggcugccauagaacucuauauagaccaggcuggacuugaacucagauuugccuaccucuguuucucaacuucugggauugagcaccaucaugccuaguaucuuuacgacuuuaaaugcccuuuaaacaccauuuaucuuaaaguuagauuauuugaggauuauagaagcuuugauggaaaauaggaauuugcuacagauaaaucauucaguugauauucccauuuuauuuaaaugaauacuuacugaguacuacaauuugcuugagucugugcuuuuuauuuuagagacauuuguuuucauuguggaaaguuggggcaaguuacaagauuuauuucuuacaauuguguguugcaucagugaauaaaaagaauauauguuugugaugguuugucuauccuuggaucagggagugguaccaucugaagguguggccuuguuggaaugggugugaccugguuagaaugggugugucacuguggguguggguauaagauccucacccuaguugccuggaagucagucuuccacuagcagccuuuggaugaagacauagaacucucagcuccuccugcgccaugccugccuggauacugacaugcucccaccuugaugauaauggacuguaccucugaacauguaagccagccccaauuaaauguuguuuuuauaagacuugccuuggucauggugucuguucacagcaguaaaacccugacuaauacagaaguugguaccaggagugggguauugcugugauaggccugaccaugauuuuauuugaaagaauauagauuuuuggacuuuggauuuggaacucgguggaaugcuuuaaaugagacuuaaugugucauccuaguaggaauauggaagacuuugcugcugggaguaauuugaacuguguuaaccuggcccaagagauuucaaaggagaagaauuucaguauguggcauaaagacuguuuuugugguauuuuggugaagaauguggcuacuuuuuaacccuugucugaaaagucugccugaggcaaaggugaagagacuuggauuaauugcauugacaaaggaagguucaaaaaagcccagcagagacuuuguucucugguuaagucucacauagagaaguuugaacaagcauagcaagcuuagaaaggcaaaauauaaaauauaugguucgaguauugaaggaguaccaggaagugaaauggagcaaaaucuuguguucuaggagauaacagauuaagggagugggaccuuggggcaagguucuacccagcuuaauuagauccaggcauggugguacacaccuuuaaucacaugcugaucucugcauucaaggucaaucuacagagcaagaaccaggauagccggagcuggugagauggcucaguggguaagagcacucaacugcucuuccuaagguccagaguucaaaucccagcaaccacaugguggcucacaaccauccguaagaaaaucugacucccucuucuggugugucugaagacagcuacaguguacuuacauauaauaauaaauaaaucuuuaaaaaaaaaaaaaaaaagaaccaggauagccaagcuuaggcagugaagcauuuagaaaacauaaagccaguguuaauguaauaguacaaggggaucauguucuagauccuguaagcagcagaacuuggcagcuucagccauguggcucuggcucuagaguuaagaauggaaggaacuacuugauugaugcugguuagcuggagcuaaggaauuagcggugauuaagaauagaccagcaucacugaggugaaaucuuaugggaauuguuuucugggagcacaaagaagcuguguuccagagauagccaagguuguaccucgugcuacagcuggacuugguaauguguaagaaucacccaggugguacugguuuugaaagcaugaagaugucaugaagaacagcugaggcuuggcacugugagaggucuuggaggccacuggagaagguguauccaaacuacagcugaggagcuguaguuaauggcccaggacugaaggggucaugcaaaggaggcuauuggugaagcuuaguuggaguggaacaccccaguguauuggagaugucaguaccauggagugaucaccaagaacugcagccauaguggaauggaucaaccugagcuuagagugcuacagagggcagagcuggagaagugaugccagcccuuaggaggagucuaaaagaugaaguagaaucccagacacugaaacaagaagcuguaacauugaaauugccuuggagacucaaagauguuaaagaugccagagccauggcauacaugcugaggaaagcugcuaacagggaguggaaccagcccaggagaaagcaguuuguugcagucaacaaagaugaaaaaggaguggagaucugaagaccgcuuugacaucagccauggagaugcagaguuuggaguuugcucagcugguuuccugccuugcuuuggggauuacaguuaauuaaauugaaugaaucucagaagagaccuugaacuuuggacuuuuaacauuguugugacugcuauagacuaugaggacuuugaaaguuggacuaaaugcauuuugcauuaugcuauguuuaaguauggccccuauagacucauauuuuugaacaagucuauggggaccagggaguggaaugugaugguuugucuauccuuggaccagggaguggcaccaucugaagguguggccuuguuggaauaggugugaccugguuggaaugggugugucacuguggguguggguauaagauccucauaauugggauuaugcccuaugccacuaggccuggcuucuuagcucuuuguuuaggucuaccuuguauuugauuaagauucauguuaguagugcugccagagcaguacccauuagugacauugggaauguguucaaauuauacucuacacaaucauagcaugaucauuugcaccuguugguuuguuguuuuugagucaaggucuugcuauguguaguccuagcuaaccuggcauuugccauguagacagggcaggacuggaacucaacagauuuguauuugucucugccucacaaaugcugaaguuucauggcugucacucauguaucucuuuucccugcccaacuccugagauuuuugccaagcuaaacuucauucaaaguauaaauaaaggggaaagcugguucuucacaggaagaagggaccagggccagacucccuaauaacccagucuucauuucacuauuggaguuuuuuagauacuuuuuuuaaaacagagaaauuuuagggaccaaguguuucugaacauuauauaagauacgaugccauagaauuugaggaaauccauuuguuuaauuuggauuucuacagcuuuuacaauucuuuuuuccaagaagccuuuguucugauuaguaauucagaguauuguuaacccuguaagagaagcaucacauuuugauuaaaagcuuaguacuaauuacuuaauucuaagauuggcauggcugauauucuuaucaguaccaagagauuauaaugucuaaauccauuguagagaaucauauuagacuuuucaguucuuuuccaguuuucuaucacuaaaaccaaaugugccuuagagauuuauuuaauguaugacugccaguguguauauacguguaccuaucauuaccugcuuuugagguuagaagggagcaugaaaucccuuagaaguggaguuacagacauugugagccuccauguauguaggugcuugggagcuaaacuuggugcugguaagugcugagccaacucucaaccuuauacuuuaauaccagcauuucuuuucaccuauucacaguauucagaucugggucuaucagaugcaaagaaaacuauucugccaaagcaagucuaguuagcuacugauuuuguauggguauauuucuauguacauaugagguccauuccucaggagcuguuacuuagguuuuuuuuuuuguuuguuuuguuuuuguuuguuuguuuguuuuguuuguuuuuuuguuuuuucgagacaggguuucucuguauaguuuuguuuguuuuuaaagauuguuucuuuuauuggccuggaacuugccaaguagguuagccuggcuugucagcaagucccagagagucaccugucucuguuuucccugcaguaggauaacaagagcaucccaccaugccuagguucuucauguacuuucugagaaauaaacuuagguccuuguguguuggaaaccauaccgugagaaaguaagccuuucacagcuucccauccuaauaagccaaauggccuugugcuaaggagcgggucaucaccuccuccucccuaucccuuccuagcaccagagacccuaaaagcugaauuauagucaccucuuccuuaucucuuccugacucccaagacuucuaaggacaugaguuaugugcugagcccagccugacacccaaggcuguuaaggaggaaucuacaccccggagauaagacucagugccuccugccugcagucugaauucagccuucagguccccagaugcccacuucuuuguucuuaguuaauucccccucaaccccucccuguuucccuugcugugugcuuaaaaccuggcguuucggccuaauaaacugagaccuugacaacucuuuacuuggucucacuucuguuucucgcucauuucucuucagguuugcagucacccucacacccacgaauuacuggguccugcugggcgggacacuugugcuugcuuacaugacacuucacuaacugagcuaggucuuuauucuguaaaaugauuauuauguuaauauagauucauaaaacuaguacagguguaacaguuccuuaaccaacuaguucccaaauaaccacacuaaaagacuaagacuuauuaaaauugccuugagccaaauacugagcaguucuuccauucugaaccuccaagcuagcucgguuuccucccagacaauauucacauauuacuugcauuuuuuauuuuuuuguacuuuuuucuuccaguucuccuguugcuuccuugaccucuccuuguggguugcuccuuccugccugccugccugccugccugccuuccuuccuuccuuccuguuuuuuuuucuacuccuccuagaauuggaaguuccacucuauccucuaaagcucuguauuggcucauugacuuucauugccaauguagaaugaaugagaagcaauauuuauauacaaacuugagauaggagcuucugagaauaaacauaacaaaacuauguccagacugaaaccagauacugggauagagaaaucagcacguaaaauaauacaaauagauucuacccuguguacaaaaacauauugccgaucugagugggauggcacguuuaauaaaguucaucacuacucccucaagugcugcuuuuauagacuuaugccacuaucccugguaaccccucauuggaguccauguuaucaaugucugcugauuacucaauauauucagcucaaaaauccuuagaaagaucuacucccucaaucauaagacuugacucuaauauccagccguuccuuuaggcucuuugcaccauaguuguucuuugacccgguccacagucaauggggucugcaagagcgagugggguuguggggcaagaguuguggcgaagaauggagacaacacaggcuaucugcucaagucucuuuuauugaaagguaacuauggguguguauauauauauacacacauacauacauacacacacacacauacauacauacauacauacauacacacucucuagggagugcagcuggagacacuuaaccacagauccaggaugcauaggagaaaaacaagauguuaucagaguguguucagcuguagugggcuucuugcaaaaacaucaugcuaagaaaacaagucucucgucagugaguaaauagcucaagauucugcuaagaguuggcuuccaacaguucuuuacuaugcuauauuuuacccuagcugaagagaugucacuuggacauuuguucacaauugugcuuuguuuguaguaaguguuuucucucucucucucucucucucucucucugucucucucucucucuguguguguguguguguguguguguguguuucuugguguagccccuggcuauccuggaacacuguagaccaggcuggccucaaauucacagaaaucuaccugccucccgcucccgagugcugggauuaaggguguguaccaccaccaccaccugccuaguaguaagacuuuguaggcauuuauaauuuauuuucuuuacauauugagccucuauauaaaauauacuaaaucaccuguauuugauuuccaacaagauugacuuuuucaguguuacugagcuaggcgagguggcccgcgccuuuaaucccaacacuuaggcggcagaagcaggggaaucccugaguuggagaccagccuggucuacauagugaguuccaggacaaccagggcuguguaaaagagacacuguuuugaagaacaaacaaaaagauaaaaaaauaaauguuaucgguuuaaaugugugguagugggcagagguauuaaggggagaaugcugaacuccauuaaggcaggaacugacuguaucuuacagcccaucagaccaugccauccuaccucacaaggcagaagaccagacaaacuuucucauggguuggcaggccauugccgaaucgaaaacaguuccaacaaauguacagguaaguagugaagcucuuuuuuaagauuuauuuacuauuauacauaaguacacuguagcugacuucggacgcaccagaagagugugucagaucucauuauggggugguugugagccaccaugugguugcugagauuugaacucgggaccuuuggaggagcagucagugcucuuacccacugagccauuuuaccagcccccaguagugaaguuggaaugcaaaauguagccucucaggcuaaacuguuaauaguuuguauuuaaacuguucuguucacugugguuugagguuugagggacaauagauagauccgauauuuuguuaagacguuuuugugaugcagaaacaucuguuguggcuuguaaguaaaaucugauguauaccauaaugucaucuacuuagggugaauuugaaacuuaaaagauaaaaagagauguugguccuguguccuucugaaccuugugcuuguguggguauauguaugaggugugugugcucacugcaggcccgaagcugaugaaaauggagugcuucuuugauugcccucuacuuguuuauugcacuauuuuaauccuuugagaauuucauucuguguucugcuccuucauuguccucccuauucuucccaucacuacucuccuaucucaucccuuucuacccaacuuugagauuucuuuccuuuuuuuuuucccuuuaccagaugacuuaaauuuguauugugugucuugggagugggccugcccuauaggggucaguuuauuaaagaaaacugacucgcccucuccuagcuaucagaugacaguagcuauugagcuccagguaggguuuugugcccuucucucugugcuaggauuuuuuugucuggcuggagcuugugaaagucuugagcaugcugucacaauugccuugaguucauaugugcaccugcccuguugugucuggaaaacacuuuuucuugauguuauuaucaaccaccucuagcucuuagaaucuucuugucuguccccucuuccaugaagaucccugauccuuauggaggcccuacacucugucuguuguugcaggucccuuuugcugaacccagagcucagcugucugggggauuccuugauuugcuucccaagugcuggacacacaaacacauacacacacacacacucucucucucucucucucucucugucucucucucucucugucucugucucuguggcugccacccuugccuggcuuuuuaugugcaugcugggaaacugaacucuaguccuugugcuugcuugcucagcaagugcuucauccacugagccagcuccucacuccuuagcaguuuugauauuagccaguuuuccagccccuuggaggaagccuuucuuguucuugucaauaacugggguaguuaagaaguauaggaaggcaucuaaauuaaucauuuaugcuaaaaacaguucauugagcccauuuuguguacuuugacugggugcauuguuuuccuagugagauaaguggagagcuaagagaaaccauuuagaggaauuucuaguguaagaacaucuuugaauuugagaaauggcucagugguugugggcgcuggcugaucuuucagagaauucagguuugauucucccacauauacuaugacucagcuuucuguaaacuugaguucuggggaauccagggccucaugggcacuacacauggaugaggugcauaggcaagcauucaagcaagaacucaucgcaugaaauaaaaauucagucucaaagaauugaaagagggagcuggacaggcauguccuuuaaaagaauguugucuguaguaucaaguuuuaaaaaucuuuucccacuuuaauuaccguguuuguuacuuucuagagaaauuuguaugaaaaucaaugaugguucugagauucacaucaagguuggacaguuuguauugauucagggggaagauaauaaaaagcccuauguggcuaaacugauugaauuauuucaaaauggugaguuugggccugaaaugggagccuuaucuuauggggcaugauugcaaaguaugcaugaggggagacugcugaguucucuagucacagacacuugcagaacagcauggacgaugagguggaucguguaagcauuggccguuccuuucuccgacuagaauuuagccuuuccauuauuuuuaggggcaagaauguucuucuagaguacagcauuuggggguaggaauuuugaaagacauuaggaaaacuggugauucguacuacuaguuauguguguggguuuuuuuuuuuuuuuuuuuuuuuuuuuugguuuuuugagacaggguuucucuguauagcccuggcuguccuggaacucacucuguagaccaggcuggccuagaacucagaaauccgccugccucugccucccaagugcugggauuaaaggcgugcgccaccaugcccggguguuauguguuucuuaauaugagaaaguuacuaugaaauuuuucaaguaugauuucuuuacaaguagagaggaagcaaauuguauuagaaagguguaacaauuccuguucagacagaaggaaaaaaaaaacacuuuugaugauuaccucacagggacuuuuauacaaaguuugacaugcuagaaaaaaauggugcucuucauuagaggcuggguaggcucagauucaggaccugccuagugagugagaugguacucacagcuacuuccgugucugggaaggugggaacaggccagaacuccagagagaagagcaagaagcaagagggcuacacagagaaaccuccccuccaaaagcaacaacaacaaaagaagcaagggagcaacuugaaacuguauaaagccaucucucccuagggauauaguugucagaguccuguggaaguucauaugccuaagugggacaaggaagaacaguaaagagacuuuuacuuaacacagaugggagggagggaggaaugccugacaagcguggagagaaacuuuaucaagcuguuaucuacuagagagggagcacugcagaagugugagcuuggucuaagacuuaagagcccuuguguagaacuucaauugaugacuuaguaucgcuacagaguuaaggaccgaggcccaugaucacacuguugagaauauauccuuuugguuuugguauauuaacauagugguaaguuauaagaguaaagcuguguuuccagaaaucaugguaguuauugguugccaucucacacggacuugaauuuugucuuuauauuuauuuaucuccuuuaguguguguguguguguguguguguguguguucaaguucauuauagucugcaugagagaaaucaggaugcugugggaguuguuucuccccuccuaccgaguggguuccaggaaguaaaccuagguugucaggguuggcuccggguacccuuacuuguuaaaucuucuuaguaucccaguauuuuuucagauuuaagucucagguaccccaagcugaacucuauuccuuuaaguugugauaguccugcccuuguuuaccaagugcuggcguuauaaguauaaacuaccauaccuaacugguggccuucuuaauaaucauuaacuuguauuguaagcaguuauggcaacuugauuuccuuuuuuuucuuuuuuaaaaaauuuuuuuauuuuauguauuacacugucggugucuccagacacaccagaagaggacacuggaucccauuacaggugguugugagcuaucaugugguugcugggaauugaacuaaggaccgcuagaagagcagccagugcucuuuaccacugagccaucuaucucuccagccccaguaacuuguuuuccaucccuuuggaaaugcccuguguacugauaaacaucauaaaggaguagagcccggggcuggaaagggagcucaguaccugggaacacuuacuacacaguaggggacccagggcuauuuccuaguacccgugucuacaacuccaacuccagaggagcugaguccccuuuuuagccuccgcggauacugcauguacauauggucauauaugcauucagucaaaacacucaugcauaucaaauaaaaauaaauuuuuuuuuuuuaaaaauggagcaacuccaggccuguggcacacgccuuuaaucccggcacucuggaggcagaggcgguuggaucucugugaguuugaggccauccugaucuacaaagccaauucuaggacagccuggacuacauaacccugccucuaaaagccaaaaauaaaggaaaguggagcaaccuaaaaaguguuuguggagucauuuugcugcugauugguucuuuggucauugacaaauaauauuagguccuugaaacuugguuucuuacucuguaaggagauagauagguauaguacaugcuuuguagaguuuaucaggaguaaguauaucuguuguguaguguuugacacguaggcaauauucagugcuguauuguuugccuuacuauuuaaucuucccgcccuccccaauccuccuaggagcugaaguuccucccaagaaaugugcacgaguacagugguuugucagauuccuugagauuccugucucuaaaaggcacuuguuaggccgcaguccuccugcacaggagauauucugguaugacuguucugacugggauaacaagauuaauguggagaccaucauuggcccuguucagguucgugccuuaaauccugcuucuaucuuuagcacccacacugcauggcuucagaaauauuacuaguucuaauuugaauucuguucuaauuaucuguuuggcugcuugccccagcacacagauacugacagcauagaacauaaugcucugggcuuucuagaggaagcaacauugggauuaugaccagaaagaagagcaggaauuagaaaaugugccuuagugagaaaugauaugagcacagaacauuguaaggcugaguacauagugaggacuucaccuuaaauuacucaguacagagagugcugauugcuaaaggcacgccuguguuccaagauuuuuugauucagggggugaccuguugagucuuauuucuagagcuguuuucauaucccaguagcaggauaaugcucucuugugagguuugucuuuggguggggaauugguuuaacaauugccuacagagacuggucugaccuggcuauagaaaucuauuucauggcuaaaugagugaaggcaggaaagguagaugcagacauugaaacauauagauuugaaaggugugcuguuuagcuuuucucaacuugacauaaagagagguguuuggaaauaccuccaacaaaucggucugugagcaagucucuggggcauuuuauuaugacuaaggugaaaagcccagcccacugaguaugcuaccuucuuaagggcccagcccacugaguauacuaccuucugggucauaaaaaauaaaaaagcaagggcagaaaacagcauucauuuuuccuugcucucugcuuaaguuucugucuccaguucccucggugaugggcuuuuaccaugacugcaagcuguaaggugaaauaaaucuuuuccuccaccaguuagcuuuggucaguguuuaucauagcaauagaaaguagcuacagcagaagggcagaggaggaugguguguaaggaacacggagaguuauaagcaggacugucauuaaagccagccugcuagugugcaaggccauuuagggaacaccaagcaacaagugagguggagccugaucuuagaaggcagugaacaguuuaagaggcaggaagguggcggcuugugccuuuaaucccagaacuugggaaguaaaggcagguagauucuaagccagaggucucaaaaccaaacagagaagagguaaggggggagaggagaggaagagaagaguuuaagucaucuggucuuggagcugugugggaccaccguuaacuguuuauuguguugagccauuuuggggaguuugaccuagauuaauagauugggggugggguggggaaacaaagaaugggcuaauaugugcuugaacugagaggauagcaagaaugaagaagagaagccaggcagggugaggauauaguccaguuaguagaccauaugccuagcauaaaugaagcccuggguucaauacacagcuguaguuguacacaccuggaauuccaauacucaagaaguagaguuaggaucagaauuuacaggagacccugucucauaguaaagccuaugagagagaaaaagaauaauuugcugggcauggugguccacaggagggaggggcuggcaguucucuaaguuggaggcaggccagggcuacauagaaagacacugucucaaaaucaaaauacgaauaauuuacauuucaucgaaauccuugaacuauucauggcuuuuuaaaugcucaguuucucagucagugugcuguacagugucugccucauuucauauaaagaugggagguuaaauaguuuucacugcagccaugauagucuuucuuagcuguguagucuucacauuuucuuguucaucucauuucugaaauucagguaguggcauuagccccagaagaagugauuccuguggaucagaaaagugaggagacacuguuugugaagcuauccuggaauaaaaaggacuuugcaccacugccaccagaagugcuugcagcauuaagggaacaagaagauaguccugaguggcaaaaaccuuuaaaagccaagauuaagaauguaaaaagcccugcccggaacacaacagaacaagaggucaaagggaucaaaucaaaucauuccacuuccaaauuucaccagacuccugcuaauauugucauccccaaugcaaagaagucgcuggaacucgaugguaagugggguuguaaaauaguuuuaccucagugugcuuaugccccuuuaugauaaaccaguucuuccucccccagcgguugcugccuggugauguuugcugccucuauaauuggcuuauucugggaugucauuguuggaaucacaaugugauuuuugucucucuuaguuucauccauuugggaguuaucccuauuaucauccuauuggugauuuccuuuuuaugcaaugcuccauuguaucaauaacuacaccuuauauucuuaacagaagacaucuggauguuucuagcuuuuuaugauugugaauagagccacucuaguuaaugauucacacugacacuugaugccucuuuaagcucugugugugucucaugccauauauauaacucaaaauggcuccucuaugcuuuuuguuuguuucuccuuuuuuuuuuucaauuuuuuauuagcuauuuucuucauuuacauuucaaaugcuaucccaaaaguccccuauacccucucccggcuuuuuguuuuuuaagacagaguuucucuguguaguccuggcuuuccuggaucucacucuauaaaccaggcuguccucaaacucagagauccucugagugcugagaucaaagggguguguuucuguuuugcuuuaagacuagacauuccugccugccaccccccucaguuagaucagcacguccugugggaaguaucaagguugaaucucauucaccuuuuguuuuuuacuagggccuaauaugcaccuugccucucuaauaguucagcuauaucuauggagggcugugauuauuuauuuauuuggggggggggggcuugagacaggguuucucuguauagccuuggcuguccuggaacucacucuguagaacaggcaggccucgaacuuagaaaucugccugccacugccucccaagugcuggaauuaaaggcauaacccuggcuagggcugugauucuugauucucauaauccuggcaaguguggaacagaucuacauguaaagauugucuucaggaaucccuccuuuaucuuggcagauauagucuggauuuaaaaagaccaaaaauaacuugggucuggugacacuuuaguaaaguacuauaaaauuucuucaaauucuggugcguuggggguggguacuguguaguguugacuugggaaaacuuaauuacugaauauuuauuuauaaaagcugaccuagaaaucaaauucuagaucaugcagaugcagcucagugguggagcacaugcuuagcaagguccuagguucaauucauagugcagaaauauuaaaauaauaaguaaaaguuguauacauuuauaaauagaaaaaucguuuagaaaagaagaggccauuggccuacagaaggaaacuguggauuaauaccaaaaaugaauaacuuccauuguauuacuucuguaacgucaugagaugggggguuuguauuaauagguauaacgucugucucucuaggcuuagguuuuaccaggaagccuaacacgagguggucaaagaagagcucgugugacuccuuggauuaucaaaaaacaucuaaaagaagagcagccuucucugagaccaccucgccuccuaaaaagccuaauaaaccucgugaaaucaagcccucuucagcuuuggaaacucgaguuaaaaauggacaaacucaaccuuuuugugccaaaaguagugugguucugagagcccggaacccagcuaugacgaccacaaagcuugguguggacaacacacuuagcccuaucaggaauggguugagaucuucaguggugcccucugggggucugacaccaguauacauuaggagguaagcaggaguguugcccccugucaugguuaggggguaugcaggaguguugcccccugucaugguuaggagguaugcaggagcguugccccaucgugagcuacuugagauacguuauguggugagaaaagagugcugcagagagacacguacuagccucgucuaaccagacugaggaucuuuccuaagguuucacaacagagcucuaggaaguuaugcuccaugucucuggccuugggaauguguucuuggaguuugggugugguagcguacaccuguaaucaggaggcagaggcaggacuagcaugaauucaacguuagccugaacuacauagugacauuaucuccaaaaagaaagacaugcuuuucuuuuccaacgucauuugaaaauacugauacuuguuucuggaacuauacugcuucauucacaguccuggauuucauguguuuccugugacucuuuggcacaauuuaaugaucacuuuguuuuccucuucuuuuuuugguuuuuggagacaggauuucucugucuagcccuggcuguccuggaacucacucuguagaccaggcuggccucaaacucagaaauccaccugccucugccucccaugugcugggauuaaaggcgugcacuagcaugcccagcccgaucauuuuguuuucuaucaaguugguuuuugauuuuuauuuuuuuaaccuggaaucuacuauuaaauauaguauaaaaaaaaaaagauaaaucuaggacaagcuuuauaguuuggcacuugaguagauaauuguaagcuuagauuuuuuucaaaaccuacuuuauuuaggauuccuaaaugcuucaaccuucacuucuagcccacugaccacagagguaguggacaaagaagguuaacgggaaaaggacguuguggaucuguuuagaaguagugccuugagggugaucacacuguucguugucaguccacuucaauagcaaacaccaaacacuaaaucaguagcagcaccaugagucauggauguggccagaaucagcugcaauacuacaggaaguucuuuaaugaguuucucucuacaaaguaaagaccagucaagcauugcacgggguagcagugcaagaguguccucugaaauucuauuuauauguggauucuauuuauguucuuucuaaacaucaggggcccucuuacagacagcuuccagaaagacauuacaugccacaacugaguuguuuaaaaaaaaaaaaaaaagaaaagaaaagaaaauuuccacuucagauaauguuguauaauaaaaauuugacagaccacaaauagcaugauuuucaauguuuucuuaaguagaaauuucuagcaccuugcucauaauaaguuacucaauacauauuuuauacugaguguauuucugcuaacuuugagacuuuguaaacaugacaaauaaaaaagggacaaaaucuuuugaugguuaguccaucuuguucuaugauagcagugugauaagucugacuuaaaugauguguuaaaauuuuggaucuuagccucacaugguggcacacgccuuuaaucccagcacucgggaggcugaggcagaggcaggcggauuucugaguucaaggccagccuggucuacaaagugaguuccaggacagccagggcuauacagagaaacccugucucaaaaaaccaaaaaaaaaaaagaucucuuuuauaaguuuguuagcaaaguuugaugaacucuugccaagguuaguauaaaaagacuagaagccagugagaccuaacuaucuccagcacauacuuuggauccuugcuucccgaaaugccuuccuauaacucugaugugauaccuugcaggaaggcaaaagaacaagaaacucacaaagaacccauccguacuucucguguccauagaaagaguucucucuugacuuugaagcggauuaggcaacagcuuugguaagacugcccauuaaaaagcaacaaccuugcucccuucugugauagcguccuguaccucccuuaaugucacuucuauuugaaggccaguacauugauacucacacuuucaccuagcauuuuguacaagugucauagucugaaagggacuagaaauguugaccuggccuuguggcuccuuggcucaugccugguguuucagcaagaccgggaauguggaaugccugaaagcauuaauuuugauuuuaauagaccuuuuugaauuugagcuucugaugcugaauuuugggaagaugaacauuucuaauacuuauuuucucaugaauaaaauagggaauauauuuuguugagggauuuaguggaauauguaaugccuauaucagaaaugaaacaaauuccauaucuccugguggugggauaggcuggaauaccucuaaagcacacuuuaugcagugauuaaggccuguauacuaaauaacagaaaauaauuagacuccaucacucagucuucuagauggugaugacagggaccaagaagaggaagaguccguagacucugagagugaggaggaagaugaguuuauuuccucccucccaacaagaaauucccuggggcaguccaggacccggcagacccccuccaagucaccacagaaaaauguaagguucuuuuggguuucuuucccagugguaugucccucuuguaugauaaagaaugguaaugccaagaccaaacacuaacaguuggauucuuagcuuauuuaagaaagucugucccuaagaggagcaggccuacaugaauuugaggacugaaaauuagucuacuuaaagaugagcuuuuuacucuuguguuauuuuagaagacaguguguugcuauguaguccaggcuggucccagacuucaagcaugugcuacuacauguggcuagcucgaggugauuuggguucaaguuucucuuaagggucagagucaaauggccaagagcccagccuccugagggaaguauagacacugacauauucugguguuugcauuucccuuggcaugcauagggaacugaagcccagguugcacuuaaugcaacugagaaaccaggagugcugcuucaguguggcaauaacuaugcaauagcaaaauggaaggaaguucuugugggaccguagcagccuuaaagauguuggaguccucuuguacagagguggguuugagaaaaaacagggcaaaacauaacagagcuccuuagcguacaguuaagaaaugcucacuuagauauuguuuuccauuuuuccagaucaagauggagcugaggcugaaaucuaagaacaggcucuagggaagggagucuaguagauccuauuugaacgagagccacauuuacuguaguaugugugcaaaaaguucucuguuacccugggucucaccuggaacgucuuguagacuucugguacuuuuccuucaggugcuguuuucucccaauugaugaaugaccuuuuaaacaauuagagucugcacauacuguagcuggggaacaauuggagcuaugacuauuacuucacuccuggaggagaaaugagacaaagcacuggucuguuccauagaguaauccucaagaaagaaagagccucuggagcuggggaaauggcucaggguuuaaagaacuuugcuuucccagaggaccugaguuuaauucccagcacucaaugccaauucacaacugucaguaauuccacuguuggcaaacuaaguguucuuuucugaugucuuuggacaccaagcacacacaugguacacacacacacacacacacacaacaccccugcacaugaaauaaaguuuuuuuguuuauaaagaguaggccuaugaaugagcgcagggacagggauuuguaguagaaaaaucugaugaggcuuuuuuuuucuuugcaaacugcuagguuauagauggaagaauaccugagucaaagcuuacccauauuuucaaauaaaaagauuucaggaaucacauaugaccuauggcuccucuccccccaccccccagaguagcuugugauuauauauuauauauauauuauauauguguguguauauauguguguguauguauguguguguguguauguguguguauguauguauauauauauaugcuuugaacuauaauuuaguggcagaucaccuucauaauauauaugaagccuugaggauuuuguuuauuuuugagauugucuaauuguuuaucuuugccccaugucugcuuccugaguccuaggauuuuugugcaccaccauuccugcugaauaaucuauauguuuuuauuuccucaaauuaacuauuuuaaucccaauucuauauaaauauuagagaaaggggaucauguuuggacugugaacauguuugaugugagcggguagggauagaggaugaguaauuuuuauuuuaugcauguaggagguaagacuaccuuuugucuuuugccaguucuggguaguuuuguuuuguuuuauuacaaccgauacuuucuuuaaauacagccuaaaccuagaacaccucaucgugccacuccucagauccgagacagaaaccuggcuguccaggagccagcuagugcgcuggaagaggcacggcugagguaagcuacucagggguccuguuugggguagacagcagugauggggccuucccuucccagaaauuggagguugguugagccagcacuauuaugucacaggacuccgguggagucagcuugucagauuaaagucugaaagcuuucucaugaggaaagaguuucaaggaaacuuacucccggaucuuuggcuauuccccuaacccauaaaauuaauuuuccaaauccacauuagucuaguguauggaucuacgugcacucucuauaguauuaccuuauaguaaaugccuuuuaagauuguauucuaacauagcuaaagccuuuuuccaguguucuuagacuccagauagcagcaaagagcuuaacccauucaguaacuaauuaagcucuaccauaaaacaauaaagcaccugcuauuuacucagcugucuguagauagagacuaaaagucucacugagauagaaaucuuuuacuacaggcuacauuccaugucaaguauaaguugauauacuacccugauaagggggaacucuccagacaggauaaguuuuacuagaccuaagaauuuagagcuccugauaacacacuacucuuaaggccuaucaagaguuaacaacccccugaugcuuuuaggcugauccuaggcagggcuuguuaucccuaauguaaacauuuaauuagucccugcaaauuccuuucugcuguaacuggugaauuucaguguaucuugucuuuuugugauuuguauccucugauaauucguuguaauauaagucugaagcucaaccagaacauuacauucagauucaacaccucucuuguguguggcugauugucauuuucauccgacuucuuugcccaucugccuaaaaaaaucccauuccucgaagaccagggacccagagggucuguggcacuauuauacaugcagacggaggacaguaugacaagcaccuaaacaaaaaccucuggcugauggaugcacaggaaggaagcaccuauagaguccugcugccaucgcaucuggggugggagcugucucuaugaguggugccccuuaguuucagagcccuaaagaagaauucuuuuaaaaugcaggaaccuagguccugucagacaucaagauuuuuggaaagcuguagguuugagucuacccgagugguucuguuguagaagggggaaacuggguggggcaucguagagagagaugauaagugaagaauucccuuuuaucauauagcuuccauauaggaauaauagacgggucuuuucccuucuauuggguagauggugacagacuuucaggccuuucuguucuaucuaccaccaacuguagguugcauguuucugcugugccugacucucuccccugucgagagcaggaauuccaagacaucuacagcuuuguggaaaguaaacuucuugaugggacuggagggugaguagugcugaguggacaggugggcguaguaagagcuccgucuacccagggugugugguaagcagagccauugcuaaaccuaggagaguagacuucugcccuuggaagccuugguaaguauaagguacuggguuuaauccccagcacuacauaaaauguagaugguguugagguagaagcaggaagcucaagcguucaaagccauucuuggcuacauagugaguuugaggcuugcuugggcuaugugggauguuugucucaauuuuaaagcggggaggggggggugaccuuuggagaguaagcuugcacuaauauagccuugacuguagaaugaauguccucuaacaggccuaacugaccaauuuccuauaguguagucuucacuacucuuacuugcaucucaggggucuugcucuuuuugaacauguggauggcauggauucagccuauguguauuguuuucuugcucuagguguauguacauuucuggggucccugggacagggaagacagccacugugcaugaggucauacgcugucugcagcaggcagcagaaacagaugauguuccucccuuucaauauguugagguuaaugggaugaagcugacagaaccccaccaagucuaugugcagauuuuaaagguaggcuaaguuauuugggguuuuggggaaacaguuccuuagaaacacauggaaaaggaaagaauuacuuaauuuuaugugcacuucacaaauuuauccagagguggcaaaggugaggcaggcagacuuuuuagagguuagugauuacaugccaacauggaaggagccccuagcucacagauggcguggagagugucuuggauuugaauguaagccuuguucuuucauucacugguaaccuuugaacagauaauaucccgcuagguaaagggacuagaguuagaggcaggguauaggaaaugaguagcuucuucuuguagacucauuacucuuuacuacagcaguugcuuuucccuugugcagaaacugacaggccagaaggcaacagccaaucaugcagcagaacugcuggcgaagcaauucuguggccaagggucccagaaggaaaccacuguacugcucguggaugaggugagguuccgggguacucgucugccucacugccgggaugcccaagccauguuggggagccggcaagcagcucaggggggcaggacgcaguacauaaugggguuccucaguccauguuuucuugagugggaaauuggagucugggacaauugccgugguucucagccuccuguguaccagaugcugcuggguaccacugggaguugggaacggggcuugagcuuccccucagggugucugagcccaggacugugguggaaccugguuugguuccgagugaguguuaaagcagaggucuuugcuguggcaauccuugaugaagagguggucuuugcuuguccaaacgguuuuauuugaugguggauguaaaugcauacauccuuacucagggugaaccaggcauuaaauaccuuucucgggaagaggugcccaggaaggggaucccaucagcugaacuguuggggccuagcuaaaaaccucagaacuccagggcuuuaugcuaugucacugauugcuaugguccucucaauggggugucuuaccugcuccagaacagcuagcgcuuggcagggagcuggcuccacuccugcuguucucaauucugagauucccuggagucugagccuguuuggccuuacccaguccuucugucugguggcauugucuacuugccccacugugaggugccccaggaguacaagaggaggaguggcugcacagacucacucucccagaagcagacaguguguaggcaaaagugcuggcuccuucuguaucaacugaagccuguccauugauucucuuacggacuagaaagugccauguggacagggcgugcacucacucuguagugcaggcuaucacuuuaugugcucuggcuuggucucugagugacauuguauguauauugucuuuggcagcuugaccuucuuuggacucacaaacaagauguaauguacaaccucuuugauuggccuacucacaaaggggcccacuugauagugcugaccauugccaacaccauggaccuucccgagaggaucaugaugaaccgugugucuagccgacuggugaguccagggugcucugcaaaaaugaaaauauaaagcacuaguaaauacgauuuuugcuauaacuaucauuuuugugcuggaaugagaaauguugcuugcccuuuucuauaaauaccauaccuuggcuuucuggucucacaaaguacuagaaguuuaguuacuuuuaaaaaauaaaaaguauuuaagccugccaccucuucgguacuuagaauaaagcagagaaccagaccaacugucucugccuucgugggcuuaugguuaguuugucaggaagcaccaccaucagaccgugaagaacguggugguaagggaaggugggagcugugauuuccuuacagcaccucugucuucuuggaagauucuaaaaaaaaaaaaaagcuuauaauagaaaacaggauagguugguaucuacugaccugcaagguacccaggucaacuaggcagcagcugaaaggagaaaugggaagaaaguaauagauuguuacaugggacuuaaggaccaagcuugaggaccugugaacaauuucccuccgcaaucugucaucuugugucuucagggccucaccaggaugucuuuccagcccuauucucacagccagcugaaacagaucuuagugucucgacugaggaauuuaagggccuuugaggacgaugccauccagcugguggccaggaagguaugucaucuucaagaagcuccugcuauaccuucaagccauucagcaagucccuacugaacacccacuguguguguccugugcuguaugcucugaaugaagaaaacguuaggaaguacuaugaaaauaccaaaggguugagggugguggcacuugccuucaaucccaugucuggcaauuccaggauugaguuugagccucuucugauaucuaugggaaguucugggucagccagggcuaaauuugugaacuacugugucaauggauggaugagugggugggcggauaaaaaugaagaaacaguuauggaagacuaguaugauucuuuagaaggccacgaggaucaugggcuuauguacaagcuaaccugaauuaauacaagggacaaacuguuuuguguuauuaaagggauccuuuagagccauguaggaaggaccaaaaccccgaaauaaugacgugacgguauaaguucaacccuuagaaacuggucaguguugagacuuguuuauauagaaugaucuagucuacagacaagcuguaugcagaacugcugugcguguuuuuguuuucaauauucucuuucauuuuguuugggccuuagcacaagcuucugaauucacacuguucacuacuaggaugcuguuuuacaggugaggguggugcuaaugaucaaauguuugcauggcaccucuacccagaggauguagggaccuaaagaaagggaaggccaugauacuugugucacuuauuagaagaguggcuuugguauacucaaaacauuaaaaauugcugauggugacuagugagauggcucagccuuugacaguacuggcugcucuucaagagguccugaguucaagucccaggaacuacaaggugugucucaugaccaucugaaaucugaugcccucuuauggcaugugggcgaacuugaaguagaggauucauacauuaaauaaaucccaagcuuuuuuuuuuaauugcguauaauucaacuuaacagagaugaguauuuuacuugcuuuaaaggcaugcaccaucacacuucacuaagaugacuacuuuuaaugucuuagcguauuauauacauuauaguuuucuuggaaaacuagaauuuuguuaggaauggauccuuuuagagauaauucagugugguccagugacaggugaguuucugguugcuaaugaguacugggaauauaagaacugagaaagaggucuuuguagcaugaaaagaauuaaaacucaagugaucuagguauguaugacaggguauccauaucagcacuugggacagugagaggaggagugccagcucaaggccagccugagcuacauugggauauccuaucaaaacuaacaagcaaauggcaauaaagcauucaagcguuuuucaaagucagcuugggaagugccgcaguuccucuggucccugugccuggguaggaaagagucucuagaguagaugggcaagauuaggauguagugacagacagccaaacacacaagagagguguuuaaucugaauguaauuuuccagucgagcaucagacuuuuauaauacagaauaaauugcagaacaaggcacauugaauuuuuccaggugcaaaaggagugacuucaaaaggaaccagauaaauguauaacacuagagauuagcacagaugcaaggggagugacuacaaagggaauuuguagggaccagauaaauguuuacauuagagauuagcacuuucugccaggcaagcauuuuacacuuagaguuaauagccccaggguaguuaacucuugaaacgccucaagaauaauguagugucacugaccccaaaauucucuaggccucguuaauucuuaucuauaucuggagacuguccauuuucaguauaguauacuaauuugcucuuggcauggaauguagucuguaauaagaauuucuaucucagugagaauauuagacucuauuuucagacacugaauuaauggcuagugcuuuauuagcuacugaauggguuaagcuccuugcugcuaucuggaaucuaagaacacugggaaaaggcuuuagcuauguuagaauacaaucuuaaaaggcauuuacuauaaggugaugcuuaauagagugcaugugaaucuauacacuagauuaaugugguggaaauuugaauauaauggguuagggaaagagaugccauaacacugggaggaaaauuucccuggacucuuauccucgugaaacagcuuccaggcuuuuugccugacaaaccgauccaaacuggagaguuggcuuucgccagaauauccaggaggagaguccuagaaauucauuacucaugagcagcuuuuuggcauuucugccucacaagcugacuccaccagagugcccugacagggaagaaguggagaguuccuugagaagaggggcuuggaaaccauagaaggaucagcaguagcuacugacauugugcgcuaguuucaugcgccugucucaacccagggcuucccccaaauuuugucaaaggccagguuugauaccacaaaacugaggagggcggaguguggagugggugauucacucagcagacuucucugagugaauaaaguuugauuuacuggggcuggcacugccugugaaaggcaauaucauaaacucugaacucucuauuuguuugggggccagugagaaggcaaagagaaagggggaggggaucauacauauguacauacauacauugauacacauuuacauguuggguggagcagagcucuaacuaacaagcaggcuccaacaacuuuauuuuauucucagccuuuuaauaccacuuaaaacagagcucucuguguaagaaaaagauuacuuuguagcuacaaguuacauaugcuaaaaacaaucaccacaaaaaacagauuaaaaucauuauacaagaggaaaccguaacaggaugauugauuaugcauuuuucuuuugaaacucagaccuagcuaacauuucccaucucucucuuuuucucuacaaguucaacauagcugcaaagcaauaauauuugugggugucccugcccucaaggcuccucagcugcuucgguucacaagggcaguggaaauaagagacccagaaaggguucagaagcccugugagauguaugguggaugaccacacugggaccacuugucaguaggcagaucaacuuuauaagcauucaaucagccuucagucacccuaaguaaaguuuuaggggacauccaggaugagcaggggccauuggcuuggagcucugggugccuggaaugcuucauuaguguggggaagcauuucaggaaucucaggugcuggcugaacaaguuuugucagaagaaaggaaguugauccuauaaacauuccucugauagaggccaguguggggcuuagaauuucccugagcucagagaaggagaaacuuuuaaugagggaguccuauauuaugagcugagccucagaaggcuaucuggccacuggcagacaucuaccuuaauuagcagaguuuuccugcaucauugaguagcaaaguuuaagcaagccaguccaucguagcaaauuuuuuccuauacuucgcugaugacaaugaauuugccaagaaacagaucauuaucuguacaucuuauuuuugaagucuuguucagauuaacuggcuaaucaccugucuuuuuuuaauuguacacccugcaaucuauggcgcuaucccuauauaugagaucaaagaauucagccccaacccagagugauuguguucuuugaaagaaugaguguguucaaacuugucccaagccuauuguuucuuccuaguacuauuaugugcuuuuaguucaugaaagcucgcuguccuccuuuucucaccuauguaacccucacuauucuacaaaggaggggcaacauucuacucuuuuuuuuuuuuaaagauuuauuuauuauuauacauaaauauacuguagcugucuucagacaccagaagagggugucagaucucauuacgggugguugugaaccaccaugugguugcugggauuugaaccuucggaagagcaaucaguacucuuacccacugccagcucgccagccucaacauucuacucuuaauuuuaucuuuuuuagaaaaacaacuuaaaccaucucauuaaacugucaacuaccuuaacuuccuaaaacuauuuaaaucaaaucaggaguuccaaaaauucauuaauucauccaaacaguauuuuaugaaaauucaucuucauauugaucuacaggaaaauugcccaauaguauggagggucuucccgugcccagucuuacaaugcuagguaugugaggaauauagcaaugacaaacacagacugcauaucaacaucaagaagcaauccugugccuuuccauuggaguugugcaaaauauugugucuccaggaagcuuacuuguccacugcagcuccuccugcacgguaucuggcaaaguuugacuucuuucccuuccuaaucuugauuuuaauucucuuaggcauugaucaggccguucucccaaauuuacuacauacugagggaguuuaccuccaaauacacucuuccccuagcugcugguaacuguuucucggggcacacagaauaagaacccuuguguuuuguuuguuuuugagacugggucucuguagucuuugcuauucuggaacucacuauauggacuagacuggccuugaguuccuauauuuaccuccugcuuuaucaccauugccagcuuccacagacgucauauuagggcuuuagauucccuagcagcugggcuuguggguguuugugaaccacuauguggggacugagaaaagaaacaagcucucauaacaauaagcaucuuuuccaucuccucaaagacuaacaacaaaaccccacuuauuuccugaauaauaaaacgggauuucuacccguuccacugguguuaccuauagaaucacgggacagcaguuugggauguaguaauuguauuccagucaugaacauacauacauacauacauacauacauauauauaaaaaucuguguucugcuauguggcucacuaguuaccucuccuucaguucugcccugccucuucuguaucugccuguaaaacacccccacccuaucucugccccaaguccuaccuauucucuucuuugcuauaggccaucagcuuuauauuaaaccaaucagaagauaagagagggaguguuaauaauauugauguagccaucaauuuggcuacaauaccaaagucuaucugcacucagccuuguuggcacagaaaucagcuuuugaauaauacaaagacagucuuuacacaguacacaaagaugaccccaacaagaaccagugguuauuuaccugagauggcaagugcacauuagaaauaaaauauuccggggcuggcgagauggcucaacggguaagagcacugacugcucuaccgaagguccugaguucaaaucccagcaaccaugugguggcucacauccacccuuaaugagaucuaacaucaucuucuagugugccugaagacagugagcagggcugacuggauuggagagggguccuaaaaauucaauucccaacaaccacaugaaggcucacaaccaucuguacagcuacaguguacaucaaauaaaauaaauaaaucugaaaaaauaaauaauaaaaguuccuucuuguagguagcagcccucucuggagaugcccggcgcugccuggacaucugcaggcgugccacggagaucugcgagcuuucccaucuacgcggugacucucugagccuggugacuguggcccacuuaauggaagcuauagaugaaauguucuccucgucauauauuacugccaucaaguaagauacaugcuuugcugcaugcacuucugggaggaucugaggagaggucccugcguaggggcuuuagcaauuggcuuguuuuucagacuucacucguucuauccccauuuaauuagagaaagucuuaggggcaaucguaaggcaacacaauccuuggguaggggcugaaugcuuacaacuuuuauuggggcauuuauugaguacaaauacuacaggaacagacuggguuugguuuuucaugcauauaaucccagcacuugagaggcuaaggcaggaagauugucacaaguuuaagaccagcccaaguuacauagugauaguuccaggaaagucugaacuacacagugaaacucaguaaggaaaagaacaacaaauagguaguaggguggugguugcaagcacuugcagcucuuuaaagaagacucaaauuuagcucccaacguagacaugucagcucacagcugccugucaauucuggggaucuggcacccuuuucuguccugcaugcauacgccauucuuuuaaaggauacacaaacaagacaguuauguuucuucuuacugaggcaugcuccacucccaaaauucauaaguggguuuuuaauuuuauuuauuuccauucauucuuuuauuuauuuauucauuuauuuuaagaugcaggcguuaauucuagaacuaguuccuguguucgcccauuuccaaagagcauuuucugucaguuugauucugugggaaaguguggggcuuugucaggggauacagagaaugcuucccgguguucucucuucugugaggccagugguugccugcagucucuagaacucccaucucuugguuucuuuuaagaaacucuucugucguggaacagagcuuccugagagccauuauugcggaauuccgucggucaggacuagaggaagcaaccuuucaacagguaauuggucgagaguuguuuuuuguuuuuuuguuuuuuuuuguuuuuuucugucuuucuagauauggguggguccagaguucuuagacuaggggggaaguuaacaggggcucagguucuuuaguaacuggcguguugguccgguguucaguucuccaguaucacaucaaccaggcuuggugguucauacuccugggacuuugagguagaggagggaaggagguuuauaaauugugucauccuuggcucauacacaauuugagaccagccuggaauauaugagaccuugucuuuuaaagaaaggaaacaacaacaagacccuggagugaccuuuagcagugcuacauuccagaugucacucugcaggcucaaacucuuaaugcaugugaccacacgacaugacuuucucugcaguuaauaaucauuucauguggaucaacugauaggugcaggacaucucguaacacugaagguuuaacaccugcaaucucugcacuuggaagaugaggcaaggggauugacaagaguuugaggccagauuggucuacguagugaguuaaaguccagugugagcuacagacuucaagaccuuuccuuuaaaagacuagaaaagacccgggcaguggugguacaagccuuuaaucccagcacucgggaggcagaggcaggcagauuucugaguucaaggccagccuggucuacagaguuaaguuccaggacagccaggacuauacagagaaacccugucucgaaaaaccaaaaaaaaaaaaaaaagaaaaaaaagacuagaaaagaaaaagugucauaaccugccuauugucacauagauaaaugauagaauggcaagguucagaugagccgugcccuguucuacagcuugcauuugugcgagggcaucuaccgaugacacauuugguauccaaggcgugaaugacuguuuugucacugggucuuaacuauguagccuugguuguccugaggcucacaaagucuccuggccucuggccucugccucccaagugcauggacuaucaggugcuccauuuuugcaaaagaugaucagauaaaagcccgggauuauugucuuuccuaaccuuuacuucacuuucacuuuugcugucuagauauacagucagcacguggcucugugccgaauggagggacugccauacccaaccaugucagagaccauggcugugugcucacgucuggguucuugccgccuccuucugguggagcccaguagaaaugaccuccuccuucgagugagacucaauguuagccagaaugacgugcuguuugcucucaaagaagagugaaggacuucacaaauuucugcuuugucucagagcuuuauuuuauuucuucagaacauggaauuacagcagaauauacaggauggaaauuguuguuauaaauuuguuauuuuccauuauuuauuuugcuuuuuccaaaguguuggagaaguuacgguaacauacuauguauauaaagauauguauacaauauacuuguaucuauauaaaauaguucugggagaauuuguaugaaguuagguauacugguugccucugagaaaucccugguggguuggucagagguuagaggaagacuugacuauaugcuaugauguauuggauuuuaaaugauacaaaguaaaauugauuuuauagaaaagaacugguaugguuuggggugcagcacacuaacaaugcccuuugcgugcagguggcacuggguucauuucccaaugauaaguugaagccuuuagcccuucaucgggaacaucauguuaucucagaauuugagaggcugaagcagaaggauuaacugcuggcaggcaagcaggcacugaucuucaaaacaaaguuaccgcuuauaaaaacaaaucuuguugacagaaaguagaggguacuuaaggaugaugugcuauggacugcagaaagccuguuccccacacugcaauaaauuggauauggugguacacaccugcaaucccaaaacuugggaguuagacacagaaagauuagaaauugaaaauuguccucagaaaagcaaguucgaggccaguuguuugcucuccguugcugcaacauagacauuaugacuaaaagcagcuuuggggcaaaagguuuaacuuggcuuacauauucuggucacagucuuaucaccaagcuaggccguguugagaaaaaaggugggagggcuggguuacauauaaaguauguucaaggcgaccugggcagauuaggaagacccugucuuaaaugaaaacuuuuaagauggggucuuaaguucccuggaugcucuggaacuagcuauguagaccaggcuagcuucagagcuccaccuguugcugccucucaaguggggauugaaggcauaugccauuccuugaccaaacugaaacaaauuuaaaaagauaacucaguggaagagggcuuguugacaaaugagagagguucuggguucauuccacuaaauaaauauaagguuaugaaccuugugcauucaacacauuacuauguccugauacauagacugcugcuugggaacuucauuaaaugagugagcugugauaaugucugcuauuagucuucaaauaguuuauaaauuuguagccagacuugauggcaaugaccuguaaucccagcuacucaaaaggcuaagacaggauuauaaacauaaggccgagacuguaacaucgugagcucaaggucagccugagcaucuaugugagacccuggcucaagagggcuggggaugcgggauagauagaguucuguguacggaaauugaccuggcaagcuagaagcccuagucuaucccuuuuauuacauacacauucuaauaaaacugaguugagagucccu

SEQ ID NO: 2025 - RNA, 20013 nt, Mus musculus
uggaauuucccgcccccucgcacaaguuaaaaauacuggacaacagcauuucauuguuagauuucuguuugggauuccaaagagacucgguaagcccguuucgcugugcacgcgucugugucuugcaggcaagcacuuuggagaagcgcuggacccuuccccccacccccacucgcauucgcaggacuuccacucaggcaugaugcaaccaacugacauaagguccaagaaaaccaugcuuggggccuuuuauugcacaacugaagagguaguccgagggaacugggacauaagucaucucaagcacguaaaguguaaagcuucuuuccguuaagucuguugcuuuuuguauugggucgaguuacuaccuaacaagucaacugccgacuuucccuccugaugagaguccauuagagcucaaugcuuagugaaggacauccaagguguacaacccgaacuagaccccacaccacccuucuguuaaauccaagacaaaagguaagcgcagacacaaugggacgccaaggggaccgccgccuccuccaggaagcagcccggccgccaaucagaauagugaggugcgcgaggcaugcugggcuuuguagucgggaggcaggcgcgcaguugccguacccacccccaccccgccucccucccgcggucgaggcggggccgugcgucacgugggccucucccgccgccgccgccgcugccgccgcggucuuucucugucucagcugaggcagccaucuugcucuugccgcgugcugguguuggaggacccuccccgcugcaggugagacccccggcgggcccgccaccccacggccuccggccgcugcgcacggucuccccccgcccuccccucucgacacccgccguccgcuccggcugccacuuccgccguggcgcggcgagugggggcggaggcggccggccgggccugucgguuacgggcggcgcagcugggggucggcaccugagggaagguccccagcaccaccgcccgcuguggaggagccgggcccgggcucuggccgcucagguccagacccaggaggguagaacccuccucguccaucacucauuauucacaacaacagugucagacgcuuugagcagcagaucuguugucaucucuuuugcuccucccaaacugagguuagcacccggccaccaagcucuuggggccgaacuagguugcagcgcucuucacuuuguaauagaagugcuuguuuacaagucucucuuaauuuugagacaguuaccuauccuuauaaccucuucacacugccugaugauugaucgccaggcacaguguuacacagcuggugaauggcgguuucaacuuccguucccacguucuuucauuauaccuaauuaguggcccucuggaagaaugguaacaauaguuaccaacuacugagugucuuaccugaacuugauaaucuaugcuuuagccuucaacucaguaaaguaugcgaugguauacuuuuuuuaaugcgggagaaacaaacacaaguacaaagaaccuaaauaccuuuccaaagcccuaagugguaaaaccucacauaaaaagucagggcugaaaauucaaauuauuuuuaucuuuguaaacaugauuaaaguacuuggaugcuuauaauuugggcauccaauaaauauugauucaucucuguauacucuuuuuggaaguccuugagaaaagugcagaaaggauucguggauauucacucagugaucauguggcccuugaaagucauuucucccuuugggacacagagaggaacuuuccaggccuuccaggcagcuaacaauuuuguuuauaauuuaugcccugcugcacuaacagguaucugagaugaccucacacuugaaacaagaaugacagguacauuaaagauauuaaguagggauuaaaccaggugaccuuuuaggucucaggcugagucuaaaugucuuuuucuauuagaauccuacacagcccaacuugcuguuggacaaaaggccauauuucuccuuccccugcugcuuuaagcuucuagaugcccuaaaauuaugucuuuuccauaaaauacuccuuaggaauaagauuucuuaauuauacugaccaccugaaauggaauuauucuuucauuuacaccauaagaaagaguuaauuugggcuuugcuuuugcuucaaauaagucuggacuuuuugucuuaucuuuccaacugccaacucuuuucuuuaggaauguuaccuaaaaugcaaauagucacaaagggcuaguccugugcuuaguuuuaauauucucuccugaccuccuuuuugcaagaaauuccuuaagugcuguguuauuucacuauaaguucauggcuguagcucuuuuguggauguuugaaugcaagguugagguuucuaucagcacauuucagucugcugcacagcuaagauuggcacacaccuaaaagacuguuuggauucuacacacaacucccaugcaaaagcuuuuaccugcuugaccauugugauacaauguugaacaaagugagaagccauagguucuaauuuuuauuugugaaauggauucagccuuacagcugcgauauauacaggucaguucuuuaaguucagcuucaguacagaaugguuaguaauuuacacgaucuuuugagucuucuuuuuuucuucuuucaaauguaaagaacaggauccuuaucaucugaaugaugcaauuacaaaguuagaauuaggaaaaaaaaaguuuaauaauagccuauucccuuauucccuccuucacaucucaguaaugaucuguuaagccacagaacaagucaaacaagacuguuaaauuagcuuuuuuuuuuuagcgcaugguauguuguuuuccaaagcaggagugucacugucaagacuagaauucaugauuuuagaauguccuuagaaucuucaaaggucaaaauuugcauagcuuauuuuuuugucuugcccaguaacuuaauguaaccaugauacaaauguaacaagauacuauuugaucuuugucaaauaguacagugagacauuuugccgcugaugcaauaauaucuuguugagugugacauuaucagugcaaggucuagaauaaacuggggugcugcagaaucagugaguauuauuugggaaucugguagcuucccacuauuaacacaucugaccuugaauagaggacgugacuuguuugcugacagccugacaacuccauuauucaguuucuucuuugccuagccuuuuuuuguaugugccauauuuauucuuuaaaagaaauacagaaugugauuccagagaaaaugaucuacuugaagguuuugcuaauaacauuugguaacuguucucugcugugaaagucucugcaagaaaaagccugcuugccugaagagauuucauaauugguuagguuuuucugaaugccagagaacugagucauguguuaggaaugaaucuuuaaauaggcaacuuugaaucccauucauuugcuauuuguauauuugacucccaugugguauuuaauuuuuuuaaaaaaauugguuugugaagcuagaacaaguuaccacuauuuaagaauagagacgguauugauaugaccuugauguuaguggauauuauauuaacucagugaagcaaagcuauuguuuguauaaaugauuuuuuaacuugguaaagcagugaauuuaacaaaucuguuuuccccccccuagauuugcaacagcaugaaucaagaaaaguuagccaaacuucaagcucagguccggauagggggcaaggugagugauugccggagagugucacuuccgugugcggugguccuugagugcagaaucuuuucagugauuacaaucagaccacauugcugugugugugugaugggaauuugucuagaucuaaagcagguaacuagaagaugcuucucuccgauggugccaugaaaauagaccccuuaguuugaauccucaacuuuuuauuuuggugugugucuuuguguguacaaauauaugugggcauuugagcauaugaaagugcacauguauguggaggcccaugggugaugugggcuggaguuuuucucauucauucuccauguuauauaucaagacagaaucucuugccagcugcuucgaaggguuuccuguuuuccauuucccacaugcagggauuguuuucccuuuauuugugguccaaggcucaaggagaauacuguauguacccucaucuuugcacacugcaauauuugcaaaaagagaaagaacaaaacuuaguucauacauggaucgcuauguagaaaaggcagagaggacaauauuaacagguuuuaaccaugcuuuucauugaucauaaccacagaucuugagcagagaagggaagaaguaacuaguacuuuuuuaaaaagauuuauuuauuauuauauguaaguacacuguagcugucuucagacacaccagaagagggugucagaucucauuacagaugguugugagccaccaugugguugcugggauuugaacucaggaccuuuggaagagcagucagugcucuuaacagcugagccaucucuccagcccagacuaguucuuuuucucugauaaaguuggaugaugucaguucauauuaacacacggauagccacaauggucacauuguagcauaugcaaaacucgaguuuuguaacaacuagguaagaccuggaagggacugaugaccccaucacaauuacauuuauuuaucuauuuaguguguguguguaugugugcauugauauguauguguguguguguguguguguguguguauauauauauauauauauauauauauauauauauauauauauauauauacacacacacacacacacacauggaugcuuauggacacauggcaugugugugggucauagguaaacauauaucuucuguugcucacugccauauauauacacacacacauauauaugcauauauauguguauguauauacauauaaaauaugaauuauauauauguaaugugugcacaugcacacacagagaucugaguacaguuugcaggagucaguucucuccuuccaccauguggguucuggggauugaacuaaaguuaacaggcuuuaauuugcugagccaucucaccaguucccccccgcccuuuuuuuuugagaugguuuuucacuaaaccugaggcuugcuaauuuagacuggcuggugagugagcuucuagacuccucugucuccaccuuucagcgugguuacagguguacacugccguccuuaauuuguauguugguugcccauauucaguuccuuauguuuggcaccagcacuugauuuacugagucauauccucagucccauauuuaucuauuuuuaauguagugguugguacacgcauaaauuuaucuacuguuagcugauacuuaaucuguaccaggcauaguaaauaaacacguuucuuguuuuuuugcuuuuuuguuuuucaagacaggguuucucuguguagcccuggcuguccuggaacucacucuguagaccaggcuggucuugaagucaaaaaucugccugccucuaccucccgagugcugggauuaaaggugugggccacuacgcccgacuuuuuuuuuuuuuuuuuuuaauaugaguacagaugguugugagccaccaugugguugcugggaauugaacucaggaccuuuggaagaacagucagugcucuuaaccacugagcuaucucuccagcccccacaguggacaggguuuugaaggcccuccaaguuugaggccagccucaccauuuuagaacuggucgcaaugugaaaaaugggaugaaaugggaucaaauagagaacagucuagaagcuguugcuuacaacaugguacacaaauuuagggguuggucugacauaauuuaaugaaagauggguguggggagaugaagggcauagagaagaauugaggguuucccagguuuuuauuuaauguaggacugugguguuaaccaaguauaaaaucuagaagauaaggaacuccuauuuguggacuguuagaucuauaaacauguugaacuuucugguuuuuugggagaguauaggagggaacagagucucuaaaguccauguuguucaggaauugauauguugacuagacugacuucaacuuuuuuuuuuuuuuuugagacaguguuucucuguguaacagcucuggcuauccuggacucacuuuguagaccagcuuggccuugaacucacuaagaucugccugccucugccucccaagugcuggguuuaaaggcgugcgccaccacugcccggcuuuagccucaaacuuuuaaauaaucuugccucucugcauuuuugcaugcugggauuauagguaauuuaguugaaguacucuuucaauacaguagcucugcaugguggcacacccuguaaucacagcacacugaauuacagacugccucacuagauagcaagacgcugucucaaaacaaaaauguagagcaagcaucuaagcuagcccugaguuaggaaugcuucacaaauaaaugaccaucuauguaaagagugaucuguuacaacugugucagcagagccugugcaaccagagcuuuuuucucccacugggauugcuaagagagaacccagcuuucuucuggaagucccugaggaccucugcaggagcuauucagauacugggacccuguuugcuuuuggucacucuuauuucagaaacuuaggcuuuugguaguauuucagcucugauguugccuacauuuuuuuaaaacugacccagaaaauuaauccauuauuuuaaauauuuuuuaauggaaaauuuauuuuucuaaauauauuuuguguauaugugacugugccugcugguaucaucaggggccagaagaaggcauugggaccccugaaucuggaguuaugggcaauuguggguugcaugacaugggugcuaggauuugaagagcaacaagugcucuuaaccacugagcaauauuuccaccacugaauuucuaguuaucaguagagaaauuaacuuuuucugacuuaguaaauaguuauaauucuuaacuuuaggccaaaauucugacugaucaucauauaucacaucuaacccaucaaguuauuucugucucuugacauucugaccauccucaggcacuaccacaacucucaucucucaccacauuugugcacuagcccccugacuggucucauagccuccagauccaguuuucauguaguaaccuuagaugggaguaaacaggucaaaugaacugucaguagcuuccuguuauaauaagagugagcaccuaccugugagauucuaaucuacaugguguggcccuugugugccugucugauuucauuuccuucucccuuccucuuuauucauucugcucuggccacaugggcaccgcucugucuagaagagcaguuuacaaguucugucuuguuugguucugcuuggaucuuuccuuccugaucgugggucucauuucuaggaagacagugcuuuguucuuuuaccauuuugguuuguuuuguuuguuucuuaucuuuacccuguuugaaaugaucuauuuaaguacuuguugacauuuuuuuaaaauuauaggaauguaaguaaaaucuugauguuuucauuucuagauucuuagacucuggggaacucaguaauaggaauuuaauucucaauauguaguagauccugagauuucagaccauccuuagauuuuauuggcaggggcugucagggauucuaugaaaguauacaaugcuagaaaguuguuauuaagcauacuaaauggccuuagaguuauacagucuguucuuuuaacaaacaguauuuugaaauagaaucuacugaaaugauaaaaucuagacauuaaaaaggaguaauaacugacuacagcugcccuuaguuguuggcugaauaucacaacucuguggucuuguuaaucacugcuauuugguuagcuuucuccaugugaaguuuagauuguggccaggaggaugugguugcuguagccaauuguuaugcuuaguaacaccucugucugauuauuuuccaggguacagcucgcaggaagaagaaggugguacauaggacagcuacugcugaugacaaaaagcuucagaguucacuaaagaaacuggcugugaacaauauagcugguauugaagagguaugaacacuuggaaacccagaucauagagaacuagcacacgcacaggucuucugacuuuucacauuaaauccuagcuuggaagacucuagugcuucauguacaugucuuugaaagaauguagugguugaguuuacuuagggugaaauuacguuaguaggcaguuagggcguuucuucacacucucaggcuuaaguauuugcaugcaugacaguuaugaaacugcucuugaacuucaguguaaaguaagauuucuuuuucuguuuugcuuuguuucuaugggccacucuggacuggccucuaacuugugaucuugccuccuuaguauugguauuuaacagaguauguggccuggugccuagcaaguuguucuuucuaaugauguagaaguaaaguccaauuuuuuuuucaagugugacuuuuauuuuuaccauaaauucaucuuucuguacuauaaagucucuauuaugucauccaaaaacaucuagcaguaguuuucugugaauuugauucccucccugucuuucuuccuuauuuuuauuauuuauuuauuuagguauuuucaagacagugucccuggcuguccuagaagucacucuguagaccaggcaggccucaaacucagagaucugcugccucugccucccgagugcugggguuaaaggcuuguuuuuauuuuuuuaagcuauugucucacuggauaguugccuguuccucuauagugcauucagcugguuggauuuacuacucuuucaaaaagauaacuuuuaaaagucuauuguuuucucauugcugugacaaaauacuugaccaaagugucuugaaggaaggguuuauuuggcuccuuguuugagagugcaguccaucaugguggggaaggccuagguaggaucaugaggcccaggccauauugacugggucucgcuguagcuuuggcuggccuggaacuuacuauguagaccaggcuagucuugaacuuagagaucucccuaccucugcuuccagaaugcuggauuuaaggcauguaauaucccaccuggcuaucacugagguucuaauaauaugagcaucccagagacaaggcaugacguggcagcgcgcuccacaugcaugcacaugcaaaugacccaaauuaacuuccuuuaaaucuacauucacaaucaguauugauaaaaucauagaaaauguacaacacaugcacuuucuccuuucugcuugaggugacagcguucuuagauaaaaauuaggcugugauuugcauaacuaauuuuaaguuuuuuucugagcuguugaaagcuuuuauauauuguccuuuaaaauauguauuuauucaugauggagagcuggugauguguggaaaugaaagaaaaaauuuugaagguugguaauugucuacuauguggguccuaggagucuuacucaggucauuagacgugcagcaagcaccuuuagcuggugagcugucuuacuggcuccagagcuuuuauaauuugcauugaccuaaaauuucagagaagcuggguguggugacacaugccuuuaaucucaacacuuggugggguaggggagagcagagacaaguagaucccugacuuugagguuugccuggucuuuagaguuagucccaaggcagcagggacuacacagagaaauccuaucuugaaaaaaaaaaaaaaaucagguagucucagugauggauauauuagagagaaaagacacccugaaaccuaauuuuaacuuauuuuggaugauauagcucagugauaaaguacuugccugaguucuuggguuuaaucuuaaaaacacuauaaauguuugccugaguaaaagccacaacauaaguaguaaguuacaacacagaaacucgaauaauaccaaaguuaacauaacugaaaauguuuacaaaguuuuagcucuucuuuuucuuuuuuuuuuuuuuuuuugguuuuucgagacaggguuucucuguguagcccuggcuguccuggaacucacucuguagaccaggcuggccucgaacucagaaaucuaccugccucugccucccgagugcugagauuaaaggugugccccaccaccgcccggcucuacuccuuuuucuaucuucaacccauucauagauccagccucauccauagugauauuuuggagcagauaguuuuucugucaguucucuagugcucuguaggauauuucgagguaucccaggccucuguccacuaauuguuacccccaacacuguagugguaacagucaaaaaugucccugagauggcugucuugguccaccccugugaucccaucccuuuggaguuugcacccgaguacaaguuaauaccagcuuugccugaauggaaagacccugucucaaaaacagucacugccacaaucuaaagaaaaaaauuuuuuuucuaaauauuguaagaugguucuuugaaggaaagaaaaaaauuaccuuugacugagaaacauuuguauagagaaauaaaaaguauauuucucuuauaguauagauuaauuuguguguguguguuauuuuauguagauuaguguuuugccuacaugugugucuguuagagccccuggaacuggaguuacaugcaguuaugagcugccaugugagugcuaggaauugaacguagguccucuggaaaaguagccagugcucuuaaccacuuagcuaucuuuccagccccgauauuuuugagaacauuuauucguuuuuauuuuacaugugugcauguuuugucugcagcauuuguguucacuacgugcgugccuggugcccagagaggucauaagagagggcauuaaauccacuaaaacuggaguuaugggugguugugagccacaguguggguacagggaauugaacccaggucuucugguagaguaacaagugcucuuaaccauugagccauuucuccagcccauguuuuguuuugugagauaaggucucauuauguagcccagguuagccuuaaucuuuugguagucuuuucugccacagccuccucagcugggauuauaaauuuaggcaccucaucccgcuuugugguauugacuuuauccauguaguuaucucuaaggauauguauuucuaaaugcuuguuuuuguucaaauucagaagaauuuauagcuguuuguccuacaccauagccuccagaguccuguguauguauguuauguguacauguguggggagauguaugcauguaugcaugcuuucuaucauuuucugccuuauuccuuggaaacaggauaucuuacugaaucuggagcuaggcuggcagccagcaagcccuugcaauccucaugccucccucuuucccccaaguguuagggcuauagagagcaguguaguuacucccagguuucucuauggguuuuggggauuugaacucaggucuuaauacuugcacaguaagugaucuuacucaccuagccaucuuuccagcuccuaugauccuucaaauuacaauuuauuaaaauaaauguuucauaaugaaauaaggacacaguaauuuuucuuuuggagguauuggaaauucaacacucuuauuacugagcuacaucuucagcucuaguuaguaauuguuaaacuacuaucauacugauaaugcugugcuuuguguggccaugcuucuguugcaacugaaauugucacacugaagagcuuaauggcagucaacacuuauugcaugucuacugaauacuaaccauuuugccagaggugguacagaaaguauuacucauaaccucugucauuucuaaguuacagccaugugggaaacuaauuagacagcuagccauauaaauauguuacuccauuucagcuucauagcaccugaugaacuacuaguuacaaaucagagagcugaugcuuguaguuucaccagccccuggcaucauacuuaacaaggauuagaauucuagauuugaacuaaggaauguuaaaaaccagaguugauacuauguuaagauagcuggcuuuugaucuuuucaguuguacuuuguuuuuagccuuuuccucuucucuuguaucuuccacauuacuuccccacccccaaacagcuaaugcccucaaauaaaccuguccuauggccuggaagagaagaaagaaagaaacaaacaagaaagaaaauucauaaaugcauuggauuugauccuauguuggcuaauuuguagucagugagauauauauucuccacauaucuauaauguuuuucuuucccauuugaccuauauucugagacaaguaauugucaagcuugcauagaauuggauuuuuauaaauaaauaaauaaauaaauaaauaaauguuuuaagcaagaagauggcaaaguagccaggaagccaaacaauaaguugaguaacucuaguucauuucaaauacuuaguucauacuugguucacacuuagccagcuguuugucuuuggguuuaaccaacaauacuguccuguauuucuuccucuagcaaaaagaacaauauagauuucaaaucaauuaugacuucaauguuuauaagucaagaauaucucaaauuagcugggcagugguagcacacuccuuuaaucacagcacucgggaggcagaggcaggcgaauuucugaguucaaggccagccuggucuacagagugaguuccaggauagccagggcuacacagagaaacccugucucgaaaaaccaaagggaaaaaaaaugucucaaauucuaauauugccacuuuucaugcccagaagugguuguagaaauucuuucuugaaccaugugauuuggaaaacaccauugaacaauuucccuuuacucuugucucuuaguaaaccaugggacuugaguagauccaaggcaccacccuucauacccacuguuacccucccagaccuccccggauuuuagccacuuuaacauuucuaccacagcugcagucauuuuuagaauaauauacuuuaucuucuaaaauugcuauaaauugaguuauguugccauuuguuuaaagcagcaguauugaacacguacuguguaugauacacuucaaagaaccuuaaauacaccuauuacauaauauacaauuuuaauuccagcacuuuggaggcauaggcuaguggauuacuguaaguucaaggccaggaaggacuacauagugagacuguaucagaacaaacaaaacaaaacauaaaaagauccuuaaauauagaccagugcagugcugagaaaaggaagggugcaaaauuaaauagugauguuugucacacacacaauuggaagugacuugugggguuauuuuguaauauccagggauaucuguaauuucuuuacuuagaguauugcugaaacuuggaguucauuucucccccucccccccugugcugucggugguugggaccccucugaagaagagaagccacuucccacugucacugagagcacaaggacaaggacaguucuguaccuuuaaguaguuaaguguuaacacuccugaccuuuuauauaauaagcagauagcaccaaggugacuuuuagaguggaaucaacuucaugguggaaugacauuguuuacacauuuaacuuguguaaaugagaucauacuaacccauaacaaaaaaugcagaaaggaaauacaugaggggaaaauaacaauuuaaauagcguguauucacucuucuguuucuguaaaccccaagccaguggacuaaauuaaucugaaguaaucaauucaaguugguaaaagcaggauaguguuaaagaacucccaauuauuaacaaaacauguucugguggguguguaggagagcuuuguuugcagaaauuaaugaauguggcugagaagaaauauuuaagaauuggagaaaacuguuaggccuguugguacaaaucuauagucccagauacuuagaaaccugaggcaggagaaacaauaauaaagaccagccugaagccaagcggugguggugcucgccuuuaaucccagcacucgggaggcagaggcagguggauuucugaguucaaggccagccuggucuacaucguaaguuucaggacagccagggcuacacagagaaacccugucucagaaaaacaaacaacaaaaaagaaaaaugggaaagaaggaagaaaggcaggcaggcuggcuggcuggcuauuaaacuucccgggguuccuguacauauguggugcauauguacacauuuaaaacaaaacaaagcaaaaauaccuuuauucccagcacucagaggcaagcagaguucuaagccaggcaaagauucauugugagaguaucuuagacaaaaacaaacaagaauaacaguaaacuagguugaaauuuugguaaauuuacugagcauucaaaaaaguaaaaugcuuggcugauuagauuucugugucaucuauguggguuucucagugguuauuuuuacuucauacuuuucccgccuuccauucugucuucuaaguaagagguaauugcacugauuuuguuuguguaacuaauuaagaaauugguucaugaauguaguucuacuuaagaaaaaaaaaaguggccaugaacugaggccugaguggcuauuucauaaccacuccaacaauguguacuagccagcaccauuguaauccauuaugagacucuuucucugccguauuuacugcugagauaauuaggacuauguaggauugcuacuauguaagauaauacugcuuuuuaaaaagauauuuguaguugagucuagcaugugaaauacauuguuuucugugcccauucaggugaauaugauuaaagacgauggcacgguuauucauuucaacaaucccaaaguccaagcuucccucuccgcuaacaccuuugcaauuacuggucaugcagaagccaaaccaaucacagaaaugcuuccugggauauuaagucagcuuggugcugacagcuuaacgagccuuagaaaguuagcugaacaguucccacggcaagguauguauuucaauuuaguauuuuccccuucuucccugcugucacuaagaaaaaccuaauguuaaaagcaccccaucuggaacuagggccuagcucaguugacaguccuaaccuuguaugcaugacauucugguucaguccccagcagugcuagguaugauggcacacacuuguauuuccagcacaaguucaggguuauccucagcuguauagggaaauuggaguuagccuguaccagagacuguuucagaaacaaacaacaaaagguguuuuacuuaaacugagaggauuuuccucaguagguaauucuuuuacuuuuuauaaugccauuuguguguuucauaaaacuuguaguuuucuuuuuuaauuaaugaaaugugucauagaauauucagauacaguauuaccuauugcuacuaaaaucauaaauaaugauaaucaucaauucugaauuuucagauuaguuuuuauuucauacaugucuuguugccucugaucauaaaagagccuuguauuuaaguaguuauauggucauacugcauagcuagguacuuagaucaaaauaagugguaaauaagucucaaauauuuuuuuuaguuggagauuaauaaaggauacaaaggaggaugccuuuguucaggccugucaaaaucuacauuuuguaacuuuaaccuuuucugcacauuggaaucaccagcuguucuguauauauuuaauucacguuaaacuuuuauuguuuuuaauguuacuuaagcaaaaaaauagaaguaaauuuuagguugucuguauucaacagccacaugagauuuagacaaagagaagauaaguauuggagguguucugugaagcucuuuguucucagugacuaauacucaaaugaacuuuuuguaguauuggauaguaaagcgcccaaaccagaagacaucgaugaagaggaugaugauguuccagguaaagucugucucaggccagggacccacauaguagaaggggagaaccagcaacacaaguugucuucugaccuacaccugcacacauacauacacagaugcaacacacauaaaauaacacaguguaauuuuuaaaaugaagaaaaagugauuuauuuucuuucacuuacugcauagaugacuuucagauuuuuuuuuuuuauuugacugaaugucaguugauuuagagugagauugauagugguagguuucuagcuggguauuagcuggcuuagaagacccuggagacggacccuaaucagcccaaaaagccaaggacuggaacuucaggucagaaaaaugucccuuaaguccuaucucugccauuacauaauacuaucuaagccugguucuaguaaugcuaacccucauaaaagauuacuggauagcagaaggcuaucugagaaagaacaaagacacacuauugccuucaauuugugucucgaagcacaaacaggccugccacucaccugaacagaacaaagacccucaagaaaaacuguucuggggacuugagaaauaggagacugccgccugccucauaugcagucugggucacacuugccccucgaguguaugcucuacuuuauuacaaauguaguugccugucuuuuaugcuguuucuuuguguuuuaucuaaauucuuuagaggucacaaagaacagggaauccaacugagauccucaugauaggauauauaugaauacagaagucccuuccucauucagaacuuaggaucacaaaauauuccacaaagcucuguugccugcauauauuaaauugaaaucacuaugauuaucaauauacauuguuauugcugaaaauuuuuguugaggggcuggagaaaugacucagcaauuaagagcacuggcuucuuuuccugaggaccuggauucaauuuccagcauucauaugaaagcccacaacuuucuguaaaaucaauuccaggggaucccacacccucucuuggucuugagaacugcaugcucguggcacacagacauacauuugggcacaacaccuauacaaauaaaauaauaaaauaauuuuuaaaaauuguuggcauuauaacugacaaaauauuauuaguuauuuuugcauaaauuuuaaaaaaccauuuccuuaagauugcuguuuuauaaaagucauuauuacugaaaugugcuauuuuuuuuuaucuuuucugcuuuuugacuaauucuaguugcaacuauuuugacuuauuuguauuuuacuuauuuuuuccuuucucuuugucagaucuuguagaaaauuuugaugaagcaucgaaaaaugaagcuaacuaaaauccucuggguuuuggaagcuggcauggacuagauuuaacaaucagcucuguuguuccaaaguuuuacagacauggagaacacaccuguuauuaguucaguaauauaaauauuuuguauauuaaugaugcugucugcucagcaguucucggucauuugauuuugcauuuugcacuucuucccaggaucuaucuucccaggaucuguucuuuuggucaaaauaugaaguauugguacaguuugagggugguuuuuguuuuuuugggggguggaacuuuugguguguauguauauguauguguguggguauguguguacacaguggacagcagauuggauaacaguuauaucuuccuauuccuuccuccaauagaaauaaagcaaaucuuuacauuuguuacuuuuuuuuuccuaacaaauacugcacauaauugaugaaaagugaguaccucugauugcagagcugaggcgaguccuuccguuagaagcuugguguuaauuuguugaauuaacuuuaauauuuuuauacauuucucuggauugaaaauguccugaacuauuuugccaccagauugcugcgagagucacaagaugggccucuuugguguggcuaccuuagacucacuuccuaaucaggcccauacaauguccuuuuuuagcuuucuuccuggugcccugccuccccacauauuggucuuuaaaugaacuggucagccuuugauauuacucuucucuccugccuagcuugagacagaaguucuccauauagaauugagagagugccuaauuccucuuuuuguuccucaccucgaggaacaaugccauugucaauguuuuauuccuuucacauuuauaguugguagaguucaaacuggaauagcuagcaugugcuuccuaauuaacuuuauacucggcuuauccuguuuccuagguguucuugguagcaggugcaggggugccucuuuuucagcaaaguugaaccugggaauguccuuuugaaugaaaagaacauguaggccauauuaucuccuagcauaaauaggcauucucugaaaugguacuggcugcaggagaauuucuucaggcaguuuccuauucuuggccuugaccuuaccucugaguagaucuaauugauuguagcugcucuuaacccccuccugcaugcuuaggauagugcuucgggggaacagugguaaacacaguauuuaauugcuuaccuucuucccuagaacuuggagguaaguuauauucauucacucagguuuucuugcuguucugauaaaagcuuguguuuugacauaucaacauuuauuauagccaauauuuuaggauaagaucgaaagaaucuguuguuuucuggcccaucaccaaacuaacugcagcuuaaccuugcagcaugccaacuuuuguuucaagcuagauaucuuuccuugauacuuaagaugcaagaccaacagcauauugagagauuuacagacaugaaggcaaaucucccguguucuuuuucauccaaacauuuucaacuuauuuuauaaauuuguugauuuuuuccccuguuauguuuuauauauauggacguaacaaaauaaauaacaguaauaaaauaacaguacaaaagaggagauauuuccucuagugcuucuguuaauuguugucuuuucuauuucucuauucuccauacuaaauuaauucucaugugggcauuguuuaaaauaaucucauccauuguuaggucaauauuuguagcuggucuacuuacuucagaauuuagucguuccuuugccuguccaagcaaaagacagaagcagagagcagcgggcaauguuguagaugaaaaaagagaguauaucuagaacugagaaaauguguguccugguccagauucaggcucucuguugccauguucacccacaucacccaguaagguucaucauccauccaguaagguacuucugcgugugagcuuuguucugcucucgcagcucagaaucucaccugggaauucucaagaagggauuuugucaucuauucaaggauguuguuauuuuuaucaguacuaauaaacuuuauauacauauaccccuuugcauuuugaucacauuuuaguuucugagaguaauucuggucauuaucuccuuuuauccugcugucagcagcucucuauucuggucuuccuuuuguauaaaggauucgaggagaggugacuccgugauuaagggugcacugcccuuguagaagaccugagcuuagucccagcaccaaugucagguggcuuaaaacugccugcaacucaagcuccaggcgucugacauacucugcuggcuuccuugguaacuucacauacuuuauaauaaaauuaaaagaagcaauauucuuuuugucucauuucuauacuuucccuuuucugaacaaaaauauuuugauauguucaacaaagaauuauguuuucaagguagguaggcauagaauaaagguaaaacauaggugaaacuuuaguaaacuauauggaucuuggcauaaacaugaauuaaaugguuauauuucuaaau

SEQ ID NO: 2026 - RNA, 27673 nt, Mus musculus
ccaccucauccggcuguuucuuuaagccuggauaucaaggacuuagggaaagcaaacucgagauguacucccacauccuucuacgugaucugcaccuuuaaacuuacuccauuccaaagcggacccucgaggcaccgcccacauccgucuaacaucacuuccuucaguguuuggcuaggaaaaaaaaaaaaaaaaaaaaaucugggaauccgagggguugggcugaacggcgauaagggggcagagcggagcuucugcuggaaauccuguucccucaauccgguggcucugugcaacuaccaccguggagaugucgcuucguuucggggccaccuguuugcugagcuucaguuuccugcuccucaucacuucuucagacggacgcacugggcuuggaaagggucagaccucauucuuaccguaaucuuuacggaccccgggccuucuuaacacuuuauuuucucacuguaucuuaggccacuuuagauuccuuuuuaucuuccccaacugcuuuuguggauuucucggggucaggaguaccagguccgggagaggguuuaagagaaggaaguuguacuugagggcgcucuuaauucuugggauugagaagauauggcccuuaaauuaggacuagguuguuuaagaguccauucaugugucauguuaggcgcuugggacgccuccaggaaccgucaccuucccgccagaagaaauaggucgcuugggaagcccucaggaaccgucaccuuuccgccagaagaaaaagggucgcuggugaccuguaguggucgcuugagucugaagauuccucaccacguucccccguacccccaagacccgguucccuauucccccaagagaugcagaaaaaagagcaaaugaaagguagaccuuuugcuaggucaccaacaguugguuuugguguggcucagcuaguguguuggaagaaacugauuucuuuagagcgauggaucagugguuaucaaugaagguuaggaaguaaggacccccaacuccguguauuaccagcccuauuucuaaacuugaacaccuucucaucaguuggguuuuuuguuuguuuguuuuggcagcugaauugacuaacugguugaguuauaaauggauuccagcccugcuuuggaugguuuguguuaugaccuuuacuguaugggauuuuucugaugcugguggugugugugugcuucaguguggugucugcccgccuguuuucugguacacaugacuaggccauaagaggauauuggguguuuuccucuucugcuuguucuccaccuuaugaaacagccucauugaauuugaguucaccauuuaggcuagaggagcccugugugugugcgcguguguguguuuagguaaauguguggcccaaggaggccagaaaagggugucagucccccuggagguggaggugcaggcaguugugaucugccucuaacaugggaacugaacuugaguccacugaagagcagcagguucuuuucuggucccagccccuauuuguuuguuuguuugguugguuuuuugagacaggguuucucuauagcccuggcuguccuggaacucacucuguagaccaggcuggccuggaacucagaaauccuccugccucugccucccgagugcugggauuaaaggcgugcgccaucacugcccagcuguuuguuuuuagagcucuuuaucuuuacauucauuggugggcauugagacugaguggaaauucaaugagucaccucaguucaguauugauuuucgaucaucagccauguuuugaucauugacucggguacuagagacaugacaaugaagagaacaaacaagguucuugcuuucacuggguguauauuuaagucagagagugcaauaggauagaucuacgacagauuaauaaaagaauuucagcuuauauaauacugugguagauugggaaguacagacugaggaggguaagggcgcuggcaucuaccugaauuaggagggugagaaaaagcuuuucuuuucuuucuuucuuacuuuuuuuuuggggggggggugagagacaggguuucucugcagcccagguuguccuggaacucacucuguagaccaggcuggcuucgaacucagaaauccgucugccucugccuccugagugcuaggauuaaaggugugugccaccaugccuggcaaagcuuuuucuuucuuuucuuuuuucuuuugagaaagaaguuuuucuaaggugauauguggguuucugccuaugaaggaagugcugaaaacugcacaauggguccuauuaagucaaaauguuccaaauacugaugauccuauuguaaaacaggccgcuguguauuuagaauagaacuguauauacagagggagacuggagugcuaggguguaugcagagcugaguuucaauguguucugccagugaccagacgagaugccugugacaaguagcuuaaucucucucaugccucuguuccucagcugcaaaaugggugugauuguuaccccagacacucaacacauaacaaacccugcucaaucgacuguugaaugcauauaacauuaugaaguguugugugagucucauuucuuugucaggcaguaaauacuguguuauucaauuagcaucauugccuaauaaacaacuccaaaauauauugaagccuugaaucccgggacuggagguagaagcaggcgaucggaucucugugaguuccagggaacccaaguggaagagcuaguuugugauaauugaaugaaaaagcaaaagacgcgugaagugucacacacuugaaaaagaucgaguaagugaaauauuguuauuauuuccaccauugaggaauacuugcuuguuucuaaaaggaauuaauauuaucucaaguauuugucuuguguauuguuuauguauagauucuuuggacauaagaaauauacucaccccaccuaaaaaaaguaaaaaguacuaccugaggcaggaaguccugaaaauuuugaugaguguuguuucuuccaaaaugucuaaagagcuucuccagcucuuucuagaagauuccuuggugguuugcagagaggaaacaaugaguaacccucccuacccuccccaacaguuuucauuaugaagaggaagcacgcugguguggaauagugugcacuagacuggaauuauuaggccuagauuuuaaucuuggacaggccauuuagccagcaguggucuucccuagugaccauuuauuaagugagagugaacuaggaauguguccuaagggccucgcagcucuaacauuccaguguccaaaaacacgcucauuauucucaguagacuagaaacuuagcucuaucaccuggaaagaagugugguugcuagcauuuacuuccucucugcuagcuuccaggcauugaucugccugcguauuuuuuucauacauaguaacuaugagguggguaauauuuuuauuaucaucccauuucacagaugaagaauuuaaaaugaaacauuagaaguuaacuaguaagucgagggcaggaagaugaauccccagcccaugucuuuacccagugcaccacucuggccuccaaugcagaaucuagaaagaggccauucauguguucucccgccuguaauagaaauagaugacuucagucucuggaauucaaagcuggcacaguaacacuuacgcuccaugucccguuuacagccacagucacuucaugagacagauauuuuuguuagcuauauuuaacauuugcgcagaugguagaaaggcugccuucugauggagacaucacuuggcuacacuguuacucuaccuuccagguacaguguugccuaacucaggccuggcugccagcucugacaucugaccuuuccuuauuuagguuucaccagcuggagccuggggguuuuuucuguugucuuuaaaacaaucuaggaagaagagcuuggacaccaacauaaauacuguguuuagaacuggcuuuuccuguuuuaaacaucgucuucgguggggaaaaagagcuguugauuugggaaccuuuagcuuccuuugcagauggcuggcaugaacugccuugcagaugacaccuuaggaaacugcacugucugcagaggcuccgugcugccauggccaagagaauagcugcuuaaaacuaccugucuaagucaucuuucaagaggaaagggagaagcaaaaacaaagcaauuccccauccccuguggguguucuguagcugaagucaguguucucaagguccauuccuucauccauucaucuuuaaccauuguuagugagcuagccaacuguagggaaugguuuaacuauagaguaaccaccuccauuccagcucugccucucaggggcaauguaacccuaggcaaacucuuuaacuuuaguuuccuuaucuuuaaggaggaaggauagaauuagcauaucauaagguuauucugaggauauauaaauuaauaccuguaaacacauuuuaaaaacugcuaugcuuaaaaaaaaaauccagcuggauggugauggugaugccuuuagacccagcacuccgaaggcagaaguagaagaaucucugaguuagaagccagccuggucuauagagagaguucugggacagccagggcuacacagagaaaacaaaaaacaaacaaaaaacccccacaccauuaucauuacuauuuuucuuuuuuguuuuguuuuuguuuuuuuguuuuguuuuguuuuguuuuggagacaggguuucucuguguaguccuggcuguccuggaacucacucuguagaccaggcuggccucaaacucagaaauccaccugccucugucucccaaaugcugggauuaaaggcgugugccaccacugcccagcacuauuuuuacuaauuaucauaagcucuuauguuuuccaucucucugcaucuguggugcauucaggagaggugaaguuugccugucuauggguugcugcuauuuuaaccuauccauugaugcuuuaaaaaaaaaaguagacuuuauuuuuagaacaauuuuaugucuguggaaaaauugagcaaacaaaaaaggggccugagagauggcucaacgcauagaaguacuugcugcgcaaguguguccacuuauguuugaucccuugaaccaacacaaaagagggaauccacuccaaaaagcuuuccucugacuucuacacgugugccaugcaugugcucccacaugcacagaucaugcacacaacugcaaguacacauuaaaaagagcagaaaauaagaguuuacauauauguccuuucucuuccccacuuuuaaaagaaaaagauuuauuuauuuauuuauuuaauguaaaccagaagaggacauuggaucccauugcagaugguugugagccaccguguuguuggugggaauugaacucagaacgucuggaagagcagucagugcucuuaaccacugagccaucucuccagcccccucuucccuacuuauucgcaucuuauguuaauguagacuguuauauuugaugcgccaauguugacacauuuacuaacaaagaucuccaguuuauguuccaguucacucuuuuuuuuaauuuuuuuaaaagauuuauuuauuauauauauaaguacacuguagcugucuucagacacaccagaaaagggcaucagaucuuauuacagaugguugugagccacccugugguugcugggauuugaacucaaaaccucuagaaaagcagucagugcucuuaaccgcugagccaucaucucuccagccccuccaguucacucuuaauguauauuuugugcauucugacacauauaaugacauuauuaguuugcuaggacuaauuuaauaaguacuauagauugugugggguucuauuugucuuuauguacuuauguguguguguguguguguguguguguguguggccacagguccaccacaggccuuguuuuucagagggccauccucccuguguuugaggcgggaucguucacagggaccaggcuaggcggcugcugugaacucuggggguaccccucgugucugcuccccagcacuugagcugcaugugcacaccaucaggcccagcguucugcacggagucuggagcauggagucuggagauggaacuugaauugucaugccuguguagcaaacauuucauagacugggacgucuccucagcguuagauugguuggcuuaaaccacagaaaauuuuguguugaugauucugaagacuugaaauaaugaucaagauguuggcaggguuguuuucggcuuguuggcggcuaucuucucuugcuguguuaacagggucuuccuucuguguauauuuaaucucuuucaagaauuagggugggggaagaggguggguggcgcauaccuuuaaucccagcauuugggaagcugaggcaggugaaucucuuaggccagccuggucuacagagggaguuucaggacuuccagggcuacacagagaaacccugucuuggaaaaacaaaaacaaaaaccuuugggcuggaaagauggcucaguguuuaagaguauugguuguucuuccagaggaccugaguucaauucucagcacccacauggcaacucaugcuugucuguaacuccaguuuuagggcuucugaugcugucagauaugcaagcaaagcaccuuuuuuuuuuuuuuuuuuuuaauuaagggaagaaagaaaaaagaauuccggccaauuuuauuaccucuuuaaagaccacauccucaaacacagccauagaacuucaacaucuacagggaugugcacaguucaucugucagugcaccucagugucacaaaauagcuugcugguaucccagcccauggcagguggguucuggggcacacacucaagcacuuuacugccugagauagcuccgcuguccuugcuuuugcuuguuuuguuguuugauuuuggaacagaauugaaugagucccagacuagccucaaaacucaaaaacuuaguaugacucaaagcauaaccucuugucuccacuucuuuuuuuuuuuuguuuuguuuuguuuuguuuuguuuuguuuuuuucgagacaggguuucucuguauagcucuggcuguccuggaacucacucuguagaccagacuauucucaaacucagaaauccaccugccucugccucugccucugccucccaagugcugggauuaaaggugugcgcccacuaucccggccgucuccacuuauucagugaugcgauugcaaauguuugccaucuuuccugguuuagauuugacaguuuaauuugugauuccaugaauguauguaauaaauauuucucuaaacacaucaaauguaguuuucguuuguuuuuuaauucugugguuguuaagccugguaccuaaaguccucguggucuaauucuguugcuucugcugaucuuucugacuuugauuguuuuguuguuguuguuguuuagcauuuuguggcucuguaguggugaacacacaguaauuauucaucaugaacuaccuuggaguccuaacauggggaauguuuucuccuaggaagguuuggagagugagcugcacuggggacaugaaucccucuacuuuucuuuaguggcuuaacggagagucuccggcugucuccaguuugccaccugauagcagauauuuacuuuuggggugggugaccucaccuuugcuuguuccucugacguugguuuccuuuguguuuguggagggauuucuguuaucccagugaguccacucugaaagucugcuucucuggaauuucauuguuuuguggguggguuucucaggcucuuuagugggacauggccaauuguccagguuugaggccugugaguaaagugaugacagacacguugagcaccuuccagucuccuggcauccucccaaugucacccuguuguuauucacucuucaggaucaaacuuugggccuuagguaaaugacacccgcucuccacuggcuggcagcguauucuggugagauugaaacgugguggugguugguuuggacaccacuccuguguguuaacaggagggagcuuuuauuuuccuuugggagaacacugauaacaauuagauuuuaauuuguguaggggaaauaaauuucugaaagacaaauauagugauugaaaaagcauaaagugucaggcuguggugucacuuugccuuuaauccuagcacucaggaggcagaggcaggcggaucucugccuggucuacagagcaaguucuaggacagccagggcuacacaaagaaaccagcucuugaaaaacaaacaagcagggagggagggaagaaagaaagaaagaaaggcacaaggcuggauguuaaacccagguuggcuuuccagcagcaagaagaccugauacagaugauuggcuucuuggagccucaacuguaaagaagagcaaaagcuacugauguucauacccuaagacauuuuuguauuuuguuugcuauuuagcaguaaccuuuugagagacaauuauuauacccauuugaguucugaaaagugaagauauagagagaggaguuauuguuaagguaacaugaguuggcuuguauaauaugcugcacacauauaauaauaacagauauaagaaacgucacagaagaaguggcaaaaaagaguaaaauccggaggaugggaaggagugcugugaauggcuguccucuggaugugacacagcaacuguggcucccugcacagggguuucacaaggcccucauccacccugaggagcuauagguaaaaggaccagaauuggcucugggcacccucagcacaaaggagauuuauuugccccagagggacaaagaguggugaauaagagacaaagacaggaaggagaugaggacaaaagagaagagaaaagggccaaggcuggggagggauacuugcccuggagggacaaaggacugcuuuuggauugaggggagacaaaggcccauagauaaguggcaguuuauaaugggaaaaggagaaaccccugacuggguuagaugguuuguguugauugugaguuaagguagccaggaggggcccuuggauuacuugauuuaaauacuuugauagcugacuuugauaggagaagggaguaacuaaacaagagaaucagccuggggaagcagcuuuaggacuguaauguaugguuuagucaggaggaggaggguaagaggcaaagccuguuggugcuguguuugccauaguuucuggaggaggaggagucauuccucagugguguagcugcuaguaaguugcccuugcuuaaguagacaauguuaggcuccaaaccuggucccuguuaauauacaggcaguuccaccugccuguucucagggaccuagcaacugcuuauuuaaucaucugcugccucuagguacaccaggugugugcugcagauaacccucagccaccucagcucgcucuugcucucucucucucucucucucucucucucucucucucucucucgcucucgcucucgcucucucucucucucugccucucugucucugucucucucucucugccucucccucucucucucccucccucccucccuccccucucccucuccauuccucccucccucccuucccccccucucuggagauuucccugacuuuguucucugagaccagugaacccacccccagagcugccccaauaaaccugcucuuauacuuuuaauuuagcuugaauuggcuuauuauaucggcagaaaaaaaacuauuagauauucucccauccagccaggcucaugcaaguaacccuuguuacagacacauacacaagaaaauaggaagauuuauuagaaaggccucaaugaaagggggaaaggauaaaaggauuauauauacauauacgcacacacaaugaaauuuagaaagaauaaaucaauuuuuucuggauauaacauaagauuaugugauuuggucucagauuucgagcacucuauugacuacuuggaguaguccauacuuguguauugcuaagugcuagggaagcagggaaagauacaagagguuuggucccagcacuuagagaauucuccuuggaguaagggaaaggacacgcuaaugucugaagauucugucugggaagugugguguugggacuagaauggaggccccuaucagaagaaaugcccuccaggauuauucauacccgagugugagaguggggaacaaggcagagguggagccugcagcggagaggacagcacagcacagcaccgaggggcagaagcacuccugugucuuacaaaaaugcuggaaugggauugcagaagugggcagaguguuuuuguuuguuugcugucuguuuauuuguuuguguuuuuaagacaaguucucccuuguagcccuagcugucccguuacucuguguagaccagacuggcuuugguaugcuaggacuaaggguauuugucaccacauccagccauguguaauuuccucauugaagccuuuguaagggcuccauguaaggguagaccggauagccucugaaauguuucuuauugagcagugauauaauugaaagagaucaugccaggccacgccgcugugucaaugagaaaaggagcuugccacagaucucgccgaccagagcucaacucugggcucacacaguggaaagagagggcuggcucuuuuuugguguuuuuguuuuuguuugagacagguuucuuuguguagcccuggcuguucuggaacuagcucuguagaccagacuggccuugaacucagagauucuccugccuaugccuccugagugcugggauuaaaggcaugugccaucacggccgggugagagggcuggcucuugaaaguuguccucugauuucugcauggagacuguagcauaugcaugcccacauacaugaacaaauguaguucuaaaauggaaaagaccauucuggcugaacugugggaauaaugacaguuaaugaccugaccuuauuuauuaguuucuuguaccaauauucugagguagaaauuagugucuugauuuuauagauggugaaccaggacuuagauggcuucauucaaaacucuacagucuuaaugggaaguggaguuauagauccacguuuugugugucugaagcuucacugccggucauuucagugaugaugcucucugaucacuguguaagacagucucauucauucucacuguauuguuggcauagugugguaguucacauaggacucauuacuuaagcuccuuaauaaucacuaaugaaaugguguucucccguuuagagguaugaaaacagacuugggggaggugacuaccuaugguucaguauucccagaaaacagugaagcuggcguugaacaccaggcucuuagcagaggggaaacauuuuuuuuuuucuauucauggauauauuacaagcaugucuccuuucuuucuugugugaauguccuuuguuuuuuuggauguuuauaaggcucuuuccuucuagguuuuggagaucacauucacuggaggacucuggaagauggcaagaaggaagcagcugcaagguaucaaacacgcucgggauguuuauaguaacaaagcuuucuagccauuagcuuugcauugcucucagaugaagggcuaggucaaggccccacaagaacuauguaaguuuccugauaacaaaaagucagcacuuacuguguaccagguguuaaauaaucuaaauugguuagcucauuuaguuucucgacauuucuaugaaguauuguuguuacuuuuuuagaaaugagaaagucacucaacaguuagaagaucaccaguugguacauagcagagcugagcuucugacagccucuuuguucucugucagugaguuauauacuagccuuaagcuaaaauaguguaauguuucagggaggguuaguuugugcacaaacacgcagagcauaaggggugggggagggugcagaagcaaggagcugccaauguuacaaagauugguuuauuuagucuuuacagccucugagauugguacaacuaugaaauaauaacuguuacauuuuaucgaaaagagaauugaaauacugaaaagugaaauuacuucccagucuuuuuuuuuuuuuaaagauuuauuuauuauauguaaguacacuguagcugucuucagacacuccagaagagggagucagaucucguuacggaugguugugagccaccaugugguugcugggauuugaacuccggaccuucggaagagcagucgggugcucuuacccacugagccaucucaccagccccacuucccagucuuuaaacaaccauuaaguggacuuucaugugucuccuguacuguauuagagacuuacucuacuccagcauguguguccuauauuauaucauacuccugucacacacauacucacauuuauacuucuguaccuaucacacuugugcuugcuguuguaaaacagauccuaagucucaugacacgggggucucaacucaagcuuucugcaggaggauugccaaguuuaauuaaaaaaagauacccagcuaaauuuaaauuucacacaaaggaaaauuaaauaugcccauguaacuuaugcaacuuuuuaaaaaucucaaaaucagauuuaauuggaaaaucuucauuguauuuggcgacucuauccacgauggaaauuucaauuauucuuucaaguucaaaaucaaguucgcuccgaggguauagugcugaggcauagagcauucacaagguucuagcccagcagcccucucuaccaaacaaauagaaacaaauucaagcaucaaucaagucuucaaggagguuuccgggcagcuuuuucacuucuguucuucacacuaaaguacagcuacccauaaaaguguuuacuuugcguggacacuuaaugcuuccugauacgaaccuugauuuuuuuuuccuuuuuuccauauauauauuguuuuuuugaaccuugauuuuccuaggggaacaguuuuuauucaucucugaccccaaccaugaaaggauguugacgacugaaauaguuguuaugaauaaacauuuacuaagagcuacuagguguaagagaaguccugaauagagaaacaucauuuguaauuugccuucuguaugcuaaauguggugcuaguaauuucguugaaugcccauuaaaucccauuuaauaaauacccucuuugacggaggguaaucuuauccuguugaggccuuuaacguuugguguaaauaacuaacgccauucuaaucuuugcgucuccuuucugagaauguugguccuugaucugguugguuagaguuccgguuucccauagaaacaaaaggucccguaagaguguaagggaacaggaagcucgguuuucucuuccgguuccugccggaaguugacgccaaacauccgcacauggaugccccuggagaucaugccgcucgucgugguuugcgggcugccguccagcggcaagagccagcggacggaggagcuccgucgggcgcuggccagcgagggccgcgcgguguaugugguggacgaugcuucggugcugggcgcgcaggacccgacuguguacggcgacuccgcuggugagaaggcucugcgggcugcgcugcgggcugcgguggagcggcgccugagccggcaggacguggucauccuggacucggugaacuacaucaagggcuuccgcuacgagcuguacugccucgcccgggccgcgcgcacgccgcucugcuuacuuuacugcgugcggccgaacuggccgagccgcgagcuucgggaggcuuccgccuccgagaaccgggaccuggcugucagcgugagcuggagaccgcgggccgagaccggcgggaagucucaggcggcuggcgcuguggaggaacagcgcgccaccagccccguagccaacgggggaguucuggccgcugucucaaaggaacuggauccagaggaaauccugccaucaaacccuuccgcuguaaugaccccgggguccgagaaaucugcagagccugcguccugugccuuuccucccgagguucuggaguccuuagcgcugcgcuuugagucucccgacucccggaaccgcugggaucgccccuuguucacugugguggguuuagaagagccauugccccucgcggagauccggucugccuuguuugagaaucgggcucccccgccccaucagucuacgcagucucagccucuagccucuggcagcuuucugcaccaguuggaucaggccacaagccagguguugaccgcugugauggaagcccagaagagcgcugugcccggagacuuccuaaagcucccuggcaccacggagccccuccgauuuacccgacccuugaccuuagcagaauugagucgccuccgucgccaguuuauuuccuacaccaaaaugcaucccaauaacgagaaucugccucaauuggccaacauguuucuucaguaucugaaccagaguuugcacuaaugagguagugggcagcagcuguggcucgugucugacuauucuacuguacuuuguuuaggaagaauaguccgaaggucugcaaagcauacuguaguaagauggccaaguuuugacucguuuucuuaacugccacugccauacccugaguguguaguuagcauaagcugaggcauugagugguagcuccaaaaacaccagggggcuucgguuggagucuacuuaggaauacuacacaccacuguuggccuuccaucgggauuaagucaacugugaguagaaaccgaagauaacaguuuuguauucauaauggccuuuucauacuccaaguacuuuugagcacagagccucuugcuucugaccuggcacuuggaacacagauauauauaucuuuuguucugucccugggaaacugauauuuguguaagacaaccaccagauauuuucucuaauaaaaucuucuaaaauuaccugcuggucucuugauguaguuuacuguuuccucugcaacuuaguauuuuauauguacauguaguaucuuuauaugagaggcuugauugcuuggccuauauauuguagcaccuugcauguuuauugaauauucuaaggcaaacauuacucuuaguuuuguugguagcaaacaguauuggauuuucauuauccauauaguucuucagacuuggcagcugugugaagugcaaacaugcuuagcaggaugaaugccagccaucccagaauaaccugugcaggguuauuacugacuguugaccaguggcuaggagguguuugaggaagagcuuuagaaaaguuacuauuugaaauaucacuguagaauagucugcuaaggaacaaaaugcaacuuuuuagacuuucuagaccuuggaaguuucuugcuacuuguaaagaguuaacaaacauauuccaaauuauauuugugucaaaaaaauaauuuagauuugcuuuccuuuucuuuuuuuccuuuuuuuaaagauuuauuuauuuuauguaugaguaugcugucgcugucuucaggcacaccagaagagggcaucagauccuauuccagauguuugugagucaccaugugguugcugggauuugaacuuaggaccucuggaagagcagucagugcucuuaaccacugggccaucucuccagcccuuagauuugcuuuccaaccuucaaauuuuucacuagguaugauacucgcaccuguagucccagcacuugggaggugaaaacaggauuguuguaaaucugaggucagccugaguuacagaguaagauccuaccuuuaaaaacaaacaaaacaaaaaagcccaggggguguuuuugucuguacagaagcaaccaguggguugacuuuggccuacagauuauuuuugcuaacucuuauucuagaauggcuaauagauguuugacaggacuaagccauucuaaaauacgcaugcucugaaaacugguggacugccuugguuaauguuuccuuuguaguaucuaccaccucugauauauaugaagggcaggaaagguucauguaugaaauguagguuugagcuaggcaaccucaacaaccuuuuucaaccuucauuucugauuuucuaguaaauuauugauugacuuggauuuaaaccuacauguucaggcuggcucagugguuaagugcacugacugcucuuccagaguucaauucccagcagccacauguuggcucacaaccauccagggaucugaguaccccuucugcugugccugaagacagcauacucaaauacacaaaauaaauaaaucuuaaaaacaaaaaaaacggccaucacuggaaagagaggcccauuggacacacaaacuuuauaugccccagaacaggggaacgccagggccaaaaagggggagugggcggguaggggaguggggguggguggguaugggggacuuuugguauagcauuggaaauguaaaugagcuaaauaccuaauaaaaaauggaaagaaaaaaaaaaacaaaaaaaacaaacccuacauguucuaggacugucaauaauaggcucagugguuaagaguacuggcuguccuucuagugguccugaguucaauucccaacaaucacaugguggcucguagccaucuguaaugggaucuguuucccauucccuccuguuugaugcccucuuuuguugugcaagcauacagcaaauagagcacucauacauaaaauaaaucuuuuuaaaaacuacauauuuuaucuagaugacucuucuaaauaaaggauauuaauugucauggccaaaaagaacauuggucugggagucaguccuuuuuuuuuuuuaauuuuuauuaacuuauaaauggcagaacuuacauuuauauagucagauuucuuuuuaaugauuuaugcauuuuuauuuuauaugcaaucucuuaggauucuuggucuuuuuggguugggcuggagauugaacccagaacuuguacaagcugaguaagugcucuaccauugaucaacaucacagauuaauuuucucuuuucuaugagaacauuaauagugucuacccuagaugagugugaugguguaugcuuguaauucuaucgcucaggaagcugaggcagggggguugccacgaguguuggacuaguuuagguuacauagcaaagacucugcgucaaaagcaaaaggaggacagaugagauguccuggagugcuaagagugcucaccucuaagccuaaggagcugaggucaauccccagggccuacuccauggaaggagaggaccucugagcuccacaguguacaugcucucucccucccugaagcaugcuuggguccacacacacucaaauaaauagaauuauguuucacauacacaagcaaauguaauuauuuacuugggggaaaagggucggggucucacuacaucaccuugccuggccagcaacucaauauuuagagcaagcuagccuugaauuaagaaaucagccucuccuucacuccagaaacacuuacauuuucuccaacagugacaucuuggaagaauggacucagucacgauaagagacuggguuccaaucuuuuuacugaaaaaaaaaaaaaggaagcaagauggaauauucuaaacaaagcacuuaggguuuaacaagauguguugcuaauuucugguuuugcacaaauaaagagaagaaaggcaaaaaaaagagaaaucagccuucagauugcuggcaauaaagaugugugucacuaugcauagcccauaacuguaauuuuuaaaaaacguuucuagaguucuuuguggggcuguauaguauaaugcaugcaaaguauuuaacauauaauagucacauucaacacauuuucauuaugaucaccuggauccugccaucuacuuacacuugugguuuacaagccuuuaacgagucagucuauucagauucuuaagccucaggugagauagcuaaauaguuuaccuagaacuuauuuaacuaguuaaucauguagaauagcagugguauaugguaaauacuguauguuugauaucaguaauacuguauguuggcauagggucuguaaagacaaaugaaaaugucccagaaguucuagugacuguaggcccuggcaaucuaaacccaaccugucaugcuuacacagcaaguauuuuacccacugagccaucucccuggccuuaucaauaauuuuauuacuuauuuuauauuuaucauacuaaugaaaguuacuuuuugcccuuucaauaauuauguaauaguaaucauuuggaaauacaguaacauuuagaauauuguaauuugauguuuuucuucuaccuuuuuucucccuacuuuuaaagcccaaaucuguggaauuuauaaaaacaucaguauuuauacuuguuuuucugauaauaaucuaugacuugggcuggugagauggcucaacaguuaagagcaccuacugcucuucugaagguccugaguucaaaucccagcaaccacaugguggcucacaaccaucuguaaugagaucugaugcccucuucuagugugucugaacacagcuacaguguacuuagauauaauaauaaauacgucuuuaaaaaaauaaucuaugacuuaaguaguuggauuguuuuacaguuucuuuugaaaccauacaaaaaccacauuucugcauuaccaaucauuuuguuagaguacuuuugaaggauuuuacuauaauauacuuucuuuguuuucaaguggcuugccgcugauggugaucauccauaaaucuugguguggagccugcaaagguaaguacgaguguuucaucccaaggucaggcuucagauguaccagaaauggcaaagcacugcugagugccuggagcacuuccaaaugucagacagagcaucuuagcagaagcuggaauccuuuacagaggggcauaaauggcuuagggagggagggaaccaaucaaaaccagaggauauuuuugacugugguguguauucuuucugccuguugugauaccagucagguuuuauuuuucacugauaacucgacaacuagcaaaacccuauuucaaaaaugcagcugggcauggcagcucaugccuguagucccagcucucaggagggugaagcagaagcaugggcacaggugugaggccacccuugacaacagagugagugccugucucagacauaaguaaggggcuagagagauggcucggugcuuaagaguacacacuagcuccuccuaaggaacaccugaccucugagcacucacauucauguacauacccccccacacacacacauguacacauaauuaaauaaaaugaauaagaggaaugugaaugccagacacugcagugcaugccuguaaucucagcacuuggugaggcagggggaucagaaguucaaggcuagcuugggucccacugagagacucuguagcugaucuuugcuacuuuguggguucuuuuugccaccccuacacacacacaccaauuuuaccuccuauuuaccuccuaucauuaggaagggagggagggguggagggagggagggagggagggagggagagagagagagagagagagagagagagagagagagagagagagauccauccauccaucccugggucuaguuucuuuccuuuuguuucuucuuuaagcacaacuacuaacaaaccacaaccaaccucaccucucagggccuuagcauuucuauaccucugaaauguuuccagaauuucggagucacaagauugcagaaagccaugcucuguuagaacgccaggcaaaucauagucagcugcugugaagcggcccauaucuccacaacugggaguaagcacaugcuuggguuuuguuuuguuuuguuuucgagacaggguuucucuguguagcccuggcuguccuggaacucacuuuguagaccaggcuggccuggaacucagaaaucugccugacucucccucccaagugcugggauuaaaggcaugcuccaccaugcccggcgugguuccuuuuucaauggaaauuacugaaacauaacuauaaaaggcaaacaguggagggcagugggauggcuuauuggguaaagacauuugcuacagaagucuggccugagugugguuccugaagcccaugggaagguaaaagagcacagacuccacacuugucuucugaucuccaugugugcuguggcacaugcagucacacacacuacaguuguauuuuauuuuuuauaguguuuggaggucggaggacaacuugugagagucuauucuucuguggugaagguuacagggauugaaccggggucauuaggagaggcaguggacaagacacccuuaucuacucucuucagcccacgaauaguuugucuucauuucuuucgagacagggucucacuagcccuggcuaugucagaacucacuguguagaccaggcuggccuugaccgaaauccuccuguugucuccucaacuaaaggcuuguacuaccacacccacccucauugucccuauuucuuaaguuugaugcacauugcagucacauaacaaaguaagugccagaagcaggaugagaaucuagguucccaggccugguuuuaugguuguauuuuuuaaauaaaaagcucuuguccuacuugccaggcaguggugcacacgccuuuaaucccagcacuugggaggcagaggcauguggauuucugaguucgaggacacccagggcuacacagagagacccugucucuaaaaaaaaaaaaaccacucuuguccuuauuucauauugguuuuuuuuuuguuuguuuguuuugcuuuugagacaaggucuuauuauguagucccagcuggccucacagaaauccaccugucucugaguauggagcucuggaaauaaaggugugccacaccacacccugugccuguuuuuuguuuuuuguuuuuuuuuuuuaauugagauaggucacagguuggucuuacacucaaguaaguucaaguuacccuucugcuucagucuccccagaaucuggucugcaacugugugccaccaggcauuaauuguuuuugcuguuuuaaucauauacguugaggacauguauauuuguauucuuguggaggccauagaucagccuuggaugucuuuuuccaauuaguuuccaucauguuuuucauuucauuuuauuuauucuuguauguguucucaugugugugcggguugaugcuagaggacgccuucguggguucaguuuucuccuccuaccuuuucauggauucuggguccaagucagauugccaggccugcauggcaguugcuuucaccugcucagccauauugcugguuccuucucauuggaaccugaagcuaccagauuaggcaaagcuggcuagcaaggcagccagucccagggauccacuuauugcugagauuacaugcgugugccaccaugcugggcuuuuuugguaagugcuagggauugagacucagccgucuuccggcccucaauuuuaguuauuuagacuuaacaaugguuccauuagauggguuaauauauauguguguguguguguguguguguguguguguguguguguguacauauacauauauauauaugcuaaugucugacccuucaauaaaaguuagugauauuuaugcugacuaguguuuggguauguuucugucauugcaaaaaucuuuuuuuucucucucucuccuuagcuuuaaaacccaaauuugcagaaucuacagaaauuucagaacugucccauaauuuuguuaugguaaaucuggagguaagacuuaaagaugccccccccggggggggaugauuuuaagguauaguuuuagauuuauuauaaagugaaaugggcagaacgggcuacuuguauguuguuuuucucuugaaaacaagagaauaauacugagguuuacgggagagacguauuagccauccagcauuagagaggaaugaggaagggagaauuugaguaagugacuaaaauuuggaguuuuuucauccuuagcuuuugauuaugauauguuuuauaucuuccuauagcuguucuauagauagucauauguagaggcuacuacuuccugcaaauugugguucaguugagcaccuacuggaugguuggccaugcgaggcuuuuaugugcagccuuccugauuccucguggaaguaucuuuuauguccuuuauacaggauccagcucuugugauccagaaucuuagaauaucaagaguuagacuuggaagggguuuuuuggggucauugguauuguucccauuuuauagaaaggccugagguaggucaggggugugauuuuuguuaacaugcuaagaaccuaguaagugagcaaacaugacgcagcugugcucccguccaggccgugcucuucugcacaggugugggaucauguagcacauguagcacauguagcacugcacagugaugcuucuagacaugagucucauuaaagagacuguuugcuuaaacacagauccaagaaccuucugaacacauuaacagacaacauugagguauuaaacguguuucccuauauaacuaguguaucccagugcuaauuaaagcaauuuaaauaaaugacccuauuuaaucccugaaaugagaaccucaccacaagcuauaaaauuacucucuuucccaugaacauaauuucauuacuuucugggguaaacugggacucacauucacagagaacaagauguuucuagugaguaacuccaauguaagaaaguguagccacgggcuggaguguagucaugacuaugugguuaaaaguuaaaaguguauguuccuguggaggaguccaaguuugagucucagcacccaaaugguggcucaaaaccaucuaugauuccaguucuaggggaucugaugcccuccucugacguccaagggcaucuggcacacauagagugcacagacauacauugggagcacaauacucauguacauaaauaacuaaaaacagaagaaaguguagccacagugucagccuuguucaugcagucaggagguccuauguggagguauugggccugccgcagugaacagaacacuuccccuguggaaguagcauucuagcacagggaagcagguaaaaugggauacauaagauggagcugaaugcuauggcaaaguuaaggguaaaggagauacggugacuuaggauuuaaaauaggugucuagaaaagaaaauuauauuugaccaaaacucagaaacaggaaagggagugaaaccagguaugauugggaagugugugucuaggcagagccaguccagaagcccaaguuuugaauguuucuguagcuaaaggcacccaaacaagauagaagaugaaguuugagaacgggcagggggacgugggcagaucauggagccuccuggccugagcaagccuggaauccacuggaaggcuuuggagagaggaagauuauguuaucugugguuuauauuuaucuuaacaggaugaagaggagcccagggaugaagacuucagcccugauggggguuauaucccacgcauccuuuucuuggguaaggcuacauuggagcuuguugggugacccaggcucagguguggggagagaaguaauaagcacuggaacuguaguggagacaaacggaccuguccaacaaccagaagugaggugcugcaugccugcaauucuagcaccagagcuucauguguucgaggcuagcuacagagcgauccuggggaggggcagggcagggcagggcagggguggugcuaagaaucugaauaugagaaugaacaccaaaagggucugcuuuuaucgggcaagauaaagaaugugaccuugcacugagucauucauagucauuuggacaucacccguauaucaaacaccauuuaagacacuacuagggagaaacaguuucuaccccugggucugugugcagcuaacccaaugggauaacagaaccagacacaugucuuucaacaauuuuuuaauuuuguuuuuuuaaaagucagguguaauaacccuggcuauccugaaacucacuuuuagaccaggcuagccucaaacucacagagauccaccugccacugucucuggccucugccuccuaagugcuagacuaaaaguguguaccaccauguccagcuuuguguuccaacaauuuugugggaggagaguuucaagacaggguuucuccguauaauuggcugucauggagcucgcucuguagaccaggcuagccucaaacucacagagauaugccuaucucucugccucucaagcgcugggauuaaaggcauguaccaccacugccuggccaucuuugaauaauuuaauaagauaggaugaccaucuaaucuucauucaacauuuggccagccaggugugguagcacaaauuuaugaucccagcacuuggaaacuaagacaggaggaugggucaagaguucaaggccagucucaguuauauaggaaguuuuagcccauccuagaauacaggaacccuaucucaacaaauaaauaaacaaaccccaaaauuaauauacagaaaaaauuguggccaguuuuagugggugaugcaaauaggaaauguauaauucuauuaucaagccgaaaaggaacauuccaagaagggaauagcauuugcacgguaugggauggagguggagagcucuguucaaggaaguacaugcacuuguuuaugauuguggcaugaaacuucacauggaggguggugagcagagauguaggcugcagagaugggucucguguaccaacggauguaccuuucuguugucauaauuguggucuucacaccauuugucuucaauagaucccaguggcaaggugcguccugaaaucaucaaugagaguggaaaccccagcuacaaguauuucuacgucagugcugagcaagguaucguucugagagaaaggaggagggaugguuggucaugggcaaggucugugacagaaaccuagcuguaugugccuguuggcugaacauugcccacaugacuagcuuuugaguagauccuacauugaauacaauugggaggaagauaaaacagccuuucuccagcuacuuagacuccaguggaaaagcucauuagcuggcuggaagcugaaggacuggagcuuaugaagguaguuacugguuucuggccucaguuaauaagucagaguuggauuugauuaguuuuguauuuucauuacaacuauacuguucuuccuguaagaauccagaggaagaggaauacagacuucgcugaggaagccaaagcaguuuuauagauguuaaacuaaauggacagcaguuuuauagauguuaaaccaaauggacaggcaguauaggcucuggcucugccaagaugguguagguaaaggcaccugcuaauaaaccagaugaccugaguucaagccccagaaccaguaaaaggacagcacugacuccugcaaguuguccucugaccucuacacaggugcugucacauaggagugcuuuacaggugcacacacaauaaguaaaaauguaauacaaaauaaaaaucuaucccuagaaagacacaaggacauuucccacuaugaaaucggguguauguaggguaaggcuugcuggaaacagguagcuugagucugucccuaagagugaguuuuagugaaaaugggaaaggcacauauggcaggcagagggaauggccuuagcccagugcugaaggaaggcugacgcaucugccuugcuuuuuggucucuugcauuugaagcacuguuauuuuagaggcagggguuggaauagauguccugugcugcuaguugcuuacaaaguugcuaugugucaccuauugugagccugucaagucacucuguuuccuguucuuggaacucuuauucccagaauaggaaaggggaagacacggagaugucuaucucugccccugagucaggaggaugcaucugccucagccuaaugcagguuccuagaucgauauuagaugcagacuuucccacacggugggcaguggggcugucaguccuaaacacgugucucucaggauucuccuucuguuuagacucuuacgcaauugcucuugucaucccuacacuaacacagcccaaaggugggcacaaggcuuuucccagaguccucauggcuuaguuggccagggacuggaaacauuuaaaccugucuugccaaaaauguaaguaaaacauaaagggaaacuacccaugugagcugcuuuuauaagcauacggggucugcaggauucccaggacagacuggcucagcccagcgcuuacccucccauuuuagagcucccagucccaggccugcacucacaucacuguccuucuggaaggacaagucaguccgugggggauaucagugcagaagacauuucaucugcggcucccuuuccuuaagcuucuccuuuuuuuuccccuaaaaacuuggcuguuuccauuauuguugguuaauaguaaaaaugauuaagcccuucaguaaagaucauuuccucuuguaguaggcacauaugugcguguuuacacacacaucaugaucaaugugacugaccagucauuccaaagggggcagcaggaggguguucccuccucccugagugucaagugagcacgugcagccaugacgggggggucagcaaaagugcuagagguuaaccaaaguaacaacuaacagguuuguaggucuugauauuuaugaaacaguuguguugucaauucucugauuaauuuuugucgaaguccgauggaaguagcauucucucaagggaaaacagguccaugacgccagggcugaaaacuagaagaucuugaucuuguucuuccuaaaacauuuaaagucuguguugucacccaucagauauuaaaggcgcuccacacuucccaaccccuuaccuuuauuccaguuguucaagggaugaaggaagcucaggagaggcugacgggcgacgccuucagagagaaacacuuucaggaugaguugugacaugaaugaguguucuggaagaaaagcagcagagagcgaauccuaaagaaucacccagaaccgcuaagccaccagaaaccaugcuucuaccuacacuggcaggagcucucacuguggagaggccacugacagaagcugcucuguggagccagcagcggggccgacugacucucaucugcucccuuuccuaaguauccauuccuuugaauguaaagaaugaaacucuuugauacuaacuuugagccacuuggggauuaacuccaugucaguauuugagucuuuacccauuuucuccuacuguacucaagcugaagugaaacaaaccagaacgaucuuuucuauaguguacaaauugcaggaguuaccaauuuugaaagguggcauucuccuuuugucuugguaacccuccuggacuucucccggaaccccugcgcccgcccacccuuugcucaggcauccccguuugcacgaaugcgugucaagaauggcugugcacugagacagccccaacuggaagcaugcuuucccuguugcuguuagagaaacucucaagucugcaaacccuacaugaagccauuuugucaauucaccaacuguauuuuuguacugggguuaaaacaaacacaagagauaaaauauguuucauuaagcuuuauuaaaacuugaaauggaaagaugcuau

SEQ ID NO: 2027 - RNA, 4344 nt, Mus musculus
ccaagaaacacauuaauauguagcccuuacugaaaacagaggugcaauguucagugcauacaaggacagcugugccaggccuggcucauguuagguacaugaagccuucaagaaucauaguguagucagggaaacaacaaguuccuaacgggcagcuguuaagugcuguaauggaaauguguguauguccaggagagacaagagaugcugcugauaagauucugccucaucgucguguuuuaucuaaaaaguuuuuaaauugauguuacaauugcuuccaggagcucguuucagaagggccgguucccuggguuucuaagaacaguguaacauuuguggcugagcaaguuucccaccauccgcccaguaaguuacagguucuccacaaccuuucgucuuaaacggucauccagguccgaugacuugucacuugugcuguccuuccuguuaccugaacuggagacuaaucacagggacucagcaucacugaucccauagaaugaaggggguggggaacuaacacuugucaucuuacccauggcaacuuggagagcaaguugucauuuguaguuuuugcacaguguauuccagacaugguugagagaaugcauauccucaacauuuuguucaauguacaguaagaguggaaauacagagccaggcaguaguggugcacaacuuuacucucagcacuugggaggcagaggcagggggaucucugggaguuugaggccagugugaucuacauagggagugccaggacaaccagagcuauauaauagagaaaccuugucaagaaagaaaaaaaaaagaguagagauauuggaggggcccauauugaggggaggggcacaggagcauccuugcagaacaggacacgucuuaaaccugcgggaguugccauagccuccugcccacuggcucucucugcuugcuuuggaaggaagguaaaagcauacacaccugacaugauuugaggcucuuuucugugagaaggaucuucuauugaacgugagugacuaagaaaacgcuuucuuuucaguuucagccuuuuaugcugaguguuuuaacaagaagauacaauucaaugcucauaucuggacuaaaucaaaauuccuugggaugucaauugggguacacaacauaggucaggguaagugugugauaguguggauucuaacauguacuggacacucaaggaaaaaauguccccugaaagucaggcugggugucauaauuacauguagacuuagggauuuggagggggacugggugggguauaaacuauaucaccuccauacccaccaacagcuagcgggccucugcccuaacaggcugcucuuccuucccaggcugugucucgugucuggaguacgaugagcacuacauccucacguuccccaauggcuauggaaggcaaguagaugauuuccccaucagcugcagccgugguguucuuaagccuugccuuucuuuccuaacugccagucucaccugaaaaccuuugaucuuguaggucuauccugacagugcccuggguggaauugggaggagaaugcaauaucaacugcuccaaaacggguuacagcgcaaacaucgucuuccacacuaagccuuucuaugggggcaagaagcacagaauuacugcagagauuuuguagguauuuuguuuuucugccucaguauuccacuuuucuauaguacuuaacucucuugaacgucuguugggaacuaaccaucaacugcgugggucuccaucuuaggagucaguuucuuccuaaacacucuugacaaaaggagaccugcaugcugggcccagaacccucaagggugguaggugggauccgcugcaccgugcacuccagccuucuuggcagguugaaccaugagcucaucuugaagagaggcuuugugacugcaguagagcaucuucagaccuucacaaagccccucauuuuccuauuccuuugcuaaggaaaaacaguaucucauauggauagguaucuggcaggacagggccuggaagguagcuguguaaccagaguuuucggauucagaaacugccugcaaaaggagucugucccguuaagcccugugacguuuucucugcccugaaacugucccagggaguaaugcuugacugguugguuaaucaguuuuccaaaaugauuuaaucugagucagcugccaaaccaaaaaaagggguggggggggugagcaguauggggcccugaagagaaaaguuugcuguucccuuccgacagagugggcccagugcacaccguuacucggcugcucuguacaagacagugauggacuagcagguggucaaaaggaagaagaccugauuaggccuguucccuaaaaacguuuggauggagcauauccuugagcuuugacguaguuuauagaagacagaaggauucuuuuauaugguacuuguguucaguacacugcuaaauaccagauccucuggagaucccuguccugagugaggaaugaucugaaagccagugucuuacugugaaaugcguuuggcguuuuggaucugcucaguugcucucuuuaccagaccacccuugcuugaguagaauaguuuccagcuugagacuaauauaaauuguuucuuuucuguuuaguucuccgaaugacaagaaauccuucugcucaauugaaggggaauggaaugguaucauguaugcaaaauacgcaacagggguaagaccugugguuugucuuuugccuaagcagcucacccuuggugcuuguucccuuagucugggacuuuaaccaggagcagcuagcaucucuucagggugagcuuccuccuuccccacucacucuccuacaguacagcuaacaaaauggccuuuacuuuucucuguucucaaaacaguugagaaucuauuuggagcagugcuuagcagucgccugguaaauguuuggucuguugucaagauuuguaagaugaaaugugucuuaguuaggguugcuauugcugugauuaaacaccauacccaaagcaacuuagggaagaaaggguuuauuuuacucacacuuccauguaacaguuugucauagaaagcagagaaauuggaaacucauacagggcagaaccuggaggcaggagcugaugcagaggccauggagggcugcuacuuagcggcuugcucagccugcuuucuuaaagaaacaggaccaccugccagggauggcucuaucuacagugggcuugugugccccacacccacuaaucacuaaauaagaaaaugcucuacagcuagaucugauguauuuuucucauuuggggcucccuccucaggugacacuagucugugucagaugacauaaaaacuaaccaacacaaaaugcuaauuuguguuuauacacucagguuagugauuaauaaaauuugacuggcuuugccuuaggcauagaaaaauaggacuguccugccaugaagaaacuuggauuuuauaucuacucaguguuucuauuaagccagguauauggauuaacagggaaagccaugaauuagaguuuagagacgauuuacaacuuaucuucagaggccauuuaaccugaguacuugacagagauagucuaaucccaaaagauuguaucucaagcguguagugaacacacggcugugcugagucucuguugaacagagcucagaacucaagacuuaggauggggcccugaacagaaaaguuugcuauugcauucagaacagacugggauuuguguguuaagucuccugagaaguugacucugcaguaaaacugaauaaugaagaaucauucugccucuuguuguccaggaaaacacugucuuuguagacaccaagaaauugccuauaaucaagaaaaaggugaggaaguuggaagaucagaaugaguaugagucccgcagguaaggagccucacuagagcagcagcagccauaugcuucuugcuugccuagaugcagugcguggggcuggaagacagcauuaaaaaccagugccgacuggacuccagcgccugcgucccuugucaguacccaaacuuaagagcucuguaaccacaggccaauuuacugauuucucaaugcccuuucccuacaguugagagugucuuacgccuucuaagucccuacaguugaccucuugacccuuuugagaucacuuuuuuuuuggggggggggggguucgagacaggguuucucuguguagcccuggcuguccuggaacucacucuguagaccaggcuggccuccaacucagaaaugcaccugccucugccucccaagggcugggaucaaaggcgugcacuaccacgcccggcaagagaucacauucuu

SEQ ID NO: 2028 - RNA, 682 nt, Mus musculus
ggugcuugcuuacaguuuccaaggguuagcccauuauuauuaucaugguagggaguguaguggcagcagacgguuguuacacuggagaagcagcuaagagcuuuacauccuaaucugcaggcagacagagacugggccuaaugcuggcuuucgaaggcuccacgcccaccuccuccaacaaggacgcacuccuaauucuucugagcaguuacgacuggggacugagcuuucgagcauacgagccuguuagggcauccuuagucaagccagcacaccaugggaagcacugagcacagcaaaguuguuguagcuguuuuaguaucagaggaacaaagaagauaaaugugcuguagcccagcauuugggagguagaggcaaggucauugcuguaaguuaguaaccaacaagcaggcaaaguaagcaccaagccagccugggcuaaagaaugagacccuaucucaaaacaaagaagauacauaaccagagacaauuuguaaugauaaaagaauaaaagagccggguaugguggcgcaggccuuuaaucccagcacucgggaggcagagacaagcggauuucugaguucgaggccagccuggucuacaaagugaguuccaggacagccaggacuacacagagaaacccugucucgaaaaaccaaaaaaaaaaaaaaaaaaaaaaaag

SEQ ID NO: 2029 - RNA, 107552 nt, Mus musculus
ggggcggcgugaggagggaaguugucgaaguucggggagacgcccggccgccggccucgccuacggccugucccuccgccuccuucccgccccgggcccccguccguccguccuuccuuccccucccgugcaugauggaaacaccauggcugcggcagcccagcucucccugacacagguaacgccgcccgccggucggcccggcucgacccgccgggguuccccggcccucccucccccccuccaccgcucuggggcgcuggcgcggcggcugcccucgggccgcacggugggagcgcgugugaggagugcgggcgccaucccgagucggagcgggagcggcgagccggggccgccgcacccccgccccgggucgccgggcucucggcuccgccccgcgcggcucccacccggccgccgcccccgccgcgggucuccgcgccgcucuccuccaggucccgucggcgcucaccuucucggcaaguuucuccuccgggccugacggccgccaggugagcuccgguggggcucacgcuagacagcggccgcgggcgaugcgaggcucgacuucggcggggcaggguucccucagcuucgcucugcuccgguccgcgggagcgacgacugccgaguuccccucaguucccucaagucagccuggcuuccagaagucgcauccuguccgggcacuugacccacucacuucugcucagauccccuugcagacuuucccacccgcgagggcgccgucucugaucgucguccgaggggucauggugccagccuucugcagguggggcgccucuuuccucccuggugcccggaaccaccggggagauaacuuuguccugggacgaucucgaccaaaagcuguucucggagucuguucucggagucucgccucuuuaucaucaucaucauuauuaaaauguucucuuccuucagagccccauccucgagggauacaucuaaacaucacucacuuaggagaaccugaguucuccguuucuguaaaaccaagcguagucaucucaagacacccaggagggaugagguaccaaacaccugccagucccuuucaucuucacugcccagaaguuugccuucuccauagcugggggcuguguacucccugguauaagcccaccucagccuaucagccugcccugugauagcucccugccaucuugucuccuuggccuagauuugccuguacuuauaagguagggcauguguuuggguaauagauuauuucuauguuaugauaaagagguuuugagguguuucuuuccaagaacuuggagauaaaaaaguauuuuccccaggagccaggguggaaauuuuauuuacuuauuuauuuugagacagggucucaaauagaucaagcuggcuuugaacucacuauguaaucaagaauaucaagaaugaccuugauuuuggauccuucuuccuccaucucccaaguggacuguaccacuauauuaguuuauucaucgccagggaucagacucaggacuucaugcuggcuagacaggcccuguaccgacugagccauauccccagcaaaagugauucuauauauacuguauguguguguguguguguauuauagugcgcacacacacacacacacacacacacacacacagaggcaucccacagguaagacagccuuuaggaauaaccucauaaacuuuacauuuccaaauuuauuuccugugggucauuguguuuugacuugcaucuaacagggaagaacuuuuaagauggcccagucuugucaugaaucuguuuagaaggguccuucugaaacucacauuugaggaauggaaacauugacuuuuggguguuggcuuucugagucuagauagugaccugccuuaaacaugaucucuguuggcaggcacuuguauucugacucuguuggcuaauucugguaguuucccccgaccccccuauuaaagauuuuguucccuugaagacuucuguagaauugcuucuugguugugugccuacuuuauuuucuucuuggauuguacuguguuuuuaguuucuguuuaggaucacuuaucucuggaaauuugcuucaggcucucaguuuuguagucauuuucauaauuugcauauguucuugugguuguauaguuagguguuaaaauguauccagaguaaaugcugaaucacuaaggggaaauuauucuuuaguauuucauguuugaacuuaaauugauaauucaaauaagucaauuuaaaauauuuagauauuaaaauacuaagauauagugagauauuauaaaggcacaggggaaaaaguuuuuaaaauauuuacuaauguaucuuuuuccuucaaacuuagcagauuuauaguucuuagauauaauuacuuauuuguguaugaguguuugccugcauguauauauguauaccacauucaugucuggugcccauauaagacagaagagagugucaaaucccuuggaacuagaguuauggaugguuauaaaccaccauauggcuacugggaaccgaaccugagcccucugcaagagccacaagugcuauuaacuugagcugaaccauaucuccaguccuugauuuuaacauguguguguguguugcacacauaugagugugcaggugcaugugcugguuggagugcaugaagagacuagaggagaaugucaggugucuuccuguaucacugucugccuugcagccuugaaugagagauugccauuuaggcgggccagcuuguuucugcucuuuacugcugggguuauaggcaugcuuggccgugcuagguuuuuauguagguacuagggauuugaauuccacuccucauguuacauaguguuuuuaccuacugagccaucuccucaguuccucauacuuuuuguuuaaaaaguuuuagcugcuugaacuaagucagauaaugguguaguuugguuucacauucauuauugauuuauuuauguuaccuuguguuucuuuuuucugcucuucuaacacagagcuagauaugguauacucaagugggagauucuucaagguagacauguggaagguucaaaguguauggcuauguugccauucuagucuggguucguugacuuagugauccuucugccccagucucccaagaagcugggauuauggaugugugugucacugggcccgcccagcaaaggacauuuuaaauuucaccucuuuuuccucuguuuauuuggaagaaauaaaucuugugucuaugccaaaccuguuaaagagcucuuaaacaguuaugaagauuaacuggaugcuaguuucugccucugguaaugaucguuuuggaauagguuaguuaguucauucauucguucauucauucauucagccagccagugugucugugugugugugugaaagaguuuuuguuuguuuuugagacagggucucuagaccugguuguaacaaagaucacuuugccucagccucccaggugcaggaauuaaaggcaugcauugcuaugccugcuucuguaaauauuuuauuaaguauuagauguaacacauuguauuaagguuggcuuuuuaguuuuuuggcuuuuaucguuuuaacuaaagcaacaaauuagagaaaaaagugaaaauguuuuaguuuauguuucccuugccuuuugaaugccugccaaacacuccucuaacucuuucuuaacuaaagauugaaauugaguuuugucuucuagagaugauagaauacuagauucugaaugccauuuuuagcauugccaguaaguaugguaugaauaauauccuaaugaagacaggaguaaaaucuuuaggucucugcuuucuuugccuuaaaaauugauccacagugguuaagagcacuggcugcucuucuaggagaaccuuguucaguucuaggagaaccuuguucaguucccagcaccugugugcuaacagccauauguaaauccaguuccaggggauccagcaccaucucccggccuuugcaugcacagcacuuaguaggugcagauacacccauacauauaaauauuaaaaaauauuauccaacaaauauuguugagcauuuacuauuggccaagaauuaguauagcuacuuagaauauacuaacaaaauaaaaaauuuugaagcuuaaagacaaaaagcauggagcuuacauuuuaauagaggacuuuaaacauuauuaaauacuuggccagcucuaacauuuuugcuuugcaaguaauaccugaugaaguguugguuuucucauuguaguuagugcugcccaaccuuacuuuuucucauuucaguuguuuucacuuuucuuguugauaaguaaaauccaaauccuacaugauggcucagucuaaucccagcaagugggaaucugagacaggauuacugugaggccagaauggcaacaaaguuaaguuguaagucagccagggcuacagagagugucuguaugaaaaagcagaaaacaguccuggcuccuagauggagagcuguaggcagcuauugaaugcagagagagggagaaucaguuuuuuucucagggaugaacuccuaacugguuaucuaauacuaggucaucagccccaaagaaacguauguacaagccauacuaaaugaacucagcagcuuguacuuacauauuuacucguguguguguguguguguguguguguguguguguguguguaugugugugugugccauggcaugcauguggaggacauaggacagcuuguggaaauuaggccaugaauuugaggggagaaacuggacaugggaaggguuggaggaagcaaaagaaaaagaaaggggaaaauuugaaugagaaagagccaauuuuugcuuuuuuuuguagauuauagaaaggacaaguaaaguuuucuuuuuguuuugagcacuuucuuugcuuuucuuucuuuuuguuuuugagcauuuucuuugcuuuucauucuuuuuguuugaacacuuuguauaaaaccuagagccuuacgaaugcuaggcaaccacucuaccauugacuguuuccucaauaacucuaucugugcagccuaggcuggccuggucucaacagaggucagucugcuucagccucccaaaggcugggaguaaagguaugcaccaugccuggccuaggaauuucugucuuaguucagggcuaacuauugcugugaugaaacaacaugaccuaaagcaaguuggggaggaagauguuaauuuggcugaugcuuccacaucaaugaaggaaauguccaucaaugaaggaagucgggacgggaacucaaacagggcaggaaccuggaggccagcgauacagagaccuuugagggggugcugcuuacucucuugcucagccugcuuucugauagaacccaggaccaccagcucaagggugacugaccccuuccacaauggacuagcccucucccccauuaaucacuaauuaagaaaauaccguggagccgggcaugguggcacacgccuuuaauccuagcacuugggaggcagaggcaggcggauuucugaguuccaggccagccuggucuacaaagugaguucccggacagccagggcuacacagagaaacccugucucgaaaacaacaacaacaaaaauaaaaccaauucacuuuuaauagugcauauauauuccgucuguuagcaacugauuuaacacuuuuauaugauacuuuugaaaauuuacuuaaacugacaaaguaaaacuauucuaagauugcaccacacucuccaucuucuugcagagucucauuuaucccauguuggccuagauaacuaaggauaaccuugaacuucugauccuucugccuuccccucaguucugggaucuugcacuacugcagcuguuucgauaccauaauggauucucacuaccaacugagucacauccccgguacccuuaguauagaaauaaauuucuuuuaaaugcugauuauaaaacccagggccucaagcauacuagacaagugcucuaacacugaaccacacccccuucucuuuaaguuaaauuaaguuaauuuaguguacuccauuguuuuuuuaguguauugcuaagaaucuaguaugugcuuugcacaugcauuguuauaucugcuagauuuaauuuuaaauagucuaaucguugugcuuagagaaauugauccaagaaaugaugauaauauuuaauauuauuauugacuuagauaauuuaguuugaagaguaauuuauaauuuuguuuucugguuuauaauuuauaaggcauuuuaugcucuuucauuuaaucuuuauaauaacugaaugaaccaggcuauuauuaucauuacuuugaauuggaggcuacugaggaucauauuauuaucaucagaaauaaaagggaacaugaaucuagguaugaaaaaaaauacaauuaacaugaguuuacuaccugcucaaggccuuuaguccauuucccagagggagguauucuugcuaguuugugugugugugugcgcgcacgcgcgcaugagugccuguguguauuuucuauaaugaucuucuucuuucucucaauguaucuuauaaaagcuauuuugauaagcugcuguuuuacaacuuuauuauaauuuguuuauuuguuauaggaaguucuguguuagugcauauagauacccgaauuauuuaaagcauuucaggguaaucuugugugaaaauaaucuuaguuuaaauaacguagucaauaagaugaugaacauuucuguuguuuacagucuuucauuguuacuagcacugcaguaaauauuuuacauguucgugugccuguaguuacguggcuuaguuuuugguagauguaauuauuagcucaaaugguuuaaacguuuuuuagauuuaugaguguuuuacuugcuugugugauauuugaauguguaucaugugcaugccuagugcaucagaaggcaucagaaggcaucagaaggcaucagauccccugaaacuggaguuuugaacaguugugagcugccaugggaaugcugggaauugaacuuaggucuaaugaaauaagugcucuuaauacugaacugucucuccagccccucaaaugguauauuuaugcuauguaaugcuggcacuguuugagaaugguauauuugugcuauguaaugcuggcacuguuugagaaugguauauuuaugcuaugcaaugcugacacuguuugagaaugcuauuucuuucagcuuuuuuugauauaguuauauuagacuuuuugaucagugccaguuugacauaaaaacuagauuucaccauuucaguuuguuauuucuuuaguuauggguaaaguuaaaauuauuauuuuguuuuguuuuuguaaacuguuuagguuuuuuuauguuuaaaauuuauagccuuucucucauugcuuuugccagauuuagauuuuuuuccuucauugcuggcuauugaccccauccauagucuuacauaugugugcuacgcaaguucuauaccauugaauuucaucuccagcccugauaucuauuuuuuuuuaaauuguuuuaugugucugagaguuuuugcugccuacaugcacauaugugcacugugugagugugcucuguguuauggauuagaugagggugacagauucccagaacugaaguuacugaugguugugaaccucugugugaguguugggaacugaaucuggguucucuguaagagccuucugagggcugaguguauaggcauaucacuaugccuagucugauuagaaggauuuaaguuaagcauauuuauuuugguuacaaaggccacuuauaguuuauuaaauuuuauuuauuaugaauuggcauuaaacgugaguaugaggaagauugaaaugguuuaguuugcaucuucucuguagucuguguuguugcuuuuguucuuagucuguucucuacauucugucccccccaaaucccccccgccgccccuugucauacuuuuaugcauggccccuuguggguggauucuggaccaucugguacuuuagaacaguuuaaaacugauucuggugacucugcuuugagccacacuugcuugaaauguccuggcuugucuuugugcuugguauguuuucuuucuuauauucccacugcuuuucaugacugauuuuuuuuuccuuaacacaugaauuuugguaguaucaguauucauggauuaagguggucaaaacuuuuucuuuuaggccccuaauuccuauaauaaaaauuuaacaguuuguuguuuugagauggccuuuuuuuaaaaaaggggagaauugcuugaaaucaggaauaaaaacaucaaaaucauuaauuucgugccuuagcaucccaaguguggacauuagucacuuuauuuuucuuuuuuagagacaaggccuugcauaggccgggcuuaucuugaccuuguuuuauagcugaggauaagcuucaacuccugauccucuacucuccugccuuuagcugcuaaggucuaccuagcauuacagaugugcaccaccauuccuuuucugcuuagauucaagucuaagaauccugggccagauccuucuucaacacacacuuuuuucuaaagacagguuuuaccgugugcucuggcuugccugggauuuaagaucccucugguucugacugcugaguauugauugggauuaaaggguugagugcccaagagauuuuuuuuuuaaguuuuagguuuuauaugguuccuugguugaugcauuuuuuagcuaauuaaaaaagauuaaaaaacauuuauuuguguguauguauaugugauauauguguguaugugugugucuguguauauguauguauguguguguauguauguacguauguauguauguauuaggucaaaagacaacuuaugggaguuaguuuucacucuccaccauaaggauucuagggguugaacucagguuguuagacuuggagacauacauccuuacccacugaucuaucucucugguccuuugaaguaauuuuuguaucggaugugaaggauccaauuucauauuuuugcuuguugguaucuuuuaguuguggugcagcaucccauaaaugaugaauuuauucugaauucauaauuuuguucuauuuauuucuguaugucuaaacauguacagugcaguguuguuguuuucuucugagacaggguuucacuguguaguccuagcugcccugaaacuugaucuguagaccaggcugaucuugaacucauagagauccaccugccucuagagugcugggauuaaaggcauguaccaccauugccuggcuuuauauaguuuuaaauuuuuacucaacaaugucuaguuuuucagaaacuguuuuuuuuaauuaauuuauuuauuuuauguauaccaguacacuguuguugucuucagacacaccagaauuggguaucagauuccauuacagaugguuguaagccaucaugugguuucuggaaauugaacucaggaccucuggaagaggagucggaguucuuaaccacagagccaucucuucagccccagaaacuguguuuuauaguuguuaaauuuacuccuaaguauacuauucuuuuugaugcuacugccaauggaauuuauuaaguuuaucuucaaacuuacuguaaguacguaaacuauagucacuuuuuauauugguuuuuuuuuuuuuauaucuuauaaccuugguaacuuuguucauuuuaauggauccuuuaguacuuugcuuauaaaaagaucuuacucucugugaauagggauaguucuacuucuucuagucugguucccuuuauuucuuguuuuugucuauauucccaacuagacccuccuuuauaauaaugaaaagauguggcaagcauagaagcaaugugccagucuuuggggaaaaccgugcauguauauaguauagccucaucacucacaaaccuacagaaagaaacugaaauuuuuuuuuauaaauguauauguuauguauguauguauguauacacacacacacacacacacacacacacacacacacagacuguguaguaauuuguagcaauuuacuuuuuuuuuuuuuuuuuuuugagacaggguuuuucuauguaguccuggcugucuuugaacacucuuuauagaccaaacuggccuggagcucacagagaucugucugccgcuguugcuacuuuuuaaaagaaauuuuuacaugucaaaauugauaaagaauauugcuuuuaauuuacaacagaauuuagggguuuuuuuuaauguagacaacugugauuuagaaauuucacuucauugcuaaaaagguucauaugcaauuuuguacaauuaaaauuuuagaucuuuauuuucccaaauuucccaaaucaaaaucuuguuucauucugacuauguaaguauucuuguuauaaaggaucuucagagaaugcacagugcuauugagaauguaaaaccaugcauaaucucugcacucuagucauuccuuuucgauauuuguguucaugaugugugcuuuucuaacaucuaaaaagugguuauauuuuuaguuuagcaacaaugacaagagcugguuuuacugaggcacauaaaaacauucuugguucaucuugcuuaauaugagugacguggcaauuuggaugacuuuuucuguucucaccuauaaucacauuaguguaguaauugacacaggguguacuuuaaucaccuuaauaaauugcugccuucguauauguuuuugcaauaacuagugaaucuauguugugaugaugaauaagguaugguuuggagcucagggguuucuuuuuuggaggguuggggguugaagacaagaguuucucuguauaggacuggcuguccuugaacuuacagaaauccgacugucucugccuccuaagugcugggaucaaaggugugugccaccacugccugucuuggagcucagaauuuuuuauguaugauuaaaaucauacauaaaucccuuugaugccaauucaguaaaaucaacuccucauaaucuuuacuuucuuuuuuaaaacagacauuugccuuuagguugguaaucauauacuuuaaaaaaaauuuuuuuuuauuuuuuauuuuuuaauuggguauuuauuucacuuacauuuccaaugcuaucccaaaagucccccacacgcucccccacccacucccacuucuuggcccuggcguuccccucuauugaggcauauaaaguuugcacgaccaaugggccucucuuuccacugauguccgacuaggccaucuucugauacauaugcagguagagauacgagcugggggggggggguauugguuaguucauaauguuguuccaccuauaggauugcagaucccuucagcuccuuggguacuuucucuagcuucuccauugggggcccugugauccauccaauaggugacugugagcauccacuucuguguuugccaggccccggcauagucucacaagagacagccauaucuggguccuuucagcaaaaucuugcuaguguaugcaauggugucagcguuuggaagcugauuaugggauggguccccggauauggcagucucuagauggucuauccuuucaucucagcuccaaacuuugucucuguaacuccuuccauggguguuuuguuuccaauucuaagaaggggcaaaguguccacacuuuggucuucguucuucuugaguuucaugccuuuagcaaauugugucuuauaucuuggguauucuaaguuucugggcuaauacccacuuaucagugaguacauuuugugugaguucuuuugugauuggguuaccucacucaggaugaugcccuccagguccauccauuugccuaggaauuucauaaauuuauucuuuuuaauagcugaguaguacuucauugugaaagaucuguaugauaagaacuucaagucuuugaagaaagaaauuaaagaagaucucuuagaagauggaaagaucucccaugcucauggauuggcaggaucaauauaguaaaaauggcuaucuugccaaaagcaaucuacagauucaaugcaauccccaucaaaauuccaacucaauucuucaaugauuuagaaagggcaaucugcaaauucaucuggaauaacaaaaaaccuaggauagcaaaaacucuucucaaggauaaaagaaccuuugguggaaucaccaugccugaccuaaagcuguacuacagagcaauugugauaaaaaaaaaaaugcaugguacugguauagcgacagacaaguagaccaauggaauggaauugaagacccagaaaugaacccacacaccuauggucacuugaucuuugacaaguggaaaaaccauccaguggaaaaaagacagcauuuucaacaaaugaugcuggcacaacuggagguuaucauguagaagaaugcgaauugacccauuccuaucuccuaaggucaaaucuaaguggauuaaggaacuccacauaaaaccagagacacugaaacuuauagaggagaaaguagggaaaacccucgaagauauggguacagggggggaauuccugaauagaacagcaauggcuugugcuguaagaucgagaauugacaaaugggacuucauaaaauugcaaagcuuuugcaaggcaaaagacaccgucaguaagacaaaaaggccaccaacagauugggaaaggaucuuuaccuauccuaaaucagauaggggacuaauauccaauauauauaaagaacucaagaagguggacuccagaaagucaaauaacccuauuaaaaaauggggcucagagcuaaacaaagaauucucaccugaggaauacugaauugcugagaagcaccugaaaaaauguucaacauccuuaaucaucugggaaaugcaaaucuaaacaacccugagauuccaccucacaccagucagaauggcuaagaucaaaaauucaggugacagcagaugcuggcaaggauguggggaaagaggaacacuccuccauuguuguugggauugcaagcuuguacaaccacucuggaaaucaguuuggcgguuccucagaaaauuggacauaguacuaccggaggaucccgcaauaccucuccugggcauauauccagaagauguuccaacagauaagaaggacacaugcuccacuauguucauagcagccuuauuuauaauagccagaagcuggaaagaacccaggugccccucaacagagguacaaucauauacuuuaaaaaaaaaccucaaacugagacauuuuuaagaaugaaaagggagugcuacaaauauuuaacauucuacacauuuggggguuaucucuauucagacuaguuuauuguauugguagauaaguaaaauaguuccauuuaguuucuuuucuuuuuaaagauagguucucaccucuguagccuaagcuggccaugauauuauguagcuuaggcagccuugaauuugaauccaucuucuugccucaacuucccuguuacugggauuauaagugggagauuauaagugcucuguuuaugaugauuucacauguucuaucauuagauccugaauuuuguauacauuuuauauuuuauuccuuucuaguacagaauagaaauuuaugcaguuaaaaaugaaagacucuugauggaauuauugcaguuaacuccagagcaaaauacaagaauuccagaaugaaaucuucuauucuguuuuauuucucaccauuuuguucacucuccugugcuugugaaaucugcaauuacugucuuagcaaaaguuguuaauaaaauugguaguugcuaauuuucaaaagcuaaguuucuuuugcagcuauuuucauuuguguguguugugggugugugauauauucaugugcauguguuuuuguacaugcagaggucagagggggaugucuagugucuuucucucuuguucucuaccuuguucccuugauacagggucccacugagcuugaaguucuccauuuccucuaggcugguuggccagcaaccuccugggauccaccugucucuccuucaugcugggcuuguaguuacacaugaccugcccggcuuuuauguggguguuggggauuugaacugagguucccauguaugcacaugaaacucuccucacugagccauguccccagcccacauuuuuuuuuuuaagacagagucucauauuguuuuaauugaacuuuaauccuugaaaaaggauuuccaacugguuuuguacaguauauugucaaguuuuggaggacuuaguuuuaaaaagauuuaccacuaagacacuuaggcaagauuuauaaggcaacuuuaacauuuauaaagacuccagcuauuaaaaucugaugagccuguuauguugccauguugaaguauuuguauucaauacuagcuuuauccauaacauuucaacugucucuauauaaaagcaucugugacuguugacauucagcauugacugugacccugaaacuuccauaauaagcagccuugaagguuuccugcaaguuuucccugucuguuuucuggagaaaugaaaaagugcuuaguucuguguuaaacagcauuugguuguuuuuuuuuuuuuuuuuuuuuagcuuguugcuccuaaaagggcucauaguagauaaugaaacagugguuacaaaacagcagaacagauaauuauaaguauacuuuacaaagaauaggaaaauaacuaccaaauuuucagaccauuggcuuuuuguacaguguugauuuguuccuaacauguuuucccacugacauugcuagcugguagccaggugaucugugucacugcauauaccacuuuuucuagccacucuaccaaauagcuaacagcacuacuggcaaacucuucuauuuuacaagacauuaaagaaguuaauucaugucucuugugucaggggcuauaucuuuuaaugaaucucugcuugguuuucuuucauuaaaauuuuuuuaaaaauaaguuaauuuauauauugaugggggaaugugcuggcuuauguguggaggucggaggacagauuguggaagucaguucucuuccucugccauguggauucugggaugaagcucagguugucaggcaucucagcacagugagccauuucuaugucucugcucauuuucuuugaaagaaagguguucuggugaaucuguaaagaaucaagacagcaaaauggaauuaucacuugucuuucaaaugcugucaguuguuuaaguuguuaaaauacuuaaccccuauuagcauauaccguggcuaggaguuaguauacacugaaaguauacuaaguccaucuggguuuauauuaauuauuuuaguguaauggauaauaaaauaguucauuucuuaaugugagaaaucugcuuggaguaggaaaaccggaauuuguauucugauuucucucucucagaaaugaacucugagacugaugacacacaccuuuuaccccagcacuuaggagacagaggcagguggaugucugugaguuccaagacagcuagagcuacacagaaaccuugucucccaaaacugaaaucaaagaauguuuuguuuguuuguuucuuuuuuguuuuguuuucuuuuuuguguggaaaagcagaaacuaugggauauguguacaugcuugguauacacauaauauaucuugaguauauacugauuuauacacaguauauauuccauacugugcauauuuauuucuacucaugcucuuccuccuccucaccucuuaauaaggacuaucagaucuuucuuaaauaguacccuccuuuuuuugccuucauggacauucagauugucaacugaauuauuuaaaauuauacccuaaguuauuuccuauguucuuaucuuuacacaaacacacacacacacacacacacacacacacaccgcacacacacaaucacucuugacuuuguuuuccuuucaguauccucauuucuuuagcuuauaccauguuugcuauggcaaaugaauggugcucuuuauaaauuaucuucuacaaaauguuauacuguuaucucuuguucaucacuucuuuuuuuuuuuucuuguaugugugugugugagagagagacauggucuugcuguauaggucauacuggccucagcuagguacauaggcauauaccaaccaccauguccaugccucuuccuguuuuguacagauguagcugggcuuuguuaaaugaaugcauacauguuauuucuaaguagauucacccucuuucuuccuaccauaauuaaauuccuacuuuccugacacccuugaacuuucauagaugcccugcuuugcccugaacauuccucaauauuccuguacaggcagaccugagcuuuugagcauugauacuuugaggcugccuugcagaugagcuauuauguucauuagcugaacaaggaacccuuugaauggggguguggaaugaguggcacugccugcagauaagcaauucaagucuggugacaucagaucaucaucaguacuccaguuuguuuaccacagauuguuuguuguugcuguggucacaauuuuaugucguuuuacaugcuaggcaagugcuuuccuucuguauugcaucccuuaccuucggcugauuacuuuauugaaguagauuuugaacugauuuuuaaguaccauggauacuuggguagagggugggcauuuugaagagagcucuaaacugacuucuguuauauggguuucugguuagaauuaugacuuuguucuccugguucuuuguaaccugacuguuacucauucuccuccuuguccccaaagaagaacaaaccccuuuccccaaaacaaccuuucuaaaaugaucuuuuuaucuuguuuuuguuuuucaaauaucuuuagaaugaaugccaacuauauaucacaagaaguuauugaauaaaauauaauugcuauuuauuucuauuuuaguugucaagugggaauccuguauaugaaaaauacuacagacagguaagauuucauuauuuguauucugaauugaccauaaaauaugcuaucaauuguugauuauaugcauguagauaagcauucacacacacaagaagcagucacuagauauguuugauguguuaugcuuucuauuuuuugggcuuuagccucuagcuuugaguacuugauacugacuuuguuuugagaggguccuacuaggugaucucugcuggccuuuuaguacauaauccucaagugggaacuugaggguucuuuggaaagucaguuguguuggaugguguuuugauggagcaaacacgugaaggaauguuuuccugaaguagacacagaugaaagaaagacuaaggcagacuugugaaggaauguuuugcugaagcagacauaggagaaaagauguucugcuaaagcaagcacgugaaaggacauguaaugaaggauucuuugcuaauaacaaacacguauuggucugccuugcauugaguauuugagcugcauuuguugggacucuucagacggggcugauuggaugcccacacugaggcaagagcuguacugaggcacggcauguggaagacaugugauguuugauguuucaaguuuucgcacagccaagaacuucugguguuccuacugaucuccugcugacuugagccaaggcugaggcuggcugucucugcuagguuguguuaccacaguagcuaaccagacucuguauagaacuggacugcugguuuaucugugaaguguuugugagugguucgagcuacugcugccugcuaaccugugaacugaaaugcugacuuccagacagcagagauggaguugcuccaaagaagcuuuccaaacagguccacuucacccucagcauccuuucuuucccaccaccucuggugaguggugggcaauaaaagagguuaaagcauuuaagaaccaucauuaaagauaggauuugaaaaaauuaaaguuacguaauccuaucucaaucuccugugugcugagauuauaggcuuauaccagacacuagcaauuaguucucaggaaaaugaaagagaauuuaguuaccuuaaauauuaguguuaaaaaaaucuuuagaauauuagacccacucauucagauaaaaauauccaaauuaauguguaagccaaagagauauaacuauuauauguuuguuuguuuguuugaugguuuggugguugguucuugcuccauagucuggauggccuggcacauagucugacuugucacaacccuccugcaucagccucuaguguugagauuauaggugugugcuguuacaccugucuuauuuaaguauguuuuacagacugaaagcauggcugucacacacaugaauugaguaugggcugagguguaacucuuuggcagauuacauguucaacauacacaaagaccuagguuuaauucccagaacugcagaaccaaucaaccaaacaaaacuuguaucaaggcuuuuauuaauuaauaaaacucagggaaacauucagauauaaaauaaagaauacaaaaacaagaugugauaauauuuguuaauccuagcacuuaaaggaggaagcaagaggaucaagaguucaagauaauccuggguuacauaaugaguuugaagccagugugagcugugugauacccaacuuugaaaagcacuaaaagugaaaaugagaaugugaguccuagugauacucaaccagaaaauucauuugcauguguauggacaagaauaauuugcauucuaauagaguucuauaauuucucauuccacaguuuaaagucuuauuaaaaaacuaaccaggaacacacacauauuuuagaucagauaauguacugauguucuagaugguuucaauuacucauguuucucucucucucucucucucucucucucucucucucucucucucucucucucucugugucucucucucucucucugugucucucucugucucugucucucucucucucaauauuuuugagacaguuuuaugcaugcuaggcuggccuugaacucauuaagugcagaguaugaccuugaacuuucugccucugccuuccaaguguugugauuacaaguaugugcuccugugcccaguuuuguuugcucauuucuguguacucauuucacagaaaacucacuuaauuauagaaaagauuggucucauuuggcuugcagucuagcucauuucagcagauaccaguuagccaauacagagaucccuuugguuuugacuuggaagucuaggacuguguacuacuuaguagcuucuaagucuaauucuuagaaauauguagagucugauguaguuuuaauuuuaagcacauacaugcacacauuucuuaagagugggauucuuuuuuuuuuaaaacuuuuuaaaaaaaauuuuuuuuuuaagauuuauuuacuuauuauauguaaguacacuguagcugucuucagacacuccagaagagggagucagaucuuguuacagaugguugugagccaucaugugguugcugggauuugaacuccagaccuucggaagagcagucgggugcucuuacccacugagucaucucaccagcccaagagugggauucuuguuguucaggaaggucuuggacaugagggcucaggucauucuccugccucuuccucaugaguaucggggauuacaggucugugccauugugcucaauuugacuuuaugcuuuuuuuguuuuguuuuguuuuuuaaaucuuuuugauaugagauuuuauccaugauggcguugaggauaacuuuguacuucugauccuccugucuuuacuucucaagugcugagauuccuguuguagacagcaaugcccacaacaugccaguguugguuauaauuuuuauagagucuuguuguguagccagacuuccuuuaaauuuuagaucccccuuccugagcuuccccagugcugggauugcagggaggaugggcuggggacaaggugucauuguagcccaagaugaccucaaacuugcuguguaccagagguuguccugaauugcugucguccuaccuuuaccucugaaaugauagaguuauagguguuugccaccauuucuggcuucauuacuguuuuuuuauugaacuuugaaacuuuucuuauuuguucuucuggcuuuagguuaggaucuaaaccuuagaaauuuuuuuuuuaccauauuuccauuuguuaugaauaaaagaauugaguuuuccccagauauacuaaaguucuuagcuaaaaaaacccuuaauacuugugguggugaaacuuuauaaaaccaacauuuuucauucuuuguguguguguguauguuugcauaugaaggugucuuuacucagguguccuucaccuucuguuugagacaagaucugucuuuggucaaaugugcuaagcuagcaggccauugagcugggaucugggauccaccuguuucagaauuucuuuucaccauagcaggaauuauaggucaccaccaucuccagccuuuuacuugaguucaugcucccauacucaggcucuaaggcugacagaaccaucucuuuccccucaccgugcaugcucagucuuucuaggagagauuuauagauauugacuccacagcaacucacuauuuuuuacagauagcuuguccuagcacaauaaaaaagaauuguucuuaaauauggccuuguauuauauacuugauucauuuaauuauguccuuuuaaaaagccaaagaaguuguugacucuuugugauuuauuauauugucauaaaaaguugucuuuuaguaagaauuacuguuuugauacucugauguaucaaagaaaucagguccuauuggaaaauguuucuaucagguuacuaaaguggauccuacuaauuaaguagugagauagcauuacuaagaagaaaaaaaaaaguacuuuuuucacauauuuuugauaugaggguguaccuuacugauagacugcuuguuuacuauguacaaagcugaggguucugucccaagcaguggaggugaggugagggugggggaaugacaucuuuaagguuucccuaggcagguauaguuguauacacggugaucaagaacuugggagguagagacaggaucggagucaucuucacuuacacuggaguuugaugcaugcugagacaagaguaucaugaguuuauggcuagccuggguuacauaaugagacucuugccuguaaaaaaaaagacuugggcauuauggaauaccugugaucccagcccuugggaagugcagauggggugggagagggucaggaguuuaagguuagccugggcuacaugagacuuuggcuuuugaagcaaaaaacaaaacaaaacaaaacaaaacaaaacaaaacaaaacuaaaaccaaaacgaagaugaaaaaagaauaggguuuccccuauucuugccaugccugcccagguaaaggcaccugcuguaagagccugguaaccugaccucuacacacaugccaugccccugcccccagcacauacacagagaaauaauuuuaaaaaauugauuuaaaagauuaccccccacacccgcaaaacaacagaaaaagaaaagaagagaaaaagggaaauggugugaggcaggaggaucacuugagcuggcuaguucagaguuagcuuagguaacauagcaaaaacuuaucuuuuaaaaaaucaaaucaaauaauucuaauacagagcugcguauaugcaucgcaguagagggucuccauaugggagaccuugagcucaaccucuaaugccugaaaaguaaagcaaaaucccaaugccaugucaaacaauaagcaccauuacauuguaaacgauuuguucaggaguuugcuuugguguaguacaucagcuuccaggcuaaaaagaggccagaggccuauuucaguguacuaguauagacuaaaagucuuuaggugucuuuuucucuccuuuuugaaaugaggucuuuuauuuuuuuuauuuuuuuaaaagacaggcuuucucuguguagcucuggcuggcuguucuggaaaucaaucuguagaccaggcuggccucaaauucagagaugucugccccuguucugccucuggagugcugggaguaaagggaagcaccacagccaccacaccuggcuauugagucaugauuuuaugcagcgcagacuggcuuugaaauuuacuguguaauggaggugugucuugaauuuccaauucucuugucuuuucccaaguguugggauaaaggcugugcugggauuggagagguggcccaggaggugacaacacugguuauucuuuuccaggggaucugagaucaauuucuagcauccauauaguggcucaaaaacauuuguaacuccagcuccacggaauccaauacccucuucuggccucuguggguauuggcacauaugugguacacagauauaugugcaggcaaaacaacacacacauaaaauaguuuuuaaaaaggcaugugcccuaccagccagggaguacacauggcuccggcugcauauguagcaguggaaggcuuugucaggcaucaaugagaggacagguccuugguccuaugaaggcuugauagaugccccaguguaggggaaucgaggguggggaggcaggaguggguggguggguggaggaacacccucacagaagggauugaauaggugguuggggggugggaacuggguaaggggcuaacacuugaaauguaaauaaauuuaaaaaauaaauaaaaaacaaaaacaaacaaaaaggcgugugccauugugucugcuuuuuuguuuugguuuguuuuuuuugagacaggguuucucuguauagcucuggcuguccuggaacucacuuuguagaccaggcugaccuuaaacucagaaauccgaccaccucugccucccgagugcugggauuaagggcgugcgcuaccacgcccgacuugugucugcuuuuuauuauucuuuuucuuuuacuauacugagaaucaaacauaaggcuuuauacaugcuagguaagugcucuaccacuaagcuguguucucagcccacaggucuauucuuuuuaaguguugaaauuuaaauccauugugaaacuuugaaaccuuguugaggacauagauucuagcuuguaguuuauagcagacagccuuuugcaggaaccaggacuauagaaacugccuguaaggugaaguaaaaggauguucuuaauuuguuucuaaugacugcaagaauggaagauuauaagauuccauauuaggauacaguauauaaauauuuaaugaauucaaucuauguuuucuuugaguguauugauaugcuggaugugaauguuccuuuccugccaugguuaggaaguaagcaggcaaagaaacguaguucuagagaguucaaaugcauguuuccugaugcuuucuguacuuccuucuucccccaaaauuacaggauuaggcagcuguguuuuuucuuauuuuuuauuuuugcugagugccucuggccuguucuuuccuuuagaagguauuuucuucuuuugagucuuugcugguacuggacuggguagaauacuuuguguauuuacagaaaaucuagucuuuuucuuuuuuaaaaaaauuaauuaauuuauuuuauguaacugaguacacuguugcagucuucagacacaccagaagagggcaucacaccccauuucagaugguugugaaccaccaugugauugcuggaaauugaacucgaccucuguguucuuuacgacugagacaucucuccaccccaaaaauuuagucuuuuaacuaaacuagaaacacaacugguucaugaauauccuagaauaauauuuccuuucccuugacuuuuuaaagauuuacucuucauauuuacaaauagaaauuuagaaaaaucuuuacaaaaaugaguuuuggguuuuuguuguucuuguuuuguuuucuuguuucuuaugauugcauucugucuuaaaggaaaguccccaucaaugaaaaugauuuguuucucuuaaguacuagauaaacuaaauauuugaacguugucaugacuuacugcuugguuuagagcugauacugcuuugauuuuuuuuuucuaauauuacaguuucuaagaguagauauaaaagcaguugaucuaaaacuauuugaagaggcagguaacauaaagaacuauuucaguuugucagaagaccucaagaguaacuuuuuucuuuuauuggcauuuaaaugacaaccauaaaaaugagggguuagaagaucuaguucauguucugacuacucauuugcuuuccugagcuuuuuuuuuuuuuuuuuuaaacuuggauaauagacaugagagacacacguuuuacaaauugacuccugucuagauggcaccauucuuuuaagacucugcagaguccuugcccuuguuagcagaaggauucugguuccaguucuuaugguagggaggggagacagagaaguagugguaauuuugauuuuguguuuuauugucugcuuccuguuucuaucuuuucagguugaggcaggcaauacuggaaggguguuggcguuagaugcugcugcauuccugaaaaagucagggcuuccagacuugauucuuggaaagguaguauguguuuauuauaacuagauuuugcaugaauauguagaagcauaaugaaacugcaaguagauucagaaggauacagucaagagacaggcaaguuagacugaguuauagaagcaguucaaguaauaggaugggguguuaugguguauuaauuuauccuuuugaaaauuaaagugauguggaacauuuuagaaccaucacauuugacuaggaugaagugaggaaggaauugugcauuuggguauugggaagaggcagugcagaguaaggaaacuugcugucuacucaaacaguuggaccuauccuuguuccuuuuguaaagcugcccguauuuaauguacaaaguagagugacugagggacuggaaagaacagagguggaaagucccucucgugccaaauuguuauguauuacauugauauaugauaauuagaaaucuugaaaaauauucaauauuaauaauuuugugauucacagauaaacauuaacucuccaaagggaaaaaaaucaucuuaauaagaauuaaaaucagaguaguguguuucaguagacacacuuuauucacaguuaagcccugggcuggugaaaggacauuugacuagaaguugggacuuggguuuaauuuuucccucauuccuuuaguguucuuaagucagaucaucuaaccuaggccuucaugugguugaaagaguugcauugaauaaucuuuaaugauucuuagaucuguuuauauagaucauaaaguuacaaauuacagggacuugauuuaucuuuuaaaugauuuuuguuaaaauauauacaaagauugauucuguuuuccuccuaaauuucagauuugggauuuagcugacacagauggcaaagguguccugagcaaacaaguaagauugacagauucaugugaauuauguuuuuggcuaauuugaaagaaaaagugguaaauuuuuguuuuguaagcuaaauauuuguuuuucaagaccauguguccuaucuaaugacugaacauuuagccgauagcuaaaguuuggugacauuguuuuuugaagcauauaucuauguauauguauaauuuguaucuuauuaauuaaaugucuugaauauaugagaucauaaguaaacauugguuuuauaaguaaguguuaguauagaucagcccugaccuuugaauggagucuuuggggguaaucaaaccucaauucuuguuuuacuucuuauauguaaacaaagaaugguuuacaagaaggaacuacacucuagucuauaaauauaugaaaguggcuauaaccaaagauauugaauaccauacacacacacacacacacacacacacacacacacacacacacuuuauguuuggcuuguugaaaguuuacuauguccugauacucuuguuuagcaccaacuguguaaaguucuuuuucccuaugaacauagcuaaaacagggucaaacuagacaaagggugagaauaauaauuagaugauagucaaaauacccagccucauuuauaugaaaacuguguuguguguauggguguuuuaccugcacauguccuuguaucacgugugugccuggugccugcaggggguagggcauuggcuccccuggaacuggaauugcaggcaguuguaagcugccauguaggugccaggaauugaauccauguccucuggaagagcagacagugcuuucaaugauggagucaucucucuagccucaagaacacccaggguuucaggacuagauuauaguaguucucauuggagguucugggaagaagggccaguuuaaggcacugaggacauuggcacucagguaucgcccacucagucagcaaauauuuguuaggagccaagcuuuauaaaugaagaggugacaaugacagauacagcuccuccuaggaguuuauaauauaaaaacuucuuugcuugguaguacuggacaucgaguuugaguugucuuugucauguccagguugcuagguacaugggucagucauugaaguuugaguuuacauugaaggcauaguguuuuguucuggaacuuugaagaaugauuuguguugaguuaaaguuccagccuacaaucauuuauuuggcugcauuguuuuuggguuugugauaagcagaaugucaaagcagaaaggcacaguaaauaaaagcuugcucaccucauuucugcugagaaggaaagagaggagaaaaggcuggggucccaguaucucuuucaagggcucacccucaaugaccuacauaggcccucccucuuaaagucuuuucaucuacuggugacaccacccaggaccaugccuuuagcauaugagcguggcauaguauuaggggacauuuaagauccaaacuauagcaaagaugauacuuuuuaaaaaguguguguuuaguguguauauguguguacauguucauguguaugucugaauacagaucugcauaugcccugguguacguguagaucagaacacaaccucucuaguguuagucuucacucucaaccuugauugaggcaggauuucuuuguaguuucaguugcauaugccaggcuagcuagcccauaagcuuuugcagauucccuucuccaccucugaucuagccauagcaugcugugauuacaaauguguacaggugcauccagcuuuauguggguucuagagaucugaacuucagaccucacucuugcauggcaagcacuuuauccacugagccauuuccccagcccaaagguaauacuguuugaauuauccuauaaaagaaagaaaagaaacuaguauugagaauuuguaugacaaaaugacacuuggugcuuuccuccuacagaauaguuuuuauuucauugcuccuaauacauugcaaaguagauauuauuagacagccuuccuuuuaggguugaaguuuauuuaauuugcucaagucauuauaguuuuagguagcagagcuagaauuuaauggagaauuacuucacaucagagcucauccacacuggagaaauggagcugauucuuuaagcauagcugaagaaucccagcauugaaagcuuaguggugcaaacaaaacgucagcagaagagacaugggaagucaaaggagagagaaguggggaugcuucaugaugcuccucagaugagaugagcuuugaagcaucauuuuugccugagcugcuaagacuauaaggagaaugaaggagcuaggggguuauuugugacuuaggcaguaguuucucacuugugagaguugaagucugaucacacagaaacuucuuggguaaaugagaaaaaaggagagagaggaagaaaaagugagacagaaggaaagaccaagacagagagugagacagacacacagaaggggucauacacacgcacgcacgcacgcacgcacgaguguguguuuuaccaagggucugucauguauaugagacaaguacucuaccaucgaguuacauucccagucccaaggagaaucucuugaaauauuucaagaggcaaauauugaguaaaacagauggcuugcaaggccagaaaggguuaggaguagguaagaagggaauaggugagaaugggcuuggcuacaaauaaugaaacauugaaucagcaacaggcuuaggauguugaaaaacuggaaaaaauauuacuggaauaaaacacucagaaugacugaaaacaaauucaguuucuuuacauuucuuuacuuaauaaacuugaguugagacuuaaaguauaaugacuuuuggugaagauuuguaaguauuuuuaagucaagcaguuaaaauuaucuuagauacuguccaauugcuuucuguaguucuuuuggaauagcagugauuagcucuuggacuccugauucaauuucaaaauuacaucucccacuccagaguugacauuugauaacaauuaguuuauuucauuuuaggcuuccccacucaaaugagucucaguuaauagacaacacuuuuuagugaaauugaauauucuuuaaaguaugaauauucuguacaguuuccacuuuucauguaccauaguauauuuaaacauuuuuaucuauguuacuuuuucuaguaaugguaauagauaauaaaaauuuuuugugucuauuuuccucaauuuuaaagcaaauguuuuugaaacgaauauacuguuauauuugcugcuacauaauacuguggaauaauugugaauuauuuuguauuuuauauuuucaaauaauaaaguaggcuuauaagaagguagauugggaaaaaaagcuccuaacauuuaugcuuuucuuugucaggaauucuuuguugcuuuacggcuuguggcaugugcucagaauggacuggaaguuucacugaguagccuaagucuggcuguuccuccaccaagauuuguaagaaauuauuuuauauauguaaaauuuauuuaauuauaaagaucaaggcuggggagauggcucauuggauagagugcuugccuuuguaaacaugagggcuggcguucagaucacuagaaccaacauaaaagcuggauaggcauagugaucugcuuauaaucccagaauucagaugagacuggauuccccagggcacucugguuagcuaaaguaguggacucagugagcucugagucacaugagagacccugcccaagaaauaaaguggaaagugaauaaagacagcaucugacgucaaucucuggccuccacacagaaacauacaugaacacauacuacguucauaaaaaaauuuaccacaugggcuggagagauggcucaaugguuaagagcacugacugcucuuccagagguccugaguucaauucccagcaaccacauggugacucacaaccaucuguaaugggauuggaugcccccuucuggugugucugaagauagcuacaauguacucauguacauuaaauaaauaaaaccuuaaaaaaauuauaucacaugaguugaaauaaguaacauuuuaauuuuuccaccuuaaucccuaucacuuagcuaccugguuucauuucuuaguaauuauggcuguuacuaguuuucuaugucuuccaguuauaugugcauacaaaaccauaaaugcacauuucuuaauuuucuaauaguagcauuuuauguaguugauucuguacccuuuaaaacaaacauuuuuuagagauacuugcauguuaacaugaacuuuguauaguauuugaauaguauuuuuuuguuuauaucuacuaugauuuauauaaauuccagcuaauaggcauaaagauaauuuuuuaaggaaaagugcuauacugaauaguaauuuuguuuauauaauuuccuuauguagaaaauguaaaaauaaacucucaagagugauugucuuaaaaguuuuugcauguaucuccuggcagugggcaaagagacauuuguuggugcucuuacaucagucagggcagagcagauggcaguacuuuguucauccuggcuugaugcuuggcuugauggccaaugcuguugcaugccuggggcacauaagaaaaagagguuuugcauguaggaucuuacuuuuaucagcaguuggucagcaugucaguuuccuugugcuuaugcuugcacacuguuagcagacuuagagauccuugucagcuugguggccaaugguaugugaaguaugaaaauauuugucuuuuuagcuuaugggugagagugauuaauuuuucuuucuuuuucuuuuuucuucuuuuuucuuuuuucugagacagaauuuuucuguguccuggcugucuuggaacucacucuauagauuagaguggccuugaauucagagaucugucugccucugccuccccaguguugggauccaagucaccaccacuaccaccaccuggcugauuaguuccuaagauacugaauggcuuauauuccacuuauggaaaugucuaauuuucuuccugaauucuagagguucuuuaaaaguuaggaaguuaacucuucauuugcaaauauacucuuccaauuugucauuugucuuuuauugggcuauauuauuuaccccuauauaacaaaaaauuuuuuuuuuuuuuuuguuuuuuguuuuguuuuuuucaagacaggguuuuucuguauagcccuagcuauccuggaacucacuuuguagaccagguuguccucgaacccagaaaucccccugccucugccucccaagugcugggauuaaaggcgugcaccaccaucacccggcuaacaaaauuguuuuauguaaacaaauugucaagcuaaaacugauuguuucuuuuucuauauuuguuauuccugauggagguaucuuuuaugauaacuacugaacauaacuacugaauaggguuaauaaaauguauugaauaauuaaucuuuuucauaccaauuucaaaugccacaucagggaugaccuaaauuugcauaugcauguugauguuuuuauggauuuuucuguucuuaauuauugaucuuuuuauuugugugcugauuuuuacaauguuuugauuaucuuuguuugggaaauuauauaugauacaguuaucucuacuucaaacucuacuccaaacuuucucagaauuuuaauggauuucguuuuaauuuuaaauuuaauuuuggugcugcuggagcuaaacccagggccuuauaccuacuggacaaguguuuuaucacugagguaucucugaccccucuuuuuuuaaacuuaguauuuuagaauuauuaaggcuuuuaacuucagggggcuagagagauggcuuaguaguaaagaacacuggcuucucuucagaggacucagguuugauuuuuagcaugcacaagguggcuuacaacugucuguaacuucaguuauuggggauucaacauacuuuuccgguacaugggcaccagccauacaugugguacacaaacauaaauguaggcaaaauaacuauacacauaaaauaaacuaauaagguaaaaauacuaaccaguuuugagaauauguauuucucuguuuagauaugacuuacaagggugccuuagguauuuguugccuagauauaauuauagggauuuuucacauguauuuaccugucuucagcaauguaaaaauaaaaacuugagggugcugccguuagguaucaugacaaggaacuuacaagugcuaaaugagcuugguuuuuagucugcuuuucccccgguaauacugagggaaagguuguaaguauuuuuguuaacauucagaauagaugccuauuaucuuacucuuaguuguaggagaaauucuauagcuauguguuuuaaguguuguuccacugugaaguaauuuggcaaaaugaaaauguuuuuauuucaguggacaguagaugaaggucuaauuaaaguaaaacaguguugguauccagcauuuuauacaaauauauuuaaauacaaaaacuacauuuucuucauugauuauuagcaugaggacuucaacaguucauuguuccuuuauuuccuagcaugacuccagcaguccguugcuaaccagugggcccucaguugcugagcucccgugggcuguaaagguaaggaaguuucuugcaucuccuuugcuuccuacuuauaaacaccuuucucccugcccucaaaauacauuguucugcacuggacuuacauaugcauguucagauaguauaggaaauucagaaaauacugaaauuaaaaaacuugaggaaugccuuagcucuuagagauuuugugacauuuaaaaaaccauuuucuuucaaggaacugaaagauagaguaucacuugugauuuguuacuuuguugcuguaggucuguuugagggacuaggugaucuucaaagcaucccaucucuugcuuugauucuaacucaacagcagaaaaaggaaauauaguguuucaacuagucuuuaguagagacacuuugaaauuauuuaauauauuuugaugagaauguuuuuuuaaaaaauguuaccuuauaaucuguuauuugaggauuugauacuuauaugugcaguuaaauccuuuucaugauuauuuaacuugucaucuuuuuuuucauauuguagucugaagauaaagccaaauaugaugcaauuuuugacaguuuaagcccaguggauggauuuuugucuggugauaaagugaaaccaguguugcucaacucuaaguuaccuguggaaauccuuggaagaguaagauagcaaacuucaaauguaguuuguuuguuuguuuguuuguuuggaaacauucuuaauguauagcucaggcuggcuuagaacucaugaaccucuugccugagccucauaagugcaaggauuacaguauuguacuagaugcaguuauuauauauucuaauuuuauauuuaccaggagcacuaauguaauauauacagaucuuauuaaaguuguaucaguauagaauuuuuguauuuguaacauguaauuuauugucauuguaguucugguuuuaauuauucccaauaaaauaugagugguuagauuuaguuacaucuguaaaguccauuaagcauauuuauaucuuuccauguguaugugaaugauccaguuuuugaaaaauucuaagggccaucuuuauuuuucauuuuuaauuguguguguguguguguaugguguguguacagaugaguacaggccaaguaugggaucccuuggauuuggguuacaggaagcugugaaccacacuguggguacagagaauuaauucaaguccucuggaagagugcggaugcuuguaacugucaucucuccaagcccagaccauauguauuuuauguuuucuaccuuaggcuguguacuauaggauuuuguuuuaaggaauaugaaaucacagauuuuguucucugacuagacuuuucguuuuuuuuuuuucccccucuagauguauguggaccuuuaauucuuugaucucacuaagacuuaaauccuggccuccuuuauuucuccucugucuuuuuaaaauugcaucuuaauuaguuaaugugugugugugagacacaguaugccauuaugaaaauuaggggacaauuugaaggacuuggcucacuccuaccaugugaguccuggggauagaauuagcucaguuuguucaguuuggcaccccuuuguuuguuugggcugaaacgugaaggcauggguauccugaagcaggguaagagaguucuacaugcuccaguagcuucaagaggagcagcggacuccgaugggccuaggaacauaugguaugagggaaaguuccaugucuuacagcuguuuuagaaaagaaacugugauuaucuccuuagaugcagaaaaggccuuuaacaaaauuuauuucucuacaugauaaaaguuccaaggaaucuagggauacaugggaguuuucacaacauaaugaaggcaauacacaacaagcccacagccaacaucuugcuaaguggaaaaaacacaaagcauuucuguuaaacuuagaugugaggaaaggauaucccaggcuguucugaaacucaauauguagaccaggcuagccucaaacucacagagauccaccugcugcugcuuuacaaguguuaggauugaaggcuugaguuuuauuucuuuuucuuucuuuuuuuaauuaaucccacccaacugucuccuuguggaugucuccaccacccccaccccaccugaccucuaaacuccuuggggccuccagucucuugaggguuaggugcaucgucucugaaugaacacagacccagacguccucuaguguauguguguugggggccucauaucagcugguguaugcugucuuuuuggugcuccaguguuugagccaugucagggguccagauuaauugagacugcugguucuccuacaggaucacccuucuccucagauucuuucagccuucccuaauucaacaacaggggucagcugcuucugcccauugguugggugcaaauaucugcaucugacucuuucaacugcuuguugggucuuucggagggcaguggugauaggucccuuuuugugagcgcuccauagccucaguaauagugucaagccuugguccuaaaugcuuuuaagacuuagaugugaggaaaguauuugaauuuauuaagaaguuuuugauuuuuaccaaaaacucaagugugcaugugguaauuauuugccuucucuuuuguuguauucaggcuuuugagaaaugcuaaaauaaguuccugaucacugauuuuaucuggguuucucccgauugcuugucacuuuuguuuuguuuucaauauaauuucucuccuuucuuccuuauguuuuaaaccauaaccacuuucuuuaaauacccagcucuuuguguaauuccuugcauaaacugccacagaggguccaauccagcucuuuccuucuuaguuaaguaacuuggggaaaguccuuagaaaaacuguauguugguuuucaagucuuugccaugggcguacauuucaguugauaggguaccaaggacugaaugugauagugugugugugcuuaauacagugcuuguuacaacucagaaugcuaggugcuaugguagaauggugaugacugccaucacauugccagaaauacuugugauacuaccccugggccauuaggugcuuaauaaauacagaguuugguuuguuguuuugagaccauuucuugguguagcccaggcugccugggaacucuuuguagaccaggcuggccuugaacucagauccaccuacaucugccuacugaauacugggacuaaaggcaugcagcaccacaucugucaagacugguuuuuaaaagcucuuuucuaguauuguuuccaaccguuucucuacuguauggucugugugagauuccaauuuucuugcuuuaaacuaaccuccuaguaacuucccauugcaauuaagacaaaguccagauuccuuuuaagauacuuaaccucagacacucucauauuccauuaguaugcuuucucuuccugucccuaaagaauacauaaaguaaagagcauuaauuguucucacuuuccuuuuuuaagguuugggaguugagugauauugaccacgauggaaagcuggacagagaugaguuugcaguuguaaguaacuagauguucuuaaaguguaaaauacuaucauaugacagccuucucacacccacaccuccugacagcuuauuaaaacagggcucgaguuuacgaucugccuacaugcuuaaauuacagugugugucaucugucuugggaaauaguucccauuuuaauuuauccuuagacuaugcccaucagaucguaguuacuaaugucuuuagaauuuauuugguugagugcauauauuuaauggguaagagaauguguauguuuugccaucauuuuuuuuucccucacuguaggugcauaggaaagauacucaguuaaugugcaauaaaaugauggauauuuaaaaauccuuauauugaucugauguccacugaaaguuaauauugcuuaaaacacaaagagaaaaaccacuuaaagaaagucaguaguugguauuaaucccaaacuaaguccuuuccuucucugacacccuguguaacuuuagcuuuguuugugaugauuuauuuacuuacuuacuuaauucuuuuaauuuuauuauuuuuaauuuuuuauuagauuuuucuuuauuuacauuucaaauuuuaaucccuuuccccauuucuccucugaaccccccccaucccauaccccucccccugcucccuaacccacccacucccgcuucucuguccuggcauuccccuacacuggggcauagagccuucacaagaccaagggccucuccucucauugaugucucacaaggcuauccucugcuacauacuuggauagagccuugagucccuccaugcauacucuuugguuggugguuuaaucccugggagcucugggggguacugguugguucauauuguuauuccuccuaugugguuguaaaccccuucagcuccuuggguccuuucucuaccuccuccauuggggauuuuuuuuuuuuuuuuuuuuuugagagaaaguuucucuguguaucuuuagcuguccuggaauuuauccuguacaccaggcuggccuugaacucaagaguaucaccuaucucugccucccaagugcugggauuaaaaucuguuaccaucacugcccagccuaguuuuauuuuaaauaaagauauccuaaagcuuuuuaguuuagugucuuuauguauuucuguacucacauaguauauaccagcuugaaaacuguuguuucucuccacacacacacagagacacacagggcacauggguugggagggggauguacauuauuugaucugguugcuguugcuuuaguugcagucuguauaggauagaguacaguauaguaagagaacaagaucauaguccagcaguauuaaaauuauucuguucaucuuuaggauuuuggugaacaaaauuuuggcuuuaguuuugucagggaaacuauuuuuaagaaacaugaaauugguaacuuuuucaacuuucaggaaaaaaaaaguguugucuauuggcagcagauggcaagcauugcuuuuuuguuuuguucaguguccacuuuuccaggaaaugacuucaucugcagcaagaaugcugaccuugauaugugugcuagucacucuguuagcaaaguaccagccuaguacuacagauacucugaaguagauuguuucuuucugaagcuucaaguuuuugaagacauaggguucauguguuuucaaacugacauggaguucuuaacuguuuggccaguuugugguaaaggauugguuuggcuaucccuggauacacagccccagagaacuuguuagaaaugcagauucucugacucagugccagcuuuacugaucccagaauuccaggaaauucugaugugcacuaaagucuggguccacaggucagauuuagcuguuccaauuauaaaggaaagagugauagucaaaauuaucacacagaugcuauuguuaauauuguagcuaaggaguucuugguuuguaucauauacauuuauauauaauauuauauaaacauuuuagugucuauauagauacauagauauuuaaaaaguucuuuuuugagacagacucucauauaaccuaggcugggcucaaacucaguucucugcugccugguccugaguaaugggguuauaggcauguaacaccaaugguguagucuauacaguagccuauggcaucuuuaaaauauuguauuagucaaguuagcaucccugagcugccguuucuucauuuauaaaauauuagccaucauauaaauugugggucacaguuguauugaguacucaguaaguacugauuugaaaauucuauaaaacucaaauuuaggaguuaagauagaugcccaaugcaaauuuccuuugagagaauuauaauuuucagugggaaaaaaaaaucaagaaauaaugcacccacucucaguugcaacggaaauccuucuugagguuaaagauauugucuauuuuucuuuuauuauauaguuuuuaaauuuauuuauuuauuuauuauauguaaguacacuguagcuaucuucagacacuccagaagagggcgucagaucucauuacagaugguugugagccaacaugugguugcuaggacuugaacucaggaccuuagcaagagcagucgaugcucuuaaccgcugagccaucucaccagcucuaguuuucuuuuuucuuuuuuuuuuuaauuagguauuuuccucguuuacauuuucaaugcuaucccaaaggucccccauacccacccccccaauccccuacccacccacucccucuuuuuggcccuggcguuccccuguacuggggcauauaaaguuugcaaguuuucuuuuuuuaaaagccauaaaacuucauccucugagaguaugaaagguaucuuuaacguggagaaguuacaguguuuuacaguaaauauucuacagacaguaagcuuuuaaaauauauguacacauauacauacacacuuuagauauuuaaaauauuuuaagguagguaauacauucuaaucauucaaaauuaaacaagaagauagugaaaaaaggauccaucucugccugcaacuguuguagucuucucuggccagcuacuuuucuuacuuucugguuuauccuugaauuuuccuuguucaaauguacaaaaauuuugaauaauuauuugcucuuuaccacagaagauaacaccacacaaacacacaugcacgcacacauauacuggagguauguguucaacacuguauuuuuuuauguuaucauugugcuuuagauucuuggacuuauuuucucauagaauacauugugauuuuuuuuuucugguauauuguuuuuugagacugaauacaauggauugcuuccaauuuaaguauguaauuugguaaauauugaaaauuucguauucgugaagacaauaccauaaugcuuuccuaugauuuguuuguuugucuguuuuguuuuguuuuugagacaggauuucucuguguagcccuggcuguccuaaaacucacucuguagaccgggguuguccuugaacucagaaauccuccugcaucugccucucaaguacugggauuaaagaaguaugcuuucccaaccuagcuucauuauuuuuuaaaaacgauuguuucauaguuuuuuauuauauagguauaucaucacuuuaguguuagucuuuuauugauggacaggugcuauugcagccaauuguuaugguuaauaaucuuuuuucaggcagcauuucauauggaaaauaaauguaaguauugauuucuagaugugaaaucauuuagccaaagggaagaguguauuugcaauuuggugaucaguugguccuucaaaaggauauuacugauuugaguuuuauauaggagaaaacaauaguuuucccucuauagucuuuuuaauuucuuggcugagauucauguaaugaaagacauguucucaaaagaaaaauguuuauuaauauguauaauuuauauuuacuugggagacaauuugaggaaagaaaaacuuuccaagaaguagcauaaaacuuaggcuuauuacagugucuucaacacauguagagguuuagguaaaugagaaggcaaagaaaaaggccuaagacacuagaaugcacaaauuacaaaaagguaccaaugguagauagcagugaaaguggauagauaguaacagcagaaaccgauaacagcuagaguaacgccucuucugugagugcuucugaugcaccaucuccaugcuuguaauguuaggugaggcuguggcucacccauguagccccagcacuugagaacuaagggugguuuaaggcaaaguuaucuugugucuugcccaguugcccucugcuacaaauaauccugccauagugguacuuauuacccuuuggugcucaguagcagugucugacagugccucuuuuuugagaguucaccucccaaguacauuaugaaaguugggauucuugccacuuaggcaaaauguaaacccacuauaauuuuaaccuguaguuuuaguuuagggguaaaauugaguauggcuuuuauauguuaaacgaugagcuauuugugauguucauuugggucgggggcauaaauuaguucauauuuuuuguucaucuuccuauuggacuuaaauuuaugaucuguuaauuucuaggagcauuuuauauacuaggagauuucuuuauagacagcauuuucuacucaaauucuuauauucuuugcuauuacaagaacuucaauugaagggugugccucuuaaauuuuugcuacugaauauuccuuccugagaauuauuuagcuuugaguuuauuuucuuccucuuuccuuuucauucuuccucuuuuucuccuguuuucuuucaacuuuucuuuaagaagauuuaagaugaggccaugguggcucacaacuuuaaucucuguacucuggaggcagaaguaggcagaucucugaguuugaggccaucuugguguacagagcaaguuccaggacagccaggccuacacaaagaaacccuguuucuaaaaaauaaaaacaauaaagaaacacacauauguguguauguauguauguguguguguauauacacauauguacacacauauauacauacacacacacacacacacauauauauauuuacacacacacauguauauguguauauauuaaaaaugauuugugguugagcagggcuuaacucagugaaugaauuuuguacuaauuuuaaaauaauauuugauuucguuuuguuuaucuuuaaggccauguuuuugguauacugugcacuggagaaagaaccugugccaauguccuugccuccagccuuggugccaccuucuaagagaaaaacggucaguauaucaggcuccaagugggugauccccucuucagcagccaaggaaucuuaccacuccuuaccaccuguaggcauuucaccuaccaaagcaccguuaagacagguagaaaucuaucgguguucaaggauuuugcucuaacaaaagugcaugaauaugauugauaaagauagcaggugcagucaaagaugcugcacucuucuaguuaaacccauaugacaucaugcccagaggaggcaggugcuccuuagguccuguggauguuuaacuggcuuugccuucaucuaucagagauuuaagauggaaauggaagauacugugugcuaacaugcaugcuugcccugucgugauaauuguuuuuaaucuguaguuaacucuugauucuucagaucagguuauuaauucugauugauucuuacuuccucugaucuaucucuugucagguuguguaaagacaacuaaugacagcacgugcauguuuuagcucugggcaagaaugcugcauggaacuguagaaaaugaaacuuggggauuaucuggauauuguuuauacagguuuucccaguuacugcugauaguauggaaaugguuuaauugugcuugacuucuuugguuacuuaaaagaaaaauguuagccuggcaucuguaagucuuaacugacuuuaaauuuguugccuucccuuucuccuguuugguugugacguggggggcagugugccgccaucaaggugauuuggguggauugguucagauugcugauagauacgguuauguguuaaaagaguaucaaauguguacucuuuucaagguuggauuaauuuugacagaaucuuucucuccccacucuaguggguuguauccccugcagaaaaagcuaaauaugaugaaauuuuucugaaaacugauaaggauauggauggauaugugucuggacuggagguccgugaaaccuuccugaaaacagguuuaccuucugccuugcuagcccacauuugguaagacuuuauuuuaauaaauuaaaaaaaaccaaaaacguguauaugugugguugucugucaauucuaguuuuuuacuacuuuugugaauaaguuauuauuuguuucauuuuuauagaggaaauucaaauuuaaagaauuauguguaauaaacaaaaauucaaaagugaaaacaaaacaaaaaacccaaacaacccuccagaccucaggcaugguuuguuugccugaagcuuuagggaucuggaggugucagugacuuguuaaaguggcgccucaguuuacaccagccccaacucugagaguucucuagagaauccagauggcuguaauucuaacacuuuagucaguaguaucuuuaggccuggggauauagcucaguugguaaggucccaugcaggagagccuggguuugaucccuugcauuauauaaauuggaucugguggcauacaccugcaaucccaggacccaaggugcugaaagaucugaugaucaggcccuauccaacuguacagugacuuuaagaccagccugaaauaaaugagucucagucagucagucagucugucuaucugucucucugugccuuccucccucccuuccuacuucucucccucugcgcgcgcgcgcacacacacacacacacacacacacacacacauauuucauuuuucuuuaaagucgaauaguauuccauuuuuuauauauacagauuuuugcuauucauuuaucuguugauagaggucuguugguuccauuuuauucuguagagaauagagcagcaguaaacaagaguacaaauauuuuuguaggaaaauagauguauaauauugagguuacguaaucucagaaagaaaacuguguauucuuuguguuuccuugccuguaccauauagguguacaugugcaaguagaugcaaauuuggguauaguaaguaaguaucacauguagugaggagaacaggaaagagugaugaggaaagacagagugcagguaaaaacaaugaaucaugaaagaggguauaaaacuugugucucuaguuuuaacucugucauggguuuuuaauuuuuuuguauuggauaagugcagaggcauguaaggaaaaauuucauagauucagaauggcuguauauguguuuauagaauugaauauguccauaugugacacucacuauacaucugucuucuggugcucuuuaaaaauucauuauuuuauacauguauauaauuuauuuugaucauucgcacacuccauuacccuccuuaucaccuuugcauucuauggagcucuuccuuacaaccuaucuuuuuuaacuuuuauguuuuuauuuguuuucuauucucuugagcuuaauuagaguugcuugcauguacauggguauaggauuauuuacuggaucauaugcaauuuagcagugacuacuucacugaagaaauaugacuuccuuuccccuacagccaugaacugucucaaucaagggccucaugugccccuuucuuguucaugccacaguguugaugggcguggcuuguacaggucaccaggacugcugagcuugugauugcaauagccauucacauccagaagacagcguuucacagcaccccucuccagcuuccuguucauacauuuuuuuuccuacucucucuuccaugauguuuccugacccuuggugaucuuuuuagcaucuuaauuaguccaccucuauaacauuuauguguauuuuugaacaagcugucauuugucuuuugcaauucagcugauuguuuuuaaaaaguuacagucauauuuuucuucuggaguuuugggguugauaacuaacacuauuguacuguuuuguuuauuuguauaggucacuaugugacacaaagggcugugggaagcuuucaaaagaccaguuugccuuggcuuuucacuuaaucaaucagaaguuaauaaaaggcauugacccuccucauagucucacuccugagaugauuccaccaucagacagauccaguuuacaaaagguaagauaacaucaaagaagaccugcaugcccuagaaaaggacaaguuccguguugggucacagaguuggagggacagagcacucagaguugguaguuagugugugucugugaacaugcacauagaccuucucuguacauccuugagcgguagcuugucaacuucucuauucauuauucaugacagcugcacuuuacuguauuaaauugaagagauuucuaaagaaaauuuugaaacagggucucaagauagcccagacuuacauugaacacuauuuaacugaaaauucccuugaacuugugccccuuccugcuuucacuucuggaagaucauaggcaugugccuugccuagucaacuuuuaugaauagaguugaaaugguagcuguaggaauuaaauuguuaaauuuuacuugaugauucgcuuuuacagaagacaguacaaauuuggaaacaaaaucuaggagauaguaauugauuaguaucaauuuuacaucaaaauagccuucaggaaaaacuguauguugaggauacaucuguauguggcuuuugccaaaggaugacucuucauucuuaaguacacagcugaauuucauaucuaaacagcuggaaguuaguuggguuucugauuagcagugggaauuuucagaacauauucauuuuauucacaauucccuuucaauuuuuucuuucuuaucuagacccccuuuuuaauauagcacauuuacaauauccugguuuauaauagaccuuucaaaggacuuauauaugauggguuuaguugcuuucaaaauuaaauaaccaaguguuguuugaaccuguagucuuagcuccugggaaggcugacacuaaagaauucuugaauccagaaguucaaggcuauccugggcagcacaaggaagcugcaucuccaaaaaaaaaaaaaaaaaccaaacaaaauaaagcauuccacccaaacuuuguaucuuuaauccucuucucaccaguauauaaguauuucuauagcgauuuuucaaggucguauauaacaggaacuaucaaauugugcuauuaaguauucucucucaaauauuaauaaaauguuuugauuuuucauuaauaacaguuaaaaauuucauuuuaaccuagcaaaagucaaaauuggauuuuauucccauguaaaacuaaauagaauucacuacuuccaagucccgagaauuggauauauaaaaagaauuuguacuuuugaguuuucagaugggucacuuugugaacuuuugcagccucuugauguaugacauggguucuuuagguuguggagaggcugaaaggaagucgucacagaaagaugaaggguccguauuuucacuuauacguucugcucuguuccuguugcucagcugugcaacauuguagccugcacuuaugaaguuucuccucuguguucuuaauuuauaaugacugaaaugcuuaucaacucuagucucccagagaacagaacuuugucaauuuuuuucuauucuuugaaaucuguuugcuaguagacacuugagauuguuucuguuacccaguuuauaauuuaguagauuucucagaagucuacucaauagaggauaccuugucucuugguuccagauuuauggaaauacuuuauaacuguuggucuugguauuauauaaccguugucuuaucuauuaaccaaauaaaauaaaauaaaauaaaauuuguacuuacuuucaaauaaucucuuuucuucuuacaaucugauuuauuuaaaaaaaaaaaaaaaaagagguacugcauuucuguagcuucaacuaauccuucucgaacgucgcucuccuccucucuguguuuuuucuaguuuggaguuuuuuccauucugcagcccucugcuuucgccuuucuuguacugucaguuucuuaacucuccucucucucaagguuagagcucuauuuuaugcugucuuuguuguugcauuuuagcaguacaguuuuuauuuacaugauguauuuugaaauuaaaguguuuuuuuuuuuuaugcagcaaaguugacagugcaaacaguugcuuagcaugcuuuuaucaugugucacuugauucuugcaugcacugugccuugcuuucccuggacugcuuaauccacucaaaauuacucaagugagacuuaggagacacacaaaaugugagagaaaauauucguaagaagggugcaugugggaccggagaauuggcucagcaguuaagagcaaggacugcucuugcaaagaauccaggucuugguucucagccucacaugguggcuucacaaccaucuguaacuccaguuccagggggagcugacacccucuucuguccuccaccagcacuaugugcacacuuacauacauauagucagaauacucaaacacuuaaaaauuaaacagaaagggguguauggagagaagcucuaccagaagaucuggcuuugauuccuaggcucauaugcauggcagcucccaaccccuagaacugcaguuucaggggauccagagccaccuucugguccccacaggcaccaaguacacacuuggugcacagacuuguagcuaagcaaaugcuaauacacauaaaaauaauucaaaaucaaauaaaugaacaaaauaguuuuuaaagaagggcaugacacauuuuucuaugugugcccuucaugugcuauauauaauuuuagcuggauguuuccauauuugcucgcaugccacuuuagucauguaaagcuaucaccuucuaauuuguuuaugguuaaacuaauuuguuuaacuuuaucuuuuuaucuguugauauuuuaauaggaaagacucaaaucugagccacuuuuuaaaguuggagugacagaagagguguggaagccauguguuuucugguauacuugcaccucugauagaauacuucucaguagcaauuuaagugauagaaguuacucuugaugaugaaagugagaucaagugcuauuuuucuuuuuucacuugccuggcuggcugacucauccuaguccacaggucaacuuuaaauaaagcuaaaacuuagugaauaacugucucgugcaaaaucugccuuaaaaaauuuaauuuaauuuagcauccauaacagucugugaaucaauuggguuuaguaaaacagguuuuuuugagacucacuauggcaguguauaccaguaaccucagcacuccaaaggcuaaggcaggagguucacaguaaguuuaagacuagcauagacuaacuaggaagcucaagaauagccugaacuauguagggggaagcauugucucaacuacaucuucaaaagaaguauauuugauguaaaguuguaaucuauacaaaauuagaauuuuaauuaauuaagaccauauaggugaguuuuaaugcugauagucaaaacaaauucaauacuaacagguaaggugauauuuaaaaaaacauugaagaaauuaucaaauuugaucgaccaguuuaccauguguacuuuuggcacaguguuuucuaaauuauuuuggcaugcagaugccaaaggucauguuauaaaaugaacuuuuuaauauaaucagaaaacuuuugauaaaauuaauagccagguucaacuuugagcagucacuuggucuguuuucucagcucuaaauugaguuaauacugaccucccuaauaauauacuuuucagauuacuuuugagaacugauugaugggcuugguaaacuuuaaaugacuuuauaagggugaggaaaugaaauauuauggaaccuucagguuucuucuucugucguguaaguuggugauauacauuaaguucacauuaguuuuuuugguuuuucgagacaggguuucucuguauagcccuggcuguucuggaacucacuuuguagaccaggcuggccucgaacucagaaauccgccugccucugccucccgagugcugggauuaaaggcgugugccaccaugccuggccacauuaguauuaauacucaguuuuauauucugcuagagaggucacuaauauaucuuagguuccacacaguaggcuucaguguuaccauuuccaaaagcugaugauucugcuauuugucagauuguaauaguguguauaaaccagguguuuaaaggaacaguuauccuuugcucugacuuuaaacauuuuuuucuuuaagguuuauuuacuuuauauauauaugagcacacugucacucucuucugacacaccagaagagggcuuuggaacccauuacagauggcugugagccaccgugugguggccgggaauugaacucaggaccucuggaagagcagucggcgcucuuaaccucugacccaucuccccagcccugcucugacuuuaaaaagcuaaacaagacaucaaugggaguucaaagaagaaaaccauuuauuugaccuaccuguaggcagggcagagauuaauuuuuccauuuuucuggugaagagaauauaguuaggaaagugacagacucuagguuaagccuagauuucauuuuuauagguaacauuugguaaccaauucugauauuuaauauuacuuacugaacgaaaaccaaguguuggguacacuagcaccccauguaaucccagcacuuguggauagaggcaggaggauuaggaauucaaggucaccauuuucuucauagcaaguuaaggccaggcugaguaaaugagauccugccucaaaaaaccuaacaggccggagagauggcuucaguuaaguguguauggcugcuggaaaggaucuggguuugacucccagcacccaugucacacugugcccaaccaccuggaauuccaguuccagggaaucugauaccuuuuccuggccucuguggcgcgcacacacacacacacacacacacacacacagagaaaauauuaaaaguuuaaaacaaaacagcauuaacaugaaauacaguuauguauguagugaacauguuuacagaacauguuugagcaguggguuaguagguuuuagguuaaauagaguagauacuaaaagcauuuaagaaaaguuaguaauuguugaauugaauaaaaucaaccauuauuauaauucugagauucaacaaaauuuguauacuuauucugugccagaugauuuaaauggaagaaagucaucaucccucuugcugauaaauaacacaucucaguaggagaauucauuucuaaucagcauguguuuuauuuacuguagaauucuggguagacaaaggcagugggcucugagguguggggucauaauagcuuucuggagauuauaagagaacugucuuaauuuacaaguacauauguaauuacaauuacacauauauaguugugcuaaguauuuuauuaaaugaaugaaaagugcuaguaauguaguaaaaugaaauaccuugucucucuguauagcuuuuaucauuuuuagugcuuagcauuuauaguaguaauguauaacugugaauuuuuuguuuuuuagaacaucacaggaucaaguccuguugcagauuuuucugcuauuaaggaacuagauacccuuaacaaugaaauaguugaccugcagagguacguaaaguaaaauuauagcugacuuuauaagcacacauacagauuauauguacaacauauguguacuacauauacauacccucauuucuaaugcuuauuuugauaagugcaacuuuauuuaauuaccauauuucuguguaaauggaaucagaaugcuuuuuuaaagauuaaauauuagggaagugauugaggaagaugcccacugcugaccucuugcuuucacgccuaugcacauguacaugugcgcaugcaugugugugcaaacacacauacacaacaugcacacgcacacacacacacacacucuauaccuuuuuauuacuuuguuuuaaaacaaguaaacauuggguuacuguaucuauaauaauguuuagauuugauuuucacaaggcucauaaauacuccauuaagcauucuugcuugcuuguaugucuauugacauuuaaacagcuagacaggaaaauacuugucucugugucucaagcaguuguagaaagacacauucuccauuguucuacaacuuguuuucuugacuuacacaguuguuuaauguauaaaaugccuuuguaguuauuuuaauaagaauuaggacaccauuaaguaaaauacucuuugcuuuuguugacauuucuaauauguguugaguuugggcaguuaagcuaguaacuauggcauuaugcugcccuaauauaaugacugauaacuaacaauaacugauaauaaugcucuaugaggaacauaccuaacauuuugugacuaucuuaugaaaacuaaggaguuacaaaaccuuguuuuagguuguagucacauuuuaucaaugugugauucauuuguguauauaaugacauuugucaaaauauuuucuguuuuaagugagaccuguaacagaagcagacuuucauucucucaccuuaccaugucauaguaagacucaucuaccuauacuaaagcuacauuuauuaagguuaaaauacuaaaguuuguguuagaucaccaagucuuuaagauauuucauuauauauauagucucauuauugugaauauacauuuuguccuguacaaaguuuuucucuugagaaucugucccuuugaguuuuuacaauacauuagaaugaauguguaugacuaugaaacaaagaauuuaaacaguauauaugacuuuacuaaauuagucuaugauggaagauuccauccuuauucaaguugguuuuuuuuuuuaccauuuauuuauuuuauuuguguauuugugugugcacacauaugggaaugugcugugguauucauguaaaggcaauagcacaaccuucuggagucauuucuccuuccagcagguggguccaggagaucaaacuuagauugucaggcuuggugggaagugucuuacccauugugccaccucacuggcccuuucauuguuuuagagaugaagauguuuaauucccaggacuucuaguugauguaggaugugcugcccaaaccccccaguaacucccuagccuuauuucuuaguuggaucccauuuucuuccuugauugaaguaugaagggugcuuucuucaugguguucucccugcagagcacagagguguacaccuuuaaucugagcacucaggaggcagagguagggggaaucucugaauuuaaagccugucucuggucuagagagagaguuccagcauagccagggcuacauaaagagacccugacucaaaaacaauaacagaaaaaaccccauagaguuuccccugucauccuggccauucuuagucacgucucacauugcacugucuccugugacacuauaaaucuuccgaacaguagacacuguauuugcucuuucuaccuucagcacuaagcgagugcuguaaccucucauugcuucuuuguuguuauauuagucacuuuucuucucacugugucuuacacgcguucucgcgaccggccaggaagaacaacaacaaaccggaaucuucugcggcaaagcuuuauugcuuacaucuuuaggagccagagagcaagagagcaagagcuuuauugcuuacaucuucaggagccagagagcaagagagcaagagagcaagagagcaagagagcaagagccaaagcaagagagcaagagcaagagcucuauugcuuacaucuuuaggagccagagcgcaagagugcaagagcaaaagcaagaaagagcaagagagagaauggugaaaccccgucccuuuuaaggagaauuauccuccgccuaggacgugucacucccugauuggcugcagcccaucggccgaguugucgucacggggaaggcagagcacauggaguggagaacuacccuuggcacaugcgcagauuauuuguuuaccacuuagaacacaggaugucagcaccaucuuguaaggcgaaugugagggcggcuccccacaacugugaggaaaugugacagaaguaacugaagggaggaaggauuuacauugguucacaguuucagagaguucagucuaucaugacaaagcaagcuggauggugggaguggcuccauccaucaaagcaggaauacauuguagagcuugucauacagcagccagaccagaaagcagagacuacacuggcaguggggcugggcuuuaaucuucaaaagcucacuccuagugacccuacuucuccagccacaccaaacuucccacagccucacaaauagcaauaccaucuaaagaccauacauucaaucguaacagccuaugaggacguuuacauucaaacuguaccaauuccuuucuucuaaccacaugaugcaggugggcuuauuaccccgcaccucagccugccaccucuuuuauuacuuacugccuaggauuuuacuguuuucauuugccuagacauaccuuuaacacugugaguaucuauccaugcuuuaugacccauguuuaacagcucuuauuauuuuugaaaucuuuagauugcuaauuguucuuuuucuguuucuguuccuguuuauuuuaauuauuuuaucucacuguguagcccuaauuggccuagaacuugcuauguagaccagccuggcuuuaaacucacagauauuaccugccucugcuccugaguguaggguuaaagguaugcacuacuguguucagcaaauucuuaaaagcuauugauggaguccauaagaaucuuuacuuugaaaguaaaagccucagagaaguucugggggguuguuuugcuuuagauuuauuuuauuuuuaaauuauguguguauauggggugggauauguacuugugaaucaguugccugugguagccaaaaguguaggauccuggugaggcuggaguuauaggcaauuguggguacugugaagggaacucagguccuuagcaagagcagcuuuugcucuuaaccauugaaccaucuuuccaacccccuaagaaguucuugaagucagaaaggugcaagaaacggaggcuauuuugaucacuuguauagcguggucaugauaauuuaugcugaggcaggagguaauauuuugacaucugcuagauucuacuuccugcuugucuguccuuuuagcaaaaacauaggaaguaaaagucauauccugccaguccuauuauccuacuuuuaggccaauaaacaagauagguaauuauaauaguuacugggaauugugcugcauccacuuuauguaaauuuuuuguugaauucuugcaacaucccugaagaggaagaggauuuaucuugauuuaacaauuuuuaaauuacuuauacaguggaggcaugagguacaaguguguguacauguguacaagugugcauucuacaaaguauagguggaggucagaaggcaucuugaaggcuagaacucugguugugaggcuuggcggugagugccuugacccauggaaccaccuuuccagcuccugucucuuauuccagacaaggccaucuaguacagaauuucagugguagaacuuucaaccagauuucuagauuaucagcauaauuuugucaauuucauuuuaguuuuuucacauuuauuuaguguguggggugguguguauacauggaggucauaggacaacuugugggaggagucuuucucuucuuucaccauguuuguccuggagaucaaacucaucuugcuacacuaggccgcaagugucuuuacccacucagccaucucacuauccugauuuggucagauuuaacugucaguaucuuaguuucuuugucuguuaaauagaaaugcaaacacuauuauacagaugcugagacuaugguaaguuaguauagguuauuaguuaucguccucaauacucagcucauaccuuagagcgaaaggcuuucugaauaguugcucaauaaaaacuauuuagaauaacugaaugaauuauuuuuccuagaugaagacaaacaggaccauuguagccagauggucaguaccauaucugcacagucccagagauugaccuaccugagaccaugaggaaaugaagaacagacacacauagagggaucucuagagacuaaaaaacugggauuggguggccugggcucuuggaugaggaagccacagugcccaggaaguucaguguguuuaucaugaacaguugaauagaagguaaccucauuacauucagccacauaacgggacagguucauuauguacagcugaacaaggaggcagaucaucuuauacagaugaaccagaagucaggucuagcuaaucuugguggagcagucugaaggugguaaauauuggggacuagaggaagacuuugccaucuuucugagccucacaagggugggguagguugggaaggauuugccaauuucccauggaggcuaauggauugguuuaggaauggucaugcuaugccauucuguuccucaauguguaggcuucuaccuuguuuguauucaagaaccgauuuaaaacaauaacaucuuuugauaccccagaaaugcgucuuuuagccccaaucucugccaccuucucuuccaccucucaggagcuggcugaguccuaccgucccauaggagcuuuguuguguucuuuugcagcaccuaggucagggccuucugcagacugaugagggauagucuaagccugagcuuucauaagugguauaucaugcuuaugccuguaauuccagcacacuaaaggcugauuacaaguucaaggccaguuuagacuacauagugagaccuuaucucaaagaaagauuuucuuaagagagccuuagaaucuuaaaauuuuaaaauuauguuuucaauuuaguucuauuaaguuacuacuaaaaaccauuagauuugaagagaucauugcuuauaguacuaaguguagagcucuuuaacuuaaaugauccagucugaucuguuucuagcacaucuaugcgccaacacuaggagguaucaaugacugccucaccaaugaaaacacuggaauaggcggguccagguuaagauguacuguugguuuaaaauguuuugguuucaaaguaucagaaaggaauauaaaacaucucaguaacauuuuuuagauuuauuacauacuguaauauuuuugaauauaguaaauaaaauauauuaagauuuacuuguuuuuaauauauagauuuuagauaaaaaucuuuaauuacauauauuuugugguuauagcuuacuaagggacaggacaguuguaucuuacaauaaagcaguaaauuuuaagauguauuauagucugaguuugaaaaacaaaacauccuucaaaaauuuuuaggguucuaggcugggcuuugaggccuuuaaugcuagcacuugggaaucugaggcagguagagguugaggucugcuugguuucaggacagcaagggcuauguagagagaccuuguuuaaaaaaaaaacaaaacaaacuaauuuuagggacuggggauucucaaucuccaccaacagaagggccaaagugucaucaauuuguauguuuccuugccacuucuggaagcccaguaaauaacucaguaugauggcauauaccuuuaaucccagcacuaggaaaguuaaacucucugagcucaaagccagcuuggucuauauauugaguuccaggacagccauggcuacauaguaagacccuguuuuaagaacggggaaaaagccaguagugugaucuuauauuaauuaauaaauaaaagaauuauccuaauaauagcuccugaaguuuauuuagcgugccaggugucaugcuggauuuuuuucuagguauaauguaaauuaaucuugguuaacaacuuuacuaucccuauaaaauaguaaggaacaccaaauucgugguuuauguuucuuuccauacuuuuugucuuucuggauaaaaauaacaaaugagguacuuuuuauuugaaaaauaaacauuuuuuuuuucuuaaaaaaauggaucuaauuuugaguccugccacuaaaugugcuuugguuuuauagaagccaggcucccaaauuuguuuugucagguugcuguuagguucuguuuuauuuaugcccauagauauauucucuuauuuuucaaggggggaaaaagcucauuaaaagagccagccuccaucuggaguggugaugcugcaguggcugagagcacuugcucuucacagauccuguugaggucacagcagcucccauugacuguagccccaguucugggauacuggaagcccucugcuagccucugcaugcacccacacacaugugguacacauguguaaucaccauguaaaauaaaaauaaauuaauuaagaaaaacagaaaaacagcccgccucccaaaacuaaaagaguuagggugugugugugugugugucugugugugucugugugugugucuguguguguaucauacauucuuaaaauguuuacaccauuuauuuuccaacugguuauauauuuauauaaccaguuggaaauuauauaaauaggggcccaccuuuaauuuuagagaaauuaaaaaucuaaguaaaaaucagugucuguccuaaacuuucaaguuuuagucgacucagaguaaagagcuaccuucuuuuagacucguuugaaugaaaagcuaaaacuuaucaucagcuuuguauaguuguuacuuaauguaacucuaaacuucuaacaauuuccaaauaagcaagucagaccuuuccagcaguugucaugagcgguugaguaauaggccucucuucccacaagccaaaaggaaagcagaguccgacuguuaaauacugcugugcacagcucagucuggucuggaaccucuggggcucagcauuuccugugugcugcaauucugcaugccuacuguuccauuucagcuuuccucaccacacgugccuuccaucccagauggaguuagucuaucuagaaauucucaccucugcuuucauuuucuuuuauguuauuuuuaaauuauuaauguagagaucguaaguuuaccauuuuaaccguucuacguguugucuuuuguuuuaguacuggagguuguuccugagucuuuugugagugcucagccacugaguuauguaucuccaucuucuugugguuugcugaauuucuuuaagggauuuauuuauuuauuuccuaucaucuucaugaguuuaaauuuaaggucauuuucuuguucuucagacacauuaggauguccugggcuugcugugguaggauagcuaggcucuggugguacauauuucccuggcucuuguugauuaggucuuuaggcugggucgucccugguguuggcugaauguuccugaugcuggcagaacucagggaggcaggcaggaccugacaauggagcuccgggaauagcaagcaugcugaucaccucugcuggcucuaccccagggggaccugaauguugcuggggucccacaggccuccuuaggaaggcaagcagagcugugauccugauacuggagccaaggggacaaagccauaucuccggcauuuuaaaaaauuuuuuuuucccgaaucaggaucuuguuauaaguugcccaggaugauguagaacuccccauuaaggccuugaacuuagaauccucuugcccuggccuucuaaguagcugggacuagaacuuaaauguacauuuuaaaugacauuaaguacauucauuagcugcuaucaucaguaaucuccauaacuuuuaaaucuuccagacagcuuaauguauauguguauauuuuuguguuagggaaagagcagaaggaaaagcauccccuguagcguaggaccuauucaguggaagcuucuuauucugcaggguaagaaagauuuggggaaauaagcgguuuguuuuuuuaaaaaguagguguacuugcuuugugccuacgauggacaggagacgauggccuagaacucuggggcagagaaagggucacuuucaguuccacuccuugggauaguugacgccacauagugacaaagaaccacaagcaagaagagccgcacaccaagccuguugacaguggcaggcucccugcccgcgguuauccaugcucacaccugaccagcuccacuuagcuccccacugccaaccccucuuucugagacaggguuuauauccaggaugaccuuaagcuugccguccugaggauggccuuggcuucugaaccucugccuuuaccuccugagugcuggcauugcaggugugagugccagggugucaguuuuaugcuguacuggguggacuaaauccagggcuucaugcaugcuguacagagccuacuaacuuaauuacagcccuaacuccuacucugagcuuaacugaaauucauauauaaccuauuuuagucacauauaaaaacucugguccuuugaguuuauugauguuacagaucauauuuuuauggauuguguuucugcugacagaaauuuuuaaugcauuuaucauuuaaaucuuacagaaaguauaagauaaaauugcaaaucaaaacuauaguaaugucauuuauuucccuuuacuagaaaccuuuauguuaucauaugacuuugagcuuauugucuaucaugcuuucguugaaggacucuuguuagcauuucuuauaggacagccauacuaguuuuuguuuauguggggauaguuuaaggccaguuuugucagguauaggauuuuuuguuguuguuuguuuuaaagacagaucuaacuuaguagcucuugcuggccuggaacuugcuuggaaugcauagagaucugccugcuucugccuucagagugcuguguuuacaaguaugugucuuccgugccuggcagguacagaauccuuccuugacagcuugucuuuucaguaguuaaaauuugucuuccuuccugccuccuucaaugggaucugcaccugccucaugcauugugucacaagcuguguaccagugagcuccagugccagcccuuagaugguuuucuaaccuugccuuguaacucuauguccuuuuuacagguucaaaaaguaugccaucaucauuaaggaugacugauacuuagacucaaagccuguaccuuccaucauguguauuuugucauccuaacucaagauagugaagauauuagcauucaaauaugaagaauaagauguggccucugucauaaagacacuuuuguagcaggcuggauuagaaucuuguucuuuucuuuucucuaagucucaggcagcucacugaagauuauugaaugaggauagaaugcuucccuuuacuuguaauagaaaucaguaguuaaguuucuuaguauuaacauuuuaaguuuagacggcaccuaaaggaguuuuacaagaaauaucaagacugaaaaaacauaaagcauugugaguuuuuuuacaagcuuucuaguuuuuaaugguuuuuuuaguuuuagaaaacgauggaugcugaguucauaaaaaugacaacaauauaucuggaaggauauggaaagugauuuaauccucucugugaugcuguuggcacuguaucaaagucaagacagaugguucccucuauccucccgauaaucugggccuggaaaaaauagaaguaaauuguggacucggguuuucuugccccuacugcccuuguauuugacuaccucaugcuuaauuucuucaguuguccaccacgugccucugaaagccuagccuugagccucgcuuuccuugauggguccaauauaagggacagagaaucaaaacagucagccuuucaaaugccagggaguucuaucccuuccuuuccuguagcauugguacugugcauuucucaggguguacaagcguguguacaugaauagggcagagagguaaucuaaauaaaaggugauuaagacaauuucucuccccuuuuuuggaaacuacuucuuuauuauccauauaauauauugaagguugcuugagaagcuaaguauaucacuuuuaauuguggucagagccuugaguaguuuuuaaaguauguuaaacaggauguuuuggggguugaggagauagcugaucgguaauauucgugucaagcacguguauaugggugaggcuugauagccagcaucauuguaaaguuugauggucuaucuguaaucucaguagggaggcagagacagaguaucuccugagcaaacugcuggguagacuagccaaaucugcaagcucuaucuagguacaagugagagaccagcuauagauagauagauagauagauagagagagagagagagagagagagagagagagagagagagagagauauuagagguacaagugagagaccggcuauagauagauagauagagagagagagagagagagagagagagagagagagagagagagagauauuagagagagaccggcuucauucauauauguguguguguguguguguguguguguguguguguguguacacacacacacacacacacauauaugguagagagugaucaaggaagcccccagacaucucauugggcccacacacauguccuccugcucauauacauaggaacacauauauacacaugcauaaaaaucuauauagaaauaugcauacauuuuuuaauguuuuguauugguuauuuauauauuaccuuuagaaaaauauuuuuuaaagaaaggaaaauguaagaaauacuggcaaucaaaauuucauguaucuaaauguauguuuaaauguuuuuaauuaccugaaaacaagaguguaguuagagguuaagagcuguuuaaagauaaccaauuagcaauuugguguuucugauauaauaaucuaaauuaauuuuuauacauuggccaguauuauguuaugguacuuaguuuuguuaaagggaccagaauuuuccuuagguuaacaaaacauaaauuuaggaguuaaguuuuauugauuucugagcuaagaaaugauuucuaaagguucucauauuuuauuuaguggagaaugaucuucaacauauguuuagagauauuucuauuguuucuccccaaauaccauaaauuauaagcagcagcuuguacucuucaagcaucuucuauuuacucaagcauagacugcuugcuacuaagagccccaaaccuuagacaucucuuuuucuccaagugagcucccuuugcucugccauucuucugucuguauuacuuuaagucagcucacugccuucuuacagcucuguucuccugugugcacauucugucuucugaacaggcacagugaguaacaggagcuaacagcagaacagagagcuugagcagacaggaauaagaguuaaaagaacaacagaaagaauuuaaaugaugcacauucgugucugcagcaaugcuuucugauacauuauaauguuuuuuaccuuugcuaucuacugucuacaauggagcugaagugguauugaccuuguguggaaugucucugaggauuugggggcauggagcuggggagaggauuuggaggguguuagauuuccaugugacuuaucuuuggcauacugcagcagaacggaaaacaaucaucugcucacauaaggaugaaaagaaauuuccaagauugagcuagcaggauuuuuguuguauuuucagauguuuuuuuccccuugugauuuucuguuuuuccuuuucauguaauuugauaaggguugggguugggguugaaaggaaggcuggaacaaugauuugaaugguaaaggaacuguuuaaaaucuccacgucauugucaucgugacacacauugcaacccaucccgacaaacggucauugaguuccuuggccauuucagguauuuaaaaguaacagugugcaaauagcuguacuugagugccuuucuccuccauacaaaucuugagaucauuguacauacagauccagagcagcugacuuggugguguacuucagagucucacuuaacaagaugagauauacaaauaaggcaugcaguuucuuccuuacauauuuaauaucauuuucucacuucuauacagauaaauggaauccgagcuuacauuuggguucuguuagaucugaauuauguuaguuauuuaaaacauaguacugacccuguaagaugaaacugucauacuaggcuagaaggcuucuuaaaugcuuucuucccuucuccauauugccuucuucucccuacuucuauguauugcugaagaauucuguggauuuuuuuuuuuuuugccucucauuuuguagaaaauaaaagagcaguacauguuaaugguuuuauuuaguaaacaugggaaguuaaauuuguucuaggaaaagaaauagcuuuauuuuguaauuuaaaucuuaaagggauuuuuuagauucauucguauggcuccagcuuuauuaaagaacauaggacauuggaaugcuauuucaaaggagagccuuguguguuugaguucagggaaagacgucacacuucuuuggacucuuuuuaaacauuauguacacaauuuuguauacugacauauuggguuucauagguaguccccaaaggacccuuuuggaguaaaugugguauuucauagaaugugcuaccuguauauuaacaaucuuuuacauuuuucuauauuguugcacucuaaaauugauguacacugauauuuaaggaaaauuaacacacaaauugcucguuuucuuaauauuguucacuguuucuaucagccauucuuauuuaauaggacagugauaguuaaggguuaaacuuacagagcugaugcaacuccuccuuuucuucacucccaguuuucauuggaugguaucaccauagcaacagugagaucagugaaacccgaguguuccauugauuaauuuuugcuucuuccuuuuuuaaucuauccccccuuucaccacauuuuagugaggaagcaauuuuuucuuuacaaacagagcuuauauugauuucuauuccauaaauaauuuaaagaggguagaaaauucugcccuucauuuaaaaauugaauguuucaacauguauuuaaaaagcgauucaggauuaggaggauggauagccauaccagcuguagcugauguucucagauacucuugcauuguuugcuggucuucuagggaaaagaacaauguggagcaggaccuuaaagagaaggaagacacaguuaagcagaggaccagugagguucagguaagugggcuguaaaauguacugcucugauucucguggaggaauuuucaugcuaaauguauuuacuaguugaugggcaugauauuaggucuagggaauaccuaauauuuguugaacauaaucuuuuuuaaaaaaugaugguuguugcucugaauucuggccuuuaaauauauuacugcaaugagaaagcaguguuuuuagcacauauucuuaaauuugaaaauauuugaauauuuaucugcauauuauucauuaaagauaacuuugaaugacuugauuuaaauauuauuacaccaauaaaauuaaaauagaucaucaaaaaccaaauugcuuuuucacgcauguaagauuuuugucagcugagguaccuacuguuuucaaagacgguuucucaugucacugggaggguggaaaugauagagauuuaaaauaacaucuuaugaaaugcuuuguagccaaaauauuggaaacuuugucauaaagagauuuaauucauuuuugcuguguugcauuaguauuuuuauuuuauaaauagaggagauuaaaaaaccuguuuuuauuugauaaguguggcaguguuuuaaacauuaaaaacaguauucagcaguguuugcuguggccauguuacuggguugugcuccugagugcuguauggguguugggugugcaggcacugguagcauugccagcaagagcucauggguggacauuuccuaaugugucacuuacgugucaggucuuucugcuuguacuaaugguguugaaugggcagagacagggauuucuuagacccauccuuccguuugcuagaggagaagcacggucggcuggggaagaugauucacugaaggacugaggaagccagagagacgugugguuggaguugacucugauuggaugacugccuuuguuuuauguauuggaauuuuccuaaaaguggugugaaagucaagagauuuauuaccagcauuucucuuucagcuaaugagaaggaagcuguaggcugguaagcugccggaguuuugugucauuuuaagcuucuugagaaaugcaaacacuaaaccuuaauuuuaguaguuauugcuggacacagcuuaggaacagaggacaaaaaucuaugaaaguugggguuuuuuucccaauauaaucacugguauaaucauagacaacuuugagauuuaaccaacugcuauucugaaauauacagguucuuguaauagacaguguuuuguuauuugaguacauuuauagggaaaaacaaacaggauggagauuuaauagccaguuuaggagagagcuagaacuuauauuauuccuugaauauccucaaauauuugguuucuuauaauuauauaaauuuuauugcuaaaauuucuccagaauauacuugcacaucuugauuaaugguauuaguaaaguaacaauaagcuuuuugagauccauaauguauguuuggcacaugaguucugaacugguuuuugcauaggguacuugagacauuuuggagcuugcuuaguguagaacaagaacugcuggcugaaaauaaauccacugaaaauuaacacugagguuaaugaaacuucuggauuaguagagucaucuauguauuaucaaugguaaugagaugcuagaccaagaaugaugaucuacguacauacaaacaaacaaucauuuggauauauauauaugcaauccgaaacaccucauuuugugaucauuuccuguuuucugaagcacaaaaagcaaaauugguaagaaguggaguugauuaccuacugagguagcucugauuuacuguucaguaaugagguccagaguaggaguaauacugauaguuaaaucuguaauuccaauuuucaguccuuuuuuucuuuuucuuuuuuuaaacaguguuucauguaacucagacuaacauugaacucacuguaguugagggugaccuaggccuccugauccucuugcuuccaccucccagguuuagagauuacaaauguccaccaccauagcaugaucucaguacugcauuucugucuuuucuggaaaaaagaccauuuacuagagcuguuauuaaaugguagcaucuaagaaaguguacuucgcuacuucuuccugacucuacuuucuaauggagaugcuaauaagaaauuaaguuuagccuaucauugaggauccuaccuugucucuuuugaauguguuguuucucuagcuaauaaaguaaauaauuauacagauucauaucucaagcauagaaaaaagguuuuaaaaccaagagcauuaauaugaguauccugccuacacauauguaugugcaccauaugugugugcgccacaccuggugucugcaggggauggggguggugguggugguggugguggugguggugguggugucuggucccuggagcaaguuacaggcaguuaugagccaccauguggguacaaggaaaugaaccucgguccucugcaagaauagugagugcucuuaacucccaagcuaucuuucuaaccccaccuggaguuuuuugguuggucuuauuuuugcuuuuguuuuggugcugaagauugaaauugaggccucgugcauauuaagcacaugcucacucacagagcuacacuccagucaaguuuuugguuuuguauuuauauaugcucucuacuuuaaaguaaaauacuaauuuucuuuuuuuucuucauuuuuauugguuauuuuauuuauuuacauuucaaauguuaucccccuucccaguuucccuuccauaagcuuccuauccccuccucccuccccccuaccucuguaagggugauccccaucugcacacacacuccugccuccguggccuagcauuccccuauucugggucaucaagccuccauaagaccaaggccuccccucccagugaugccagauaaggcaauccucugcuacacauccagcuggagcuauggguaccucccaugcacucuuugguuggugguuuagucccugggagcuuugguggggggggggggggcgucugguugguugauauuguuguucuuccuaugagguugcaaacuccuucagcuccuacaguccuugccuuaacuucccuauuauggucucugcgcucaguccaauguuuggcuguguacauccacaucuguauuggucaggcucuggcagagccucucagggggcagcuauauggggcuucugucagcaagcacuucuuagcaucagcaagugucucgguuuggugucagcagaugggauggaucccuagggagcccacauacacauggaagcugaacuaguaucuauucacugauaacuuagucagggaagaaauaaagaaagaaauuaaagacuuuuuagaauuuaaugaaaaugaaggcacaauaaacccaacuuaauggaacacaaugaaagcagugcugagaggaaaauucauagcucugagugcuuccauaaagaaccugaagagagcauacacuagcaacuuaacagaauaucugaaagcucuagaacaaaaagaagcaaauacacccaagaguagaccugcaggaaaugaucaaacucggggcugaaaucaaccaaguagaaacaagagaacuauacaaaaaaaucaacaaaaccaggagcugguucuuugagaaaaucaucaagauagauaaacccuuagcaagacuaaccagagggcacagagacaguauccaaauuaacaaaaucagaaaugaaaauggagacauaacaacagaaacuaaagaaaugcaaaaaaauaucagauccugccacaaaacuugaaaaucuagaugaaauggaugauuuucuaaguuuuuguuucuuguguggucugugaguucucaucuugaaacucuuucucucuuuucuucucccugcucccagucacccuguacugacgcuugcagugagaucucuguccccugagugccaguuguacauuuccguuuagucaucuuaguguuuaucauuugaaagcuggucagucuaaagcaggucuuguuggaaaauaaauagcuucaaguuuggacuuauuucugucaauacuuuucuuuugaguugcugacaucucaaauauauauuugagacguuuuggggguaacagugcuugcugugcaagcaugaagacccaagcuagaauccccaguucccacauaaaaaucuaggcacugcugcacaugcuuauaacuccaauguaguagaaaguagagauaggaucacugagauaggcuggccaccagccuaacuccaaguugagugagagauccuaucuuaaaggauaagauggagagugaugagcuggagcgauggcuuagugguuaagagcaccuacuacucuuccgaaggcccugaguucaaauccuagcaaccacaugguggcucacaacuaucuguaaugggaucugaugcccuuuucuggggugucugaagacagcuacaguguacuuacauauaauaauaaauaaaucuuaaaaagaaaaaaagagugaucuaguuggacaucugaagccuucccugacuuuuccagaccuguauggcacaagaaagcacacaggugcaugugcaucuuccaccuuguaugagcuucuugagcuuagaaauucugcuuuggaucacguaugucuuccauuguauuuggaaauacagaguuagauauuuaaggaaaguguucaaauuaaaaauaaacagacugaacuuauacaagaaauuaaaaguagggcagaaugcacccagaacccacuggcaggaaggauuaagagcauaguagguguaguggcuauuccugguugucaacuugacaauauuuggaaugaacuacaauucggaauuggaaggcucaccagugacccuuaucuggaggcuuggagauccuuaucuggaucuugguuugaagaucuugagccauaguggcuauggauuccagaagauugaaucuccgaguuaaggaacacaccuuuaaucugggcuacaccuuuugcuggagacaauauaaggacauuggaagaagggagucuagcucuugcucuugcuccugcuccuucgccugcuugcugcgugagacugaguaacugcuagauccuuggacuuccauucacagcugugacugaacgauuguugggaauugagcugccgacuguaagucaucaauaaauuccuuuauuaucuagagacuauccauaaguucugugacucuagagaacccugacuaauacagaaguugguaccaggagugguucuagaguaacagaaguacaaggaugaaucuuuuaaaauacuggaauuggcuuguugauccaccagcacuuucaaauauugaaaccucuccagauucucucccuccugggagcucagagaauuuugaagacccaugguugaaacuauauuccgaacuuaaagaagcuaaugcccuugauuuucuuaaugaauuaggugauucagugcacaaagcuuucuacaagauggggaaaaaaucgaaaaaugauuuuacuggcuggcugcucuuaguaucuguggaaaaaaugaugaaugaaaggaaggaguugugugauaaaaucgaaaggcuccagacacaaguaaacgaucuaaaaguugcuaaguguguccuugaggagaaucuucucucuuguagcaauagagcucaaguugcagaaaaucaaacagaaacucucauuguaagguuggcugaacuacagagaaaauucaagucucagccucagagugugucgacaguuaaaguaagggcucuaauuggcaaagaaugggauccuacaacaugggacggggaugugugggaagaccauguugaagcugagaauuuugaauccucagauucucaaggguuugccccaccugaggaaguaguacccucagccccaccucuugaaauaaugccuuccccacaugaggaaauuaauuuugcagagucugcucacggcccaccaauaguuucuucuagaccuguaaccagacucaaagcaaaacaggcuccuagaggggagguagaaaguauaguccaugaggaaauucgcuacacuacuaaggagcuuaaugaguuugcuaauucauucaagcagaaaccuggugaauaugugugggaauggauuuuaagggugugggauaaggguggaaggaacauaaaacuagagcaggcugaguuuauugacauggguccucugaguagagauucuagguuuaauacggaagcucgcauaguuaaaaaaggugucaaaaguuuguuugaaugguuggcugagguguuuaucaaaagauggccuacuggaaaugacuuggagaugccugauauuccguggcuuaguguugaugaagggauuuuaagacuuagggaaauugcaaugcuagaguggauauauuguguaaagcauaauuguccacaaugggaagguccagaagauaugccuuucaccagcucuauaagacgcaaauuggugagaggggcaccagcacauuugaaggguuuuguucuuucccuuuuccuugugccagaucuuagcauuggagaugcuucugcucaauuagaugaauuaaauucacuggguuuaguuggaucccgagguaacaagggccagguggcagcauugaaucgccggagacaaggugauccuaguuauuauaauggacagcguagacaaaagaauguuuauaauaacauacccaguaauggucagcacaggagaggugaaauuuauaauggcaugacucgcuuggaccuuugguacuggcuaaucaaucaugguguuuccaggaaugaaauacauaggaagccuacugcauauuuguuugaucuguauaagcagaaaaauucucaaacaaaugaaagaaaggcuacauuagaucgugguaaacagcaaucucggccagugaaucaauuuccagacuugagacaguuugcagauccggaaccccuugaaugaagggguggccagguuccucugaggaaggaucuugauaagacacucaaagguuuugcuguuacccuuucuccaguucuuccccagagggaccuacggccuuuuacaaggguaacuguacacuggggaaaaggaaauaaucagacuuuucggggucugcuggauacugguucugaguugacacugaucccaggggaucccaagaaacauuguggcccuccaguuaaaguaggggcuuauggagggcagguaauuaauggaguuuugacugauguccgacucacaguagguccaguagguccccggacacauccuguggugauuuccccaguuccagaauguauaauugggauagauauacucagaaauuggcagaauucucauauugguucccugaacuguagagugagggcuauuaugguuggaaaggccaaauggaagccuuuagaguugccucugccaaagaaaauagugaaucaaaaacaguaucguauuccuggaggcauugcagaaauuacugccacuaucaaggacuugaaagaugcagggguggugguucccaccacaucuccauuuaacucuccuaucuggccagugcagaaaacagauggaucauggagaaugacaguugauuaucgaaaacuaaaucaaguaguaacuccaauugcagcugcuguaccagauguaguuucguuacuugagcaaauuaacacaucuccuggcaccugguaugcggcuauugaucuggcaaaugccuucuucucaguaccuguccauaaggaccaccagaagcaauuugcuuucaguuggcaaggccaacaguauaccuucacaguuuugccucaaggauauauuaacucuccugcccugugucauaauuuaguuagaagggaucuugaucguuuggaucuuccacaaaauaucacauuggugcacuauauugaugacauuaugcugauuggaccaagugagcaggaaguagcaaccacuuuggacucauugguaacacauaugcguaucagaggaugggaaauaaauccaaccaaaauucaaggaccaucuaccucagugaaauucuuaggaguccagugguguggggcaugcagagauauuccuucuaaggugaaagauaaguuauugcaccuggccccuccuacaaccaagaaagaagcacaacguuuagugggucuauuuggauucuggagacaacacaucccucacuuggguguguuacuuaggccuauuuaccaagugacucggaaagcugcuagcuuuguguggggccuggaacaggagaaggcccuucaacagguccaggcugcugugcaggcugcucuaccacuuggaccauaugacccagcagauccgaugguacuugaggugucuguggcugauagagaugcuguuuggagccucuggcaggccccuguaggugaaucacagaaaaggccuuugggauuuuggagcaaagcucuaccaucaucugcagacaacuauucucccuuugaaaaacagcucuuggccugcuauugggccuuaguggaaacugaacgucugacaauaggacaccaagucacuaugcgaccugaacuacccaucaugagcuggguacuaucagacccugcaagucauaaagugggacgugcacagcagcagucuauuaucaaauggaagugguauauacgugaucgggccagagcagguccugaaggcacaagcaaguuacaugaagaaguugcucaaaugccuaugguuucuacuccuguuacaaugccaucugcugccaagcaugcaccuauagccucaugggguguucccuaugaucaacugaccgaagaggagaagacuagagccugguuuacugauggcucugcacguuaugcaggcaccacccagaaguggacagcugcagcauuacaaccccuuucugggacaaccuugaaagacacaggugaagggaaaucuucacagugggcagaacuucgggcaguacacaugguauuacaguuuguuuguaagaagaaguggccagauguacgauuauucacugacucaugggcuguagccaauggauuggcuggauggucagggacuuggaaagaucacaauuggaaaauuggugagaaagacaucuggggaagaaguauguggauagaucucuccaaaugggcaaaggaugugaagauauuugugucccauguaaaugcucaccaaaaggugacuucagcugaggaggaguucaauaaucaaguggauaagaugacccguucuguggacaaucagccucucuccccagccaucccugucauugcucaaugggcacaugaacaaaguggccaugguggucgagauggagguuaugcuugggcucagcaacaugggcuuccacucaccaaggcugaccuggcuacagcugcugcugauugccagaucugccaacagcagaaaccaacacugagccccagauauggcaccauuccucgaggugaccagccagcaaccugguggcagguugacuacauuggaccacuuccuucguggaaaggacagcguuuuguucuuacuggaguagauacuuauucugguuauggauuugccuuuccugcacguaaugccucugcuaaaaccaccauucacggacugacagaaugccucaucuaucgucaugguauuccacacaguauugcuucugaccaaggaacucauuucacagccagagaaguacgacagugggcucacgaucauggaauucacuggucuuaccacauuccccaucauccugaagcagcugggcugauagaaagauggaauggccuuuugaagacgcaguuacagcgccaauuaggugguaacagcuuggaaggcuggggcagaguucuucagaaggcaguauaugcuuugaaucagcgcucaauauaugguacaguuucacccauagccaggauucauggguccaggaaucaagggguggaaaacggaauaguuccacuuacuaucacuccuagugacccucuaggaaaauuuuugcuuccuguccccauaacucuagguucugcuggcuuagaaguuuuggcuccagagaggggaaugcuccuaccaggagcuacaacaaacauuucauugaacuggaagcucagacuucccccuggucauuuugggcuucuaaugcccuuaaaccaacaggcuaaaaaaggaauaacaguguuaggaggggugauagauccagauuaccauggggaaauuggauuaccucuucacaauggugguaagcaagauuaugucuggagugcaggagaucccuuagggcgucucuuaguacuaccauguccugugauuaaagucaaugggaaacuacaacagccuaauccaagcaggaugacaaaggacgcagacccaucaggaaugaagguaugggucaauccuccaggaaaagagccaagaccugcugaggugcuggcugaaggugaaggaaauacagaauggguaguagaggaagguaguuauaaauaccaauuaaggccacguaaccaguugcagaaacgaggauuauaaaguaauaugaaugcccauuguaaauuuacuaaugcguuugcgauuguacgagggauaguuauaucauguuaggcguauuuacaaccuuguuauuguuucaugugaacaugagauauuauuugugucaaguugacaagggguggauuguaguggcuauuccugguugucaacuugacaauauuuggaaugaacuacaauucggaauuggaaggcucaccagugacccuuaucuggaggcuuggagauccuuaucuggaucuugguuugaagaucuugagccauaguggcuauggauuccagaagauugaaucuccgaguuaaggaacacaccuuuaaucugggcuacaccuuuugcuggagacaauauaaggacauuggaagaagggagucuagcucuugcucuugcuccugcuccuucgccugcuugcugcgugagacugaguaacugcuagauccuuggacuuccauucacagcugugacugaacgauuguugggaauugagcugccgacuguaagucaucaauaaauuccuuuauuaucuagagacuauccauaaguucugugacucuagagaacccugacuaauacaauaguagguguuuauaaagucccacuuuuaugugacuuggaauggugagauggcucagcaguuaagcuacuugcugucaggcugaguucacucuccuagacccacaaagauccuuaguugacuccugcauguuguccucugaccucuguuacacaugccaugccaugugcauacccagauccacagaauaaauaaauguaauaaaagaaaaaguuaguaacucaggcuaggaaaugagucaguaaaaaggaccuacauucauuucccagcacccauaucguggcucacaaccaucuguaacuccagugccacaaaauccuaugcugccuucuggccucuguuggcaucaggcacucauguggugcacauauauacagagguaaaucauuuauauacagaaaaaucuuuaaaaaaauuuaaacuugaaaaauaagaguuaauaacucagaguaauuacccuuuuuuuuuuucauuuuauuucauuuauuuggcuuuuuacucccugaggaaaagggauaccugugguuggagaaacaagucuuauucauaagucagugggguuuuguuuucuugucuuacggguauuuguuuguuuguuuaauccaguauagcuguaauuugcuauuuaacccagacuugucucaggcuugagauugcccugccuacaccucccaggugcuggaauuacaggcauaugucaguggacuuugcauuuucacucccugguguguuuuuaaugaaauagaccuuuccauguugcuaauauuccauagguuuguuagguuaacuucuucaguaguacaucagaguugaauuaguuagacucuuaguaacuagacucuuaguaaguagauuuaauauguauuaagaguuuuguguguuuaauucauuucuacauagcuucucaugacauguggagaggugaagaugaaucugucaguuuccgcauuuugaguaguuucuagaaaacaggacauuuuucuuaaaaauucuuaaugagugaagccaagauucccaauucagauaauccuuuauuuaugaaugaggugucuucgauguucgcuaaaguacacuuuggcacugugucacaccauucuuguucauucugucccugcugcucugcacuggugucccccucuucccuuugcaguucauagagcagaagcggggugcacgcgcagcagucuucagugacuucaccaccugugcaagugcuagaacugcacugcccuaguuagagagaacugggggcagaggccacugcaggagggggagggagacaggcaucggugccuucaucuaguuccaggagaaacaaguuugugccacaauaaaauaauggaucuggauacagauaauaauauagaaguugcaugacaaagugaguuaguuugugguaaaaguucuuucuuauucauauuagcauauauguugccacuuuucauuuugacuuaauuuuaaaucuguuuacugagagcaaagguucuuggcuguggauuuguauuggaaauguuuuauuuuuaaauauuguuuuauuuuuaagcuuuucuuuauaaagaauuuuuucaaauguucugaguguuuaccugaacauauguaugugcauaucuggugcuaaugaagaaugcguugggacuuuuccaguucugaacaguagugagcgaccgccauaugggugcugggaacuaaacuuaugucugaaagagcagcgggugcucucaacuguugcacuaucucuuguuuuguuuuuagcuuuugagacaagaucacacuuugcugacauagaaacacucaguuuuccucaccccuggacaugcuaggauugaaggcaugagccgccacaccugccuggaguuguguuguaauuuuuauagaugcuucuuucuucaugcugaaauauaaacagagagaaacacaaguuuuuauguggauguugauuaagauuuaacuauuuucgcugggcauggugacgcacuccuuuaaucccagcacuugggaggcagaggcaggcggauuucugaguuugaggccagccuggucuacagagugaguuccaggacagccagggcuacacagagaaacccugucucaaaaaaaaaccagaaaaaaaaaaaaaagauuuaacuauuuucuagagguauuuugucaggaaacuuuuccuuaaggccucacuuuuguauuaauuacaagguauguuuucauugcagcaaagaaaaaggaaaaagugguaggauuagguuaacugaauggaaguauuugcucuuauauaagaaaaugcaggacugcagauauauugcauugguuuguguagucucuucccucuuauggaagccuauuuucugguguuauaaucaagucucauuaaaaauauuguuuuuggaaauaguucauuguauuacaggaaaugaacauugauccuguuacugauaguuccuaaguuaaaaaaaaucaguuugucuuuuuuuuuaggaaaacauuuaaauuaauaaaauaaccagagauguggucuuuuuauuuuuaaaagggggcaaaucuggaggaggaauggccuaguggcuaagagcauuggcugcucuuccagaggacccagguucaguucccagcaacccacauggcagcucacaacugcuagaacuccacuuccagggacuugaagccaucuucuagcuucccugggcaccggcacacacaacauauaugcagacaaaacacaccguacacauaaaauaacaaaauagauuuuuuuaagaaagucaaacuugacauuuuuuaauuguagaaaauaaaauggguccaagaaauuuguaaaauacagguccagaaaauggcuuauuaggcaaagccugaggacccacauaguuaagacaggccucacuuuuacaaguugcccccuucccugcaugcauacacacacacacaccacacauauccagacacacuuaaugaaaugcagcaaaucauuaaauauaagauacaguaaagcaugagaaauaaugaaacuuuucuaucagugaacauuuauuaacauuugcuuuauuuuauauuuauuugugaaugauaauaaauauaugauaauacuaucuaaaccuuucuacucagcuuuaaaaaauaagaacgauguccuagacacuuucauauaugacccuuuuagguaaauaauauuguccuucuuuggauuuauauuaaaagauaacauaucuaugauuaugaagacuagauaugaguagagaaugugaaauucuagauucucguuugaguuguagaaaaagaaguuggauggauggggagaguaacaauuuuacuauuuuuuuuuuuauucuguaaucuuuuuuuacaguccagucguuaucccccuccugaucccacccucugacaguuccucaucucaugccuccuucccccagauuuacuaucuuuaaucucugaguuuuguuuuguuuuuguaugugguacaguguggguaugugcauacauaggggauguagagaggagauauacuggucuuugcggauucuggauuaccaccuggucaugagcacagaaauggaugaagcuucuauuccauuuccuaguacagaaauucauguaauagggguuggagguauggcccagugguuaagagcauguucuuccugcaggccugaguucaguucucagcaaccacgugagaugguguacaacuaucuguaauaccagcuccagggguuuccagugucuccauccuccauggauaccuucaccugcaggcacauacccacaugcaugcacacacucauaauuacaaaaagaauaugucugucugucuaaaauguacuuaguacauuauacuuagaggauauaucaaauauuaaguugguaaaaacaagccaguaaucuaaaccaaaagucugagaagugaucugaauaguuucuuacuugcccauuugugcuuuaguuuucuuaccugugugugaugagugauagcggcugucucuuggaugugcaugugggguguaugcaugucacaguacaccuaugguggucucuccuuccucuguggagguccugagaaucuuuauccacugaaccaucuuaucaaccuagucuuuaauacauaaucaauuaaaauuucuccucuacaaaaacagagguggaggacuugccuaccaagcauaagucccuagauucaauccucaguucagcaaggacagauuuuaaguguguuguauaagcuauauacaucagugaagugguuuaaaauaauuauacaccaauguuauaugcuaaucaaaaaagcauuaugcuaaucaaaaguacccaguuaggagaaaacuguaugauuacauuuauguaaaauuucuaaauuagauuuguagaagagagaaauagguugguggucgccuaggacagaggagaaugggagguaaaagaagggaggucaggaauaaggggggugacuugaaaugaguaagagugucuuugggagguugaugaaaaugccuuuagaugaugauuguacaacucccugaguaaaguaaaacuauuaauucuguagcuguagauucucucacaaaagcuauuauagagaauauacuggagccuggggagaagggguggugucuucuuaaucccaggacucaggaggcugaugcagguagaaaccugaauuggaggccagccuggucuacagagugagguccaggauagccagggcuacacagagaaacccugucuuauuuaaauauugggagugggaucgaucaggagguguugguuauauuggucagaaacugacacuguaacaguagcaaaaaaaaaaaaaaaaaaaaagccuugacagagaugcuugggagaaguagcagugccuccgugcggcugggauaaacugagcgcuggcgugagucggcacacaagacaauguagguucuuaagggcugugagggguuuugauaagugauaugauuugacacaagaauuuguuuuacuuuguuucaugcuuuuaaagcauuguuuuccaguugugaugguauaccuguaauuccaugacuuuagaggucaaggcuagcuauccuuuguugcaucugagcucaagccagcuugggcuacaugaggcccauucucaaaaaagggggguggggaggguuguuuuucuuauuuuuaacugacacacuaauuauauguauaucuugggaugcaguacgacauuucauccuguuucuacaaugcacugaucagacggguaauuugcaaaacugucacucagacaugcauuauuuguguguguguugguaacuuugaaaguccuagccacuuacuuugaaauguuuaauugcugugaaccauaguuaucuugcugugcuauggaacaucaggcuauacuccuauguaguuauauauacaccucuguucccaacccuuucuucccuacauucacccaagaucuggcaaaugagaccacuccuuucacuguuaaauacaauaagaaaguauggaauuugacauaaguuggaauuguuccuuuuaaaugcugggcguuuaaccaggauuggguggggaggaggguuguuauuagugcuugugguguuuuguuuuuuauuuuuugaggcagguuauccauguagcccuggcuguccugguagucacuauguagaccaggugucuuaggguuucuguuacuaugaugauauaccaugaccaaaaagcaaguuggggaggaaagggauuuauuuggcauacaauuccacagcacuguuuaucaaaggaaaccaggacaggaauucaaacagugcaggaaccuggaggcaguagcuggugcagaggccuuggaaggacgcugcuuaauggcuugcuucucauggcuugcucagccuuucuuauagaaccuagaccgcuaguccugggauuguaccacccuccaucucaaucaauaauuaauaagaugccauauagcuguauauuauggagguguuuucuuaauuaagguucccgccucucagauggcuuuaucaugugucaaguugacacaauaaaacuagucaguacacuaggcuagccucaaacucagagaucuauucugucucagccucuggaggugcugggauuaaaggugugugccaccaacuucuguauuagucaggguucucuagagucacagaacuuaugaguagucauauaguaagggaauuuguugauagcuuagucuguagucuaacucccaacaaugcucagcagcagcugugaauggaagcccaaggaucuagcauugcucagucccagaaggcaaaaggcuuuuuaaaaggggcuagggcgcugaaaauacauguaagaguagcugaggugaagcagcauaaccccuugaaagguaacucucugagagagaugaagaugacugaaaccagcacugcagggaaggauuugcuggcagaccugacacagaagagaaagggaaguggaaggaaaaaaguggaagaagaugccaugguuuucacuagaagaccgagguuacagcagauucaggaaauaauaagagcucuguuuugacacauagcagucaguuagacauccaaggaccuaucugaguaagcagacuagagauccaaauccagaagaggucacuugaagacugcauguaaaaucaagugcuuuaguccuccaauacaaaauacuuaauaaacaagacuguuuucccuuaaaguagacuuaaaaucuuaccuuuccaugcccucaaagagauaaauguguuucuuguguuucaggaucuucaagaugaaguucaaagggagaguauuaaucuacaaaaacugcaggcccagaagcagcaggugcaggagcuccugggugaacuggaugagcagaaagcccagcuggaggagcagcuccaggaagucaggaaaaagugugcugaggaggcccagcugguaaagccuggcugcuuacugaccgacuugcuaccuccaucuuguuccugguuuagaaagaaaacauugccugcuuguuaguggcacuguagccagcagcugcuuuaugaaggcguuggaaggaugcuuaugaagaguuauaguucucuguaguaggaauuagaagggugauauuuuuccagcucuugauuacacagauguuaccuguguuacacagaugccucugaguugcuuuuggccccuucccuguuaacuuucacugccaaaagaauaccucaaaaguuccaguccacuaaacuagacaucucgugucuaauuccaucucccauucaucuccauuuauagauuucuucccugaaagcagaaauaacuagucaagaaucucagaucuccaguuaugaggaagaacuguugaaagcuagagaagaacuaagucgccuacaacaagaaacagcacaauuggaagaaaguguggagucagggaaggcucagcuggaaccucuucagcagcaccuacaagagucacaacaggaaaucagcucaguaaguggaaaccagcagaaugcccagaggggccuuguguguccuuguuguaacuuucuaacaccugccccuucuuccucugccuaguuaguaucucugguuguuuaauacuuaaaguuggugucuaauggucauuuacauaauagauuagaguaggggcuuuguaguuaaagcuguucagguuuaaaugcuggcucugucauuucauaggcgaaucacuuuugaguaucagcuuuuuuaucuuuaaaguugaagauuuaacaacaaaccuacuuauuagggcuauuauaaggauuaaaugaggcaaaacaugagguaaaaaaguuagagucauggggaaaagaagcuucaauugagaaaaugcuucugugagaugggacaagccugcagggcauuuuuuucuuuucuuuuuugagacagggucuugucucuaacagucuuggcuauccuggaacucacuuuguagaccaagcuggucuugaacucacagaaaucuacccuccccugccucccaagugcugagauuaaaggcauaucacuauguccagcuugaaagacauuuucuuaauuagugauugauggggagggcucagccuauuguggcuugugccaucccugggcugaugguccuggguuguaaaaaaaaaaaaagcaggcugagcaagccaugaggagccacccaguaagcagcacuccuccauggccucugcaucaguuccugccuccagguuccugcccuguuugaguuccuguccugaauuccauuaaugaugaacaaugcuguggaaguguaagccaaaugauccuucuccuccccaaguugcuuuggucaugagguuucaucacagcaguaauaacucuaagacacugaacaacuuacuggguuuuuuugggauuccaauuuuuagaucaauuuuucuuagugaaaucauuuaguuuucuuguaucuguuuauuauuauauauugauucuuccauuugugucuuacgguugaauucauuugacuaguuuaggucaaaacagcuuuauccuuuguuuauuggacuuugugugacuuauuuuuuuagaagaaguaguucucagagaccugacagaaauuucauaaggcuuacaaaaacaaaugcaugcaugcugacauugcaggaggacucacugggagagauuauugaagccuuuaagucaugcuucauuccuagaggaaucugcuaauaggaagcaaacucaucccugaguuagucuaggggcauagauauuugugauauauuuauuucuaggauuaaauuguuuuguauuucuacuuuguauuggcagaugcaaaugagauuggaaaugaaagaucuggaaacugauaauaaccaaucaaauuggagcaguagcccacaaagcguucuuguuaauggugcuacagauuacuguagccucagcaccagcagcagugaaacagccaacuucaacgaacaugcugaaggccaaaacaaccuagagucugaacccacacaccaggaguccucagugaguuuuuguuucauaguguuuauuauuaaguuucccccucgacuccccccacagauugaugaagaucaaaguuaguguguacagacuuaugugcagagaccagggggcguccucaaagugucacuccuuagaugcuguucacuuguuuuuaaaaaaauagggccucggagaucuagagcuuaccaauuagacuagggugacuggccggaagccccaggugucugucugucuacaucaccccugcucuggguuuacaagcacacaccaccacuuuuggcuuuuugcauggaugcuggggaucugaacucaguccacacuugagcagcaggcucuuuaucaaauaggcucucuccagccccagagcaguguuuuaucagcauuguauauaauagaaagaaguauaauuuuuaagauacauuuuaauuuuuauuuauguauguguguacagguacccacagaagccagaagagggugucagaucauuuggagcuggaguuaacaggcaguuuaagcugccuugugugggugcugggaguugagcuuugguucccuggaagaacaacuaguguucuuaacugcuaagaugauccuucaggcccaacaauugaaauuuuuucuuuucaguuuuaacuaauguucaaauguaaucuacuuaauaaaaguauuuuuuaaauaauaggucuuauguagcucaggcuagccuuaaacuuaauauauagcuaaggaugucuuuaagcucuuuuuugacuuacugugucugcuuguggggagaggggguucacaagugugcucaccuuugguugcacucaucuauguaugcaaguauagauagaagcuauaguucaacuuugcucucuucuaguacugcuaucuaccuuauuuuuugggacacggucuccucacugaaaauagagacugccauuuuagcuagacuuaggaugucaaccuguuucagccaucccagcauugguauuacaguuacucccuaccaugccuggcuuuuacuuggaaguuucaaacuugaauucagugcaccaggcacuuuaccaaggaagccaucuucucagcccugacuuuaugcaugugaccugccugccucuauucccauuuaaugagauuaagagagugugguaucacaucugguuuuuuauuuacuuuucauagaacauaggugacaaucaguauuucuggugggcaugguggcagguacauuuacguuucuguguauuuauuuuacacguauacacauaccagagugucuacaugaaagucagaagaaaacauguggaagucaguucucuccuuuuaccuugugaccaggaauugaacuuggguuaucagugucuuucccugcuuggcuaucccuguagcccuagcauacacucuaaaucccagcacuccggaggcuaaggaggacaguuguaaguucuaagacggcuuagaacuuagggcuauguagugagaccaugucucagaacaacaaaagcacuucuguagaugauaacauuugaagacagggucucacuguguugcccaaguuagccucaaacaccucugugcaauugcuucugccuugagaauugcagagauagcacgaaaaccuggcuuagguaauagcauuauuuaaaguguacuuuguuuuuaaguauuuaagaaaaauaguuuaaaugcuauuuuaauucuuuuuuggaauuaaauuuugaguacauccuuuuucccuuccccuuuuucuaacccuuccuacauucuggugaaauucauggccucuuuuuuuuuaauuguuuuacacacacacacacacacacacacacacacacacacacacacacacauacacggcagccggacgggggggggguggggggguggaggagaggagagagggagggggaaggagggaacaagggagaaagaaaauaaauacaaccuguucaguccauauaauauuaccuauauguguaugaguucagagaugaccacuuaguauuggauagaaaaagguuuuaagggucuggagauagagcauagugacagauacuuuuugcaucauuuaaagggcccuggguuuaauccucaauaccaaaauaaauuuuaagacacacacacacacacacacacacacacacgggcuggagagaugacucagugguuaggagcacugacugcuuuuccagagguccugaguucaaaucccagaaaccacaugguggcucacaaccaucuguaauggaauugaugcccucuucuggugugucugaagacagcaacaguauacucauauacauuaaauaaauuaauuaauuaguuaaaaaaaaagacacacacaaacauacagacacgcaguuaaaaaauuguuuuuagucaugcauugugauuccuuuaagucccaguacucagaggcaaaggcagguaaaccucugaguuuugaggcuagccuaguuuacauaguguguuccaggccagccaagauuucacaguaagacccugucucucucucuuaaaaaaaaagaaaagggcuguuaaaauaaucuuuuccaaaagucuuuauuauauuuauggguggguuuagcacgccacaguguucuugcggaagucagaagaaaacuuguaggaguuuguuuucacucccuuuaaugaguccuggagacggaacucaguugucaggcucagcaacaacacaugccauauccccugccugagacagagacuucucuguccugcucacgugugugucuuuguagguaagaaguaguccugaaaucgcaccuucugaugugacugaugaaagugaggcugugacuguggcugguaaugagaaaguuacuccgagauuugacgaugacaagcacucaaaagaggugaagauaauuguacauucgauuguucuuguuauucaugucuuaaaugaucuuuguagcugaaaaauauuuacuaaaauuuuucaaaguauguauaugaucagaauguaggucacuugaaguacuucucuaaacguuugguuacuaaaauaucuuuuaauuaaaaauuauuucuaggaagauccauuuaauguagaaucaaguucacugacagaugcaguugcagauacaaacuuggauuuuuuccagucugauccuuuuguuggcaguaaguaucuuucuuuuguaaguauaucuaaaacaauauuucugcuguguaaauuauauaaucauuaaggcuucaguuuugagagcgcauuuuuuuuuacaauauaagcaaagcugaaaauaagggucuuuagucuuacauuugcuccuauuuaauuuuaacauucuaccauaggauuaucugauuaagagaauguuucuucagaguaaaggcuaauggaaagauauguuauaagccagugauagagauugcacacucaugagucagcaucauuuagcuaauaauuacugaaauacuaacaccagaccaggcauggaaucacacuucuguaaucccaacauuuugcaaauuugaguuuagccugagcuacagaacaaagcugccucaggaaacuuuuuaaaaaugaagaaaagaaaaacaacaaaaaaaagcuaacaguguaauuuugaaucaguagaaggugucaggcauggugacauaaauuuuuaguuuuaguacucaaagggcagagguagguagauggaucucuugaguucaaaaccagcauaguuuacauagccagggcuacacagugagauuauuaucucaaaaauaaaauaaaacugaaaugacaauggaagcuauaauagaauuagaugucugauucucuuuccuuaagauauuucuaauuuaggaaacauaaaucuugcugggcaugguggcacaugccuuuaaucccagcacucaggaagcagagacagauggaucucuugaguuugaggccagccuggucuacaagaauucuaagacaaccagggcuguacagagaaacccuaucucaaaaacaaacaaacaaaacaaaaaccauaacucugacuaaaauauaucaugucuaugaacuauguuaaauauuucuugugucaacggucuuuugaauuacguuuuauuuccagaacuacugagcuugguaucauaggugugugauuauaauuccagcacuugguaagcagaggugggaggaucccauaggcuugaggccagucuggucuacagagcuuguuucagccagggcugcauagucucacacaaacaaggggcugaagagauggcucaguaguuaagccuuggcuuaauuggcuugcuucucuuauagaggaccugagaucaguguccaguauccacauggcagcucagaacucacuguaacuccaguuccagaggaucugauaccuucuccuaucuuccacuggcacaagcuaauggcagucuucuuaaugggaacccuccucaguguugauuacaagcaugagcacucauacuccugguuuucuuccaagaaccuuauaguuuuagcuguuggggcuagagauacagcucagacagcucacugccuguaacuccacuccagggaucugaucugauguacuguggccucucuccuucucccucucuucccucuccucccucuccugccucucucuccucucucucucucucucucucucucucucucucucucucucucucucucucucucucucucucucucucucucucuuuucauccgcagccccaaauaccuuuuguugaaagacuguccuuucaccguuucuuuguuguucaugacacucuugucaaaauucaaguggccauugaugucagaguuugccucuggcuucuuaacuuucugagaguuuuucuuuuuguuuuguuguuguuuagucgggccuucuuuauuacaugaaguacugaugguaagaucugcccaguagccuugugaggaguagauauuuuguugguaaaauuuuacuauugugugucucuuccccuguaaacucuuucaaucaaagguaaguauauuugguucuuauaguuguuacucugcugcugcugugauaaacaccauggccaaggcaauguauggaugucagaguuuauuucgguuuauuguuccagaggcuuugagguuguaauggcaggcacaacagggcagcagggacagcagauagcagggauagcauggcagcagggacagcauggcggcagggacagcagggacagggacaacaggaacagcauggcggcagggacagcauggcagccagaacaggagcagagagcaaaccuuaaaagucaaagugagcucaaagccugccucccaugcacacugcauccaacaaaggcagccguccuaaaccuccccaaacacugacaccaacugugaucagguguugaaaggccagagacuguggaggacauuucgauucaaaccaccauggcucuaauuugccuuuuuaugauguguauuauauugaaguagaaguagaauuguugaaacucuuaaguuauuguuuaacuuaacuuugcuuuugcuuuaaaaauacccuuuuccacaacaauaaauaaucaggguuuuucauuuauuuacuuuuauuuuauuuuauuuuuuugucacaggugauccuuucaaggaugauccuuuuggaaaaauuggucaguauauuuuugcguuucuucuuaacuuagauucuauucuguuauagccuaauauuguauuuagugagaacacagaaccuggguaguucuaggagaugaacugcuuuuuaguuuuaaaacugcucuaaagccaaggguguguguguguguguguguguguguguguguguguguguguguguguagugugucuguguaucuguguugggguuaaacaggacuuugugccagcuaggcaaguacucugguacacuuucaacucaagccucacuuuuuaaaaaaauaauaaucaaaaugcugcuuaaaaauaacauuggugguagggguagaaagauggcucagugguuaagacuguguauuuuccuuuauagaggaccagcguuugauuaccaaccccauagggugucucacaauugucuguaacucuagcuaaggggaaccaauaccucugaucucugcaaggacuguacugauacauauaugcauaagaucuaauuuuuccauauuguguaaaguuaaauuaauaugagucuguauacuaugacagaauacaaggcuauaaaauaacuuuacuauccuacaauuuuagacuggucauaugaguuggaggcauugaaaaauuacuaaauuuaagaugaucauuuuucugggauuuuucacuagaauaaaggaaguuguuuucuacuaaauuuugcuucccaaauguguuucaguguauuagccugaguucagagaaggaacuauguuuuaaaguuuuuguuguuuccuuuauaaacauaguacuagaaaacuuaggacuggaucgcuuaaaauuaaacgcuaacuaaaaagguuacuaagugaaaagcucuuuuuuuuuuuuaaagauguauuuauuuauucuauguaaguacacuguagcugccuucagacaccccagaagagggcauccgaucucauuauggauggucgugagccaccaugucguugcugggauuugaacucaggaccuccggaagaguacucaaugcucuuaaccacugagccaacucuccaacuccugcucuaucuuucuugaaagcagaauagaaucugaaauaaaaagggaacuugaaguucuguaggaguucaaagugauuuuacuuuuugaaaaucaagucuauucaaagaggacaauuuuauugaguuuaaaagaaaaacacuagggcagggaggcuguaaaucucaccaguuguuuagaggagaggaauggagaagagaauggagaggucagccacauaguggacaagcagccacacugaggacggacgggagggagcuuuagaaagaauaagagaacacacaguaccagaagaugcauacuuuaaaacucuggcuaguaucagaaaggaacaaaaagaaguaaagagaaauuguuauggcuuuuugagucugagugguggacagacccagcccagccucacaguggcucauaaggaaugccucaaagugucuuuuaauauggcaaugauaauuccuauagacaagagagaaaauuagauuuuuagcuuuuuauguuuguuuuauuucuucuuuuuagauccauuugguggugacccuuucaaaggcucagauccuuuugcgucugauugcuucuuuaagcagacuucuacugauccuuuuaccacuucaaguacggacccuuucagugcauccagcaacagcaguaauacaucggugaguggcaggauucaagacuauucagcugcauguacaaguguuuaaggaaauguauugaauauauagcaguggaagcuucccuuagcuuacuuuaaugguccacauuuuaaugguuucauacuuugaucauccacuggagaggaguagaugauuuauagugucucaggaugaaguuguccuuaccccauuggugaugugugugacugaaaguccaaaagccagucuuaaguaaaacuuuuuauaaauaucuguuguauuaguuuuaaaaauggaaauuacuuaaagggagacauuaaauucuucucuuuuuuuuuaagauuauuuauuuuauuuguauggguacacugucacugucuucagacacaccagaagagggcaccagaucccguuacagauggugguaagccaccaugagguugcugggaauugaacuaaggacuucuggaagagcagugcucuuaacugcugagccuucucuccagcccaaagggagacauuaauauuuuagaaaaauaaaaucauucauguuguuuauaguuacaccuggaauguuaaucuugaaaaguauaaauuugcacugaaugucaggcucugcuuaacagccacagacggugauccaaagcccucagugcuauacagccauggcuccaaucuucauuuucaacuuugcaaggcagauguugauaccucagcuuuaaaaauaaagauauuuuagauucaaagcauugacucuacugaaugcagugguaaaaagguauaaccccagcacuggagaaguggaagcaaaggauucaaagccaaucuuggcugcauaguuaguuugagaauaucuuaggcuacauggcauccuggcuggagagaugacucagcaguuaaacauauguauuucucuuccagaaagacccaaguucaguuuccaacacccaugucaggcaacacccauauucacaacugccuguaacuccaacuccagaggauacauugccuuuaacgucugagguacugacacacaugagacaugcacuuauguacacaugaucaaaaauaaaucuuuaaaaagaaaucucauuacuuuaauaugcccaagacauuuguuucugagacuuuuuaaaacuauuuauauaggggcuacggagauggcucagcagauaacagacuuggguucaguucccagcacccacccgcagaucacagcugucuguaacuccaguuccaggggaucugacaccaucaccagcccuccacaggcaccaggcauguggcuguggcaugugagacagacagauagauacacacacacacacacacacacacacacacacacacacacacagacacaaacaagagcacauagauauauauacauguagcucaaacacucacauaaaauaaaaauaaauguauacucuggauauuuuaaaauaaucaaaauagaauaauacuauaaaauauucagcuuguuuuuguuuggaguuuggcagcauuauuucugugguaaacuagaccaagaaaggcacaauuaacugacagggauuuuacacagcuauuuugucaucuguuaaucuuaagugaagauuaccuccuuagaagaguaauugguuugguuuagguuggguuggguuggguuggguuuuuuuuuuuuuuuuuuuuuuguauucuuaaauuaucuccuuacuguauucauuaauaagaguuacuugcccagcaggugguauuuuccacugauguaaauuuugaggaacaccucuauaacugaauauuuguggucuccgcaagacuaucgcaccuaguuuauaauguagaccauaugccagauuccucuaaaauauggcagucugaauucuccuccuucuucauguuaacucuauuccccacugcucucugcccuuccuaacuuaaaauaacauaugucuccuguuugucuccugccugggauguuucacccacugcucucugcccuuccuaauuuaaaauaacauaugucuccugucugucucccugccugggauguuucacccacuugugcuuacuuuuuaucuugugcuuuucagaacaaauaccaccuugcuuucaucucauaguuucucuguuaaaauagaagguugccgccgauauaauagucaucacaccuaucucuuccuuucugugucccuggaugguccuaacucaguggcagagugcuugguuaggaugugugagcucuagguucaauuccaguacuaccaaaaagugacucugcaaaacgaaggguuggaauugugguuggagaaagacacaugaagccuauugaauguuggugacuggauguucacauaaaguuaacuuguuaaauuauacauaugccacauacuuuuuagauaaauauuuuguaaucagagaauaauuguuuccauucauugagacuauaucaggaaaggaaaaacucuguucuaaauguuuguuuucuaauucagaacuuuguaaagccuucuuuuagguucgacagcgcaguuccaccuaugaaauauugccucucagucauagauuguacuguucucuuagguagaaacuuggaagcacaaugacccauuugcuccugguggaacaguuguugcugcagcgagugauucagguaaagacaguucucaguguccuuaguauuaaucaucgccuuuucaucaagguuuugcccuucuguaaacauuuugcccuuauaauaugccuuuuaaauugacauauaauuauaaucacuuaaaacauacuaauaauagcaauaaauauuuguguaucaccuuuuacucccuuacucauuaucucguuuaucauucuccuuaaagggguuucuaugcuauguacuguguucagugucaguaaaaccagcuaaaagcuuugcuguauccaguguaguuuuuggcuagaaaggugguucaguggguaagaaccccacugcagugcaagcaucaggccugagucuugaaccccagcauucacauauaaagcuagauauggcugcacuucccuaacugcagcacuggggagcaacaugugugucuuuauaccacuucagaaugggcucuucacucagggccucagcuuuauaaaaaagcaccacuauucucuggaaggcuuucaugaagugaauguugucauagcaauacuccugggucuccaguagcagagucagcucagacugaccuuuagcagugaaggcagcaaggagagggcugcauugcuucaagugcuugauggcuuguucugcuacaagcuccucuuuuuuguuccacuccacggugcucaucacacuggaccagacucuccaucccaaucaccacugguucuggaauguuacuuuuuucaucuccuccuugacauauaaaauuauguccuugaauggguccccgugggacaucugcuccugcagcuccuuccagagcuccuuccgagccccaauggucugcugguugcggacauacucggaaagcuccuucaagcccgccucagugaaauacuuagugaaaugcccaucacucuguuuacuggcagggaacagcuccaucaguuuguuguccaugcugacucuccgaagacuugcagcaacugcauugaugucuuuucauuuauccaugauuuaaagagcuuuacagcaaaagcugcugaaacccuuuuuuuaaccaaauucucauuauaaaggcuguuaagaauggaugcauuaaggguuccauuagccagaaggaccccagucaacauggcgagcuuguucuucuccggcucugaaaaucccuuuaggaagagcaguaacuuuuuaacuucaucuucaaaaccuuucucuggguaucuguagcgccugguuagcuuguuaaaagccugggugaaugcuugcauggucucuaggucuucuugugcugcacacacacagacaucugugcgcaucaugucaucugccaguguaccaccuggggccagcauuccgccagccaccaggaugucaaagaguguuucugcaaagcggugguagucaaguuuugcuccagaagcgucaagaaacuugcuacugcuuccaaaucagugccaguuucagugaagccuugaauaauacagucuugaaacugaguagggccaaaccucucuuuuucgucucuuuuucugguuuuaaaacgcuggccugauagcguuggguuuugcugcuuuugauuauucauaaaagacacccgaauuuaaggcgaagagaaaagagccagaaauccccgagcuggcggcaacugcggagcugucuccucugccgaucaauggaaucguaaccauuuuuggcucaacaauuguuucauugucacucuucauuaagagugagacagaugacuaggcuagcuacggcuugggagcacaagaaacaagcggaaaguaaaucagaccugagugcuuugauggaagguggcuagucgggugugcugcuuuccuaggaucauguggcaagggaaggaggcuaugauagagagagguuagugugaauggaucugggggugagauacuaacucccagcgugaguagcaagagugagugauaaagcaaauuggagcaaacaaguuacuuuaaugccaguauugaucacauuuagaauugugggcuuucaaaaucaguuuuuaaaaugaguauacacacacacacacacacacacacacacacacacacacacacaauagauuuaguuaaaccauugcacucuuaccacuaaauuauaguugcugugauaguaauacaaguacacgaggugcugaguucuccucagcacuugcuuacuccugguggauagacacuucaaacucugaaagaaagcuaggaugaagaagccagcucaggauacuuguaagcauuuuuuuucuacuuuagaugagauuaguugugaugcgagggugugugugucugugucugggugucucucuguguguaguauauuuuacuaacccuagacucaggaaauagucauuucaggugcugauuaaagcucaauaaggugcaaaugugucuuugcagaugcaucuuauucagggcuaucucuugaagauggugugagguugaguuuaaaucuuacauuuaguggguauaggggugagaaagauuucuucaucuuaggauucuuagguaaacagcuacucuuugggggaauacuuucuuuaauguuuuaaaauuauguauguguguauagguaugugcaugugaguguagauacccauggaggccagaggacagcauuggaugcccuggggcuggaguuacaggcaguugugagcugcccacuguaggugcugggaacccuacaagagcagucuguacucuuauccaccaagcagucccuacagcagucuuuuggggaauuuuuauuuguuccuuucuuccuuauuggucaacugauuaugcuaggaacuguuacaucuauuuggaggcuccuuaauaagcaugugucuucuguccccuauuuucacaauacuuucaauaaauagcagcaccuccuacucaccagaccucgugcucaucauugaggagaaaguaaggaaugaaaccaaguuccuggccucauagggcuucuauugucaggcgggagcagauauaggucgggugcugauaagaacuagaguuaguucagcugagaaggggauaaaaaguuauauaccugcaauauuguuuuuaccuuuacagaaaaucauaacagaaaaaaaagacugcugaaguuauaaacuauucacaucuauaauaagauuauagaugauuuuauauuaugcuuuuauacacuuuccccaauauauuaccuuuauuuuggggaagagagggugcuggugaguucauauuuacauugaaagccugaucugcuacucauggcuucugugcugccugccagcuugccuccagcaugugucucacaugcucugacagaauccuuucagauucauaucaaucaacaucugaggcaguucuugucaaagucuuaauucucugauuuggaaaaaauucugucaucuaggguacguuucuuuacuaucuuguagaaaaauucuagcaauuacauauucgucauguagaaauaacuuuuuuucaauuaauauuuuucaaauuauacuuuccaguauuuuaguucuggccuaacucagcuguguugcugcaguguuguaacucccuguaaagucugugagggaagagacggagggcauggugcagcauagucaguuccugcaggaaaaggugucggggcauuuccuuuggcuaccuuugugcacuaucaaaagaauggaucaggaguaacugaagaggaaagggaguggcugacacugcagcaugguggaugcagcccccaguuuggggcuccccagaugcuauacuagugugaagaagcaucuucugcaguuaaacuugcaguuuccugugauggacguuucaguguccucuucacaaucagacuugugaccaaccuggaaagggcugucuuuacccaugucuacuucacucucaaugcccuacuuccucgguagcaaagcagacaacagugaggugcuguggggcuggacagauggcucagcuaucaggaacacugcugcucugcagaggaccagguucaguuuccagaacccacauggcaguucacaaccaccuguaacugcaguaccuucugcuuucacagauaccaggcacacauguaguaugaacacacuuaugcacgcaauguacacacacauauaugaaaaaauaauaagugucuuuaaaaaaaaaagaauuaaggucccugucuuuucggcauaugucauuccacagcucacgcccauucacaggggcgaacucacucuguagacuaggcuggccucaaacucacagagaucugccugcccugccuaccuaguccugagauuaaaggugugugccaccacacuuggccgauucuuuuuuuuuuuuaauuuuaaauaugucccagguacaaaucuguccuggaaacuuuagcagaugugccuucugucccucaauauacgcaaauuuagaucugccuaugaccguuagcuuuauggggggauauauaacaaguucaaacuacuugugacacaaacuacuuacuaauuacagauaacuauagaauauaguuauugcuauagagaaugaagaacuugguucuugucgaaauuagugacgucuggguuagucuaaaguuugugaaaagagacuugaaugauguaugauaugugagugauggcccuguaaaccacuugauaucccuuuuagagauaauuuggucaaggacauugucaaaugacugugauccuggcacuugaaagacuggcagacagcaaagucauaugcuguacuucccuugaaacaaacaaccaaaaaauguacuuuguagagcugucuuguuucacauguguuccagaacucuauaccugaccuuccaguagcaccugguuguuaucuugagccauuuaccagcugauucauacuaaggaauacacuauaugggauguucaguguauagccaaucuguauagacaucagucagauuuaggagugauuuuucugaauguuaccacauaaaaaauaacaugaaauauugugucuuucuuuacucccagccacagacccuuuugcuucuguuuucggaaaugaaucauuuggagauggauuugcugacuucagcacauuaucaaagguaaucugcaaagauuaauaggaaggagcaaugcaccauguuccaucaaaugagcagaccuccuuaccauuagaauucuuucacaaucaugauauuugauugcagucaguccauagcagguguugauuucauguggaaguuacagaucagcuauaaucaaucacaucucuacacuaagcagacagcaguacaggugauuacauuuucuuccagaaggucuguuccgugugauaaucagaguugucuguuuaaguuucuuucccaguugaauuacguuucucccuguguacucucuggguuaguagcuauaacuuugauuccauucuauguauacuaccuauuugauuuuauccauugacauuguuggagucugcaccaacauaaaaguguauaaacucuggcacugagcguccacuaccuauuguccaguauagcuguaguguugacuuagguuaagagaaaaagguuugagagaauuugaagauaagccaaauugucuuccucuaaggaacauuugacaguguccagagacauuuaugguucucaaaacuagguggaagaugcuguucauacuuagugaguacauccuccacagagccaccgccucagcccugaauguagugcuuacaucccaaaaaguuagcagugccacuauugaaaaaugccggccuggcuagguggggguggcccacacuugcacucccagcauugggaggcagaggcagguggaucuuugugaguugaggccauccuggucuacagaguggaauuccagaauagccagggauauacaaagaaauugucuuaaaaaaagagcaggaagggagggggaacaaggggagaaacacugaucuaaauaaaucauacucuaguuugugauagaaaagucagucuuucauuacccauauuaagauuuaauauuucacugggaucaguuugcuuuuugaaaacaacuuuuggguugucuucauaguuuuucaagaagccaucucuuuaagauugucuuuccuaaaccgggcgugguggcgcauaccuuuaaucucagcacucagcagaggccgguagauuuuugaguucaaggccagccuggucuauaaagugaguuccaggacagccagggcuacacagagaaacccugucuugaaaaaccaaaaaaaaaaaaaaaaaaaaaaagauugucuuuccuauauuuaugggcacugacaagcauagaguuagacauucuuuuuuguuccauuaucaaaugguccauuuggaccucaggagguuuuguauucccuaacgcuuucuuaguaagccuuccauguagagucggcuuguuuugaggucuauugcucuugauaaguaaugaugugggagaaccaacgcggacagaccaagcuuuaauccuguuuguucuugaauguaaagguuagagugucacuucuaaggauugaaauaaaacuucauuauacuuaaaugauucuucugaguacuuuugaccauguguauaccauacuauacaaacauuucuuuuuaaacaaaggucaacaaugaagaugcuuuuaauccuaccauaucaaguucuaccagcagugugaccauugcaaaaccuauguuagaggaaacagccagcaagagugaagaugugccuccagcacugccgcccaaaguuggcacuccaacaagaccuugcccgccacccccugguaugcaagcuggagacuuuccuagauaauguuaugauuuuucucucucuagaacguguugugugggucauacuuccaucaugauguaucauauaaaaggcugcaagcaagagccaggcacuuagcagcagcuugcugauguccucuuggcugggcaugugccccuuccuguccccauuucagaagaagaaugggugaaaucucuuugguuuuguuuugucuugguuuuuggaaacccaaugauuaucauuugaauaggaguuuccuguacucugguuuuuaaauuaauauucuugagagaaaacuaacuugaagucucccuaaaucuuuaauuuuuuauuuuuauuuggaaaaaaaggcagggaaggaggaaaaacugcuugcucuuuaaaauuccuuuauaauagauguuuuguuuugagacaggaucuaaugaaauagccuuggcuggccuggaacuugcuauguagaccaggcuagccuugaacucaagacucuugaagaccaccugccucugccuccucugagugcuggguuuaaagguguauaccaucauaccaggcuuuaaaaaucugauuuaaaaauucuuuguagucuaggaacaaauuguuauauuuuaaacuguuuuuuuguuuguuuguuugagucuuuguuauguuuagcacuacccuaaggaaagguuuguuuuuaaugcaaaauaaaguagcugugaagguagcuucccugagugugggcagugcugccacgcugcucugugagaagacacaguguugaugggcacucuggguuuuuaucccuagaccuuuccuggguaacauuucagcccccaaaguucacugaccacugucuuauuacuguuaaucauucuugccuuuucauaauaguuuucccaugguauuugauucuggauauuacauauaguugcuaguguauaaaugucugcucaaaacuuaaugaguuaagcaguuuuuucuuuuaucuuuuaaggaaacucacguauaucauagguuagaaguugguuagagucuauauaauuugcaaagcuaauauuuugcuuacuuacauuuuuacacccaugugaguauacuuugaaaacucaaaugcccuaauuuagugucuuacagcugaaaacaaggguaugagguggcuuaauaggggacauguacuugcucaugagccuggugaccuacagucagaucccagaacccguguacaggcucaggggcaguacaugugcugugcauacguacacugugcacauacguccucacacacacacaucaacacaacauacacauaauaauaaagcuggaaacauucacguguacaucauuguaaaggagcaaagggaaaggaugguuuguugaaaagaucauugauuagggaucuuaaauucauauucuggucagccccagucucaguuugugaacugcagugucacagaugcucagcaagcacucucuccacugagcgacauuuccagcccucuugguuuuggauagugcuccauguagcuuaaccuggccucagaccaaauuccucauauuccuacuuccuacccacaucucccaaaugcuagcauuaaccccaggcuugauuuuguuuuccuuuguuuggggguuuguuuguuuggauuuuuaguagugcuagagaucaaaccuggggcuucauaggcuauaacuagagccauuacucugugaucuuaauguauaauuccccaugucugagccucagugccuuaguuguuaugugguagcuuuaacucaggguuugcaugcuuucacggggcuuucugaaggcauguguaguuaugagauacaagcaucuuguguaaacauugaugaaaagaauccauuaugacuaucagcauaacugggauaacuaggaaaagcauauuugaagaaacuuaaacuucaccucuuuucuuaaaaaaguauugcacuuuaaguaaaacuuuaaaaauuuaagaacuuagcugggcaugguggcacacgcuauuagucccagcacucaugaggcaaaggcagguggauuucuugaguuugaggccagugugcucuacagagugaguuugggacagucagggcuacacaaagaagcccuaucuuaaaaagcaaaugaaugaaugaauaagaugaauaaaugaauaaaauaauuugcuugaaaaugguaucgaaacaaugggugauggauuagcagggcagcauacuguuauuuggucaaagauaaguuuucagcagcuaugcauauaggcuguggacuucugaguguugaucauucucagcuugaaguuuuauagauggcaaaaauaagugaggucaaauuaaucuugugcuuuaugcuacugggcacuguguaaauauaccagagaaaagagauuugccaaauugcagucacugacucuuacugcagcuaguuucaggcuaaagcugccacuagaggccauuucugugcauucauuaucauuuuucucguuucuuuaaauggaggaagaccuaauuuuuggacaaaauuuugauucuuggccuguuuccucuuuguauuugguuuuuguccaucuagcugcaccugccauguacuugagagaagugaaagcucugaggacagcuggugcagccagugaaggccuuugagaaagugccguaggcuuuugcucuguacaccaccugcaguucuuuaaaugcuuccugugaacaugugcuugugugcuuguguuugcuguaucuacugguuaauuguaaugauuuugauccagggaaaagacccaucaacaaauuggauucuucugauccccuuaaacugaaugauccauuucagccuuucccaggcaaugauagucccaaagaaaaagauccugauauguuuugugauccauucacuucuucuaccacuaccaauaaagaggcugacccaagcaauuuugcuaacuucagugcuguaaguacugugacugggcuguuuggggaaaaucuuuucauuuauaguuugaagaguuucaaggauuucuucauagucuuccaaauuuucaucauuuuaucaauauacuaaaaauuaucuuuuauccuucccccaagcaaaaccucuguuuuguuuuguuuuguuuugcugguucuuagaugacuucauuacuuagcugauuuuagucauugugguucuugcaaacaagauguuuuauauagccuuucucucagucuugaugaaucaaauauaaguaaaaucuugacugcuacuauuuggcaaauguaugauggugauuuaaaagcuugcugucugccuacucuguauaaugccaguaagaagcuuguauauuuguagcuguggauguauguuuguguacaaagauuugguaguuucuagagaccaguugacacuuggcgugaggggacagugcagggguucuuugaauacaaaacaggucuuuacucggugcauucgcauaguaguucugaugguguggugguucuuuuuauccaucugugaacccaguuacucauucaugauaagcuugugcucuaccauggcagccuuuucaguuuuaugaaauaaacuuaagauguaagaauucuuucagaaacuuaaagaagcacugugagaauaggcuggacaaguccuuuguccuauuagaaguggaguaacccauugugaggcaucauauauaucaucauuuauuaaaaaugaaauucuuauaauagauaucaagaguuuugguuuuuuguuuuguuuuguuuuguuuuguuuuggcaaagugacauucauuacuacugcccauucuauaagaggaguuuuuguguuuaucaccuuuuauccuugacuuuggagaugagcaaugccccugaccguggcgagucccauuuggguccucucacucauuuuuuauccccauuacugcucuggcuacuuggaagagaggagggcagggagcuagcuguaugugaggagcugcagcgcccaccugugggucugugcucagagugugaaggagcaagauagcgaucccuguugaaugacaacucagcauuaucuucagaguccaugucagauggaaugugaauuguuucgagcagagaaggagaauuggcuuucuuaggagauuguaauucucggucuaaaauaacugucuggcaguuuguaacagucaguguguuaaauauggaucugcaaguaaaaccugguuggaaugacucuugaacaguaguggaggcauuuugcuuacuuuauacuugaaucucaguacaguacagcauaguagcucacaauaaaguccuccauuuucacugggagagguuugauaagcacaccaagagugacagguacacugucaaagccuuccaguuuguuucaccucuuuugaugggucuucucuugacaagacucaagccaaguagaauuuuguaucuaguaucuacugaaguugaaauuugguuguaguuacaaauauuuuuuccaaucuaauuaaucaucaguauucagguuuuacuuaagcugggucauuuuaguuauauaaaacuggguuaaaaguuccuaaggacuaucagaaacuauguuuguuaaaaaaauaauaauaauuagguucacauucuguaucuaacguucuucuauguagcaaaauuugucuguuuuugcuuuauacuuuugggguuuccugagaggccagguaaagcggcuaucaccaguggcauuaauuuuaaugauaugucaaucaggcaugcugccauaugguuguaaucccacaaccuaggacacaggcagcaggaucaugaguuugaggccaacauaagccaccuagugauaguccaucucaaauaaaauaaaauaaaauaaaauaaaauaaaauaaaauaaaauaaauccagaagggaggauuuuauggugaagugaaagauuagaccacuccuguuuuuaaauauccuauucuauccuaagcauuuaaccuguuuagagaaaauaucacugugucccagauuggcuuccuucuuccucaguccccuauguucugggacugcaagcauaugccaccaugccuggaauugcuacuuuuuaaggugaugauuuuaauggcguacuuuauaggccuuauuauauuuuuauagacuuauuuucccauagauuguguuaaaauuuuaaaguaaaccagagcucaguaaguaguuaaaauacauuuucagaaaaacaaggaauuaguacuauuccuuuagguaaaacaaguaguuagcacucuuuuauaaaaggucuuuuguaugucuuagcuuauuuuuuaauuccuucauucuuuggaucuuuuaaauggcaguaucccucugaagaagauaugauugaaugggcaaaaagggaaagugagcgggaagaagaacagaggcuugccagacuaaaucagcaggagcaagaagacuuggaacuggccauugcacuuagcaaaucugagaucucagaagcaugaagaguuaucuguccuuugucagcaguacagugcucucuggaacacugaagcuauuuaccaugugcaucaaacuaccuaugagcaugggauacaaaagguuugagauuccuagaaaugugacaaaagucuaguuuguuuuuuuuuuuuuuuuugggggggggugcuauuucaaaugugucuuuuauuuuuucuuccaaaagcaguacccuaauuaaacggcuuugccuagaccccuguucuggugugcauuuauagugagcucuugccugcuugcacuagccccuguaaagcuagagcaucaagccucugccuucuggaaccuagcagauguaguuuugcgcugugcuacccuuguccuguaguuacuaugacaacgacuggaguucugaaagugugcaaguauucucccugagcugagugcuugaaggagggggagggaaagaguauccuguuucuucugaucgguacaaauuagucaguuuaaagugcauuauauguacuucuggagaaaauauaguuaaguuacuuagagacaggggaaaauauucugcauagaucuacuccacuauugaaaacuggauaaguuaaaccauuauugcuccagccgcaaguaauuccuaaauaaaaguauuaaagccuuguauaugaaacauguuuuuagaacaauuuucucuggacuuaaagaauuuuacgauuaacagauaccucacgacauguuuccuaguuaaaaacaaacaaaccaauuucuuacaaauaaaauuuguaaggauauguucauuuuaagugcuagugaggaaaauuuguaacuuaaaauauaaccuauccguuuaagcaaacacuuagccuguacccauuuugccuuuguggcugcacugaccguaguucauaagugaccugaagucuaggaagcuagaauuggaagguacuuugguauucauuauguguuuuguuucuuuagugaaggcccagcuauuugcagugauacaaauggaagaaauaacauuuguuauauccucuuacuuucuguccaucuuuguaguuuaaauuucuuuauuugcuuuauuugucucaccaauaaaauugacaagcuaccccacccccaaaaaaauccuaguuuuuaaauugagagaaaaauaaaccaaguugccaaauuaucagagcccuacuuuuguuaaaagcccaucuucugcugaacuggccugacagacagcuggauuuuaaauggauuugaaguaaacuauaauuuguaauuuuuuagauaagaguuacuaauuuaguguuuguaauaccaagauaaacaaaaaugcaccuacaaacuauuuaaaauucuuuaggauagccaaguuaaggugguauugaacuguuguuagaguaauuuacugccuggccuauaaguaaauucuagugucuaaucagaccauuuugaaauggugcuuuuuuuucuuuuccacauacuauuggauagcugggauuuaaaacaaacuucaaccacuuucuugcacugcuaacuuuuuucuacuuuuguaaauaaauauuucagcauaaaaguuaaaacaugaaguaagggcugaaucguaaucacaaggcuuuaauugugauaacuaauuccguggccuaagugcuugcugcaaagggugaugagcaggucagguugggugguguuccuguuugccccuuccucucacuccucaggagaaagguaaguugacuugaauaaccuucguuugcacugagaaaagugaaaaauguuugaaaugcuuuaauuuuuuuuaauaaaaaacacucuggaaauauuaaauaucuauaacuuauaaacagcaacuuuugauguguaguaagugugcccuaaucuucugugcgcuuagcugggucauagagguucuuauccuuuguuaagaugugugugcucagugggccaauaucauacuaaaguauguaauaugacauaaacauaucuauaucuccaugcuugaguguauagaaugaaugucuuaagagccauuugugauguuuuaugguguugacccuggcuccaaagccugcgcuugaaacaaagacagaguuuuaaccaucuuccuuuuauguacuuguucagcuuuaucugugcucucuucauagauguucucucauguuucaaacuuauaaauuacuguuguaauuaugaagauaauaaacuuuaauaaguaaaaauguguacuauaucauuuugcauugaaacuuugugcuguucuugaucgugugcauaugguaggaggagggcaaguugccaucagcauacauuauccuguauaaaggguucuuacaguacuauagagacuuaaauaaauguugaaugcuaauucuauaaacaaac

SEQ ID NO: 2030 - RNA, 1382 nt, Mus musculus
ucucugcccgcgcugggccuggguucgcuggcgcucccgccugcccucucgcuucgcuagucuccccugccgaagcgggguggguucggcccggccuggccugcuguucuggggcuggcuggagugggagccucuaccgugcgggaccccgguggugguaacuaaggccgcgggugcgggcggaggcccuuagaggcucggcggcccugcagcugacggguaggaucuccucugcuggagccgggcagcuccacccuccucggcgcuccccgaccaggcucgccgaguucgaguggccuggcccggggcugcuggacuccuuugcucugccacaggccuuggcaccugucaggucauugccagggcugcagaggcgacacaacugacagcaccacagggcagagaagucuuguagaccgaguuuuaugagaacugaaagcauauuacaagaaaucccgacgaacuucagggucuagaaaaugugaacuucuagucuugagggaaaaggagaaaugcaauuaacuuuaaacaaagcuuacagugaguuagaaagguuuucuaaaaaggcuaugucuuuauugggggauuucuuucacucacuacaccgaggauugguuguuuuuagguggaggugaggaugguggucuaaguguaaaaggaccagugcauccauauauuucauauucaucaauuuucuguacuuuucacgucuucuuguaggcauaugagauuauugccuucuauacuuuuaugcuuuuaaaaaaacaccagcaugguugcauucaguggucaaaaugaaaccaaacccccccuccgccuccccucccccccaaauauuggucuaauuagaaccagccacugcacauauauccucaaguaacaucuguaacccaguuccuuggaguaaagugaaaguauucaaacaagccagagacaucuggauagucauuuagcaacagguuggcuguuagggaaaauuggaacuacaagaauuuggcaguguuucuuuaaguuguuaagaaaaagauuagagcuaauuuuugagguaucgaaagcugaauauugugaaucagguaacaacaaaggggaugaacuucuuuaaaaaucauuuuaacagaauauuuaggauuccauguauacuguauuccauguauacauucugggaacucugaguuuuuaguuaucuggaagcuaugauaggagauuggcacuguuaaagugauaacuagcacuaauacaaauuuacaaacacugcuuucuggaaauuaauggugucuugcuuggagaaaauaugguaacgaggaagaauaaaauugugggcauucuguauaaaaauggauguacauguguuaugacuuucaucaaauaaaauaucuuugcug

SEQ ID NO: 2031 - RNA, 1009 nt, Mus musculus
cauucuuuucucuuggaccagagugucuggugguaaguggacuuacagcccugugccuccaggaccugucuaggaggugauaaguacuuaaccuuucaaaaagaggaccaugugguguugaucuauuccaaaucuuuuggcccuuuauucuaguaagccuacuuucuagagguauuuauuaaaaaggaaucagucaccaggcugagauacacugacagcuuguccagggaucuuggacaagucacuuugauucaugcuagguucauuuuuaggcuaaaggagaggaaacauaggucccuggaaaaaguaggaaaagugucaaaaccaugaaaucuuugcaaugucuucauucagcuccuaaucuccggguugucuuccagguggaaggugacagucucugccuacucaaucaaaggcagcacucuuaccagcagcagcuacaucucugcucuccagccuugaagugguaacuuccuuuuccccacuuggugugcacccaagccuucuacaaguggaucagaaagaaggccaaauguuucugcuugaagaggaaccuaugucucagcgugauacagcauaguacaggaggccgaaaggcuuguccuguuaacaaacugaaucuaucuuuacccauuaaccaagagaccaccugccugccugucagccugucuccuuucccucuuccccacccccaggugugaucagaguuaggaggucaggcccucaccugaacuagaaacuguuuguaccaucuuucucucaaggagccuucugggagaugcauaaagugggguggagaugaggcuaccuaaggcccuucaccuccucaccugugccccuugggcaguacacugagguuuggucuccuuguccuaaugauggcccagauggaacagugucagagauuccuucugugaaaaagggcccccaucaaaaggaccuaacacugcuucuugcuccaaggagacgccaagggccuuaaagggagagagggagguacaguuuucga

SEQ ID NO: 2032 - RNA, 708 nt, Mus musculus
cuugcuguagaaacuaucucggaagaguuggcagccuuuuuaaauacuuggcuuuaugacauagugaucuauugaucaaaggcaguuuucauagaaacuaccauggguguagauauaggaaaggaaauuauggaagucauuuuguuaagaguauacacagccaguuacguuuuaguaguuaaaacuaggggcauuaaggcauggacauguuuggacauugaguugguagcagaugccaugauguuugaaacgucauuaagaaaauguacauaagucaaaaaauuuagugaagaaagauaccuugagauuggguauaaucagagauggguauguaaaaaacaacuuaagcaugaguuuaggaauuuagcugugccuggaagucaacaauguauaaagaacaaggagagagaaggacagggaccgaugcaacauaggggucaaugaccgacauauccuggaagaaauagguugaggaaaagaaauuuuugugaaagacagcagaugcaguggaucuguacagaggagaaauucugugguuaacagagcugauuaaagcugauccaaauucuaagugcuacaugaauguuuuaggaagccucaaagaaccuuugugguucuagaaugacucacuuaugagagucagcgugaugucauagagguggaugaaggggagaagaggccugccauacccacuggagcuacugacca

SEQ ID NO: 2033 - RNA, 1351 nt, Mus musculus
aauauugaacucgaguuggaagaggcgaguccggucucaaaauggagggccaugauccaaaggaaccagagcagcugaggaagcuauuuauugguggucugagcuuugaaaccacagaugauagcuuaagagaacauuuugagaaauggggcacacuuacagacugugugguaaugagagauccccaaacaaaacguuccagaggcuuugguuuugugaccuacucuuguguugaagagguggaugcugcaaugugugcucggccacacaagguugaugggcguguguggaaccaaagagagcuguuucuagagaggauucuguaaagccuggggcccauuuaacggugaagaaaauuuuuguuggugguauuaaagaggauacggaagaauauaaccugagagacuacuuugaaaaguauggcaagauugaaaccauagagguuauggaagacaggcagagugggaaaaagagaggauuugcuuuuguaacuuuugaugaucaugacacaguugauaaaauuguuguucagaaauaccacacuauuaaugggcauaauugugaagugaaaaaggcccuuucuaaacaagagaugcagucugcuggaucacagagaggucguggagguggaucuggcaacuuuaugggucguggaggaaacuuuggaggugguggaggaaacuuuggucguggaggaaacuuugguggaagagguggcuauggugguggaggugguggcagcagagguaguuauggagguggugaugguggauauaauggauuuggaggugaugguggcaacuaugguggugguccugguuacaguaguagaggagguuauggaggugguggaccaggauauggaagggugguggauauggugguggaggaggaggcuaugaugguuacaaugaaggaggaaauuuugguggagguaacuaugguggugguggaaacuauaaugacuuuggaaauuauaguggacagcaacaaucaaauuauggacccaugaaggggggcaguuuugguggaagaagcucagacagucccuauggugguggcuauggaucuggagguggaagugguggauaugguagcagaagguuuuaaaauaaaacagaaagggcuacaguucuuagcaggagagagagcgaggaguugucaggaaagcugcagguuacuuugagacagucgucccaaaugcauuagaggaacuguaaaaaucugccacagaaggaacgaugauccauagucagaaaaguuacugcagcuuaaacaggaaacccuucuuguucaggacugucauagccacaguuugcaaaaagugcagcuauugauuaaugcaauguag

SEQ ID NO: 2034 - RNA, 27908 nt, Mus musculus
ugucacggcggccggcagcuggcggcggggccccggcgcccgcucugcccgcccccucccugccgccccgcccgcgccgccgcgccggccgcugucagaagcgcguuguaugcugagcagcugucgucggcugcucccgcacguccuggucccgagcugcccgccgcugacccgcacacugcggcucuucccucuccaccucaugaagccguuggucguguucguuuugggcgggcccggugcgggcaaggggacccagugcgcgcgcauugucgaggugaggccgugcgggagggcgacggagagcucccgggcugagcggagcgggccggggccggagggagcagccgcguuggcggccgcgccccucgcuguggggagcggacuacgagucccgacggccaccgcgcgcccgggccgaggggcgucgagucuacgagugcuuuguuuccgcgcgcccuugcuuccacuccugggauccgggucuucucgcuacaucucuggcugucagucuccggcuaaccggccucgaggaacccgacccggaucuugugguaguuaaagugccggauuugugagagcccaggcgcuaaccuuuggcccagcugacaacucacgcccuuuuccuugggcgagugagucacucacucucagugaaccucaguugucuaagcaaauaaaaaacucugcucuccgagaaaguaaaacaccacccaacuauaaaauccucuuaucauuuuuuaaauaauguuugcuuuaggacugcagagauggcugaacggguaagggcgccuaccaccacguuccaucccugagacccacagagaaccacaaccccacucccgcgaguuguccuaugauguucacucuagagcucaaggguuugcccacacaaauaacuaaauacaauuaaaguuuugacauaaguuuaccaguuccauucuuuuaguauuugaggucagggguggcauguacacggagagaggcaaagacuuuaaacucaagcagguauggguucuagcccguguuagcuguagugauggacugucuuguuuuuucuagccccuaugagcuguaaugaugcggugaggaaggcuuaauggacugucuugggcaguguuuuaaaggaaaacaagacaaucagaaagaaauggcaggguuggggaaaaacacccaacauucaccuuuaaauugagugcuugauaaaagguuuugacccagaacuugauaauuucuucuuuuccuauaagccguggccuauauuugcuuuguauuuuuuuccacguucauauauucagcuccugcccuauagucuauucucuaaagaacaaccacagauaaauaaaguaauguggucuaaaaguuguguguuuuacaguuaugucuagaauuacagauaacuuuggaaaaucaguuuaaucacaaagcacauagaauuuuucuccuuauuuuuacuucuguuuguuuuaucuauuagaaagccaaaugacaaguggaugguuucaguuuauaaguaaaaugauuaaaauauagauagcaugguaaaggagggagugagucaaaacagguaagcaguucaagaccugacccugcuauuguuuuuccuagccccagagauugcuauuguuuuuccuagccccagagaaguuacuuuuagccuaaguuacuuuguaagaagggagaaaauagaaaugaaaugucuuguuuuguaucugugacugcuaaaugaggucucacaccugcacauagaugcaaauguuuaagcuuccugguuuuauuauauuggucauuuaauuuauuuuuagaaagacaccagguugauuuaauguacugcaaggaacagcagguuggguauaagauaacuaucugcaacuggucauuuuuauuuuaaagguggauuacuuuuuuuuuuuuuuaaagagaguacacugucauucucuucacacaccagaaaugggcauuggaucccauuacagacgguugugagccaccaugugguugcugggaauugaacucaggaccucuggaagagcagucagugcucuuaaccucuaagccaacucuccaaccccuaaaggugcauuacauuuuaaaacuuggcuuaugacuuucauauugagugcauccaaauacuuuucugaacuuauguccuuaaaugucuguacucaaucugauaauucccccauuacuccacuggaugaaaaaugucuguccugagugacugguauuucuacuuggugaaaugauaguugcuaauccuguuaauaccuguuacuuacagaguccuugaugagcaguuacaugagcugaagcugugggcuguuuguuucuguguuuguucauuuuucugguugcacugacaguggaacccagggccccccacacaugaaaggcaugcacucuaugacagagcaucucucuuuguaccguguacuuuaaaauucucaguaaguacucccugcacucacucuaacuaaggcaggccuugaacuugugguucucucgguucaaugucaaaaagcugugauuauaggccugucccaccaagccagcuagaauacauuguuuugaauuguuuguuguugcuuccaguugccauaaacauccaccugauaaucugcuauuucagauguauaauuuaacaaugacuguuccuuagcuggucacauaaacacugggaugucuauagucagguaaguuaggcauuuuuuccccauuuugagucugcauuuuggcucaauauuucauuauguaggcagcugugaacauaauccccaaagacggcaagcuuaaaauuaauuuuuuuccuuuagggaaaauguuauaauauauaacuuaauguuaaauucaucaacugucaucaaagcaaauuugguucacaggguaccugaaaugugguugauuauagaaauguuucuuuggagagagcuuauuuugguguuucaauucaggcugccaaaaguuguguuguguuguuuguuuugagguguagucucuuuauccucacucaggcuggccucaaacuauucuccugccucagccucccaagugcuaggguuggagugugugcugcuaugugcugucagaaguccaccuugguuucagggaugcagaacccuugaaguuaggcaagggagaguguugccgggaagauggaaguuuuucuggagccacacuccacuuuaguaauuguuccauggggagggaaggggagggcauguaagauggagagagagagccuuuuacuguaucuccuacugggaugagaaguuuugagggagcuuuggaaauugacuucacucauucauuuguagugauccuuucaguuuaauuuuauuuucuaauuauuucuaaaucuguguucucuuauacuauuuucuaagucucuaaagauuuuauuugaaguaaggagucaguggaacuauuguauaaugauguauuucuaagauucagggggugcuguaucauuuacaguuucuuuacuuauucuguugugugugcauaaguauauaugcaugugcuuugguccaugucuagagggcagcucuguggaguugguuucccccacucaccuuuaugugagcucagggauggaaaucaggucaucaggccucacuuguuaauuuuuaaaaauuaagcuuuauauuuguuuugaucaaaaauaaauuagagugcuguaaccuaaaguuauuuuugaaaauaguaugcacaauuuuguguggguuaguuggaaagaauacuuacuuucuuuuucauauacugugaacauuuuguuuacguaaguagugaguaaagcuucuauuuauuaucugugucaugacuuccuuaagagccuccuugaaugggugacucacucugugcuuagcaaaguuuuggaugagauugaauuuaggcauauagaaaucaaaccuugauuuuauuuaucuuuuucucuguuguugagcauuguaccuagcacauaguagguuguuguugaauaaaagugaugacagaagacuguaucaugaagcugaauacauuuuaaaaauuuggucucuagggggcacccaaguagcuuucuggaccucacauaugaauaagaccuaucuuugagauguuuuuguuuacucugagagaaugaaugguaaguaugcugagcagaauuuugaaagauuuugauuucaaaauccagaacucgcccuuuguauucagaaggcacuaaagaaaaaucugguagaccuuaaguucuauucuagucuuuuaaggguaggauaugguuaaaggaugauuuuuuuaaaaaaaagacaaauuaaaagcuauaaauagucuuuaaaagaaaugguuuacaaaacccuugcuuuugggagcuagugagauggcuuuauuguuaagagcacuagcuacuuuuccaguggacccacuuagauuuguagcacccacauggugcucacacggucuguaacuucaguuccaggggaucugacuuccccuuuugacuuucacaggccacagacuuucacauggcacacauacauauaugcaggcaaaacacucauaugagguuaaaaagcaacaaaaugugacucuauugaagaaccacuauuucuuuaagagugcuuauuguaagguuuuuuugguuugguuuggugguuuuuguuucuacuuuuuugguuuuuuguuuuuuuuguuuuuguuguuguuguuuuguuuucauuuugguuuuggagacagagauucucuuuguaacuguccuggcuguccuggaauuggcuuuguagaccagacuggccuugaacucacagaggucugccugcuucugccuucugaguugauauuuuagaagaggugagaagagcucuacuauacuuuuucauuuaaaguggaaaaguaacgucugggacaaguucaguuuuuuuuucaucuagagauuaccauuauuuacugcuuuccuaucuguagcuuuaaaaacaaaacacaccaggcuuccuguuuuaauuuuaugugugugaugaacguuugccuuaauaugcuacuuaaaugccugcugcuuuugaggccagaagaaugugucagcucuccuggaacuuuacauacaguugugagcugccgggugggugcugggaccaaacugcacugcucuguaagagcagcaaaugagcugagccaucgauugaaaauauuuaaaauuuuuacaucuaauagguuauucacuuuuccccccaaacuaaauuaaucauguuuauuuagucucuuagggcuuuccuauauacuuaauagauuuuucuuuguagcugcagaguauucuggauauugucauagcauagcugaaccaugucacuugauggcuauuuacaacaguuucuauggguguuuuugcuguuaauugugcuucagugaguuuuuuuugaaaauauaacuuugcauauggauauuuuguuuauuggauucauaaaaguggauugcugccucagaguguuuguacuuuaauugauaauuacuuaugauuacuuggggaaaaauuuugaguuuuccagaggaacacagcuauuaagagcuguaauuaaaccuguaaaacuguuuauacuuggagaacuaucucacacucauaaaggcugagaagccaccugagaggccauauguaaacaggagaaucaaagaagcugguggugucauuuagaguuugaagaucagagaaccuuaaguuuucuaggagagccauuuuucucuuuuuccaccuuuuguucuaaaagucucaucagauuggauggugagaugagaacagcugaucuguuuucuauccugcucuaguuuccuggauuuuaauaacaugugggcaucuucuugcugucaugccccuuuccguuauugacucuauuccuuuaaacugugagcccaaguaaacccuccuuuaaguugcuuuuugucagauauguaggccucgaaaugugaaauuaacagugucagaguucauggccuuugcgagucucagaccaggauaccaaaacaacgucuaguuucucuggguuaagggagcuaauaguaaauuuuauuuuuccaagaugggauuucuuuguauagcccugguuguucuggaacuaguucuguagacuaggcuggcuuugagccucuaccuugagugcugggaccaaaggccugcccgaccaugucuggaucuaauaguuaaaacacaaaaacaaaacauuagaacuagucagucuuuuccucagucugccugcccuaaauugaucuuuuuucaguaucaguuguuuccacaucuuuauucucuuugaaaucuugauuuauuccuuuuggguugaaguuucauggaccauacauauuugguuaaucuagauauguuccaguucgaaugcuauuagaacuguguuuguggaagaccucaaagucacacacaaguacugccuuguaacaguugguuuugaauugaaaucagagcauuucuaaaaaaugacuucaggggcuggagagauggcucagcguugagagagagagugcuggcugcucuugcagggaaccugggaucaguucccagcacccacaugguagcucacagccaucuuuaaccccaguuucaaagcauuggaugcccucugauggguaccaggcaccuaauugguguacuuacauacaggcagcuacugauacagaugaaauaaaaauacuuuuuuuaaaaaaggaaaaaaucauguuagggaggcuuugcauggacagcacccccccccaccgccgugugugugugugugugugugugugugugugugugugugugugugugugugugugugagagagagagggagagagagagagagagagagagagagacagggagacagggagacagggagacagagagagagagagagagagagagagaaugaaagagcucauggaggcuugcugucuuauuuuuuaugucauguucugggucuuguuauacuuuuaagcuaauaccuuaguucagcugcugcaugaaaguguauuugcuguaacauuucaguugcuuuaaccugccaaaucaagaacauuuuuacagacuaaacaugugauaagagcguuuagaaguuaauagagaacagguguagcuggagagacucuuugcugacaguuuuguucugccugaugaauaaaguuaacaaaacaucaguuggauaaaggaaaaaucacuaguuguaacuuacuauucccagaaagguccugugaaacauauucucugugccugguuucugucagucauuuccaaaagaccuguaaguugcuuccauucaccauuagaguauaccacauacuaauaaguagauauauucauuuuuagauauauaaaagacugcuuccugcccacuuccuguuuggagcuuccagaauggauuagucauugguguuugcuauuggaaagcacauguguuuaaacgcacaggauuuaccuguauaguuacauaugguuuaggugaaucauaacauggauuuccauuuucuuggugucuacugagaguauagaugcacuuuagaaaaaguuuuguucuugugguugacuuaaugguuaauuuagguuaucagaugauuaucuuuguuacucauuuaguggcuguugggcaacacaaguagaaaugguaguguuucagaagcaaagaaaaacaagcaaaugagacaagcaaauggccagaaucuggcagggucaagauggucaaauacaccugguucucuguguggggaugaaguuuuugagggcaucccuguguuacaugucccuguugacuuugagucucccuucaaaugugcagcagcagauucugugagucaaaggucauaacagcccaucuaccuuuaauagguagcaugagcaagaaauaaaacuucguuauaugaugucauugaguuuggaggauugcuauaccguaaucuagccuuaauugaauagugcauaugcacagcuuggcagcuaggaggugaucaaccuauuucagauaauuauugcuaagugcuuaacuguacuaauacaggguauaugcuggacuuaccugugcauuacagguaugagcacaauacuaaugaugagaaagcaaaauccuuuggaaagguaaauuguauaauggaguucuagaacaaucccugaacuacucugaaguuaauucaccccugauuccuuuuuugugacuagggaacucauugcuagaugcuaaagccaccauuagcacucaguccaacagcaucauccaagcaugggaaggauacagcuuucauaaacucuaauuucauaucuggaagguuuccuccugguauuucucucucaguaaauaaccuucccuccuuccaucaccucuucccacucagaccuuaaagaagcuugaaugcuaaaacugcauaucugcauuggucaccaaaguuuauuaaggucuaauuacgaagguccauuaaggacgaauucucaguggagaucaggggaccuggaucaaguuuucuuugcuaaugcuaggaagucagcacauuuaguuuccccuggaacuggacuuguagacaguugugagcugucauguagguggugggaauagaacuggguccuccagaagagcagcuaguguucuuaaccacugagccaucucuccagcccugcaccuacaguuuuaaauuguaaaacauaaucucaaccugccccccugcccccccccccccccgcuuuuaauaauauacugggaaagaaaguuuuuuggcuuugguuuuuuuuuaauuuauuuauuuauuuuauguaugugaguacacuauagcugucuacaucagauccuauuacggaugguugugaaccaccaugugguugaacuaaaaaugaaggugauucuuuucuauaagcaguauuugauuauuuuguuguugagaaagguugcuuagcaguucugauaugucauuuuggagcuuaagaugguguagguauguuguccacuauaucuauacacaugguauuuuucaaauguuuuguuuauaauuuugaacucuaaugucuggagccaggccucauugaauauguuuccuuuuaaaccuuuggguaaucucaugaauucuaaauuugcaucuguuucugggaugugaaacuguccuguuuucugucuccgucuauaacucuugacuccaugcccaugugguguugcuguauuguacuuugguuucuccuuuguuuaugggauggaucacuuuucagagaaaauuuuaucuaaacauuugaguugauuuuugguuugggggaaguucauggagaccuuugucuaaagcuguuauuuucuuuuaagauuuuuuuuuaauuuuaaguuuguaagugguuuugcuacauauauacaugugugccaugugcaugccugugccuguggaagucaggagagaaugucagauucucugacacugaaguuaaagaagguccugagucaccauaugggcacuaggaucugagccuggguccucuccaagagcaguguuuaagugcugagcccuuaagcagucauuuucuaauugaucuccuuucacauuugauuguacagguucaguuucucuuucucuuaaucagguuuaaggagguacaagauaguuacaagcgcuaccuuuggacaauagugaacugaguuuaugguguuguuagaauuguuaauuuucaaaaacauuuauuuuuugcguauggguauguggaagucaaaggacaauuugcaggaguugguucuuuccuucuaucuugcuauugcuagggauugaauacggucaccaggcuugguagcaagugacuuuuaucugcugagccaucucaccaaccuagaaauuggauuauugagucaaaagaugugcaaacugaaacuuagauuuacugacaacucccuuuccucuucccucccccaucuccccuuacccucucuccccuccccuucccuccucuuuuccagacagaauuuuccuguuuagcccugccuauucuggaacucacuuuauagaccaggcugaucuuagacuaagaucucucucuaccugccucggccuuucgagugcugagaguaaaggugugcgccaucucugccuggcuauaaaaaauaguuucuucuaagcuguugccuauccuuuguuguugguuuuugguuuuugguuuauguuuuuucuuauaauuugagacagggccucacauuuuagcccagacuuaccuugaaucuauuagguagguagcacaggcuaaucucaaacugaagguaguccuccugccucagccuccuugggucuaggguuauaguuaugagcugacacaccaaacuuauuuugccuuuaugaaacauagucuugcuauguagcccaggcuggccuuaaauuucagaucuuugugccuccguuuucccaaguaauuccuucauaguuuugaagccuuucuuuguucaggaguuuuuaugggaucaaauauaaaaacuaguuauuugcuuagcaacaccugcauauaucucagaauucuuuuucuuuaguacuguuugcuuuuuguuugagagcuuuaaguaucuagacauuugccuaugaugaaauagggaucugacuuuucuaugaauggauaccaauucuauucauugaaaugguguccuaguaucacuuauucauuuuuugucacugcuuuguaagguuuuuguuguuguucacuuuuuuaaauauaggucucauguaguccagauugaccucaaacucacuagaaagcugagucugauccucuuggcucuugcugucaccucucaagugcugggauuacaggguaugucacuacacuugccucuucacuuagguuuuuuuuuuuuuuuuuuucuccuccuaugggguuugcagccccauaggaggaacaacaauaugaacuaaccaguaccuccagagcucccugggacuaaaccaccaaucaaagaaacacaugguggggcucaugucucuagcugcauauguagcagaggguggccuagucggucaucagugggaggagaggcuuuugguucugugaagguucuaugccccaauauaggggaaugccagggccaggaagcaggaguggguggguuggggagcggggggcguggggggacuagggggcuuucggaggggaaacuaggaaaggggauaacauuugaaauguaaauaaagaaaauaucuaacaaaaauauguuuucuauuaaucaacaguaugauacaaagagaauugauauaaguaacauggaaaaggauggggaaggagaggaggaggauggggguccuuauggguccuuacacgcuauuuaaccucugugaguugugauauuuuaugaaaaauacgaugauuuuaauaaagauuaggucaaaggugucuuucaaauaaaauuuuaaaaaaagauuuauuuauuuaauuauuuauuuaauguauguaaguacacuguagcugucuucagacacaucagaagaggacauuggauccuauuacagaugguugugagccgccuuguaguuguggcaauugaguucagugcaucuggaagagcagucagugcuuuuaacugcugagccaucucuccagcccaucaaucuucacugaguuuuaauguugacuaucaacuguauucucauuuacacuguuuauauauugucucagaacuuuguuagugccuauuuuauaugccagcaacacacuauuuuaaccauuguaguuuuuaaauacuuuauauaguuaggcaaguccucauuuguaauuguuaauacuauuuucaauuuuaacuauuuacuuaugccuauuuuugguaaacuugucaauaaauccauuguuuuuuuuuaagcaaacaaacauguccuguguguagguaguucagugacagagcuccuugccuaccauuaucagaggcuuuggguuugaucuccagcacuauaaaacaaacagacaaauuccaaucagauuuuuaauaucuaucuaucugccugccugccuaucuaucuaucuaucuaucuaucgaucuauugaucuaucuaucagucagucagucaggucuaacuguguaguccucauuggucuggaacuuacauugauccauccccuuugacucuacccaguaggagguacauuuuuagauuaauauauaaaaacacaaauguuucagucggaaucuuucauaggauucaguguuuuuucuuaacugcucuuugaaaauuucacauauguauacaguguuucugacccuuuccuuucaacuuccugaggucuuccucccaacuucaugcucccucucuuuuugauagcccacugaauauaauugaugcugcccauauggacaugagugugggaucauccacuggagaaugcuuccuuuuugugauuuagcuuuuguuuauguuguacaauauagugguuuguuucuucauguaauucuuacacagugcauuuuaaguuuauuccuaaauuuguuugugucacuauuuuuauacauuuuaaaauuuaugaguguuuguguauacuugugggcagaaaucagaggacaacuugcuggaguugguucucuccuuccacuaaaugggaucuagggauugaacguggguccucaggcuuagcaguaaacucuuuuacccacugggccaucucauuugucuuuuuauuacuguuuuaaugagaucuuuuuuaaucuguauauuuucuuuuaaaauuuuacuuuuuauuugugugagugugaguauuggguagggagacaaggguacacauauguaucauagugccaaaggacuaauuguggagaucaaaggauaauuuuggggaucacuugucuccuuacaccauggguucuggagauugaacccagguugucaacccugugcaacaaauaauuuagacucauuguccccauccccaaaugaauauuuucugauuagucacugcuaguugauugaaaaguucuugauccauuuaaaaaaagaguaagcagaaaauauaaguaagcaagagaaauaaauucuuauugugucucacgguuuuuuguuuguuuuuguuguuguuaugcacagaaauauuuguauugccaguuuuuggaaccuccguauuuaaggcuuugugcaggcuuugguagacuuugguuugguuuugguuuuggaaagggucucacuguauagcccaagcugucuggaauucagagaauccucuugugugugccucccaagugcugaauuaaagaugugugcuacuaugcccagugcaagccuguuuuucagaugguuucuuauugaaccuggggcuugucauguuagcuagacugugacugcccucugguccccgugcuaggauuauagacuguaugguuaugcccuacuuuuauguagguacuuggauccaaacucagguccucuuguuuguaaggcaagcacuuacugagcuaucucucuagaucccaaaauaauaaggacuuugagggcuuaguagguaaaguacuugcuagcaaaccugaccaaaguuggauccuuagaaugcacaugguagaggagaaucagcuuucaagauucaagcaugcccacauacauaaacacaaauauaauaaaggaguuuuuuugagacagggucucucuuuauagcccaguggccuugaauucacagagguuagcacacuucugccuuucaaguaaagggaugcgucaccauauccagcaagaaguguuuguuuuguuuuaagacacugaauaauuuuauuugcucaauugcuuuaaaacuauauuuguagcuuauauuccugcugucuuccuucugugaaauuaaggagaggccauauaacauucuggugucacuuucuaaacuccauuuuaauagaaagaggaagugcuuggcauuugaaucuuccugcuuucaagguccuuguauuugugcaucauuugugucuuaaauucugcuuuuucuucuucuuuucccuuuuagacaggguuuuacauagccaagauuuguuucaaacuccugaucccuccugcuucugcuuccuggguucugagauccuagguauauaccagcucuccuaauuuuauuuuuuuuauuuugauuuuuuuguauagaccacaucuaauuuuuaaaauuuugugucugggauuguuuuuaacacaggucuugcuguguauccaggccagccuccaacguggagugguucuccugccucuugacuccugagugcggagauuauaagugucacuauacucaauuauauucuaucuaucuaucuaucuaucuaucuaucuaucuaucuaucuaucuaucuaucuaucuauuuuuguguguguauuuacauaugcucuucugcccaugcagugauccacacguggcagucagaggacagcuugugguaguugguucucuccuuccauuuuguggauccugugaucaaacucaggucuucaagauuggugacaaguaccuuuacccacugagccaugucaugagcugaccuuauguuuguuuuuugagacagaguuucauauaccuuaggcuauccucaaacuuguuagaagcuggagaugaccuugaacuucugacccucuugccuccaccuccuaagugcugagauuggaagccugugucacuauacuuuuuuuuuuucucccaagacaggguuucucugugucacccuggcuguccuggaacucauucuguagaccaggcuggugucaaacucacagugauccacuugccucugccuccucagugcugggauuaaaaaugugcaccaccacguguuucacuauaccuuuuuuaauggaguguuuuauauuaaauguagggguuucauacaugguagguaagcacucugccaacucagcuauaucuguaucccauaccuggcuuuuuuuacuuuaaaauguuuuaauugauuaggaaagcaacaacaacaguguguuauagauguuuugccuggauguugugucugugcaccacauucaugcagugucuggagccagaagaggguaucagagcuggagucggagaguugugagucuccauguugggccaggaauugagcccagguccuuuacaagagcagcaagugcucuuaaugaccaagccaucccuccagcucucuuuucaaccucuuaagaagaaaaaugaaaacuuaaaguuuagacagauacccgacauuggguuuggguauuugccacuagaaaacuaucuuaguugaauaauagcuuauaauugcaguccuuguaguuuauaggauuuauaagcugcugugcuuaugaauaugagaaccacuagguuuuaauugcuaaaaaaucagagaaugugagaaaaagauggcuaaggcuagaaauaaaccaugcucgcuuucuucagaucugccaucacugaccacuuaaugacagcagaacgcuuugaaaguccagguccaugguaacuaauauguaaaucaggguuacuuugcugcuguugaaauuuuguuagaggauggcuucaauaaaauccuuaugaagaauguaguagaaaagugaaccugguuaagagacuguaaaaauagaauguccaugagaaagugaaacauagaccacgggguugacauggcugugcucaguuauuuuacuuugacuuuguagguaaugccauuugcuucucagacaaacuguaaacuugucuuacauugguggccagagugcuuaugcuuuucuagaagacuuaguuuggcucccagcacucguggugucuggugucguagccaucuauaacuucagcuacagaagauccaacacucuucuggccuuugcagacauaacacucacauacacaggccuacacugucacauacacauacauauaaaauuuaaaaauaagaucuaaaaaauugcuuuuacaaguaccauuuauguguauguuauauacgucuauauacauuuauaacuaguuuucuuauuucccgaaagagugauauauucccauucuaagacaccagaaaucuugccaguuugaguucucugaugucaggaaauggugaguaucguaaaguaaauuaccugccagguuuuugaauguguaugguucacacugcagcauuacagagcacucuguauuggugauguuuucacugagugugugccaucauuagggcuguuuaucucugcauuuguccaauauuacuacaugcuaagcacugggccagaguagaguauccaguaagcagaagcuuccacguaaaagccaaaauaaaaagugugauaugaagcugcuauaguuuuggauagaaguugcaaaugcuuuuugaaaauuguacauaguaagugggaaguaggucacacuucauuuuucauaaaguccuuuuuguacucaacuuucagacauuugccuaugcucagugaucaagcaggcgauuucgcaaccagcguggaaguaauugagcaauuuuacauuucuauuuucugaaaauaacaggaguucuuuaaaccgauugcaauuuuagcauuucuguuaaauucucuuacuagaagcacuuauaggaaugagacagaaacaugaugauauguggguuuuuuuuuuuaauucucauccaaauuuuaucuaaguucaggcagcaaauaaccuuuuuagaguuuauuuuccuuuucugauagcauuauugcuaccuuacuauuuagugagcaagaacaaaaauaaccgauacuuucaggaaguagaauagggauaaagauguaucagaaagcucauuuauagcuuuggucauuuggagcuuuuuuaaaaacucaauugaaguacuuuuuuuuuuuuuuuuugccucaaauucagaguucugccccagccucuugauacauacuaccacacuggguaggaaacacuuguuuuguuuuguuuaagauuuauuuuauguaaaugagaacacuguagcugucuucagacacacuggaagagggcaucagaucccuuuacaguugguugugagccaccauguaguugcuuggaauugaauucaggaccucuggaagaacagucagugcucuuaacugcagagccaucuuuccagcccaggaaacacuuuuaagaguuggguaauggugugggcugucucacaccuuaaccuucaaguuauaaaguauauauacaagauaaaaacucacugaaggagucuuaagaauuuagacugauguauguuguaugacuauguaauaaauaugaguauccuaaaauuugagaguggguugugccauucuuuuuguuucauguaaacucauauggggaagcuuuucauuuuucaggaucuuuccuuaagacuguuggcuccuauugcacuaaagcaguagcagugcaauacuuucaugucuuugugacuuaagugcaaggccaugugcacaacuuaguuucagaagaguauaucaccuaaugacguuguagucauuuuaguuuguauagauagauauguuuaugguguuaacucagcaauguuucuguucagucuuuguccuuauaacaagugucacuuaacaauggaaaugggcaguuuuguucaaacaccauuagaguauacuuguacaaaccaaauuuuuacacacacacacacacacauauguuagucagucaguuuagacauguugacuuuuuuaucuugagucucagauuuuugguagauauuuucauucuuacauuuaaacuguguuagugaaaaguacagugaaacaucaauguuuugacuaguuagauguugagaugauuuuauugugacuaaacaugguuguggaagaaggguaaggauguuuacuaauaggcaaacuggaauaugugaaaucucuuaaauuuuucuuuaguauuuaccccauaagcaaaacuacuuuaucguacaaaauuauaaauauaaaugaacacaaaauuauguguauuccugucacuggauugaaugaauucugauauuucuauauguuguuuguuccagaaauacggcuacacacaccuuucugcaggagagcuucuucgugaugaaaggaagaauccagacucacaguauggugaacuuauugaaaaguacauuaaagaaggaaagauuguaccaguugagauaaccaucaguuuauuaaagaggguaagaagcaugaauaccaaccugcucaaacuaccaaggacacagaaacuaaauucaccuucauuugaauaaugaaaaacuagacuauuaaauuuccugauuauggaagguaguguggucuuugaaaauggcaguguuggaagcugcuuucacugugaagaaauugacaguaaccaggauucucugccuuggucuaagaacagcuauaguccagcuuaagguacacaugguuauacuugcuuuugcuuuuuuuuuuaaaaagauuauuuauuuauuauauguaaguacacuauagcuguuuucagacacuccagaagagggcaucagaucucauuacagaugguugugagccaccaugugguugcugagauuugaacucaggaccuuuggaagagcagucaaugcucuuaaccgcagagccaucucuccagcgcuugguuuuguuuuugaaacagucuuauguaucccaggcugaccuggaaguuaccuagucagggauauuccugcuucugacuguuaggauuccaggcacuggacccaucccugccagcaugcaguaguucucuccuguugugguuauucuccccuuucaugcucuguccucccuuuucuugaaugucuguguuuucuccuucucugauucccacucaguuuucucauuguugauauucuguuuaaaagucuccuuauuuuccugaugaaugcauugcuauuuucacugugagauuugaaaaaauauauaccuugguaggcaaugcuuuccugcaggucccuaagacuagucaguaacagauauuuugacauaagaaaaucagcgaaacagaauugcauuguugggaacaggaagcaauaaauggaucucaguagugaaucuuggguguaacuggagacacuugcaguguagaguggcucuuacacagucugccucagccugaacaaccagcuuccuuuccagaguaaguaacucucccguccuguccucugacccugaugccuuucucugcauuauaggcaugaucauuaugaaagggcagucgacaucuccauggaaacuacucuuuuuggugugugguacuggggauggaauauaggggcuuugagcaugccuggcaagcacucuugucccugagcuucauccuuuuuuuuuaaaaaaaaaaaaaaaauuucugucuuugagacaggcuauuaccagguuucccaguuggcuuugaacucacucuauagcccagguaguucuugaacuuggagucuuccaacaucagcuguugucacaggcagaacucucacugcauguuaucagugauuggcccuguauagcccaggggauacuuuuagucuuuaauguuccuccuacauuuaagucuuaauaaaugucucuuugaaacaaacucuaccauuucuuguaccaccauuucuguucauucucuuccuacuuaaggaacuuccauuuuucagucucuugauuuuuuuuuuuuccuuugcaaguuuucuaaauuacuaugcuucuaagaguuugguucucuugagcucucauuguauauauuccuuguuggguuguuuaaacgaugcccauguuuucauugugccaaugcugcugaacucuagaguuuugcacagacagaccuuuguuuagcuuccagacauaugccuaucaggaugcuaucuaaauuauccauaaaugucucagucauaccagaagcuaaaugugucacccaaaggaugauguuuauuuccugauuuggcuguugguuggauugacuacccaacucuuuagugagaggaucucucauucacuccuguucauuuucugucuaucacuaaaaucacuugaaucuuuuaauguuguuucuuuuccauccuaucucccgccacucucgauauauguccuaacauucauuuguaccagcuugccucagauucaccaaagcugccaugcuuucuucuuuccaaccaucauaucccugcuucccacugucuagcaauccaugcugccaugcugcuuguuaguuaggaagcaacuccacugccaacccuuuggucaagcuuucucauagucucuaaagacuuaauguuucuugucuuaagagcauccuuugcuguccgaggacuuagcauguuauauguagcuguuacccacuauauauauugugaacccuccaagggcaagggcaagggcagugaccucuaucugauaguagauucaaaggaauguaugcugagugaacauguuugauguggcuucuccagagaccuccugccguaauugagguaggaaugcuguagcaggaacuuaacacuguuucauaauagguuugugaaauuagagcagcuggauucugagauaaagcuaacuuaagguccuggcaaugcucuucuugugcagcgagaacacuuagcuuauggagagcaaugcaagucagugugcuuuagacuaaaggugcuaaagcuuguuagcagggugcaucugcaguggauggaggugccgaggauucacacagauuaaagaguacaccuacuguucauauuacucccauauuuuacauaaguaaugucuuuagaaaaagaugagauauagauauguuuuuacaaucuuucugaauguguuacaccuugugcugucuguguuugggggcagccaaugccacuuagguauaauuaguuugacuuuaaaaaauuuuuuauuuuauuuauuauuuauuuuguuuuugagacaggguuuauguagcucuggcuguccugaagcucucuauauagaccaggcuagacuuaugucucugccucuugaaugcuaggauuagagguauacaccaccacaccgggccaguuuuuuauuuuagcauugacucuuaaauaaugcuaacaaguuggcaggucugugauugggcagcuaaggccagagaaaucuuagucaaggcucaccugagcuauggaugaguucaaggucaaccuggugaauucagugggaccaugcucaauaaauaaauaaacaaacaaaaaguaaaaagaugggauauugcacaguaauagagugcuuuccuagcuucuagcuauuagauuugauuuauaguaaauuugagcccuaauagaaagagcauguuuucagcagugagugguggugcacacauauagcccuaguucuucaaguuggaaaucagaccauguuacguagugaguuccugucugaaaaaacaaacaaacaaaaacccagcuacuaccuccuauaacacagugauuuagagagaaacauggggcaaugcagggucuuuagacguuagagcaaagcucuaagugguaauuuguaugagaagguaguauacaccgugcugaccagcugucacuguaccagcauuuuaguuacguggacacaggguuuuggcccacuggucaggaugcuagguggcagugauacacacaguaaggaagacuacuacucuuggcccggaagcaaaaagauaaaagggccaggauccaauaguccccuuuagaaguguauucccaaugaucuaugaggccacucuuuuuuguuuguuuguuuguuuuuguuuuuuuguuuuucaaacaggguuucugugugcagcucuggcuguccuggaacucacucuguagaccaggcuggccucggaacucagaaaucugccugccucugccucugccuccuaagugcugggauuaaaggcgugugccaccaugcuuggggaggccacucucuuaaagguaggcccaacccagagaccaagcuuuuagcaaacacaugaacauucagaggacauucaacauucacuauaggacaucuuucauaagauauagaagcuacagaagugggggagcgagaggaauaggggaacacauaccuauagucuuaccaggaaguagccauaucaagaaguuggcucacuucugccuaggcuguuucccuauguaccuuccacucuugcagcuuagggaaaaguagcaaauagccaucugccugcucuucuuuuuaagaaauugucuuguagcugggcgugguggugcauaccuuugauaugcagaagcaugcagaucucugaguucgaggccauccuaguauauagagugaguuccaggacugccaggacuauauggagaaaaaaaaaggggugggggugcugagaaauugcccuuuguugauacaguauuaagccuaagucuuuuugucuuuaggaaauggaccaaacaauggcugccaaugcucagaagaauaaauucuugauugauggauuuccaagaaaucaagacaaccuucaagguuggaacaaaaccauggauggaaaagcagauguaucuuuuguucuguuuuuugacuguaauaaugagguaaugaacauauucaucuguccacaugggcuucaagcuauagauugucagcuguuagagaaaaauggcaaauuuacauuuucuguuggcagcaauauauauaucuagugagugaauagacugggugugcagaacagcaucgccuuguuaauagaauauugagggcuauuaguauugucagcuuugugacccuaaggcuugcuuuauuuucucuauauaagaagagucaaauugucuuguuuguuucuuuguuuuaauaaacaucauauagaguaacauuagguuaugaagcggaagugcugcucgaauguguacugcuugaaaugguuuguuguuuacuggaagaugcauaggucuggaaagguggagaggccuacuauuguuggggaauuugucuucuaagaauaagaugacuuggaaaauagcaagaauaaauucucuguucccacccccaacacgucuaauagcaaacccagacauaccuuugaauaaguaaauaaauuucucagaaccauuaauuaaaaagcuugacucuauuggacagccacuaugcuauaaauuuuauuacauugaugccaacagucugaaucugaaguagugccuugaaggaaguuggcuauucuuagguugaauuguaaaugugccucugguaaaggcuugccacagccuuugaguuguuuuaaaaaguaacuccuucucccaacucuuaaaaauauguuuucggggcuggugagauggcucaguggguaagggcacccgacugcucuuccgaagguccgaaguucaaaucccagcaaccacauggugucucacaaccaccuguaaugagaucugauucccucuucugguauaucugaagacaacuacaguguacuuacauauaauaaauaaaucuuuaaaaaaaaaaaaauuaaaaaaaaaaaaaaaaaaaaaaaaaaaaaaaaaaaaauauguuuucacuuauucuucaaaguuaacuuuagaauguuaccacagcuuuauaacuaaggaauguuuauucacgauuaacaagagaugcuuuauucaaaaauguugacucaaauauuuggauauuuuuggaauuauuguaaguaagcaaaaaugguacaaaguuugaggcacauaauucauaccuaauaaguuaauaauauguccgagaugaagccauacccacacagaucuucuuuuuauugcaguuugaaaaaaauccagcaggaaaaacugagucaugaaugaauucuuauuaugaucuguacuuauuuaaccuaguuuauauaaauugaaccacauguuuaaauuuaaaaagauuuugcauguugauuaaugaguuagacacauugaguuuaaugcaggauuuguggggggggguucuguuuuguuuuaguuucuucaaaauauuuucuucuuugcuuuucuuuuaauauaacuuuuuacuucugucucucuuuagaucuguauugaacgaugucuugaaaggggaaaaaguagugguaggagugacgacaacagagagagcuuggaaaagagguaccucucaggccuccccucaccaccucacuccugcccugcucguggggaccaguucuguucuguucauucucacauaggcacaguggcuuuuguagagagagaaagcagcagacuugcuuaucacccuuucuguaauguggaagagggaggacaauuaaccuacagccaugaaauaauuguuucuuuugcagaauucagacuuaccuugaaucaacgaaaccaauuauugacuuauaugaagaaauggggaaagucaagaagauagaugcuucuaagucuguugaugaaguaagugugucuguuugucuuuguagcaaacaaaacaugugaccauuggggaggcaugagaaaagauagucuaagggagaguacuuuuaagacauuugaggcgaacugugaaauuuguuguuguuguuguuuuuucuuuuuaguaagucuaaaaauggguuuagcaacaguagaccuguuuuucacaagaaauggugguuuauuaauuccaaaccucuuucuacaaacagggaaagauugguauuuucaguauaaugauuuggaucuuguucauuguuaaaaucuguagcacaacuggcaugucauagccaagagccccgguuguucucuuagagagcacagagcucccucccgaggugcaugccgguuuccuaggaugcagcucucugucuugcucagaccucagugucuguaaaccccgccugcagacccuccuccugcuucucaguccaucuuagcucccuuuccccaguucucgcagucuugcuucucuucccagaggagaacucacugaggaaaucucacugccacugccuguagucaguacaugagacgacuuggacuuuuagagccaaacugagauucgucuuuugacuuuauauuuuaccagacgacuugcagcccaucaagaagcacauuuaguccaaaagcauuaauaaaauggaaggcaaaauggucaguuuuaugcuucauuuguauuacugauacaguaaaauaaaugaaauuaagaaauuaaaggccaggcguggaugcgcacgccuuuaauccuagcacucgggaggcagaggcaggcggauuucugaguucgaggccagccuggucuacaaagugaguuccaggacagccagggcuguacagagaaacccugucucgaaaaaaaacaaaaacaaaaaaaaaaaaaaaagaaauuauaauguuagcugggcaugguggcgcacgccuuuaaucccagcacuugggaagaagcagaggcagaggaggcagaggaggcagaggcagguggauuucugaguucgaggccagcuuggucuacagagugaguuccaggacagccagggcuacacagagaaacccugucuuaaacaccccuccccccaaauaaauaaauaaauaaauaaauaaauaaauuacaauguuuaaaaucaauacaaaauugaugucuuuuuaacaggaacuuagcuguacaaucuuuuaucuguauuuuguuuuauuuuuuaauuuuggcguugagaauuuaacccaggaccucauacaugcuacacuguguuuuaacaauaucugcuuuuaaaauugucuuuuuccucuacagguuuuuggugaaguugugaagauuuuugacaaagaaggcuaacuaacccugaaggcaucuuugaaaucaugcuugaauauugcuuugauagcugcuaucacagccccuuuuaaggcaguuuuaaccuuucaagauuacaucucaauuaaugucuagaaauauauaguaagacaaauuaaauuauguguuuuuuuuuuauuuguggucacaguacacagugaauucagguuuaaaucauuuuagguauuauggugcucacaaaaugaagaaggguaucagcuaauucuuguuugugguaaagacuaccccuuuuaucccuuuuaugucugugccuucggugaguuaauuuuuuuuaguaugcauguauaucccuuugguaauugcaguauauugggauuugagauuuccacuuccucuugcuucacauuuaaaauuuucaaccugcuaagugaauuuguggaccaaauuuaaaggaacuuuauguguagcuggcucuugcucaagguguuuaguaaacauacucauaaaauggacuccuagcaaugcucuguuuaucagaugacugaccauuuccuguugaaaguuaaaacuuagagacugauuuacuacagcuugugcaacguuguaugauagugcauagucuuugcuuccaagguuugagucagggcacggggcuucagagccugggcaggauugucagcuuucuucugacauagucuguggggcaagggucacaaguagugacuuguauuccugugcucugugacacaggacugacuagucaucauaaagugauguaacaagaguuccuaccaguagacccuugacaugcauucacuaguuuaugguaauuugauucaguucuuguuuuaguaauaguuaaaaaguuuuuuuguuuuguuuucuuagacuaaauauagaguuagaguaaauuagauaaagcaaucuaaugguuaaaauucccauuuguauuuuauuuucuggaauauguuuuucaugguuacuuguuuuaaaagauuuuaaaaaucauugcacuuuggucagaaaaaauaauaaauauaucuuauaaauguuugauucccuuacugcuugcuuuuucaauaaaguuugaaguccaagugauuuucuuucuuuaaaaaauuaaaaauguuuucuuuuuucuuuuuuaaaaaagauuuauuuauuauuauacauaaguacacuguagcugucuucagacgugccagaagagggcaucagaucucauuaugggugguugcgagccaccaugugguugcugggauuugaacccaggacuuucagaacagcagucuuaccagcugagccauuuugccauuuugccagcucccuguuuucuuuuuuuguuuguucuuuauuuccuaucccuaaagcugagugguaaaacuaagguucuuuuuuuuuuuuuuuaauguuuaugaauguuuugucugcauguauguuuguguaccauguccauuccuggugcccacaaaagucagaaggugucggaucuccugcugcuagaguuauagaaaauugugaguugccguguaggugcuugggacaacccagguccucugccaaagcugcaaaugcuuuucaccuuugagugaacgucuguccaguccauacgucuguccaguccaugucugaguuucuuaagagagagauuggagugucccucauugcagcgcuuacacuguucaguacacaguguuacauagaacacagacuuuauaauuagauuuuauauuuaaauuuauugggaauaguaagaacaaguuaauggacuuuuaaaaauaaugcauuucuaugugucuuucaaaacacuacuugucauuagaagacaaacuaucccuuccuacuauagcauauugaccacacacuuacauucagucugucuugguucuuggaagauuauagugaauuuuugucucauauuucaauccaguggagcagagguuuuauugaugauuaaucacacagcuaugaaaugaagggaggguacagacuuuccguucaugcaagugaggaaauucaccagcugggaauguagauauucuaccgaugacuacaagaacacccuucagguguuuugugucaucaaaaucucucuggcauuugcaacagacaaacaacccacuguaguuucugacuuaugaauaaguuugcuuuuuaaguagaauaauauguuggcaauauugaguuuuggaguugaugagcuacaucugacuuugcuaguuuagucguucuguuuaucaaagaugcaguacugagaagcuuuugcgagucuugaaggacuuuacuuuugggccuugcuauaucuuaaaacuuacugucauuuccauguucuaguguuggguguauaggauuauuuaguaaauaaucccaauaaacgcuaugcugaugccuuugcugucc

SEQ ID NO: 2035 - RNA, 934 nt, Mus musculus
ugcgccagcuuccgcucgcgguuccgguucuuccuaacguggcuggagacccaaggcauuucaguuucagaaccuggauugacguuuaggcagaccagugguucaaucucccggguuucccuuucccaagagaagcggccuaaccgaagaggcaagcacaggagucaguaggaacaacggcauuguugggaaggaaaccaaaggaaaaugagaacaguuugagguuugcaaagaaggccucuaaagaggugaccuuggaaccaagacuugaggacugaaaagagcagagacuuggaugcagugacccgccaagagagaagggcauguuagaagguuagggcuggauaaguggaauggaaagucauuaauggagaguugagucgguuauggaaaagcacuuagguuauauucuaaccgcagggaaagacuuuaagcuuagcucuguuacccugacucgggccauuagggaaaacucugaagagagaagaaaaagagugaaaacugagccuggaugaacacaaaccuuugaaaauuggagucggcagugguagcauuuucauggaguuuuuuauaguaacagaacaaagcuaugaaucauggcaauuuuuuuuucagauaacuugguagagaugguuucuagcaaagcugguacuguuauuggccccagaugccaaaugaugacgagagggaugagacaagcugauccaaagguagugaguuaucucaauggaugguucacaaucaguuacagauuaaacuuccuuccuccucacugcugcacuugacuagagauagaguaagacaaagcccaccuaccucagaacucccccagugugcuuuaaauugggccugcaagcucacuucucggucuuucuugguaaugggagaccccagcaugcugaacuucugcaaaauaaaacacucuuuguauuua

SEQ ID NO: 2036 - RNA, 43091 nt, Mus musculus
cggcgcgcccuuugguucccuccagcgagcgcuugccgccucgguucccgcgaccccaacgucccagaggcggggccgcagucaucugagacgcuaccuggauccugacucugcgugcccaacaaacgggcccaacaaccaaacccuagcuuggcggcggccgugacaacagcgacgguggaucuuugagcuccugauuccccgaggcgcccuacgggcccgggaagcacggugaguaacaagcggccuguaaggucggaguuagcgcgguggaaccgaugaccacagggccgccaggggagaaagaaggcggaccucacugcuaaaaaaugggaaagaaguuuacauugugacgugccucagauugacuucacuguagaaauuucuuggagacugaaacccugauccuugcuuuuuugcauucuuucuaucugacccagacuguguaaggaaucuauuacguguuuauaguccguggucuacaggaaguagaccuaugucaaaagugaggcguggacguacagugucugaacacaaagacagugaugucacccugagagauugcacauucguguuggggguuggaugauaggauuuaguaggaaauuccaaaggaaggggaggacagccuguguaguccuaucgacugcugauagucgaguuaggacuggaggaugagugaccgggguuaugguugcaguaauuggguaggaccuuaauaugaaggguuuuuauuuuauauaugaagaaaagcuauugacuuucuagucaggggaaaaacuuguacauaaacccauuugugucugcacuggagggacuugucaguaaaucuggcugggcugaggaggacagcuaaggugggaggccagaaagaacuuucuauggguaagagggagaagaggugagggugacuugaugguccucauuugcugcacaaugaagacauucccugagcagacuauuuuuguuagguacagguuuguacagcuuuggcuccauuagcuuuauaaguaauacuaucaagaugagcuaguuaucaaaucucauuugguggcuuucagaugagaaagaccuaaugcaugaaaggagagacaggcacuuaagucauuccuguuggugaggaaaacuuauacuuuguggggguagaguuaucagugugauuacugauaccauggcagucaacugcuaaagaaaggcuucuuuuaaaacaagcaaacaaacaaacaagaaaaacaagccuguauuucaagaaguuucauaucucugggauaaguuuuaauugauccuuaaagguuauauccaguagaacuuugcucucccaauauuuuuagccuuagacuauauagaaaaggucucuucuaaaugacuuacaccuuuguuaguaauccucuaucuugagucagaugauucauuuuuuaaauuuuucauuaguguuuaaaauguauuuauuguguguucaugugugugcaugugcacauguaugcugcagugugcauguggaggucugaggaugacuuucaggagucggcuccuucugccaguagguccucggaaucgaucaaacucaggcuguuaguuuugacagcaagcacuuuuagccucugagccaucuuacguaaggcccuaagauuguuaucuauuguuagcauugcuguugugcuauguaugugauaugugcaugugagagcagaagucugucccacugugugcauguggagaucaaaggacaacguuccagagucuguucuuuguuuccaccucgaauucugagaacugaaucauuagccuugcgacagcaacuacuaagccucuuugucuaccucagacaagauuuuuuuuucugaaaccgaaacaaugcguagaagauuaaaaaaaauuaagacuuaaaaaguacauaugugcuggcugggcuugguagugugcaccuguaucccagcacuugaaggggggugaggaacacaugauccccagaaagcccaaacaggaaacuucaugauacauuuuuauaaacaacuaaaaugaacauaugcaucaacagacuggcucuugugacaaugaacaggaagaucucuguccccacaaaccgacuuguuuuggguuuggauauagucacacuuaacuggauauucucacuaguguuuuguacaccuguaguuuccaccucuuuuuaguuucaaguccauaugucuaauuuccaacuggauagguucguucaguacuaaugaacaaaauguauaacccugacagaaaucacuauguagaccaggcuggccucaaaccuagagguccaucuaccugccucuaccugccucugccaagugcugggauuaaaguucugugccacaaaaccuuguguuuaaaaaaaaaugaacggaaggaagagauuuggggaaacaaaugugcuuccuaaaugaauagguguauuuguugcuaaauuaaauauugagguuacuuuauaggcugaaugacucuggaguauaaaagcaaucaaaaucuguuaacaucgacucguuuauuuuucucuguauuguacauugaauauagggccuuacauaaaguaggcaagaaugcuccauccugugauuuacaugcauuuaaucuuacuaaucugcuacuuuucauauaagcaacuuaauuuugccaauuauuuuguuacuauaugguuaagaaugguccucauuugcuacacaauguucuucuaugcuuaacaauauuucuuuauuucuguaagguacugaggauuacaaauugacuaaaucacucaccaaauauagagccuguaguuccuucagccuguaauuccagaugaauaccagguacagaaauuuuauuuuauugaguauauauuuagauguuuuguuaucuauguguaugaguguuuugccuauauguauguauuggcaacauauacauuucuggugcccaagaaggccagaagaaguaucugaucccucggaauuggagcuauaguugguugugagcuaccuguaagugccaggaaauaaaucugggucuucugcuagagcagcaaguacucuuaaucgugagccauuuaucucuccaggacccguuuuaguuuuuugagccaaaagcuacauagcgugacuggccccacacucccucacucaguucuucugccucacccuccccguagcuaggauaauaggcacgugccacugugccgggcuguguguuuaguuauuugguggaugucuugccguauugcugaggcugaucuuaaacaacaaacucauuuuaauacuucuuccucagccucucaagcuuuggggccgcagguguacgcugccaugccugccuucaaaauauuuccuuuuauuauagcuacccacauuagcuugcgaaggaauacuggaagagaagaaagaacacagucuuuagaaccaggaauaucuggcuccacaguuaaaaugguggcccccugguccaguucauucacugugccccucgcuguauaaugaggauggugaucacuuucuaauugauucccaggaaguaguaagaaggcguauuaaguggaaggcaugggcauauguagggaaggacuuaguaaguucuagcucccuuuccucuuacacuuaaugacauagacuuuuuuuuuuuuaauuugguaagaaauuaucugaacugaggcuauaaaauagaagauugcucauuuccacccuagaggaauggaaaguuuuuggaguuccugcuuucuaagcaccggguccuuggugguaaucuucucacauuggccaacccaagauccuccauguuuccugaagugauucuuuuuccguagaguagggaggaggagcuggccaccugucccugcuguucuuagucuguuauuccaugggggaccuggcaaccuggcuuaggugguuuaguucuuuggaccauuauuuccccccuagagaagagcaauuaaugcugccauauggauuuuuuucuucuucuaaacuauaguuaugcccauggggagcucuuauauucucuguugcuuccuuugugccagauguuuuggaugaagacaauaagaaacguggcccagggaggcucucauauuucuuuuacuuuaauccugacccuucuguaucauacugcuguaguuuuuuucuuuuuuuaauuuguuuguuuugagauggggucucucuacguagcccuggcuguccugaaacucacuauguagacgagauuggcuucaaacucagagaucugcuucccucugccucccaagugcugggauuaaaggugugugccaccaugccuggccccauauaguauuuuuuuaaugaacauaaaauacagcauagagauauucaaucuguugucauauaauuuauaaguaguaucguuaggauuuuagcuggcaugacucuucauuguacuaaggaaauaaacccaaaguauuauuauuguuugaucuuuaaagguacuaugaaccguggaaaugaggggaaaaaaagacagcacugaacacuuaacaaugaauuagagauaauuuuaaggcauuuuauauauguguucaauauucagcauaacuucaagaaagcauugguggucuuuuuugucauaaucaaguccuuaacauggcuacccauagcuuuuuuuuuuuuuuuuuuuuuuuggcuggccugguauuucuagucuuggccuuguaaggacuuagaaugccuggcaaagagaauuaacuuucuuauaaaauauauacuuuuuugcuuuucuuuguacuuuaauuguugguuuuuuaaagguuuccuucaagcaagaugguaccuuuccauuuucccccaucaaaauuggcacuuuggaacccaaugccaauuggagagugcaucuacuugcaucucaguuacuacagguauguuucucuuuucaggucaagccaggguaagcugagucagaauauguaagacagacuugauugauguuauuacuaauuacaaguugggcuaccuaaaucccaaaguccaaguuuuuuucuuuugugugugugugucuuuguccccacugguggaagccaaagguugguguccagugucuucuauuguucucaccuucucuuuugaaucaggaucucacuagcucuggagcuugccucucagggagccugcuggccaccucacccccuccucccccaaccacgaggggagaccgauggugccacugcacccaucuuuuauguggauguagaagagccacagucaggcccuugugcuugugugguaggaaccauuuccccagacuguaaaaucugaagcuugaacuggcaagauggugaaguggguaaagacacuugcccucaaaaccugaagcuuacugcgcauccacaagagacuauacagugguccauucuauauuuuuaucuaaauacaaaauauaguuauauuaaaauuaccuucagacucuaagauauuuguaaacaucagugaacuuaaguguuuagauuugaguuccaucucccagaucuuguaugugcaaauauucccaaaccugaaguuguuguggucccagguauucaggaaacgaugcucaaucugugcuguuuuaaaaacuuucucacuuaaaguuuguaucagauaaaaauuccaucugcuuauuaaguuuuccuuaugcuuuugagaaauaaucucucucuuuuaaaaaaauauuuauuuauuuuauguuuuuaagugcacuguagcugucuucagacacacaccagaagagggcaucgaaucccauuacagaugguugugagccaccaugugguuucuuggaauugaacucuggaccucuggaagagcagucagugcucuuaucugagccaucucuccagccugauucauuuuacuuuuaaucacauuaguacaggugccagaagaggccagauccccuuuaacucgaauuacaggugauugugagccaucugauggugcugggauugaacucagguccucuggaagggcaguaugagcucuuaucuacuaagccaucuccucagccuccacccccuacccauucccucccuuuuaaagacaggaucuugucuugcuacauagcucuagcuggcuugaaucugaucacuauguagaucagauuggccucaaauucugaggugccugcaccuccugaguucugagauuaaggguuuaugccaccaugacuagcuguuuuguuugaaauauauuuauguuauguauucaagaaugcugagaucagacauaaaugauauauaaagaaaagaaugugacuguuuuugucaaucuuuauuuacggaaacaucagcuuccuaguuugucaguuuguauucuggcccagguuaggcaagaaccugggguggcguuugugccuuuuuugucagcuuauggccagucugguuuccagguguccuugucuuccucuugccguuuacaggguuucuugacuagggaucucuagaugauugucuuuguguacagucuuaaaauucuuuguuacauuuuagucaguacuuuuauagaagguuuuuguuuaauguggcuauuuccuaagguggacauuaggcauaccacguucagaaaagacuuuucuuauuuuucagaaagccaaagcuuaugguaacugaaaaggccauccgacuugcuuaucgucaugcuaagcagaauaaaaaaaaugugccaugcuucuuacuugguucucucacaguggaugaagguaauauguuguaaaauaaagaaacacacacacacacacacacauacacacacaugcacgcacacacgggcgcgcucaggcuguuauagaauauacauugguuucagcuggcuauugcaugugcuuuugcuaauuucuuugcuguacaucauggauauaaauaugaguaaaacuacccauuacagaauucaugggguagucaccugguagacuacauaagcuaucauuuuuuagguaagauuuuacuaugauaaaaauauuuuugcugaaauguaguucugcuuggugguuuuauguuuuuaauuagcauguuauauaauagaaauauuucuguucugcagaugaagaaggugugacauugaccauagaucgcuuugauccuggucgagaaauaccugaaugcuuagaaagaacuccuacugcuucucuuccuggagauuuuuugauucccugcagaguucauauucaaggacuugguucaagggaugugauaguucauaaugcagaugacuucaguucagcuuuaaaggugaaauuuauugauaacauucuuuuuuuauaauagucuuuaguuuuuaaaauuaugacauaauugcaccaucuuccccuguucucccuccaacuccucuugugugcauccccucacgcucugaaauuuaugaccuuucaaaaaguuauuguuaaggacacacauacacauaauuucagccuacucuauauaauguuaccucagcacugacugcuucauauuggauaaccaauuagugugcaguucccaaaggaagacugucuccuacucccaaccuuucccaguugcccguagcucuuugucuaagguugagaucucauaagauuucucccugucauguuagcaugucuguggauguugucaucauuugggacuuacuuaggcagccauguugaugagacuucauuaaugcagccuaucugacauuucuaguagaaacagucucacaugaaauguccuguucuccggcucuuaacaauuuuucuguccucuucagcagugacuccugagccuuaggugcaggagcuguguuauagguguucuauuuaggacuuauucuuucugcauuuugaucaguugugguuuucuguaauggucuccuguuacaaagaaaaguuuuuuugagguguaaggguuacauguaccuguguauagaggauaaauauuuaaaauguacuuaguuuaggaauuaugcaguuuaguaaacuugcaguugaagguuuuccaaaauccaugauguuucuagcccugggugguuggccagguuucuagccccggcaugacuucccucuugagugagccugaaguccaauuagaaagcuguuaaucaccaccaaggugcgugcccugcuauugcuuccuuaggguuauggugccuuucuggcccugugguucauaggugucauaccuaggcaggacuauuugcuugccuuccuuggaaguuuguauggcacguuguggugcugugaaaacuaauccguagguaggauguuuuggcucagauccagcucagugucucugaauccugugucugaaguguagauggcauuauuuuuaauuauauaugagaaugauaguguguguagcuuauaguauuuugaugagucauacagauuugagaauuauuuguaaugugugauugaaucauuguggauuuaaaaaucaaagguaacgugguuucuugagacuagagauggcuacuauuccagaagaggaagcagugggagcaagacagaaagaaggucuaggaagugcucagggguucuaaugguauauagacuuucgcuaagggcaauuagacuggaguauacauuugcuuaaauuauagagagcuuuauuggagagcuuuauacacauuucuuuuguguuagagauuucugaaaagaaacaguugugucagaucugaucaagcaggcucacugaagucagagaaugaugauugacuagguuggauguauauuaguguguguguguguguguguguguguguacacuaauauacaugcagugguagcuguaagaauaaaaaggacacaguagauauggcuaaauauggaaaagaagagcuacccugauuuggauaaugaggaaggaaccaaaaaggagugagugauugagauucccuaaggcugagucauaauugcguccuauaccccagcaccccacuguaguaaaacuuauuaggggcgauaauuacccaacaugaauuuaaagagcugcuaggacauccaaguuggaaauuuauguuggagcugaguacuugcuuugauuaaauuauucacauaaucuuucaucaugugaaagaaauaagaagugaaauguugugaauuagaauuaauuuuguuaauguaagauaucauagaggcauauguagcaauguuaaaugaacuuuaaagauauggaugcacuucaaaguuuuaaaauaauuauauaauauugauuccucaggcuuuacaauaccauguguguagcaaagauuucuuggacuguggaaaguugcuuugccuacgagcccaaaucacccccagggagaguuuagaugguguggauuuuaacuugcaauggacagcaguaacucuagcaaauuccuucaagugugugccugugaagccuauccccauuaucccuacagcacuugcaagaaaccuaaguaguaauuugaauauuucucaaguucagggaaccuauaaacauggguaaguaaaagauccauucgucuaagcuuuaaggauugauugaauuaauauauuuuucaauaauacuaauuccuauagucaguuuacaggucagagauccaucuccuuuuagggaaaguggguuuuauguuguguucucauacucuuuggcaguauuagaagaaugucauguacagaggauuaguuaucccucccuuaaugcaguuccuuucacugaaaagucacauuuguccuaucaaguugccuggagacuugcauucacuuuuuucaguagcauaguugguucugaaauuguccucuuuaguguuaacacuauuuacaaguaauauguaaguaaacuugaauaaaauauuuuaaguauguaauucuaaaugacuauuuuaauaggucaaaacauugcacauauugucuuuguggcuucuuuuucauccacuaccaaaaauagaguuuuguuuaaaugaaacggaguuucaagacucggucugcauuuugaggguugaaagcacacacuugaaguuauucuuacuuaaguuucuucugcuuagauauauuacuauggaugaaacucgcaaacuguuacuuuugcugcaaucagaucccaaggucucuucucucccguuagugggaaugugaguauuagucuaccuaagaaaaccucucggcuuaguguggauccagauaaucgggaaaaucguuggcuuuuaugugugguuggguuuuuuuguuccucuuguugguuuguuguuuugguuuuguguguguguguuuguuuuuugaggcagagccuuucuguguagcccuggcuggccuggaacucacagaaccucuugcuuccagagugcugggauuaaaggacugugccaccucaucugguuugagcucuuuuuauaaagcuacaaaagcuggugcugcuuaagcuucaguauuuuaauauuaaucagcuaaauaauauuucugaauccuaguugaaguugaaggucuccagccuucucauuaaauuugucuuuauagagaauccaggauucaacauaauaaaauuuaaaaucuguugaaggcagucguacagaaaguuccuuuaauguuaauguuuuuuuuucuuuacaguuaguguguuaaugacauugagaaagaugauucagaaacucauauuuauucagugucgauuagguguuuuagugugcauagcauguuugguucuguguuagggcuuaaaaccccuucucaaagaauuuaaacucaaagucaggugauauucacacagagagagagagagagagagagagagagagagagaucacgaaaaagaaaagguauuugcaaaugcaaaauaguaaucaacaauuaguauaugauuuaccuaugaaaugaacacugaaaaauaaacauagugccuguggcugggcagugagggcaugcaccuuuaaucucuucacuuuugaggcagacacagacagaucucugugaguucaaguucacccuggucuacagagcaaguucuagaacagccaaggccacacagagaaacugucuuaacagaacaaaacaaaauuuaauuaaaaagaaguaauuauagcauuuuugucuguuuuuugaggcuggauuucucaggguagcccuugcuguccuggaccuuauucuguagacuagguuggcccuaaacucagagaucugcuugccucugccucccaagugcugggaauaaaagcaugugccaccaccaccuggcaguugugggcauuuucuuguaagguaucucuacauuuugggauaccucuauguauauauuacagcacuuuaaccucuccacaauuccuaguuuuaggcacaaacuuuggucuccucugauuguguuccuuuccaguccaugcucacuuauuuagauaccugugaugccccccauagaccucuuuucucucccacauccaaauggaagagauaaacaccauggacuuggcucuuccuguauguacaugugauguauuuauguugccauagauaccaguguagucugccucugaauuggcaaugugauuuuuuuuuuuuauuugucaaguuuuuaauguacuacuguugcucaucaaggaucgaucuuggaaagcgugugauccgaaguuuguaaauuuuaaauaacuauaguggguuuucuuuuuauuuugagguaagcucucccuguguagcccugcuacccuagaauuugccucagccucuaacaguugggauuauagcugcaugccaccauacuugacugaugauauacuuucugucuuucuuuuagcuggcuggcuggaauuauacaugucuauagcccucagguaugggcuugcugcuugagauacauguucaguucuuccauucaggaaaggcaagugauguuuuauauuauuuuaguuugauugcuucuguuuauaguguauugguuucaguuaaaauucauacacugcuuuaguacauaauaaauguguacuuuuaaggaaaauaagccucauauuaaauaaaacuaaacaguaagaagguaagcguauagcgaucauauaggauguguuaacuugagaggcacugagugaaagaucacacaguaagcaugcuaguguggcuagacaggacagagaggcaggaugcuagcucaagaaagaugaauggaaagucuuuguuugcuuuuucuucagucuuuugagacagggucuuaaucuguggccaagaugguuuugaacuccguguguggcccagauugacuuugaacucaaggcagucuuaacugcccuagccucuuugaguguuagaucuauaggugugagcuguuauuucagguuacagacgcauugacagucuuugcuaaucuaauagaagcaugcucuuuuccagcauuuaugacauuucuugcacuaugcuucuuucucauauuucucaugucuguguaagaaugcuugaucuuugaacuggacuuacagacagucaugagcugacauguggaugcugggaauugaacuugaguccuuugaaagagcugccagugcacuuaacuauugaggcaucucuccagaccccaacacccuuuuaauucuuuuauuuuguuguguuguguauuuuguuuuagguguguuuuaccuucaugcuugucucuauauauacuauuugcauacuuggugcccauggagaccagaagagagcacucacuguacccccggaacuggagguacaggugguugugaacuaccagcuggaugcugggaauugaacccagguccucuagaagagcagcaagugcucuuaacugcugagccaucucucuagccccaaccccaagguuauuuuguuuguuuuuuguuuuuuagucaaauuccucccuuuucuuucuuacuuaggaacuucacauuuaggaguauaaauaaaagaagcccugucuuuuuuuucugaugcuuuuauaguuauacuuuauauauuugauucagcuuuccaagugaauuuuauuuauuuguacucaaacaagccagacauaaugaagcagauuaccugugauccuagcacugggagccuagggcagaaggaccaguuuuaggccagccugagcuacauaacaaguuccaagccagccuacauuaucugaguccuugccccagaaacaaaaagagaggauguuaaguguuuucuuuguuuuuaaguuuuuaucauuauuuuauggguguuuuaucuuacauguuugucugugcaucacauguguuccuuguguucauggaaaagagggcauccagugccaucggacuggaguuacaggugguugugaaccaaccugugggcgcuggguauggaacccaggcucuacaagaggauugagcgcucuuaaccacugagccaucucuucagggugcuaaauguuaauuauugguucuuuucuaugauauaguacaguuaaguuuuauuaccaauuauucaucuuguuuuaaguuucuauagucaggagauguucaguaaaagcucagggggugcugaauuccuggacucaagugaucauuuuuacacuugcaagugagaugugcauaccauugugugauugugugugcauucuugagaucuucucucucucucucucucucucucucucucucucucucucucucugaaguggaagcuggguggggaaguuuucauuuuccauuucauauauuccuguuuucuuugauguuuuacaaagaguguuuauauauuuuauuauagaauuuuuuuauuaaaaaauuaguaacuuugggggcuggagggaugucucagugguuaagagcgcugacugcacuuacagagaguucugguuugauucccaguacccucauacuggcucucugccuccaagggcaucaggccugcguggugugcagguacacauaugcagauuaacauuuauauacauaaaaauaaauaaguuuauuuuuuaaauuguuagcauuaaaagguaagcuacaugcuuuaaaugagccacuaacuagauugggaaacuuacccaggagaucuuucauuauaacguuauuaucacaaaaauuuaauucaaugcuauuuuuuuguuuaggguuuuuucagaaucuggaaauuucaucauaguucuuuauucauugacacauaaggagccugaguuuuaugagugccuuccuugugagaguaggacgcccgaccuucaguuucaguuacuaaccaacaaggagacuuugcaucuuuucaauguaagugcuuaugcuaccuguguuguguuauuuuucucaucacucagaccaaaauaucugacauaaaccaggaaggggggagucuuauuacagcucacagaucagggacuucagucugugcaugguugucugguugcauaugcuaaagcaggccaucgugguagcaggacugugggauagaagagagacacucacuuccuggcuacccuggaaguggcgcaucaggagcauagacacgccccuguccuuccuccauucagucagggcuucagccacuaagaugauaccaagugcacucugggugugucuucaucacuuaguccacucuggaaacaccuucaccaauggcaagcagagaugccccacccauggaggugaaucaacuaaaaauuuaccaucaguucuuguccuucuagucauuguuuuucaguagcuuauucacuguauuauuuuguacuguugaggauuaguuuuuauuguuguguuuuuguuuuauuguuuuuguuuuucuguaaacagcccuggcuguccugaacucacucuauagaccaggcuggccucgaacucacagagaucugccugcuucugcuucccaagugcuaggauuaaaggcuuacaccaucaugcccagcugaggauuaauuuuugauguuuuucuuguugucacuuauuuuuuaacacauggcuauaauuaauaauauauaaaagauuuucgugggagcgagagauauggcugagugguuaagagcuucagugacuguuuuccagaggaccuggguuuaguuucccagccauccccuagugccucacaacaaucuguaauuccagcccuaggagaugcaauaagauaauguaaaaaugcaucuaggagcccagccaacugggucaggcuuuuaaucccaguacucaguaggcagaaagcagucuuaguucagaggcuagccuauguuccaggagagccaggcauuuguuuuaagaccuugucucuaaaaauaaaguaaaugaugcaucuaggugguuguuacagagaaaguaggucuuugaaauugucauauaaaaaacuaaauuuaaaggauaagccaaguguggugaugcaugccuuuaaucccagcacuuaggagguagggacaagacauaucucuaugaguuugaggccagccuggucuacauaaucaguuccaggguagucaggguuauguagugaggcccugucucaaaaaagcaaaacaaauaauaguaauuaaaaaauaaaugacaccucauuuuccccgugcuagauucaaaaucuuuggcucaaauaauccuccuguaucagacuccuuuaguaccuaggcuugcaucugucuacuuuugauucuggccccaacacuacuuuuuuuuuuuaaagauuuauuuauuuauuauauguaaguacacuguagcugucuucagacacaccagaagagggcgucagaucucuuuauggaugguugugagccaccaugugguugcuggaauuugaacuccggaccuuuggaagagcaguuggguacccuuacccacugagccaucucaccagcccuuuuuuuuuuuaauuacuauuuaucuuaggucuuaaauaaaauauauucauuauuuuauuaugagaauauuaaauaacuccaaauuaacuccaguaugguuccacucaucucaucuguuuucuuugaauuccuuuauggauuguaucauuucaugaauacauuuuuaucuuacaguacucacugcaucccugguuacugaaugaguuucauaaugcaggguuagguucuuauuuucacuuaacaaagcacuaaggcaggcaugcuacagaagcagguuacagacaucagaagcauucuugucagugauccagagcuacuguucggauaaaugggguucuuugcuauuuuaagucaaaucucuaaaguaugaccuacuucauuucagaacguugaaccuucuggcaaaaacccaauccauuuugaacucagugccgagagucaagaugccgaagccgaggcagagguucuuagcaagauuuccaagacucuuccagugaagagguaaaagauaauauuuauuaccguguguuuucuuuacuaguuuuuauuuucauugggaaauuaaaauaguuuggggacaaguaagaugucuuaauggguaaagucacuugcucuccaguuuauccacuugaguuugaucccuggaacccacguauagguggaaggagaaaagcaacucuggaguugcucucuggccucuacguguggaggcaugcuuuaccccuacccugaaauaaauaagcaugauuuucuuuuuaagacuucgaauuauuucugguaguugcuugauaaacucagcucaaagcugucuuugaaugcuagggguuuuuuuguuuguuugcuugcuugcuuucuuguuugaagaaauuucaguuugcccuuugacucuuucauuagaaacuauuuuauuuuuaaaucaucguggcaggugccuugacuguuucucaaguguuuuauucauuuguuuaguaggaguauaaaauuaagggauuuguuaugcuguccuuacacauacauucugugcuuugugcauuugcacucugcuuucuacuucccuuccucuuccucuuaaauaguucccacuugguuuucagacacacacacacacacacacacacacacacacacacacacacagagcuaaaucuauauccaaauauuagagaagacaaauauuuaaaugugguuuauuucaguuaaacuaucuuugauccauccauguuccugagaaugucauuacgccacucucauggcugaggaaacucauuuucuuucuuuuuucuucugacuaugggcauuuagguugguucauaucuucuauuguuaacagugcuacaguaaguuuugcuuuauauuuuuauuuauuugcuuuauauuuuuauuuauuuuuugcaguaccaggaaucaaacccugaacuuuuuuuuuuuuuuuuuuuuuuccguuuuucuagacagaguuucucuguauagcccuggcuguccuggaacucacuuuguagaccaggcuggccucuaacucagaaaucagccagccuccugagugcugggauuaaaggugugcuccaccacgcccggcuaacccuggacuucuuagaugcuagacaaguagucuacuauugagcugcaucccuaagccauuuuaaaaaccuuuuuauuuuaauuuagaagauucauuuaucauauguguuuugucuguauguauuuauggguaccaugugccuucagaggucacaagagggccucagaucuccuggaaccagaguuguaaugguuuugagcugccaugugaguucuaggauccaaaaaagcccuugaacaaaguuaccuuggagccaucucuccaguuccuuagcuuuuuaaaauauagccugaaccuucuuuucagcuuucuuuaauguuauauauuuaggauauuguucagagaaauaagcagauauaaauaaauuuuuuauugauuauuggaauguuuuaguuuuauugagaaaaauggcuggaaucagauauaucugcauucaagucuuuauucugggggucagaaauuaaaaauguuugaaucuaaagaccaaaauauuggcaggcuaugaucauuguagaguuuugggguuuuugucucuuagcuucuagaaaccgucuguauugccugucucaagccucuuacacuguuuucaaagccagccuaucugcuucaagucucccacuaccucuccuuuccuucucauccucugacaccuaccugugcuuucaccaucacaucuucucucuaauccugaccauaauuacaauuaugcagggucagcaggcaagggugcaugccuuuaaucccagcacuuggcaagcagaggccggcggaucucuagguucccagcucgccuggucuacagagugaguuucaggaaagccaggguuaugcagagaaaugcugucuggaguguguguguggggggguauuauguugaaucuacuugaggaaccccagauaaucacugugucugaagagucuuagauccacagccuccuuuauacacuuaggaacugagaggcacuaggguuagagagugucugaagugcuccuuuccaucuuugugggcauaaaguuauccucaaacagauuagggcacuggaaacuaguccuucuugucuauugcagucauaacuuucuaaauuguaagcuuuauuuaccauuguauuuaauauuuaugaaagaacaggcuaagugaagggaguagacuccuaaauguuaagaggcuagguguaugccuucgaguaggggcuuaccuaauauuugcaaaucccuggcuuugaucccagcaccaccaaagcaacaacagaacuguugaaaacuuucuuguuuucaacucucaaugaagccuuaaugaggaucugccacuuuaggguuuaguaaauuuugccugaaagacugauaacaacuucaaguuuuuccuuuuugguuuggguguuuaaaaacaaccugaguuuaucauuugacuucaacccauuuuuggcucucgugugucuguguguguguguguguguguguguguguguguguguguguguguguguguguguuaaagaaauaacucaagugcaaagccccguacccugucuuccuccauauuggacugucugccuuaagcugcuauccuacuugcucuuuuauucugcugagauuacagucaauucgccgucuuucuguccucuccucugaggucauguagaggggguuaaugauauaucacuacugguaauaagacagcauggcucacaucugucuguguugcugucugcugagauguguccacuuuuagcuaaucuuugacuuugagggguuaaugcaaguuuuuugagccugcuggggcacuggcuuucugugucagagaggccugcacugagcacauccuugugucaucuucuguccuuguguauuucaagagagcugaauggacugguacagacccugccuguccacucagaacacaugugacgauacugucauugcuuuauugcaguaccuugcacagaaagaccguugugauuauuuucccucucuagaccaccagggcuuggaaggucugucagaucuucaauucuucuuuguggcuucuuauucuuuuucccugcuaggaagaguucaacuuauguaaaacagcauguaggauguguuuucaggagcacauuccaagcucucaacuuccuuauugcuuaccuuuucccuaaagcauccugaugagauuuugucuauuuacuaggaugaaauaaacaacaaaaaaaccuuuuauguacauauuucaggucuuuagucuuucuccacacccugccccccaaaaguuucuuuuuaaucuuaaaaccuuaauuuuagccgggcgugguggcgcaugccuuuaaucccagcacuugggaggcagaggcaggcggauuucugaguucgaggccagccuggucuacagagugaguuccaggacagccagggcuacacagagaaacccugucucggaaaaaaaaaaaaaaaaaaaaaaaaaaaaaaaaaaaaaaacccuuaauuuuagcuuuuggaacucaguaccaacauuaacauuuuucuuuccuccuucucagugcuagggauugaacccagggcuuugcauguacuaaucaaccccuuuaccacugaacuguaccccaccuuuguuaagaguuccuguuuucagguggagagcgcucucugggagacaaugacuacagcugacuagaugugagguauacuccauuucuaaguguguucccauuguaguuauagguacauaggagggggugugaauaagaacugguauagugacauaucuaugugaaaugcuaaaugaaaccuaaaacuuuguaggguagcuuagaaaguuaauuuuaaaaagaacguaggagccagugagaugacucagugguugaagcugccaagucugaugugugagucugaucuccaggacccacguagcuaucauaacagaaaaccaaugucugaaaguuguucucugacuucacaugcauacacaaaauagguuguuuguuuguuuguuuguuuguuuguuuguuuugaaacaagguuucuccguguauccuuggcuggccuggaacuuacuuuguagaccaggcuggcuuuguacucagagcuccaccugccucugcagccgaguacugggauuaaaggcgugcgccacuacugcuuggccgaaauaguuuuuauuaaagauaauaauacuauuuuuuucuuuuccuuuugagacaaagccuuacuauguaaccuuuguuggccugaaagucucuuuguagagcauagcgaucugccugcugugcuggaauuaaagagauacaccaucacacacagccauguuuuuuaaaguuauaacaacaacaaaaaaguauauaaaaaaaaacacuucagugauuucccuuuuuuucacagugguuguuuaauacgauguguugaguauuguuggugcguaucuuagcuccuccuguuacugcuguaacaauacagcugaaggagaaggccguuugacucacuguuucagagagauuucaguauuugaugggaaggccuggugaaagaagcuacuucacucaacagcaguggaugugagugaagguggcuucuucacauggggaccaggaaacguaaagcaggauaggaucagcagcaaauaucacacuaaaauccacccuaacugaccugcuuuccacagccaggcccuugcuaccuccuaaacgguccaugaccuuccuuccaauagggcuaucagcugggauccgaguguucaaaaccuaagccuaaggaguacauugaagagucaaaccauugcagggggcauaucugucacacuguaauauacauuuccaguaagugcuaagcgcucguucuacauuguucaguguggucaaccagaagguguucagugacuguugauguacuauaggaguuaaguaggguuaaacuuucagugaucagguaaaugggguaguuaauuaguaaaccugaguagaucgccuuuccugcuaaauuaacacugaccuaagaauuuaguacuuguagcugugaaaauuaauuaaauguuuccauauuuacuaaaugacaucacauucaaaacaggaaaaaaaaaaaagacaaaaaaaaaaccugguuuguugaagguuucucuuaucuccucuucuacucuuuagauccucccaaaaauuaucuccugggaaaauaccaauaaauaagcaugacacugaccuugaagaugaagacuuuucuccaagaccgauuccuaguccucacccagugagucagaagguaaugcucugaaaaaugagcuaugucaucuagaaagcuugaagucucuauagcaaagcacuuaaguaccacuccauccuuaaauaugggcuauucugacuauuaugagauuauaucuuuaugaaggaauauauguauauaucucccagguacagacaacucaaguaaugauguauauguccauauauagguaauaguguauacguaaguguaagaaagcugagguuucaguugccggcugcccauggucacauaacuaguaagcaguaaagcuggacuccaagucuggggccucggcuucagaauuuggugcuuuugucaaccaugaagacucagcauucugugucaccagugccugacaguuguuacuguccucaaagaaaacauccuacuugcauuuagagguuaguugccaauaacccuugauugauugucagacuguuuuugaauuguuaccaacuagugagcuauuuuagaaauguuugccuuaguugaacucaauugaaagggacggaaaauuaauauaguugggaacucucccuugagaagucgaugcccacacuuuugggcaucuuaaauuuccuaucucuuucucuuaacccucaagcuuaaaaucuccaacacuucuuccaaaaaaaauuauaguauaucagauuuaauguucucucuuaucuuuuucccucucuuaucucuuauuuaauauuaguagaagaaauaguugcguuacuuuaacagagaaauauucugaaguauuccuggagucuaguuuccuuuuuuucuuuucuguuuuguuuugauuuugguuuuccaaaguuucucuguguaauagucuuggcucuccuggaauuugcuuuguagaccaggcaggugacccaccuuccucugccuuaaaaguacuggaauuaaagguuuaaaauugaggccacccugaucuacuuagugaguuccaggacagccagggcuauauauagagaccuggucucacaaaacuaaauaaguagggggaauauuuauauauauguuaggcuaauauuuucuaaaaccaauuuuaauaaggguucuuaaaugcuucaaccucccuucuagccuaccuaccagagguagaagaaaagaaagguuaauaggaaacggggauguggaccuguuuaggaguaguuuuggggggcaauuccagucuuuguugucaggauauuaacaguccauccagucagcaaacaccaaacacaaaucauagcaguggcuagaucgagaagaaaccuugagacugcugaauuggcaggagucugaggaagcagcaagaagcagcuggacuaacacgggaaggagcaguucucuaguguguucucucuacaaagucaugacaagcgaagguuagcgaagaccagcaaaguguuacaaggcaaaccaaugcuagaauguccccucacucucugugggguuauauuuauauucuuaaauauaauaauaauuuauaauauuuauaaacaucacaugccuucucaaguguucacuccagcaaaacaucacauacccuuucacaagacagcuuccauaaaaauacuugucuguuuacagcaaaacauccucucauaagacagcuuccacaaaaaaaccacaugacagagcugagucuccaaagaaacccaacaauuuuuaauauauauauguauacauauacauauguguguguguguguguguguguguguguguguguguguauaguagcauuauauauuguacuccugucugcuguguacccagaauaaugguugauggucuaagaagugaacaaauuuuaauguguaauugaguauuguuuggcaaauacuuaucuaaggaaaauagagcaaauaaauuuccuaagaauuuacuuuuugcuuccauuuauagauuucuaagguccagccaucuguuccugaacuuucgcucguguuagacaacaacuucacagagucaaguaaccagucuaacccuuuggaaaugaugacuguggagaauccuuuauugauuaagccaucccagccugagcuuugugaugccaaacacagcucagaagcuaccacuggggagccuuuccggaggggcccaacaaaucaguuaagucaggacacugcuuuaagacagagcagagggaagcagucaucuaccuguaagaaagagagucuccaguucaggaacacuaaugcuaaaccaucucucagugugccaucuccugauguagcugagaaacuucaagcaguuucugcugggagcaugcaaaaggaagacuacccugugagaccuuccacacuggacucgaggcagcccucucuugcuccacaagcccagccacacaaucuuguuuuuucaacucauaauucaacaagaccaauggagcuucaagugcccacuccuucauuaccauccuacuaucccacaaacgucugcagcuguugucagcaucauggccauauucaguauaguacaauaaauucuuggcagggaaauacaguagggucuauucaagaccugcgaucugagucccuuccaaaacaugccuucuuucacucaaguggaugcccaucucuguguccuaaugccaucuacucgucaaguagcccuguuagcaugaagcaaggaggcaugggugccuauucuccccauagcaauggagaaccgucuccuguggcaggaccuucacauguggacucgugugugccacaucccugugccaugugcaugcacaugcccaauacagcaccagacaauggcaugaugggacugucuccugaugcauaccguuuugucacagagcaagacaggcagcugagacuacuucaggcacagguuugugugaagcucugcuaguacucuuaaauucuuaguauguuuccuuaauauuuggcaacucuacagugauuaugcuuuauaaaacucuacaguauuagaaccagaaagaccucuuaaaagcugaauucuaaucccucuuguuuuacagauaaaguaaggauuagagagaauaguuuaaccuuguuccauaauugcugguuaggagggcuaggaccagagagcaagccuucuaucucuauaugcuaaccuacaacauaaucacauuuucuuucaauuuucucuaaacuuuuuuuuuaaagauuauuuauuuuauguauauaaguacacuguagcuaucuucagacacaucagaagagggcauuggcucccauuacagaugguugugagcuaccaugugguugcugggaauugaacucaggaccucuggaaaagcagucagugcucuuaacugcugagccaucucuccacccauucucuagacuuuuauauacagcuaaaugcaaaggcuugcaugucucuaguuuuuccaccuuuguguuuacucaccucagccagugagucuucaggauguuccuugcgacucuauuugagacuaguuacuaagaagagaccaguuaagaacucuauguauuugcuucuuuuauuuguuuuggguuuguuuguuuguuuguuuguuuguuuguuuugagacguggucuccugaguccuaggccuugaaccugucauccaagagccuaggucuuuaccguuggauccuccuuccucuaccuaucacauacuggaacuauagauguguaccacuguaucuagcugucucuguaugagacuuguuccacucauuuuauucugcaauguucccucucuucaggucuuuuauuugaggguucuuaaucuuuuuuuuuccauuuuuuauuagguauuuagcucauuuacauuuccaaugcuauaccaaaagucccccauacccacccacccucaccccccuacccacccacucccccuuuuuggcccuggcguuccccuguacuggggcauauaaaguuugcguguccaaugggccucucuuuccagugauggccgacuaggucaucuuuugauacauaugcagcuagagucaagagcuccgggguacugguuaguucauaauguuguuccaccuauaggguugcagaucccuuuagcuccuaacguauuaauuuggcucuuugaaagcuccuuugagugggcugggcauugaacccagggccucuugaaugcuaggcaagugcucugccacugagccaugcccccaggccccuuaaucuuuucauuugucuuuuucgaagcugagugagucugaguuugccuuuuccccuucauuucucaucaacacauccauaucccaaaccagauguucucucucuuucuagccaaugugagugaaaauaacuugaaauguauacuucagguuuuucuuaccccaauaacuauauaaauauguggcuacucuguauaauauguuauuuagaaaaaucuuugauuuaaagcuuucagaggccauuccaggcucaaugagauccuaucuuuuaaaagggggcuugacuggagagauggcucaguaguugaaguuaaauaaaaacuuuaaaucuuuuauuuaaaaaaauguaaaagaaaaagacaaagauuuucaaauucugcuuaaaauacuuuggauacaaacaccugagaaauguguguauaccugcaugaguuuauguccgccacauuacaugccugugccagaggagguaaaggccacuguauccccuggaacuagaguuaccggugguugugugccaucugaugugggugcugggaaccuucucucuagcagacucagcuuuuuuauuuaaauagagcuaaauucuucgaggcuuauauaaauuuagauuuuaauaaaucauuaaauacuaaaucaaaaaugcuaauauuaaauaagcaauuccacauugaaacaauuaccauuugucuuauuaaguaaaagacuaauauaacguaaagagaucuguuaagcuauuuagaaacuguaguuacuuaaaguguuuauuuauagagugugagcucucaucuagauuauugucacacaaaauaugacagaaaauguuuuucuuuaauacaucauauauuuccucaugaauuuccucccuccuuuuuaaggaauucuaggucugggugcacaugaguucacauuaauguggaggccuaggaucggccuuacauguuguuccucgggagcuguucaccuugcauuuaucaucaucaucagacagagaaggacaagaaauacuuuguagaugaucagaguaauacuuagucugaauggauuaaagcuuuauauaaaugucuaaauaugaaugaaaagaacaggagacagggaagaaacauggaacuauugauaguacuuuccucuagaaagaggaguugagaugucugaagaggauaaugagauaggaaauaaauauauuuugguguuauugauacauaauucggauaucacacaauuuaacuguuuacaauguacaauccugugguucuuuguauguuuguucagagucaguugauuuuuguuguuguuguuuggguuuuuuuuuuuuuuuaagauuuauuuauaugagcacacugucgcugucuucagacgcaucggcucccauuacagaugguugugagccaccaagugguugcugggaacugaacucaggaccucugaagagcagucagugucuuaaccacugagccaucucuccagccccuucugucucaguaguaccuggguguaggcuaggcugacuggucagagagccugagggucugccugucuccaccugaguggugcucccauugcaguugcagucauacccaccuuuaacucagguccucauguuugcagggcaaggauuucaccaguugagcuauuuccccaggcccagguaacuuucagacauguccauuuugcguacauaaagaacuuugccagguaguggcacacgccuuuaaucccagcacuugggaggcagaggcaggcagauuucugaguucgagaccagccuggucuacagagugaguuccaggacagccagggcuauacagagaaacccuguaucaaaaaaaaaaaacaaaaaacaaaaaaacaaaaaacuuuauugcacugggucauuuuuuaagaguacacauggauuuccuaauuaucuuguucuguucugucaacaauuugaacugucuucuauugcagacaguguaccagcaacuauucuacuuuuaguuuauuuucagugcuucuuguuguuauuguuguugauguugaugcuucugagacaaguuuucuuuguuaacccaggcuguccuggaacuuucuguagaccagccuggccuugaacucagguacucaccugccucugccuccugaacucugggauuaaagguauaugccaucauugccuggcuccgugcauuuauuuuuauguugcuuauuauuuauuugcaucuuucaguuaugagccuuuaggcuuaaacagcugagccaucuucccagcucacuuacuaacaucuuuuauuuacaguuaguugcaugugugcuaauaucacugugccauagauccucccuagauguaaacuuaacauuuguguguguguguguguguguguguguguguuuaugaggaccauggugugcuuguagaagucaugaguuuacaggaaucacuucucuccuuccaguacauggguccuggggaucaaaaucaauugccuuaaaccucugagccaucucgcuggcccuguagaaguaaauugugaagucaaaggaauguuuauuuaaaauaaguacagagacacucaaacuuggccuguagcccaagugguggagcacuugccauguaugcaaaaggaugcccaaaauuguuccuauccuaguauucacagucuuugguugguugguugguugguuuaauccuuaauggagugggcagaugaauugaacggauuccuuagauucuaaugcauuuuccagucaguauagaucuuaaagccuuggaaaagcaaccugacugauaggccaccaaaauuaacuaguuaauuauaauaauacuauuuguggggaaguagaauuuuuuuuuaaaucaacaaaacaaauaaagggggauguuccucacuccaguauauauugaagaaacguuaaaaccuugcacauaagcugcuguggugguacaccggagaugaaaggagagggaaaucgaucugggaggccagcaugagcgacaaagcaagguuuagaucaccugggacugcagcaagacccuaucuuaaacaacaauuugaaaucaaagcagaaaaucccuuguuuauaaaugucccccgcaguauucacaauaggccaaacuacgcagcuuggcuguccaucagcuugauggugggucagcucaaugagcauagucauacggugguauucagcagucauaaaugccgugacuagucuugaaagcuuuauguaaagagaaagacaccagacacuuagcuuaguucuguguguaugaaauguccaaaaucagagagcuggaagguguguuaguggguccaagggucaggaaagaggagugguaaggaauuaauauuauuguuucacauuuugugacuauacuaugaacuucagaauugguuaauuuuaagguauguaaauuacaucuucacuucaaaaggagaagggaguuguaaaacuuaacacaugaaaucuaugauacagggcuagagaaauggcucagugguuaagagcacugguccucuuccagaggaucuggguuuaauucccaauauccacaugguagcucacaacuacuugucacucaagccccaggguaucuaaugcccucuucugacuuucacggacaccaggcauguaagagaugcagacaaaacacucauccaccuaaaauacauaauuugugguauaagugucuuacagacaagaacgagccagucaguguuagcuauuguuuguuacuauucuguuucaguguggccaaacacgaucaauucugucuaaaguuaauagaaggaaucuuguauaaaauccucaauuuugagugcaugaaacucaagguaugccuccuuuuccauucuuaauuuauaaaugaaguaggaauaaacuauguuaauuugagguauuugaauaaaaauucaacuuaggaauauuaaucuaaccaccuguaaguuucacuuuaaauuuauacuuagugaaagcgggccuuaguagcuaauguagauaauggcuuucugcacuaaauaagucucacaguaugauuuaauuguauuguaagaaaauauaguuaaaagucagcucuguaaugacuagaguaucuguaauuuguuacuaaacucugcugccaguuuuguugauugcuguauugccugaucaaugcauguuuuuaauugauacagauccagcgcuuauuagaagcacaaucucuagauccuggcucccauaagacaguagccaccguggaagacaccgugaaagcagcaaaacaaauggagcugguuuccauggaagcacagucuucgccuggcuugcacaugagaaaaaguguaagcauugcugugagcacagguaacauauuuuuuuauuuguaagaaauuaguuuuuagugcuucucauguuugccuuuugaaagaaaggaaaggagggagagauaaggagagggcuuaguguggugcuugccacauaaacauaggaucugaguucaggucuguagcacucacguaaaaagccaggggcaggaguuaaugugcaucuguaaugcuaacacugggaaggcucucugcccagccugugagcuguaguuucaguucuaagaaauagugguggaaggacucccaacacugagcucugguauccauagccuucugcuugcguggucacacuuauacacaucauacaaaacacacaccaaagaaagggguugggggaugcaguguuuuucugucuuauaaaacucugcauuuacuguacuguaguuucucguuuguuuggguuuguuuguuuugaggggaagauuucaagacuggguuucucuguguagccuugcuguucuggaacucacucuagacccggcugaccucauuuagacucaccugccucuaccucccaagugcugcgauuaaagaugugugccaccaccgccccgcuauuguaguuuaucaucugcgucuaccacuagaccacuucuuaggacuuagaaauggcuuacccacuuuuguaucuuacacaguuuaaagugacaaaugaaaucauucacauguuuugagauuugucuuguuuuguuuugauuuguuuggguuuuuugagacgcggucucucuauguagucccgucugucuggaacuugcucuauaaaccgggcugucauggagcucacagagacccucuuaccucugcuucccaaguacuggaauuaaagacccaugauaccauggcccauuccaaaaggaauuauuagcagucauuuuaaccaagagacuuuuaggagcauauuuauuuuacauguacuuagcuuucccuaaaggucuaaaguaggaccuauugcaacuuuucaaauuuuuuuucuaaaaaaucugaaugcaaauuuaaaccuugauguuauugugauuuauuuucauaaaggcacucaaaguaaaaguguuuucaugaugcuucaugccuaaaguucaagugcuguggagggucuugagauugcggccagauugaguucuaguccuuaacucaaaaacaaaauuauaggaaaaaagaaaccacuuugacuuuuuuuuuuuuuuuuuuuuuugcuucuucagaccacugccuuugcaguguuucccagguuggaaaauggacauaggccauggugcaagacauugagauagaguacagaugacugucuuacuuuuuguaaaucuguuuuucuuuuuagauugauuuuauguguaugaguauauguauguauguucaccagcuauaugucugaugcuagcagagguuagaugagguuguuugauccuguagaagguugguuguaaaucaucaugugaguauugaaaaccaaacucaggucuucuguaagaacaaaugcucuuaaccagugauccuucugugcagccccagauauuuauucuuauguguaauggaaaaaguaugacuagccuaucaaaccugagacuucacagaaguggugaagcuggguaaaaaugaaguaaguuuauguaacagaaaguagaaacaucguguguagauaggcucuaaaagcaagagaagcacuggguuuuuuuuuuuaaguguguguuauauguauguguguacacauaugugugcaggcaugcucaaccuuguaggugugaauagaugccagaacuugauauuacucugucuucucauuugcugcucugcucugucugucugucuaucugucuguuuugguuuuucaagacaggauuucuguguagucuugcuuguccuggaacucccuuuauugaccaggcuggccuuggacucagagaucucagccucagccuccugagugcugggguuaaaggcauacaccaccaccaccugguugccuucuuucauuaaaccuggaacuugcuuuuucagcuaggcugcuggccagcugguggcuuuuacuugggugcuuaggguccucaugcaagcagaauauaugccaagaugucuccuuauccccaaaaaacaccugccucacaguauguguaccuugugcaccucuaacaugguuauuuagaacaaaaccagagaaccuaugaauuuacagguuuuuuuuuucauguauauuuuuuuuccugaaguauuuucauuuugagacagagucuuauuaauguagcauggauuggccuuaaacuugcuacauaucccaggcuacccucccauucaagauccucccaccucagcuuguugagugcuggaauuccaggcaugccacuguaccuucauuugagaagcagagccuccucuugagcagacaggacacugauguccccuuuuccuuugccacugguuucuugucuuccugccuuucaccuacuucucuuuguggccuuuuaaagguaauuugaaacuguaauuuuguugagauaauauagauguucuuaacaagcgucuacauucauucuuucucuaguugaauauuuguucuaauagcugaacuaauuuaacuauuaacuauuuaggugcuagcuuguuuuggaaugcagcaggugaugaucaagagcccgacucacagccgaagcaagaugauaccaagauuuccagugaagacaugaauuuuucuguagauauuaauaaugaagcgacaagucuuccugguagugcaucuuccuuaaaagcaguugacauuccuaguuuugaagaaagcaaccuugcuguggaggaaguuaaucagccacuuccugaauccaaguaagaaucuuccauucacuguuaugcuauuuguuuguuuguuuuaaauuuuaucuuauuuuuuaauucauuuauuuuuacacuccauauuccacucucacacccacccccauccauccuccgacugcuccacguucuacaccuccuccccuccccaccccaucuccacauggaugcccccacuucccaccccaucugaucucuaaacucccuggggccuccagucucuugaggguuaggugcaucaucucugagugaacacagaccuggaaguccucuacuguauguguguugggggccucauaucagcugguguaugcugucuguuuggugguccaguguuugaaagaucucggggggggggggguucagguuaauugagucugcugguccucagcuucuuucagccuucccuaauucaacaacaggggucagcgcuucuguccauugguugggugcaaauaacugcaucugacucuuucagcugcuuguugggucuuuaggagggcacucauuuucuucuuuugcagugcuauggauuaaauguauuuuauauucaggaauugguuuuguuggggaugggggugguacgguguuuguuuauuugagaccagguuuucuauguauccuuggcgcugccuggcuguccuagagcucacuguguauagaguggcccugaacucacaagagauuugucugccucugucuccuaagugcaagcauuaaaggcauguaccccuugcccugcuuagaauauaauuuuuauauuuauauacauaguagagaauaauaaaaucuggcagucaaaauuaugaccucauauacuuugugguaaaaacaauuuaaaucugcucugcaauucugaacuauaccauggacuauuauuuuuuaccaucacaaauauauucauuuucuuccucuuugagacaugauaagcuuaguguauuuucauugacgucuuuacauaguagugucagcauaacagaaaaucucaaagaaaacuuucuucaguuaugcccauaugucagauauugaguuugcuaaucugaaugagucacaacaucuuaaaaaaacuucagcauucuguguacucagaucucaccauagagauucuaauaauacaggcuuccaaaugacaguacaauuauauuugaaaaagacaacagcauauaaaauaucaucuuauauguuuguuucaaaacaguagaugaccugacaaaacauagaaacaaagucgggcagugguggugcacaccuuuaaucccaguacuugagaggcagagucagguggaucucugaguucaaggacagccugaucuacagagugaguucuaggacaaccagggcuauacagagaaaccuugucuugaaaaaaaagggguguggguuugggcaaaacaaaguugacaaaaugguaauuucugaaacagauuguauaugguauuucauuuaacagucuucaguugaguuugaaguuuuugcauuaugaaauuuucuauuaaaguagugauucccaaguaauuuauuuagcaccucgguaaaucuggcaagagcucucugaacuuagcaugcgcuguaccacacccggcacauggauguagcagugaguaaagcagagcucccgauuguguguuuaaccacauaagcaguagugaccacugcucccaaggaaaagaaaccagagcggucaggugauguagacagggugaugcuggggcgugacaugggcuguauuucagcagaguagugagcaaggcucugggcccuaacguuugaacaguggucugaaugauaaagagccaguccugacauuaucgcugagaagaaugcucugguugauggaaauggcgaguauauaaagacccucgcuaggguauauaaucuugagaugucuagaaacaagcagauauuccagcagagcuggacauagugccuaacccagguccuccagguccucuuggagagcaaucgcuuaaccacugagccauguuuucagccccuuccuugacucaauucuguaaacuacagaauacuuucuaaaauuguuaagguuuucaagucuuugaaaaucuccaauccuuugguaguuaaaaauguaagaaaaggaccuaauuuuagcuaauaaaaugaaagcugauugcuuuuucaggacacaagauguagaccuaaucccccuuuuuuaacauauaauauauugauuuaggaucaauacuaucucuaggccagaugugguggcaauuagaauauggaggcaggacaaucaugaauaugagaccagugcaaacuguauagaacaacccugcccugaaaaacaaaacaaaacaaaacauuuccagagcuguccgugguggcuucggugcuguugcgcaagcaucuagucugacucaugcuguggcucucauugcucaguauucaucgugucauuagcucccugggcucccagaucagccagucguugugcugcuggagcagucucuaaagaugaguuuauuggcuguacagcuuauuggcuaucgauugcuuuuucccaauggaaagugaugguacaaggagacauuguuuaaaacaacuguuuaagaagccaugccaaauuugcagguaauggcacauugaagucauuguuuaaaauuuuuuuagguuaaaaucuuucguaucucuuccagccuuuuuuuuauuuacuacuuuagacaccuagauaaauuuuugagcacaguguuggagcucagugauuaugagcacacucauuggcucaagcuucugauuuuagucauggcuaugaacuuuucucugcucccugguugaccuaucagaugggaauaauaaaggcaccuauuuuugagguuguugugagaaguaaaggauccuaugucaucagucagaacagugccugccacuggguagccagcguuuguuugguggugaauacucugaaaggaggagauuauguggcuuuugguuucaguccuagcagcuggcugcagugcugugggcuguuggugauucugucgcauauggcaggacacagaaccugagcucgggaguggacuuucuucacccucccccccagcggauuagacaaugcuguccacauuccgggcugcucuucucucaguugcuguuccucuguaaaaugcccucacagacacaccugcagugugcuuuaggaaucucccaggcaagacuacucaccaucacaguguuuaaucacgauggucauuuaguuaaaaauggaauaagccacauucaguaacuggcauggacucucagaauaaaaacggugugugacccagaaugcuauacaaaauacaguauaggccaggccaugcuggaacuugugguaggugugaacuacccugccgggcuuuugaaugacaaugguuuuggguuuguuguuguuguuguuguuguuguuuuuggaacuguguagcccuggcuguccuagagcuugcuguauagacuggccuugaacucacagguaaccacuuaccucuaccucccaagugcugggguuaaaggcgugcgccaccacuaucuggcugaaugacaguauuuuuuggagaagcaaacaaaccuuaaaggcagcauuggagaguuccuacaguaaggugaagacgcuccuuagugugacugaagaugaagggcaaccuguuguuuuuggagcacagugggaggagcagggguagaagaaaauucaguuacagacuugccacuguggacagcugaugcugugcuagcaaggccuucuuaaacuuucugcaagugacuccuuuaaccugagagauuuuaacaugacccuguaaauaugaauauaaaguagguauguaaaacauuuagugauaacagagauaaaagauacuuauaguaaugggaugggucugauuguugaguuuuacauaaagaauuaaaucuuggcuaaauaguugaaacuauaagagauggcacuuucaacuuuuuuuuuuucuuuugagauaggguuucuuuguguagcccuggcuauccuacaacucaguuuguagacuagacuggccucgaacucagagauccacugggauuaaaggcaugcacccauuauguuucuauaagaauagaaaacuuuaucuauacauauaauacauauauuuuacauacauacauacacuguaguucauaacaugcaguaaucuuuaaucugagccaguguuuggacagcuuucauugaaauaucaagguguugaugagcaugcaaugcagaguacgugugcuauauguucagagcagaggcugcagugaagucauguguugcaggaugaauaaacacugccagaaacaacucuugacuucaucuugggaagguuguuagcagccuggaacucucgauucuccagcuucugccucccaagugacaagacuacacucauuggagcuggagauaccguugaacaguuaagaagguuuucuagaggaucugucugaguuugguucccagcacugugucaggcagcucacaacugccuguaagucaaggcccaggaagacuuaaugccucuggccuccacagguacccacacacacaugcaccuaauguaaaaauagaguaaaucuuuggagguuggagagauggcugagggguuaagaacacuaacuauucugauagagaacccugguucuuuuucuggcucagacauguaacaaacaccuacaacuucaauucugggggccugacuuucucuggccucacugggccuuugcaugcacaugguacauauaaacuuacacaggcacauaaacacauaauaacuucagucaugugccaccguaccuagccacuuuucucuauuuucuccaagagccacagguuagugcuuuaacaagaaaugcgcuuaaagccgggcaugguggcacaugccuuuaauuccagcacuugggaggcagaggcaggcggauuucugaguuagaggccagccuggucuacagaguaaguuccaggacagccagggcuacacagagaaucccuguuucaaaaaaccaaaaaaaaaaaaagaaagaaaaggaaagaaaugcgcuuauugugcugcuccucccagucauucuaucuuuucuaauuuugaaaguaauaaaaacucuaaauaaaguugaaaaagaaaccaaaaacauaaaguaauaccaccaacuaaauaauaugauaauuguggcuuaugaaccuugaauugacaaggaucuuuucaauuuuaaaacuucaaaugagcaaauuauauacuuaaauuguuuagauagccuaaaagguuuuucugcgucagauguagacagcaucaguaguuuguuucuaaccuucaaugaaagauaaguuaaaauaaaacaguauggugaucuggaagagcugacacgcaaaacgcugcuugggauuuacaacuuucuucccaaagaacugcacuucaggucuauguuaaaaguguugcgaugucuguugacccugcguguccuuugcagcagcucuucagagcagagcaaagaaccugguguuccuguguucuucccaaaugcauugcuggcugaaagugugagcaugugcuuacagacugcgccaacagagggagccaguaacagcacugaauuaccacagggaacaaaagaugagccuuaccggccaucagauaaccagaaaauuuaccaggacuuguugguaaguagaccauuuuauuuuugugaagugcuuauuuaauauaagaaauacuaguuaagcuuuccauagauuuaaacugaaugagaucuugaaauagagucaucuuugaccacuaacaauaauuacaauauguaauuguuuagauuuuucguaaauuuugauaacauaaaugguaagcuuucuaagucaucagauauuuaguaagagcaaacauuuguuuguucuugaaauuuuggcucuaaaaaaggagaaaaaccuauguaauuacaaguauacuagguaauuuauggaauuugacaagauaauauuuagccuuccuugugacaguuuccuaaaaucuuaaaguugugugcuugagagagggcaguucacaaagcuugcucucuauuagaagacucccgaucagguggcucacaaccacuuacauuccaccuacgaaggcacacacgggcacauaaauaaauaauaaacaaaucuuuuuuuuuuuaaucuucaaaggguuagugauuuuuagaugcauucuuuuucuuuccauagggccaagugaaccaccuacuaaguaacgccucccaagaaaccgaagaaccaccuaccaaagcgguaguuaccaaccgugaaugcgccaagacccaaaauacucaccaugcaaggaaaaaaagacacaauucaggacugguagacaaagauuguguacucagugcaacuauuaaacagcuaaggagccuaggagugaaaaucgacucucccacuaaagugaagaaaaaugaacagaaaguggaucaugccagguaacuagguuuuguuuugaagaugaauaaauguuagguauguugcagcacuccuggaaagugugugcuugcgucccaggccugcucauuuacuguuuauugaaagccuucuguauguagaaugcaaauauaagauaaaauacaaaaguuccccuucccucaaauucuucagugugucguagucaugguuacuuuguguguuucuuucacauucuccuagaaaugugauuugcguggaugcugggaacugaaccggcucucuagaagagcggcaaaugcucuuggcacugacgcaucuucacaggcccuucccugugccuuauagcugcauuauauucuguuguacccaugcacuauauaguauguugagcccccaugcucucugaacuuuuauguacuguuuaagugcuaaguauaugucauucugcaaguacuuguuuaaauaguuauaauaggugcuuuagggggcuggugagauggcucaguggguaagagcacccgacugcucucccgaaggucaggaguucaaaucccagcaaccacaugguggcucauaaccaucuguaacaagaucugacgcccucuucuggagugucugaagacagcuacaguguacuuacauauaauaaauaaauaaaucuuaaaaaaaaaaaaaaaaaauaggugcuuuaucacugcuugccgaauauuuauauucauuuuaaucuuuaccaauaguacaggaaaaugaggcuaacacuuuugaauauuuucucuuuuaaaaaaauacacuuguuugcuccucccucucuccucuuucucuccucucuccucucuccucucucuccucuccucucucucccugugauaucagggaacaauuuagagucaguuuuuuuccaccauguggucauugagcucaacagcaaaugccuuuaccaacuaagccaucccagaagcccugacaauuuuuuuauuucuauacuaagagacagacucagacgucugugaccacacagugauuucuucaaucccaagggcuccagggcucucuccuagucucggguaacaggcauguauaggaugcacauauguacacacaggcaagacauuuauauacuuaaaauuaagguaaugcuuaaggacaaaaagcaugagaaagaacuuuauauaucugcuuggguucauaauuucccaugcuucccaugcagaaucguguuuguuugagcaacucauuguguagaccagguucauaauucucuugccucagcuucuuauuacaggcaugauuaagacucccauuagggagugaauauuggauaauguaauguauuccuuuucuuucuguuuuugcuuucuguucuguuguacuuuguauuugggagaacguugggguuuuuuuuuuguuuguuuguuugguuugguuugguuuuuuuagguuucuuuguuguugguuuuuuuuuugggaguggggguguuggguguugguuuggcuuguugugcuuuuuaacagguuuuguguagccuagauuggccuuaacugauuauccuuccucggggcugggauagcaggccugcagcaccacaccuagcuuggcaauggugcuucuucacaauagccauccuauggccaugcuguuuguaaaacuuugaaacuggcaagucagucaguaauuugcauucagaccgugaagaugggccaccuccugguuauaauguaugcucugaaucugugccugcaccaucuuaagucuggggagucaguuuagaagccuucguaagauuaaaguggaaacuuuuauuaguuuugcagaaugaaacucuuugcuauuuugaauaagguaaaaaagcugccuuacuuugccgugucuuucaguguuuuggccugcaucagcccggaagcagugaucucuggauuaaacuacaugucguuugguaauguuggcaugagcagccuaagucccacugguguggaucugagcauggaggccaaugccauugcucugaaguacuuaagugaaaaccagcugucacaacugucucuugcucggucaaagcagaauaacggugacuccucugucggccuucuacauauuaauucagacaggaguacaguggggcuuagcuuaguuucaccaagcaacaugucauuugcaaccaaaaaauacaugaagagguauggacucuuacaaagcagugacaauagugaggaugaagaggagccucccagccacgcagauagugagagcgaccauguguugaacagaaacccagcaugcagaccugugcaauguggucaugagaaagagccuucuuggaaugccugugaaauagcucagugcucugacuguggcucugcggacacacgcacagaugugccaguacugagaaauaucacaaaucaagcugugcagccuagagcaacagagcacuugaaugaagacucugcuauuucauuaaggaaucuuaagccaaacccggcaaugaaccuccgaacuggaaaggcagaguuuacucaucaucccgagaaggaaaaugaaagagacauugcaguuuuucccggaaccuugccaucuccugagacuuuaaaacaaaugaauagcauggauucugugggcaccuucuuagacguaaagcgucucagacaguuaccuaaguuauuuuaacucuucauuucucuuuuuguggugugaggacuggguguguauugauggcacuuaagaaauccagaccuuugggauuaagacaggguuucucuguguagcccuggcuguccgggaacucaauccauagaccaggguagccucgaacucacagagauccaccuaccucugccuuccaggugcuaaguaggacuaaaggcuugcaucauugccuggcggccaugaccuuuggaauuucuaauaccuuuuagagucuuuucccuauuaguagcaaauuaacauuggcuggggguugggggugguugacccaguugugagguggcuucuuagugggaaggcuggguuuauucagcaucacugaaccuaaaacagaagcaagacucuaagaccaggugccgcagcuaaucaaguucaaauguguuucccuguaccccagggccuugcauuugcuaaugggcuccauuacugagccugaccacugagcuauauccucaacuguagauuuuuuaaaagaaggucucaggucaaucuguagccuaggcuggcuucagacuuagaauucugccuuccucgucuggcucagguaugcacuuuacccugugucucccaaaaauaguuuuuuuacauaaucauaguuuguuuccaaacuaagaaauuacauagacacaauacugcauaaacagcagaacuuuucauugccuuggguucuuauuggugggaugaggcagugcugggguugaacccagguaccucacacaaagugcuauagcacugaacuuuauaccucaguccaugagguguucuguguacucauugauucacaguuuuuguguauagauacaugaaauuauaucgcauagcuuccacuaaccuaagaccuguccucccuccaucccuaccgauagcccuaccaucaccagaauguuuuuaucauuuuaagaacauuucauaaacagaauuguacuuuuaaaaacaauuuuuuauuuagcauucuaccuuuugaaauguacugucuuacuccaaauaauauccugagaucuauccaaguguuggguguguugguaauuaauucuuuucuuauucuuuacuucuauucccccccccccaaguuguuucaaauuguuguuuccaaagaaaaaagaaaagaaaaaaaaaaacccucauugacuugaaagauuuagguuucugcugaaguuaaaaugugguugcccuguauuaaagcuugucucauaacugaaaaaaacuga

SEQ ID NO: 2037 - RNA, 39659 nt, Mus musculus
uggcaagccuugcccggggccgcugccaaaggggaagugagcuaagacuggagcuauggcccgggucuggagccugcggcggccgccaccgccagcacauccagagaagucgcgaccgaagcaggggccggagacgcggcuggacuggccgcggcgcgugugaguugcggaagucgcugguggcggaacacuucaggcuggcggagcgguggucaccccucaucacugcgcccccuccaggcccuagcagcagggcucccgcuccucucgcgcgggucucuacaaacucaggacagaagccacgggaaggugaucaucccgaauccuggugggcgucccggccugggaguuuucuaggcgcccaggcaguguuggcgcucuccugucaccaccucuccaguuaaggaucagcgaguucccacugccugcucugcaaagucuccucuccucccauucaaaaacaaguuuauuuuccuucugcauugggaaucuugucccagagaucuaaaguaccuuaguuuuguguaucuuucucccgcuuucuggagcacuccuagaaauauugguugccuacacgacuuagaaucucgugcuugacuuagcggguuguuuuguuucguuuuccuuuugacagguaauaguuguuucagaaauuuauccauuuagaucuccaguuccuuggccaucucuauguaacuucccccaccccccaucccccauccaccugaguccaauuuucucugggcucuauucuccagcccucaguagaucuggucagucccaccucugggugggagugaucagggggcucaggcccaggauuuccaacccuggaaggcagcuccaagucagcgagagaguuggguguuggcuacgaaccuggcagcucaggagugggcccgccacucaccccccacaaaaagaugaaaaagcgcaaagagcucaaugcguugaucggccuggcuggugaccaucggagaaagaagaccaagcaaggcucaggcagccaccgccugcuucgcacugagccuccugacucagacucagaguccagcacagacgaagaggaauuuggagcaauuggaaaucgcucucguuuugucaagugaguguagcaguggggagggcugaaaugggcaaaaggcaucuugcacuacuaccagccgggcaaauggaugagaaggagaggggagucccuuggaagaaaaagggaaguaggccuuggaaaacagggagaaaggauguuggacagggcaaguucuaacucuuaauaaagaguaagcagucacucuaaugucuaacaagagcuucaaaucuaggguggaaguguggacuuggggaaugggcucauagcccaagaaggaauuaaaaagguuacucauggagacagaggagcagagaggcucuuggggcuaggcauuuuuaaaaaguaggucaagggaccuuaagaccaauacucguuuuguguuucuuaaccagcuuagauauuggugauaggagaauauggugaagggcuuacuguugaaagugugaaccuucgauaaauaauauggggguggggggagcagucuuuuuuaccaaaccaguuucagguagagcaaccacuaaacaaaugagcuuugaggauugggggauuaagaggucaguuugugaggcaacugaaggaaaccucagccauuuggaccugucagagagcaaacuaaaagcaaagggaguccguugggguguagagaccagaguuaggcaaagggcuuggguccuaaaagauuugugaucuuuuagcgggcucagaaucugugugcuuuuguuaagacugguuaguuaaggacuuuuccaaguuuguguugugaaggucaucugaugaagugugagucucgaaaguugcccugcugccuuaguuuagaacugaaaacuagaugaaguuugaugugaaaucuagugugcuucuauuucuguacugccaaggcaguuaaguuaaagaauaucagguguccacuuaagccagcagaucuaguuucucucauuccauuugcaguaaaacuuggucaagaguuugugaaguuucaauaaaugaggcaaggucuccugggcuaagugagcauguauggggggggugaggguguggaaggggauaaauuacagugaagggauagaauuccauagaaccacucauuuuuacccuucuuucuguccauucuuucuuuuuaucuuauuacuacuaaggauugagcuagguucuaguaguaggcauagaacuuggcaaucccucuuccucagacucccagguacuuggauugcagaugggccacugggcccuucuugucauuuacacuucucaaaccgaguucugcuccaaagaccaccuuccugaauugacagcagugaucuagaaccugcaagcucuucccauggcccacgggaacucccuguuuccugugcaguuugaaaccuuuguaccccguagaacuuuucacgggucauauucaguaauuugcaaccuccuccuauuagacgcaaguguguuauccugugauccuugguaaauucauuggucauucauuagagaagauaaucgcauaggagcauacuguugcuaauaaagcuguucucaucacagcuaccuucucgcucauuggugaauguuuucuuccaacaggggagacuaugcccgaugcugcaagaucugcuguccccucugugccuuugucauccucgcagccugcguuguggccucugugggcuugguguggaugcaaauggcucucaaggaggaucuggauguccucaaggaaaaauuuagaacaaguaaguggucagguucucuucaagucuugggggaaacuggcccaugcugaauuaggaauuugcccguucugguaagcaguugugcaucuuguucuguacacuagcuuaacugucggcuuaacuguaguagcacuuacuugcuuuucaacccauaaacaagcccagugguuauguaccaucugacaaguagcgucugaaauuaugacacugcaguuaacucaaugcaaaggggagcaacuguaaaccagaaaccugauuauacucaaccuacagccuagccccagguacaaaguggcuguugaaauaccacaguuuccuucuaccuuacagagccagcaauuaaaauguggaagcaucugucaggugacuuccucuuucaaaacacuguguaggaacauaggaguggacagcauuuauucuaagagccaccauuuaugaagugucugcuugugccaauugacaaguaaauuguuccccaaacaggccucugacauaggcauuauuuugcucuccccacucccccgugugugugugugugugugugugugugugugugugcgugugugugcgcgcgcgcgcgcgcgcgcguguguaugcacaugccugugcagugguaaagaugagaauuacuauuuguguucuuagaagaggaagcuggcugggccaaaugguucaauagguauagacacuugcuggcaaaccugaguucauucuccgagauccaccugcgcuggaaggagagaacugacucuugcaaguuguccucuaacuuccacagacaugcuguggcaugcacauacauacauacauccguacacacauauauacauacauaaauguauguuaaaaacaaacaagcugccgggcagugguggugcacaccuuuaaucccagcacuugggaggcagaagcaggcggauuucugaguugaggcuagccuggucuacagagugaguuccaguacagccagagcuacacagagaaacccugucucgaaaaaaaaaaaaaaaacaagcuuagagaaguuaaguagguuguuuagcaauuaaguguauacagcugagauucauaccugguccucuugcccuuuaugcccaaaucaauaucuauagccacugcaguacugcaguaugguuccagugccuguagaagcuucacgagugacuacagguggccacagauuccucuguaucagcuggggucaguagucugaagagcuuaggagcugcuggaagggcugguuuucugcauguguguguuugguguuugagcucagagcaagaacuaagccaggaggcuucuuuccacaagacgaugguuuguggcaucugcuccaaggaggaaaaguuucaaauaccaugaagaucaccaucuucaaaguuuuagggagcauuugauccuuugaaguauauugcacauugcugaagaggugcacugaucauaacaguucugaccuugaacccagcacagcuaaugaacagauuugucucaugaagggguuuuguuaagagaauuuucuacuuacaaaauaucauauauucuaauuacaacguucaguuuuauaaguccaaacuacuuuuuuuuucugaaagacauguuuguauagugguuuccaccagguuuaacuaacaaauuuuguucuuuuuuaacaauaguguaauuuuugguucuagauuuaaagaauuaauuuccuaagcuaaggaaccaguuucaguuuagucacgaaugguaauagcacaccagcaaacugaccacaggcuucccagagcucucacuguaaaacuggaauuugagcuuucacuuuuccucuuaauccgaggaaaucacaaccuccugaggcaggaggaucagucagcuucucuuaaccuacagccauucaagcuuugaaggugacaaaggacagcuacuccucagaguuuaucucuagugacagugcuuuuaaaaucuuuuaauauucacuuugguuuucuucugacuuucugguccaggguugggacuggguaaguccacaguuguucgucagaaucauccugguguauauggcugaauuaaaguacagcacaaaaaaggaugugcaaccuguaggguuucucccuguguaauucuuguuuuuggaacauugcacauauuuuuaagcuuguauuuuuuguauguaaauaauaaucauaacuuggaaacaguguugaacuguauguuaacacugagcacaccuuucugcccuaugaauucuccauaauuaguugagcuucuugugacauaccuuguuuugaucacauacagcaauuauauguuuauacauuucauacauugcucaguucugcccucuagagauuccuuucugcagcuaugcugggccuguauuuacaggauaccuuagcuggccuucccagggauuucuuuguuggaaaauguaagacauguaguaggccugacagacagucaauaaauacuugcuaagcauuuguuaaugccaguuccuaaaaauaguauauucaggagaugccacucaguccauacaccugggcugugggggccagcuugcuauugaggaagauuuuccuguagccagaacugcauuugucagccaccugaauaaagcagguuuggaauugucaaucuuauuguguuguuggcuuugcuuugccacgauugaaauguuaguggccacugagaucauucagaggacaagggcucuuaccaccacgccugaugaccuaaguucagucucuggaguccauguggugugaggagagccacucuugugagucauacucuuaucucuguguccauguuacggcacacagacaccacaugcacacauaagcgcacacacaagaaagagaaagaaaacaaagacaagcaaggacuucaugagggaggaaagacuguggucugccaugcucaagccagacuacuauggacugguugcuuacuaguuuugguuucaaaaaaaaggaaagaacaguuaucuugacuaaguggaguaauuuuacuacauuuaaauaaucauauuuuaaaaacuauucuuguacuuuaaauauaucucaauaaguuaauuuuuauuucuucuuaaucuaauaaaacaguggagcuuaucagcucagauaagaccaccugccugcuugacuugaaugccuuuugagaaaucagagccucuuguuccucauuucaauaauuuuuccaaggaccccugaagaacaggagugcuggggggaugccuaaaguggaaagcaggcuuauucauggcuugcuuuuucuuugcagugaggagugacuugauccuugaauucaaagaccggcuggccuucaaaacacuuuuuaaaaaaugcauugccuguauguuuguuuguaugagaagauugggucccccugagguggaguuacagacucuuguaagcugccauauggugcugagaaucaaaccuuagacaucuagaagagcagcaguguucuucacuacaaagccauuucuucagcccccuucccuuuuuuguaaugauguauuuuucuguguggguauuugccuggaugugucugcacuguguagaugcaguaccccggaggccugaagaaggugucagguucccugagcuauaauuacagacaugugagcuugcuuguagaagagauggaaaguaccaaccagucaggcgucuccucuucuggucagccagggaaaguagagguuugauuugauguuuuauacaaaauguuagaugcuuuugugugacugugcuacaaaggugugucacugacaucuuaagcauccuaaaagaguguugguccugugagcacuuuuuuugacuguuugcucucauuucucacuauaaaauuagaacaaucacauaauucuuucugagccuauauuuucuuacccacacaugacacgugaaguuguauuuuugccucaaaagugcuuuggucauuacucauguucuaguaacccucccuucaccucuagauagagaacuuuagggucuuucuauacaguggugucagguagaggacuggcacacaguagaggcucaggaauaugucauuuggugauaauuacaucaaaauugauuauaaacuaugggggcauuguaugaaugcaaaacauaacuguugacauagguauguuguguuugaagaguguaugcagaaauuucauuuccuaaucauaaagauggaaaaaaugagaacuagguaaguucuuuugagauucaacacauugaauuuuaaaugagucgcuuucccuggugaaagaacaugaauaaguaauuguaaguuguuuguuugccauacuuccauuuauguaacaaaagugccucggcuuggcuugucucuccuaaaaacccacaucagauaaugauuauuaugauccccucugggcucauagacuccucaggaucccgaguguccucagggcuugcuaacaucauguaugcauuaguuaauaguuguagcucagguuauuuaugucucugccuuacuucuuuuucacuucuaaguccuauuuauugcauauagacuucaggaaagagacccuccaugcugaugguguuugaccaccugaguauggaaagcauucaugggauggcuuuucuuuacagccuagcugaaacucuauaagcaauucagugacacagagcugcauucguuagaaugaguaaugaaaugcccuuacugacugagauggauguuuucugcaaaccauguguaaaucaaaugcuacacuaaaagcacucaugaaagccuguuauuuagaaugcaauccuauggcagcaacuuuugaaaaauaaugaaaguaucuaauuucauauugugaauuguuucguagugggcuugcuaaaagguauauugccaccaccuucgguuuucgugaggccuuguuauuguuaaaugugcuugcuugucugacauuuuuacuuucugaguuuucuuuguuggauugaagaggagagugauguacugagauauaugguugggaggucagcaaagacuagguuuauuuagguaacaaguauuuaccaagugcuuaaaaugauauucuaagugcagaccauacagaaauggacaaaaccaaguccuggaguucacauuuuaguaaauuauuuuauaauuuacuguaugccaguuugggggcucaaaacacugucucuuucuuucucucucucucucucccucucucucucucucucucucugugugugugugugugugugugugugugugugcauacaguaacuaaucagaacgucugugacuuaaggaaaaaugacguagguuuuauucuggaagaacagccauuaucaauauuuuauuuuccauuaagagaaaaaaaugcuuuccacaggaggaggagagugcacccauggcuucugccucgggcuccagaucccuuaacuauggaggaauuauuuccagagcccaaaugucccccugccccaccuggcacguuuaucuuguguuucaucuugagcuuuuggauuggugaagaaaacacuauuugugaaauaaucuuauuccucauacuaguauuugaauacuuccucucagucagccaacuuaaaguagaagaaaauaaacacuuagagguaguuuguaauggcacuuugugcauccuugggauaggaguugucaguccaguugacuaauaugaaagcuggucagacauguaucugucacugugugccugguuaaaaguguuaaagaugcacauuuacaucacagugcugcccugccccuccucuuuccuccuuuucaguguaauuagguaauugugaauuaagucaucaccaccccaaaauuaauucacuauucauuaaucucucuucuucccuucuucccuaccuugugauugcuucccccacccccaauuugggaccagagggaaugugaucuuuauuuacaauuguucuuacuuugcuuucaguggagucuaaucagaagagcucauuccaggaaauccccaaacuuaaugaggaacuucucagcaaacaaaaacaacuugagaagauugagucuggggagcugggcuuaagcagagucuggaucaacaucacagaaaugaauaagcagguagugaaagugugacuuuauuccuguguaagcuguggaaaugaauuuacauugguuggugagcauuuaguaugaauuuaaaauucaaguuuugucuuuuuaaguuggaguuuacugugaucacauguuaaaauaguaaaauagcaaaaaaaaaaaaaaaaaaaaacaaacaaacaaacaaaaacacacacaaaaaaacuaccauuugccaaguguuuaaaauguuaacccuuucugcacaggguagagcauuauagagggaguuauaaauaacugagucaggcaaaaauccucauuagaugcagucacguguucuuaaaugagcuaaacgagccuguucauaaaucacccacucuaugguauuuagcucuggcugcaggaaguagacuaaacaccauaagcagcuaaagugaaauuucugaaagcaguggcuuaugauguuccuagucuuuccuuuggugggccuguguuuuauuuuaguuuugagacaguuucauuauguagcccaugcugaucugaacacuaagaugauaggagccaccacacuugucuguguuuuauuuuauuuuauuuuauuuuguuuuguuuuaugucucagaggaaggaagugacagugauaccaacucuaguuaucaucuauucuuagguucucgguaauuaaagaaaagcagauauucauuucuuuugugcacaaagaauagaaucaacugugacccuacaugcacacagcagaggagcaaugugggcagagaugaugucacagagaugacaucaggugggaguagcacagcucugggagagugaacauuucuccugggcagucuguggaucgaaguuggcagaacagggucaaccauucaagguuaagauugcuuugcaugacuuuauaugccccuguacaggggaacgccagggccaaaaaguuggaauggguggguaggggaguggggggcaggguaugggggacuuuugggauagcauuggaaauguaauugagaaaaauaccuaauuagaaaaaaaaaaaaaagauugcuuugcaugaacagacagacaaacaucaacugucugucuccauuuccuucuuauacauuggcauucuaggacugcucaaagagaaaacuggugcuuggcaugcuguaagauguccuuggacuuugcguaugagccuggagaaggucagacuaaaacucuuggcagauuaguagcaccacacuuuaugagaugcuagauugauuuauuaaagccaaccuacugcagaggaauucucuccuagcauagacccagaaggauggauggcggugagguagagcuggauguugauuccaaagggagcuuggcagucuggguggguuucuaaaguuagugcuacacaucucuagugcucuaucaagucagcagucaaagugagccaaaauagaaauaaaaguaaagauaauguuuacuauggcuagugguaauugucaauucagacgauccuaacagcauuuuuaaacaagauacuuacccaaaauguauucugucacuuaucaagaacuauuccuauuaccaaguugaagcuaauucaggcuggggaaaaggccaucugauugagaaaguuaaaauccaacuuuuccuuaaaucuuuaagauaguacaugaaucuucauuuacacuuuguuuuauucauguaaccucugguacuaugccuguucccucuugaugguuauaagacaccucccuuucuguggagacaaauguuuaccgagcugcuuuuauggagcuaaagccuuugauugugccucaguccauucagacugcucuaacagaaagccuuagacuagguaacuuaggaagaauggaauuuauugcuuacagcucuggaggcccaagacuccaggaucaggaugccaucagauuuggucucuggagaaaguagagcccucucuuaucaugccugaagaacccugccuuuuacugccaccacacuggagauuuugaagaugaaacuuuuaggggagcagcaacauucauacuacaguagauuuagagccaaaacgaugcaguuccuuaccccagugaucuuacggacaaacaguaaauaggaaaguaagcagcuugacaugaagcauguccauauggcucagaugcugagggcauauugaaaugaacaugcaacccagauuggagucagcuuucccagaaauggugugcuaagucugaagggggaauggaccagguggaccccagagaaagagaagguuacucucuaggacaguacagcugauccucauaauuucaucuacuugcuaaaaucuucuuguaaccucagaaucuguaaguaugaagcuuuuuaaucauccauugauacaugcacagcaacaguggcuuuugagucacccugcagacacugaaaguuggagcacccugccuucuuguucuguucucguacuguaaacaagcggaguucugggcuguaucccaugucccuuuucacauuuuguccucuuuguuagugguuucacugcugggggcuuccuucaggcgucacuuuccaugcugcugcuguggguucagucucagucagcagugucguuaaauauguuuaaccaggaacacguguaaccaggaacacguguaaaacaagguuauauauuaaauugaugaguuacugaaaaugugaccaaaggacucacaggaaccuagcccucacaccuagaaacaguguuuagcauucacuaauccaacauuuguuauagcuuuucagaagauaacuaccuaauaacaagaauggagugccuuuguaagacaauagacaagugaaaagacuuggaaagauugaggaaauuuuaguccuuccuuauagcccuccuugggccucgaaagaagccagagauaaaguaaaucaacaagcacuguuaucaaagaccuucugcaguucccuccugcucccuucugggcacuuguaugacagucuguugcauaugcaucugauuucacugggagacuguacacuguacucagccucaagcaggggaugaaaaucugggaaguggugauaacuguuguacauaaaauguuuccuuccaugaaaugcacaccacucuguuagcugaacagcauaugugaucuccuuucucuugugucacaagaaguuguaagugguauacccaagugcagauaagaaaauugagauuggccuggugguggugguacaugccuuuaaucccagugcuugggaggcagaggcaggcagagcucugugaguucaaggccauccuggucuacagaucaaguuccaggacagcaaaggcugcacagagaaauccugucucaaaaagcaaagcagacagacaaaauggaacaaauaaaaaagaaagaaaaagaaaauugaaacucaaagguaaaagagcuuauccaauuuccagcuguguaucaaucuagcauugagacauuuaagucuugggagccugguuuccuuccauuuuuauaagagugagcagggccaggugcaccuuuaauuccaguacuuuagagacagaggcaggagaaucucuggaguuuaaggccagccgucuagauagcaaguuccgggacagucaggacuguguagaaaacuccuauucauaauaauucaucauuugugauucucuguuugcguaacuuuuuccucacuauuuaaagaacauuaaguucaacccugaagaaaaaauagcauuucugcuuuugaaguauaaaauuuuauauuaagcaaauagucuaaaguggcuauuucuacuuaugcugauuaaaaaaaaagucagacuaugcauagaaguuauagcuuaucuuuuggcuaaaugugauuuuuuuuuuuccuuagugguuucuguuugucucaguuuuuagugucuucagauuguaaaauaugacauuuguugauaaguucuauuguaaugcaugaauccagucucacauucuagagucucuguuugagaccagugacaaugggagaguaccccuugucucuccaguccgacuauucguguauauguacuguaguuuccugcacaguuuggcucugcugaagaggggaggucuggaggguagacugucuggugguguaggggugcauaacugagcugagaccagucugugauccagcugacugucuagaguucauacccacaguguuuaugacgaggcgagaaggccuuaccugcuuuuauuacuucucuaguuuuaaguaaaauggcagcuuccagcagccacaccagccuucucugagaccauaaaguuccuaagauacuucugacuaguucugccauagccucaagauauuggaguaccugacagaauaguuucuacccagaucacucagagcacaguguguuauuaucccuuuaggauccaucugccaguugucagugaaaggaguuuauucacuaguguguauugugucacauaauagggcauguagaauaaucguaaaacuuccccgggaggaguccccucccuucauauucccacauagccacauagucucaugucagugauacgcucugcacugccuauguaguauaaagcuaucauagcuuuuaauauuaucagcuuauggguuacaccaaguguguauguaaauaaauggagacauucaguaugugguguccuacaauguccuuuguuuacugaauauaucuacauaucuagugauaggcauuuagauuauucuaguguuuugcugguacaaauaagaaagaccuguugugcauauuucuuugugccugugagcuaguaaucuucaagauagguuucuauaaaugaaguugcugaacaaaggauauaaacauuugagggcuauucuuucaaagcaauccuuuuccaguuuacauccccaugaacaauacacgauaaugccugucuccuuauguucuuugaagccucaguauuaucaagagcuucuuaaaggaauggaggugggggaaaaacacagccucccugauauaauugcugcuguaagagguuuuuagcuuucuaaaaguauuuuucagugugggcugaguaucucaccuuuuuguuuucaaauggauagaguuagagcccugaugaguggucugcauguuugagaacacuuagggcgguauacucacuaaaucucacuccuaaagaacugccacugauuaaucggucguacucugcaaugugcuaagagcugaggucacguguccuuaauucuuacaauauaugaaucaucuguugcuggguuacauuuaaucuccaaauguaguggcuuaaugcaacaaaccuucauuaucucacacuuucuguaugccagaaauugugaagccgcuuagcagaauguuaagcccuaggguugccgcuaaggugcacagaaaaagugccaaaugccaagauucuacugugucucgcauucucuccugccuuucccggcuugaccuguagcaagugcccagaaaguuagguguugugaggccacucauuucaacuauugguuaggccuuaguucucauccuaaaauuuagaauaagaaagcagucugguacucagacucuuugaagaguguuuugagucacauugcaagauuuguuagaauguaaaguugaagccugaaaucuuguguuacucagguucccccaguccccauuuaagcaggaauccagcuacuuagaaaccuaccccuaaguagcagaaaggaagccacauuuuccuuuuauucaauuuguuuuaauacauucauugcauccuucaguaagucaguggguauuuauugagcuccuucaggguacagaguaaugcugugguugagcuauugaguuugaaauauuaaucacauuauuaaaccaaaaccaagucccagaguagcugaaagugcuguucagguugucaggguaccauuccugaggacuauauuuugugaugaugggcuuuuacuuuguaaugugcauucccacuuggacaggaacaaaaguucaguuaaauaacuaagguguucuauuuuaccaaagugaaguuuugaaguggccgugaucaucagucuuuuccuguucagcugucgaaggauugugugguagucacugcaucuuuugaguaacugaaggguuuugcacugugacacugcuaggacuaagguaaagaaugaccuugcaagguucugccucuuuggcaccaguucaaacugggcagagaaauaggggguuguugcugcuuccugccugcaucuucccacaguacugcauuuccuccacuccugugagcugacagguaccugacauugugaacuauagaguuugugaagaaagcauauacucuacaaauucugaguuguuuauuaaucuuuuucagauuucucucuugaguucugcaguaaaccaccuaaaagccagcgucaagucagccgcagacuuacuuagucugccuagcacuguagaaggacuucagaagguaagugcugcaugugggcauuauggccaccccagugauagaauucuggcaccuugagaguucccuucgaaaaccugguauuugaaaucagcugcuucaaaagagugguguaguauaccauuguguucuauggaguacaaacuuugguaauuaggcccuuaguuuuuaacagguuacuuuaugguucauaugguuuuucauuuguccaucuggguuucagaauugcucuucugggaccauuguguuagcagguggugguuuauacguuucaguuugccguuacacuucaugaccaguuaugggugagaguuacuuuaaaccucugcuuuucugcuuuguuuuguuuugcuguuuaaagaugaucuaaaauaaaugcugaaguuaaaaauuagguagcagguugugacaaggguacuuuuaaacacucugggauguaaacugaaaaaagaauuacuuuggaaacaaguggguauuauuuucuaaaggcguuuguauaaguccuaaacaauuacuuguguguccaccauagaccccagggcugugugcaaagagcagugcauaguuucuguuuauuugaccccugguauguagacguagcagacaaaucucagccagaaggaugagagcaaggaaugccuagagcuggacagagagugaaaagaggugggagggaacagauuucucauugaacagggggaccaucaucucacaacaagaaaugaaggaaagguuguuaggaauuaagagccccuugcacagugaauuuuaaaucuaggauucauggcuuuuaaaaguuagccuguguuguuugauucaauuauauuccagacucuguccauaaaugucuaaauuguuauacaacgugagaaauuucuaaaccacaaacaaaaauaaaaccugauguuuuacaaccacaauauuguguguccgucccugugauuugcuacuuguccaguauggucaucugcucucaggguuucaauuaaaaaggucgaggcagcuuuaaugagacagauacuuaccguuacucccaagaaucaaguaggaaaagacaggccacuguagcuuuacagaggcaaaccuuagcagucuugcguuaggaaaggaaacuggcuuguucuucucuuuaacucaauaaacacuuguggagcuuucuccaguguguaccaggcacuuugcaguugguagaaauacuaguuucagacuuucauucuaggauuuacaugaucugucagcugcuuuccaaaaaaacaaccccuaaacaagagcucacuaucuuccuguguccugacaggcuuagccagccagccagugaggauucucaaacaguaggugucuuugagugucucuggcuuuuugcaacaacaaggcuuacauagcauaguagcuuagaaacuaucccaaauguucucucuuugccaucccgcuggacacagcuuuuauugcaaaugaugaugcacuuuggaaacgguaauucaucuccaaaacuuagcuagcuuucauuuaugucacauaauuuucuaaauauugaaaguguuaucauauccuguucucuuuaaggucuuguuucaguguaauuuuaaaaaacuuggguuggagucugaggaugcacuucuauugguggaguacuuaccuagcauccacaaagcccuagguuugauuuccagcaccaccuaaagccaguuguggugauacaugucuauaauucccacacauggaagguagaggcaggaagagagaaguuuaaaaucauccuugaguguauggcaagcuggacuccgugagacuuccucaaaacaauaaaauaacucugguuaaaaauauuaaugucacauaaauaaauaaauaaauaaauaaauaaaauaaguaaauaaauaaaguuaccguguaaauugucaguauauaaauguauaaaaccaaccaaauaacauucuuuugaauuuuuuuuuuuaaguaacuaauagagacugaagagaugaauuguuggcuaagaacacauacugcucuugcuggggaauagaguuuaguuccuguaacucuagcuccaggagaugcagugaccucuucuggcuuccacaggcacuugcauucacauacacacauccacaacauacacucaugcauaauuucuuaauuuuuaaaagaugacuucugagccaugcccucuguauacuuggguucuucaagacuaauaagagcaaaauaaguaguugcccuuaccuaacuacacucacugcugacagaguucuacugccagcuggguuuccuagagccaaaaauuacacccacccaauuuugcucaaaagccaucaccuaauauuccugacuguugacaguaauagcauuggcucuggccaucugucugccugcagaguguuuaacacacauaguucauggguagguauauuauccaugaguuccagacuuuauuaucuuuuauuuuauuuuauuuuauuuaguauuugacuguuacaaauaauuuuuuaggaaaauaucuuuuagaaagauugucguuuuccuuaauugggaaaauagccuaacauauuuauauaugggaaaauguucauauaaagagugaauguuuaugauuuuuguuaauuuuuuucagcauauguuacauggaauuuauaguuuggauauaguugaaauaauuaaaauauuuauuuauauucaguuaguguuuuaauguaaacuaaaaucacagcauaccacuauacugccauuagaaugggcaaaauuuuuagguuaacagcaccuauauuuuggauguauagaguaauaugaacucucuuaaacacugcaaauggggcuauaaaaugacacaaccauuuuagaaggucauauauaaguuuuuuaguaaguuaggcauagaucugccauauggccagcuguucaucuauguauugugguaaugagaaacucugaagggaaaugagggcacaagaccacauaaagauuaccucaugaaugcuuauagcagcucuguugguucaguaucaaauacuaaaauacuaaauguguacugacuguugaguaaacaaguugaugaaacuauaccaauggcguauaacaugccaaucagcuuagauauaaaugaaucucagguguacuuggugaaagaagacauacuaaaaaccaucuuagaaaguauuguucccuuuauguaaagcucuagaaaaugcaaacugacauauagagacagaaaaugaacaaaugguugccuuugggucagaaagggggaaacuacaaaaaggcauggagaaacugggggugggagcuaguuucuguugcuucuauuauggaaauaguuucacaggcuuauugugcauuuugaauacaugcauagauggcaugucaguuaugcuuaauaaagcucuucaaagggcugauguuccuauauugucucuaugcagaguguggcuuccauuggcaauacuuuaaacaguguccaccuugcuguagaggugauacagaagacuguggaugagcacaggacaaccuugggguuacugcagggcaguaugguaagaucuggacagacuacggacagucagcaugcuccuguucucuauuuccuguguuagucaugacacuaauuucccacugagcugagcagacacuacucuaccugcuuuucuuuaaaaaaaaaaaaaaaaagcaguguggacucauuggucugcaggcugugagucaaacaguuaaggaagaugggauugaaagcaaggucuuuugcaaacaugguauuggaggaaaugcucauaauauauuuuccaaagauggaacaaaaggaauaaaaagagaucagaaagguaucugaaagaaggagacagaaauugaaaacugucucauuuaucacugcaaaguaaaccacuccaacaaguuauuauuucucacucucugagcaucagggaugugagcagcauuuugcacccuagugcugagagaccaucuagaagaagaauggucaccuuaggugguucaacucccuccaggugucaggggaaugcagcuauauauauuaccuaaaccaugcggaauccauccuguaucagcccccaagaugagcucagggaacccacagaauagugagaaguaacacauuuuuguuguuucaaccccaaaauuugaggaugacuuguuguacuucuguggaagcaaagcuugccauuuccagccaccucaggcuccucaugcagcuccacacacaagccccuacagucauccaggcaguaaccgcuuuuuaacagcucccugcaggauuuauggaaguaaggaaaaggggcaccgaccacccuugcuauccugauggagaacaaguugaccucagacucuaaacuuggcaguuuguaccaaggaaccugaacugcaucagaguuccagaaaggguuuucaugucuucagagcgagugcucacuguuauuagcgagucacuguuguuacuauuagcgagucacuguuguuacuaguggagcuaacucaaaaggagaaguuucaauguagguauccagacucacuucugauuccaucugccacuauggaccuuuuguaacccauaauagcaaagaccucuccaacucaccaccccucugucuuaugcaugcucucaaguaaugaaccauuuccuaaaguacugucuccuagcugaguaauuucugcuuccuagaaccauugguuauuacacuuuuuuuuuuaaucuuaccuucaauuuauaugaaagcaagguugauaaaugucuaggauuucagguuuuaaggaaaacuguuuugccaucuauaauguuguaacugaaucaguaucuuuuaaccuucuauaacuaccgauaauauucucccuacuagcacacugugcuaaccuauagcuguaggcuucaaaggaaucagcuauguggcucuucccauaaaggguggaaauguaucaaagcaugauauacuuaggucucuacaaagacacuagagcaguggggaggaaaaggaagagucacucuccaguguagauaucagcauaccugaaagggaaaaccaaucauuuguauauuugcugugaauuauauuagauuaugcaguuuuccugcaguauagauaaugaaggagaggaaagaggaguuucugaggaauucauuccauuaagaaacugaaaagcagcugggcagugguggugcaugccuuuaaucccagcacacuggggaggcagaggcaggcggauuucugaguuccaggacagccuggugaguuccaggacagccaagguuauacagagaaacccugucuugaaaaaccaaaaaaaaaaaaaaagaaaaaaaaaaaaaaaaaaaaccugaaaaguggggcuggagagauggcucagcaguuaaaagcaugaaugcucuuccagagguccaaaguucaauucccagcaaccacaugguggcucacaaccaucuguaaugagaucugaugcccucuucuggugugucugaagacagcuacaguguacucacauacauaaaauaaauaaaauuguuuuuuaaaaaaaaaaaacugaaaagcuuauuaagaggagcucagauuccugggguaaucugggugcugcuauccagccucugcuucaggcugggcacccucaaaaguccaugauaccuucgacaccuuucagaugggucauacuauaaauuugggggaacuacuguagauuaaucuguagcuauauccugggaaggcaaguguguuccagggccauccagaugguuaaguaaccuaguaguuaauuguugcuuguauacuaacuuccauuuguguugacauuuccuaaaggagaacaauggaagcaaccagaucuugccaucaccuucaccuccaucagagcuugacaauaaaucccacagugaaagugcaaaacagguacuuuuugcuugggacuguggugggcccuggaggcaggcugagacugugggcuucacaucuacugccccagcaggugccucacaccucaccccugccugagagcugagcagaaagggauacaugcugguacuugggaauucgucucuucuccauacucugcuuccucccaaccgguggaauaaauuccuuuucacaucuugaaagauauaaaaugagcagauuauccuauaacuaugacaagauauaaaaugagcagauuguccuguaacuaugacaaguagcagccaggaccagggaaggaugggugcaaaaucuagaaagucugcuguuuugagccacagaaaacucuuaagaauguugagaaacauauucuugaaacuuggcguuuucuaaagucugaagauaaaaggcaggagaggaagacgggagggauacugggaucagaaugucauuaaagaguaaggaaaucucuaagaauuucuguccugaguuuaaugcccuuuaaaggcuauagucaucauuccuuuucaaguaguaaucaguacuagaagaugucaauaaaaauaauugagucuaguacuaaauaaugcacuacuugcugugcucuuguuuuaugagccaauucaguaauugguauuguuucuaagguaguuuuguucugacgaauuaggcuaugggacuucaguuaauaaccuaccagcaagugagguaaagguugggaaaauaauucccaaaaucaccacuuugagggaccagagugggaguuugcagagaguucucuucuuuacccuccuaucuagcugaagcccaacagcccaagagagggcauaguggaaacaguuuagaguaggaagaacaaagcagaucuaaacgguugguggucacaaccagaaguugugaccuugccuccuguccugcuugucuaguugcagugucagguggaucuacaaugcaguuuauuuccaaucuaggauauccuguaccugcacaacuccuuagaggaagucaacaguacuguaguggaauaccagagacagaaugaccuuaaacucaagggaaugagcgagacccucaguaaccugacacagagacucagccugauagaaagccaugugguugcacugagcaaggcagaacagagaacaaacgugagcuccagcacgguaagcuuuucagaucugcugugacacguugugcugguguguguugucugugcauagacgaucuuccccauccccugugaacaguagugugcacacuugagagaauacacguuuguuuuguccuuacuuuacaucagcuugaagccauauagcagcucucagaagugaguggcacgggguuuacaguguguguuugaaagggguggcaucaagggucagcugaaacacaucagcucacuacagcguguuagcagaaacaacaagucucucaauguugcccaugguccaucagguacagacacaugggcacguauuuucuuuucuucuuuucuuuucuuuucuuuucuuuucuuuucucuucuuuucuuuucuuuucuuuucuuuucuuuucucuuaagauguuagaaguggcugggcggugguggcacacaccuuuaaucccagcauuaggagggcagaggcaggcggauuucugaguucgaggccagccuggucuacaaagugaguuccaggacagccagggcuauacagagaaacccuguuucaaaacaaacaaacaaaccaacaaacaaacaaagauagauguuagaagugguaagaaugacagauaaaaaaucuugugccauuuuuuuuuaacccugaacuuggcuuacagauucauccugcuucugucagcauagaggaaaccuuuugcauauaauguuaggaaacccauuuaaauagaugaaguugcuuccaugaacaaacccaaccaauuagaucacacagaaaaaaauaugaaagcagaaaggcaaucaguugggaaggagauuagcaggagugggaggaacacgggguuaaugggggggggggguggaaugaggugauuaugauaaauauauucuguacauggauggaaaauauaaugaaacccaucauuauguauaauuaccuuaugcuaauaaaaacauuuuuaaacagaugaaaucagaguaguucagcuuccaaggucaaugaguuguuuucuguguuagagaacugagugacccacuaaaucacugaagcucacuggcuaugaggguuucugguuuucgugaucucgugaacaguguuugcuuuaauucacguuucaucuguacaucaugcugggauucacagggaucauuucauuaacagugauaggucuugcuuuuaaagguuucguagagcaaagacacauguacauuuuuuuauggaaauuauacugaaauucaaggaacagccaaagcuggaagcuaaccacucaugagauggagcccuggcacagaguuagaaaugcuugagccggcucugccgcaaugaaccuuggcaagcugccugaaaauggcuuugaaggguuggguggaaagaccuguccccuucugccuggcccuccugcuuuacaagaguguguaauuuacuacaaagcugugaagauuaaaggaguccuaguuuuuaaagccuuuugaacucagcuaagcuaaguaggggcuaagaacuuugggugauuugaugaauagugugccuugaagguuuuucaaggcuuauugugaaaacuuaccacaccauaucccuugcugucucugcccuccccuuuuuauuuuuauccagcaaagaaaaucaguaauaguauccaucuguccuacuauuucuuccagcagugucacacuggaucuggguagaaguuacauugcaguuuuaaaguuugugaauaaaacauuuagaagccuuuauuccacuuucucuccuugugcccuucccauguuauucucuucucccacuccuuugccauuuguguuuaaagugguucagaucccuuaaauaaaugugagaaauuuguuuaagaaguauuaagucaggguuggagagaugacucagcugguaaaguaggugccacacaagcgugaagacccaaguucagaaccccagacccacaaaaaagccagacacaguggcauaaaucugaaacucauuuguucuggguuugagcagagacaugcuggccagccagccuaaucaaaauggcuacuuccagguucaguaagagacccugucuuaaauacucgcugacauguguacacacacacacaaguauuugaugucauuuaaguuucaaugucuccccuuaaccuuuucuucuauuuucuuugcccucuaagauggagaauagggcugccacucugaaaagagagucuuuggugaccaacagaagugacacuguacaggcgcaaagcaugaagguaaggaacaggaagcuucuguaaaguaaaaacaaacacaucagcguccccaugacaccuacaaccagccauccccucuaauaggggcacuuugacccucugugagaaacgccaagacagagcaguuaguuauuggugaaugaaugaauaucacaugaggcacauaccuuguacuaagcacuuuacagggaacugggauggccacagugaaugagacagauaggugaccccuaugguggcacagcucaagacugaucagacagucacaagucugaucaaugcugcaguggaaaaguguaggguaugaugugggcauugagagggaucagguuggcauuccuaaggaaacaacuauuaagcugagacaguuauuguccaaguuuguuuuuauugcugugauaaacacuaugaccaaaagcaacauggggaggaaguuuauuauauccuguggguuucagucuauugucaagggaagccaaggcaggagcuugaagcagaaacuguggaggacugcuacacuggcuuguuuccucagcuuacucggcuccuguuccuauacagcucaggcuacccucagugaucugugcucuccuaugucaguuagcaauuaagacaaagccccaugcacauauccacaggcggaugaaggcagcuccucagcugagguucccucuucccaugucacacuaauuuguaucaaguugacaaaauuaauuagcagaguuaucuaaacuaacaauaggggacagaggcauagaugaucuaaaaaugguguccagcuuaaaaaucauuucauguuuaaauugcauucucaacacguucauaguccuguuaaguccuguugagauaaagggagagccaggaagauugagauagaacagcgucaucugagaugcacaguguuugaguucagaggauaggaaguuccaagucaugaacuuugcuaaaaccauauuacagaagguuuagauguaaaacuuucuaacuuuacucuuugauccucagcaaauuuguauugucuggauaaagucauauauauuuaagauuuuaaugcauuauaaggugggcuuuuauugagcuuuuaaacuguuucuacacuuuucuuaaacauuguuuaaggaaugacaacauuuuaaaaaccagauuuaaauguugaacacaaaagacuuaacagaugguuaauauuagaaaguaguagugauuucagcaguaauucauaucuuaacagucagaucagaacauagcaaccacacuucugccuaaaucucuggcuuuacguuuagaucccuaguguuguaacugucacgccagucagucagucucuccguguuaccucaucaaagcaucccaaccagauucaguuugugcugucaguaagcauuuagcaucuagguuuguuuguguguucauauugggucucccuaaauaaauccaguagccacuguucaguaacuauuaggguauacauuaggauagaacagggauguguaagcucacugagugaggcaugaggugcacuggugcuccuaaacaaaggcuuggccuuuucauacaguaaaccgaugccaaccacagaagaacuaggcugcucuccguacaauuaaguguauugguuuauauaccauccuagauaaagcugaaaauaaggccauguguggauuggguagacuuuagacccuaguaacaguuugaauuagaaauauuauaacuccuacuuuguuugugucucugacaguucuugcuaccaguuaaaucauuauaguguuccguugggugaaucaggggaaugcuugugguuugauugaguucugcuggguuuuguuaugguuuuguuuuuugguuuguuuguuuuuaauuuuccuucagaugacauggucacaaagugaugagauaucugaggcacuuuuucaguuaguauaaaauagcuccagaaaauaguguccccuauuauuuaggaagcaggugcuacacagcaccugaguaagggcacauugucuuuucugcugacacaugcauaccuuccucuauggacuguucacaaugaaacagaucagagagaauguaagauccuuguagcccccuuuaaacccagcugagcacuuaucaacacugagccccaaagacaguccuaguauuuguccaucccuucauugaccuuagcagggacauguaaaggccaaucuuaggugcggaaugugucuugggaguauagcagaagcuccagugagguguuaccccaaccuuaagccuuaucugaucucuguuuggggcagaaagaagauaauucaaauucucagguauccgagcuucgagaaaaacugcagcugaucagugcucucacaaacaaaccugaaagcaacaggccuccggagaccacagaugaagguaagcagcuagcuggcuucugaauauuucacgcaggcuugggcagccugucucccacacagggaguaggaacgguguccgccagcacuaaugggaccgagugagugaugccugagcgcaccgagcugaggcugaugcaccucgcuuucauuuagcaaaagcccauuuuguacuugauuuguacucuagucuauuaaggggagaacggguaauguuuagcuggaaauagacuucuccaugcugccugcauccaauuauaggcaaaaauguuacugucauagcuuacauuaaacuaguccuaaauguuauguuucuguuacugugaguccucuaaaaaggacucuuaaauauuaguccucuaaaaagucguuaacagguaaugauggaauucuuccaauuugcaggccacuugacuuuagguaagggcacacuaaucaauauuauuagaugcauuaauuaacaucuacugauuuaggacuugugaggcuguaacaagauacuagacaguauuggcuuugaccgcccuagcucaagcauucuucagcuuuggagcuguagaauagcuucccucaguuucucuccugugagaaacagaacuauguugaaggucuuguaacacuggcuucaucuugcuauauagcauucuuaugguaugguggcuaguggcucaugcccucacaccagacuuaauagccuauuucccaagaaaucaaaagacuuauccaacucaagucuuagcaucggucuuagucaggguuucuauuccugcauaaaacauuaugaccaagaagcaaucugaggaggaaaggguuuauucagcuuacacuuccacauugcuauucaucaucaaaggaagucaggacaggaacucacacaggguaggaacuuggaggcaggaguggaugcagaagccauggaagaaagcugcuuacugacuugcuuccccuggcuugcucagccugcuuucuuauagaacucaggcccaccauaccagggauugcaccacacacaauggguuaggcccuccccccuugaucacuaauugaaaaaaaaaaugucuuauagcuggaucucauggaggcauuuccucaacugaagcuccuuugugauaacuccagcugugucaaguugacacaaaaccaaccaguacagcaucuaagcauagaugacaauaaggcagguagagccuaaaguauggucaauuugguuuuuguuuguuuuuagauuuuuguuuuguuuuguuuuuugaaauauuugcaaguuaucauugaguugguauuugaaucuaaauacagaaauucauucaugguucauauauacauuguccuuauacaaauggccugguguuaauuuuauuuguuauuuuuaggucaccuuuauuugacuaugaccuaucacaugaagucauacaaggaguuuuccaccuguuuuaucuucugaaagauuuugauuuggggcauuucagauuuucagauuagggcuacucacccugugccagauucugcuucaggccuuaguguagucccgaucccucuucgcuuaucugcacacauccuucagucuguaccuuuaccuucauaguuacauugcugcuguaacucucagcgacuuuucuuaaaauauaccugcucuaguacuaggugaccuuugauacucacuuaauuugguguuggaauugauuguaauaaagguauauguguuugcuacagagcaaguacagaacuucacaucagauccuucagcauugccagaauuuucacagcuucuuagaaaccaaauugagacccaaguaaaaccucucucccugccugggauuucuagcaucaaagguaauguuaaugauggaaauguucaaaguuguaacuguuauaacuuguuaaugguuuuucuuguuuaaaaaugaaagcauaucuaaugaacuagagagaugauucaggugguuaaggcuugaguucaguuccuagaauccgugugaaaaaagccaggugugauggcacacuuacaguuccagcacugggaauaugcagacggguagauucuuggggcucaguguccagccagccuaacccacuuguugaguuccaaacuaguaagaaacauuuucucaaaaacaaaaaggugaacagagaccagagagauagcucagugccuaauagcacuuacagccuaaugaucuaaggucaguccccagaacuaacauaaagacaaaagcagagaguugaguaugaaguuguccucugagcucaacauaugacauguguacacccacacccacacacaucauacacaaacauaauaaucaucuauuuuaaaagguggacaguaccugaggaguaacaccugagauugcccucuggccuccacauaccugcaaauacacagguacacgcacagaaacacacacacacacaauuuauagcuaacauuguugggccagauacagaaagcugcccacaucuaaacagcaguuaauugguugagacagaauucaagcugaggcugacucuaaagcuuccauacuaccuuucucuuaaauguuguuuaaggucuucagucauucacuaagugcccuccagaccccaugucaaaggauggaauacaguauaagauacaaucuugccgggcggugguggcauaugcuuuuugggaggcagaggcaggcggauuucugaguucgaagccagccuggucuacaaagugaguuccaggacagccaaggguacacagagaaacccugucucaaaaaaaaaaaaauaaaauaaaaaaaaaaaauaaggauacagucucagccagacacagugcauauaccuauaaucucaacugaggcacaacaauaaagauauugaggccagccugugcucuauauagugagaucaugucuccaaaaaugucccuuucuuuccauaaggauagguugucuaaagcagaggacagaaaaagcaaacacaauucuguuagauuagcaaaacaagucaaaguugacuguuucccugcaacaggcccucugggauucugacagcgagcagaauaaguauucauacaaaggcuauaugucauagaacaaugucugccuuguucucaguagugucuuguacucuucauugugauggugaggcuuccugguugucucuugccgucuggaaagucguccaguucugaccacauaccuugcacugguucuucacuuagguucagaugccaucgugcucucccaggucuggagcaggugcuuccugugcguuaugacauguuuuacuugcuccuaauuagcauaugccacuguugaaauucccuaggaagaaacaguuuagcuuccgugaggaaagucucauggaagucuccuguucacucccuagccugcagcacagagccugguaggacugugaaacugaaugacuguguugcuuauucaucuugcaguuaaugcuuaacuaccauuacuuuucgccccgucugggguggcuuuccuuuguuuucuggaggggaaggcgagucauuguauuuacucucuauugaaaggaauucccaucuagccauuugcuguugggaagaaguaucccagcugcuuuucuggcucagggcauuucugaggucucaccagcugcacugccaggcccgcgaagcaacaggagugaggagggccuuucaggaauuuaugagacuuccucaauggaguagaucuugcacagaaauagcuuuuccucccuucagcacaucuucccaaguaccaaacagcaagaggcauguggagucaaagcaugaucuugaauaaaugaagaaaaauaaucaggaaagcuuuuaaagaaacacacacuagugaccuucuucuuucuauaguauuauaaucuuuucagugagcuuaagaacucagucaaguccuuuuuauuuuuuauuucuucuauaauucuuaauugugugugcacucucaaaggccagaaacaucagauccuucuggagcuggagcuggagcugcaggcaguugugaacuaccugacacggacgcuaggaacugaacucugguccgcagggggaggaguacaaacuccugaccacugauccaucucucugaaaccccuuuuggauuuuuuuaguuuguugguugauugguguuuguuuaaaguuuuuguuuuguuuuguuuuguugagguuuuuuuguauguuuuuuguuuguuuugagacaaccucauauagccagguugaccuuacuacucuguauaucugagucuggucuugaacucuggauuacaggcauacaccaccaccccuggaucaaauccuuuuuaaauuguuaaaggcuuuuguuggaaauuuucuaaugucauuuucuaaauaguaucuuuguuauuuuuuuuaauacagauuaacugguagcauuaaccaccaaaaaaauaaacaaacagauacagagauuucuaugguccuuuuuuaauggagauauaauucauacuccaugucacccuuuuaaacuguguaauugcaugggccuuaguauauucucaagauuauauagccaucaccuugacuuaauuccauagcauuuuuaucaccccagaaugaagcuucauacuccuuuaacagcuucgucugaggcuggccagaugccucaaugcuugccagcaagccugacacccugagcaggagccacgugguagaagaagaaagcccacgcccacaaguucuucucugaucuccacaugcaucuuacuauguacacauguacacauacacaauaaguacauagauagauagauagauagauagauagauagauagauagauagauagauagauagauaagggagaaguuuaagaugcacuccaguuacuccuacugucucaauaaacuuauuuaucugggauguuucguuuguagaaauggaaucauacaaucuguggccuucuauauacuucuuuuaucauaguucucuuuucauuuuguggcaugaaacaauacuuccuuucuauggcugaguaauagucuauuguaugcuauauucacacuuuguucauccauucaucaguugaugcauauuuggguuguuuccaguuuuuuacaaauaauaaugcugcugugaacaugagggcauagauuuuuaugaacaugguuguuuucuugaccuagugccuaggaauuaaauuaccaggucauacaguuccugaacggccaaaccguuguucggaaugugacuuccaguugacauucucauuagccccguaaggacucaucgcuuucccccacaucaucauugcuccugaugauggccauccuggugaugauaaaguagucuguaauccugacuuuuuuuauuucuuccaauuuugagauuauauuauaauuauaucaacucucccuucccuuucuuuccuccaaacccucccauauacaucuccuuucucucuuucaacuccgugguuucuuuuucauuaauuguuuuuacacacacacacacacauuccuaacuauaaccugauaaaucuguauaauguauguuuucagggcugaccauucgucauuagauaacuaauugaugugcucuucccuggauaaacaguuuuuccuacuuucagcaucucauaguuacccauauguaguuuuuuguguaggguugaagucuccuggggcuuagcccguacacuuuggugugucuauuguuguccuuguucaguucauauuuagauagucguauaggugagacuuuauaguguagcuucugacauucucguuuguuuguuuguuuguuuguuuguuuguuuguuuguuugagacaggguuucucuguguagcccuggcuguccaagaacucacucuguagaccaggcuggccucgaacucagaaauccgccugccucugccucccuagugcugguauuaaagguguacgccaccaugcccagcuagcuucugacauucuuaagagacaaaauugcaggguaaacuccuugacccucuggcucuuacagucuuuccgcucuuccuucugaaauguucccugagccauagguguaggagcuguuuuauagaggugcccauuggaacuggucuccacaucucugcauuuugauugguuguaguuuucuguaaugguuucugucuguugcacuuuuccaugguuauaaggacaaauauuuaaaauguuguuaggauuuauucugguagguucuccuccaagauccaugacuucacuaggccuggguaguugaccaaguuuccaguacuaaacacaauuucccuccuaauuuaagcaggucuuaaguccaaugagagggccgggcagugguggcacacgccuuuaaucccagaggacaaccagggcuacacagagaaacccugucucagaaaaagaaaaaaaaaaaaaaaaguucagugagagagcugaugguuacugccaacauaugcaugccacuacugcacccuugggguuaucaugccaugcuggucaucauugugucucauaagcaccauaucugugugacacucuugguugcuuaccuccuuuggaagcuugauuggcaccucugguaccaaaaaccuuaguccuuagaacagaggcauucaggucaguuccagcucggggccucugacucugugucugaagugaauggugucuucagcaauaagaacuuaaccuuccacucugggaggcaaccaauagcaaugguagcuguuugggggaguuuggaagagucucuugaacaaaccugaccaacaaaaagaggauuucuuaugccuaauguugaaguuaucuuagguguucucuuggagggaccauugucagccuagacgaggaaauuucauuuaaacuauauacguauuuuuacacacagacuuaguauauuacagguggggaauuuuuaggugaauaguuaaucaugauuccuaugacuucuucacacguccuuacuuauuuuaccuuccucuuuccuucuguguuuaucucccucccaauuccugauucuucaacuacuuaauuucuagaucuagaaagacaaugguacauaguagcaagaucaccauacuggguaauauuugauacacuucagugcuuuucaaaguugguugauugcagugagaauuuugguuucuuaaaaucagagaaauauuauaagaauaaguuuuuguuuuaauuccauauggggcugcuucagguuguccacagcagcugacuaugauuugccucaugcucuagcagagucauaguuuuuacaacgacagauaguuucugugauuaugugacauuuagaauucugggaucucuucacaggguauaucaaugcuaggcucccaagcagcaggcuggguuauugguuguuguugguugcaguuggucucuguuuaaguagccaggcucaaagaagaaacaagauaaaaagaaaaaauugggugucuugacugcaaagaucaaacgucccaaggaacucaauacuaccccuaauuagcaggaaauagucuaaggaugauguugcccccuuuccucucuguccuuuuuuucucccuaucuaguguugggguggguggaaaggguggaagaaaaaaaaaaaaaacguugccacaaaguagccaaauacuggcuacaguugaccuuugcauuuuguuuguuuguuuguuuuguuuuguuuuucgagacaggguuucucuguauagcucuggcuguccuagaacucacuuuguagaccaggcuggccuccaacucagaaauccgccugccucugccucccuaaugcugggauuaaaggcgugcgccaccacgcccagcuagaucuuugcauuuuauaacuauuagaauugagaaugccaucucacauauauauguaguacagaauagcaaaauaucuuuagagccauuucagaaaucgaaaacuuaagucagcaacucaaauggcaguuuuaaaaauuaaacauucuaacauuacaaccaaaagaugcacugguuugauacgugcuaaagaacaauggcaagaaaauauuuuuuaaguuuuuguuuucuacaaacccuuguuucuauaagaagagaaaacuugguauauacaauaaaaacacugcagcucacagcauacaguagacugaaauccaaagcaaagugcuucaggcagcguucauggcguauggcaugagggcauaugcacugugugucagcacgucccguacuguagaucaggcgaacacuuccagaaacaccucagacuuguuaagcauaugagucugauuuacuguuuggucacuguugccaaacaugacgccaacauugcagguauguaacuaacuuccauaugaguuuucaccucaguguaaaaagcugugcaguauaguauucgucuccuucuuaaaggaucaaaauguaucauucuugguuuuuuccuuauuucacaucuguaugugcaugugaguguguauugcguguaugugucuauaugcauguuuaccuguaugggcauggguuuugugcaugugcacauuuacaugugugugcuuguacacauguauauguguggguguauauuuggcggucccacacugaugucaggaaccauccucaccaagucagucuuccaggcaagcccagagcucgcuggcagggcuggucgcagcagccagcuugcucuagggaugcucucaccacuuucugagguuggaauuacagaaaggucaucaugcccuccuggaauuugcauguauucuggggacccaaacccuggcccucgcaggugcaugaucacaaacacuuuaaccacugguccaugggguucgggaaggcggguucuuggaggcuagaagagagcaucugauuuccuggaccugaaguuacaaguggcugggagccaaacucacaguccuagaagagcagcuagcacucuuaaccacugagccaucucucuaccccucccagcaaguugggagaguuguuuuguuuugcaggggaaggguuugagauaagcccuggcugaucuggaacuuaacuguauagaugaggcuacucucaaaucuacagagaucugccuaccucuacccaaccacucccaaaugcuaggauuaaagauggucaccaccacacccggccaaguagccuuucuuuuaaugcugggaagucaguuuaagcuacuuuuaacuguaugcauaaacauacuacaugucucucuuguaauucccguuuaacagaucuucaggauuuauuccacaagacuggucaagauguggaugggaugcugaccuaccaggaacucuggaacucccuagguucugccaugccaagaccagagagcuugagagcauuugauucgaauggagauggaagauacucuuuccuggaacuaagauuagcuuuagguaucuagucucaucagguauauuugaaacggauauguagccuggacuaccuaaaaaucuacuuaacuaaaaagacagaaaaaaacaaaaacaaaaaccuucuugacuaacucuucagcccuccaguccuuuauacuacuauaacaaacacauugucaccuuuuaacuuguuugaaaacacuauuuaaaaaauuauuuuuuuaaaaaaauuuacuuaaaguaugauguuuagaaaucuaugauuucaugaagccagugagauguuguaacuuaaaguugccaggaaaaaaaaauaaagcccucuucucucuuuccuguuuuuugaggggaagagaauuuaccuuuuaaagcuggaaaguguauguauauagagauaauaagucaguuuauauuucauaugaauuugccuuaaauuagaugcacuuuauagagccucagaauaugucuuuucuuugaaagaugagucucuucuguuuguaaauauauaagaugaaagauugugcauaauguguagaaagacgauuggcuuugaauggaaugaaugaaugacuuguuaugaguaacugacagucugcucuggguggcaacugaaccucuucacaccuccuuaaggcagcccucaaaugcuugggcaccaccauaggguuugaagcuggggcaucaguucagguauggaugcugugcagagggugccaguuccaaacucaggaaagucagauucugggccacugcuccuauuccuaaccuaagaaccagagaagucuuacugggauuuuccucauuuuuaauuaucuuucaaggauuaugagcguaaaaguuacucggugggaaauuauauguuuuccccucaagaagugggucuucucugcccacccacucuagacuaccuuaaaguuguaacugccuaccuucagcaccauguccagucagaaaugggaagguucauguccuuggcugcuaucccaaacuaguugcccagagcacuagagaaaagcucugaguacccuuugauuuuaccuuuaggauaaccaagaauuugcucuauuucuuggcaggaugccuaaagccaaaauguggucugaugaaacaggaaaucauauucuuucuuccuaauuguucacucaaaaggagcuauggguuuucuguccagaggauaccacauggagcaggcgugcuuggagcaggagccuucuggugauggggcuguuuucccaggucuaaagagcaucugugaugcuuccgcuuacaugcuuugugggcaggccaggacaggucugauaggagcagaucaccauucgcugacauguugagacacucccagugcucuuaggcgucucuggcagcuccagcagaagaccuuacagaaccgcagguugcuguagccgucagggaaacacuggagaagcuguugugauggcagggcuucuuuacuaaagaucauugcuguuuaauuucgaucaaguugcccugucagcuauagauacagucuaguaccuuuaaccuuuaaagacauuugguuuucgcuuugcuuugccuugcuuuuuauauuuuguuucuuuuauauaugauauucagcuuaguguuggcuuuuuuuuucucuagacauuaaaacucagugaaggcaagacaaguuuuccugugcaugagucuucuuagcucauguuucucucucuuuaaauuuuuugccuuaauguuugccuugcucaucuaugcugucaccuucuuggaaagguuaaaaauacaguucaaacauuauccuggcucuuuagguaacucuuguucuccuggcugccuuccauacuaaacacacacacacacacacacacacacacacacacauccguacagauuuuguaacaaccaaauaaaguucuagcaauaaauugaauuauucugcuauauuuguauauauuguaccauaaauaguaugucuguaccuggaagguuuuucuuuuuuucuuucuuucuuucuuucuuuuuuuuuuuuuuuuugagaacugauuuauaugaaauauacugaggguaauguagcuuguccuuuuuaguuucaaguucucauuuguaggcagauacuuucaagacaccuuaacucuuugugguauaugcuuuucagugaggaagcaggauuuguuucuuggacuuucuucugguuuuuccaugucaagaagcuugucugccagcaucaccccugagccaugugaugucucuuaucaaacugaccagagguagccauaacugcccucugacauucuauacguuucucauccugacuauggcauuaccagaucuaggcagagguugcuauccuuugcuagaaauuggacagacucacuggcuuaggagccccaaaaaccuaucaaucggugaagauugggucuucauuuguuuauugucuuaccuugugcauccagugccuuguguuagucaagcuucaccagccacagaucaccucuaagagaacucaaugguagugguggugaguuuggcuuuggauuucaauccuuuggccuuaucagucaguagcuaagaguacuucccaccuuaguuucuuaaaguguuacccuugguccuuugcuuuauguaccaucuaccauaauauuuacugaaagaccauucacaagccagucaugguaguacauaccuguaaucccagcccuugggagacugagacaggaaaguaaugaguucuaguccagucugggcuccauagugagaucuugucucagaaaaguaccuggcuuaaauaugacuguaguaacauucaaggaggagcagagcaauggaugcuuggcucuuaagaaugggucuaaugcagaagagcugaggcagacagucucacuucacgaccagcuuguuucccuuccauugcaguuugcucuuuaccauugcuggacagccccaucagcccccucccuggucccagcgucacagcugaagguuuugacugugaugggcucacacuuauaauggccuauugaguuguuuuuagugacagcuuuuguuugcuacacaccucauuggcuugcuuaccaaccaucuagauguggucccuucucucauauucaagccagaacacauuuggguauuccugagacuagagaguguguauuguuuguuauauaaaccuaaccuaccuuguuguuuucucauauuaagaacgguaaaucuacuuuauauuaauggaacuauuuugguaauacauaagcaauuuugguuuuguuuagaguggauucaagguuuccaugacuucauuugagcuuuacuuacuuccuaucaauauagccauuuuaauuuaucuaaauaaaacauuacguuucucucacugugucugacuagaauuuucccugcuccccugauaauuaaagggggaaaccugcuuuaaucuuuau

SEQ ID NO: 2038 - RNA, 34019 nt, Mus musculus
ccuggcagacucccgggaggagacgcgccacgacaccccuagagcgggugggcagaaccgggagcugccagcccgaagcgucguugucccuucuccacuccagcacccggaaccuugagcgcgcggaaccucgguggcggaacgcgggccucgcggaccuugcgggagauggagcaggcgcgcgggccgggggccgaggcugacgcgcccgaggaggaggagggggagucgcaggcggccauggcggcgguaguguccgcugcggguggagcgugccccgcaguccugcagguggcgggucucuaccgaggccugugugcagugcgcagccgcgcccuggggcugggguucgugucaccggcacaguugcgcguguucccggugcgccggggcucgggccugccccccgagggagcagacggcaguggggucagcgagcuggaagcgaaccccuucuacgaccgcuaccgggacaagauccagcagcugcgcaggugcgguccuggucggguggggguggggacucacgaccggcgggcagagcuuccggcaugcacuacucuccgggacggugggcuugcccuggcccugcuauaccaauaguuuguuuccaaguucagagaggccaggccacuugccuaaagucacaucucugcagacucuuugggucuuuccacagucgucaaaacacucuuuaaagcccuaugaagaagacagcucagagaaaguuguccccuacuuaggaagaugaaaaugaagaccuucagcgaaggcauuugauuugcucaaggucacauguugagucagcagauaccugccugagagaucaaguucacaggcucucccagcuuagggcccugacugccuggacaaggagacugggauuguggcaaagacugauaugauaauguuacguuuguauugcccauugaacccucucacuaaggaaauguagggaucuggagagagguagagucuugcccgaggucacacaguugguuaagguuuaucugacuguaaccaggguuccuaaggcgucagcuuccagaagguaaaccgugaagaugaaagagguguggcuuaguagaagagaacuugcuuacuaugcacugggccuugaguuccaucuccagcacugaggaggaaaagugucguaggguuauggcuguuaagguagguagagugggugccuaguuccaggacgaaggaugaagguaaggaaugguggucugagaguuuggugcuauaggaaggcacuucugaaaggaagccagacguuaccggcuagaaguucucugcauuuugucucauuuuaauuccacucccuuaaguucuucgucuucacgcggggcagcagcauccucuaacuagguguacuggcugguuuggugugucaacuugacacaagcuggaguuaucacagagaaaggagcuucaguugaggaaaugccuccaugagauccugcuguaaagcauuuucucaauuagugaucaagggugggaggacccauuguggauggugccaucccugggcugguaguccuggguucuauaagagagcaagcugagcaaaccaggggaagcaagccuguaaggagcaucccuccauggccucugcaucagcuccugcuuccugaucugcuugaguuccaguccugacuucauuuggugaugaacagcaguauggaaguguaagcugaauaaacccuuuccuccccagcuugcaucuuggcuaugauguuugugcaggaauagaaacccugacuaagacacuaggguuuaccacuucuagcccuggaacccuccaccugucugucacuuuaccacgaauagagugaucuucuaagcuuuuugaagcaaugauggaauaaaugagugaauacuuuugcucuccuucaaacauuagauagucucaaauugauuuuaaaauaguacuugaccugcaguccucuccacccacuucucucugaucccuuuaauacacaagugucuccaaagaggugucucaucucacugaguacuuagugggucuauucagacuuacucaggggccaauaauggucucuuuccuuccuugggucauucccaucaacauuuauacauacuaauauuucagaaagugaguuucccaaggugccccauugaauucuucaguguccaaacugcuuagcgcuugauguaaaaccuucacaugcuaguucucugccacucucuagaccaaucuaauaccuaaacugcaaauacuauggucuaggucuagcucuuaaaucauuggaggaauguguuccaaauaugggaaauaauaacacagucaaaaguacagucaugaaaccaccucagucauuuaaggauguuugagcaaaauuuuguuacgguuauaauuaucagcagugcguuuguacauauuuauguaucugucuauacaacuagguaguaaguuucuucaaguagggacaguguguuagcuauuuucuaugugccuagagcacagcaagagcucuccugcgcacggugccccuguuuucuaugcacucaccauggcaagcucagguacauccgugcuuauuagcugggcugacccaguccuuccagaagaaaagaaaagaucagcccaucuacauaguagugaagacagugacauuuggugucacauccaaacaguuuuuggaauaggcaguacccuauaaugucuugacuaugaaggucuaccaaacgguuaaacaagcuauccuuggcuccucacccaaacuguugugugucucccaggcaaguagcuagaguucuuggaugauguuuucaucuacgauuacaaagccacgcaucccauaaucagcuacacauucugacguauccuuaguaacaauggcugccucagccuagccuucaagccugaagagcauccccauuuuaagauaaaggaugaauucugguguucugucugauaggucagggagaugcucagguacuaaggcuucuuccagagcauccauuuggaguacaggaucugaugguggguauagaaggagacgucaaaaauuagauauauucagguaaaaccuuaacacugaguaggcacgcuguaggauuccugccuguggagguaacccagcaauaugacuugacaguauucuuucucucuugaguggcuuaagaaccuaagaaagcgagcccugcaucaccugagcgaguagccugcaaaagaaaaauaaagcaaaaaaacaaaacaaaaacaguguugcacugcugaucccuagaggcuuaccuauagcugaguaacuggcuuugcuuuccacugccuugacuuucaggcuuauacccuguucuuaacugaaugcaaacccuuuagccucauggugucugugucccuucucugaggaggugcgauggagugcuuccuuauuucaaagcccgcaaaggccugcgugcuucaccuuuauuuaccuuuugucaggucugacccagcggccuuugagucccgccuggagaagcgcagugaguuccgaaagcagccaguggggcacuccaaacaaagugauuuuaucaaguguauggagcagaagguaagauguacugggccucggagguugguuuugucuuguuguauaagcuuacuagcccuuacccuuuaaguggucgccagugaccggaacaucucaucuuuucucauucuccgucaguaaauguguacccugcucuugcuagacaagauccuguagucauguuggaauguagaagacugagaggagaguccccacucauaagaaauguagucuaguggucaaggagcucauggaacugagcuguaggauacaggggauauuuucaauggagguccuggguuugcuuuuuuuuuuuuuuuuuuuuaaagacagacucucacugucuaucucuggcuggccuagaacuugccguguagaccaggcuggcuuuggacucauagauucucuugccuccugagaacugggauuaaaguugugcacuaccacacccagcaagaauuauuauuauuauuauuauuauuauuauuauuauuauuauuauuuguagguguguaugucugaauguguguaugugcacacauggcugcagagguaacugaguuuaaaagguagacuuagguuaacuugccugauaagaagacaagcuccggaaccacgugccaaggacugcgucauagcguuuagcuaccagcuagguaguuaugggcaaauuauguaacuucucucugccuuaguuuugccuauuugugaauuagaaauaauaauaccuaccucacagaauaugcuaagacuggaugaaguaguaucgugcacucuccagcaccaucccuggcacauaaaaagaccuuaaugcaucauuagucuuugugauccuugagcaccaaugcuggggaaaggguauagaaagcuagcuaugauaaucuagggcaaugcuuuccagacucuuugaccacaacucacaguaggaaauauauuuacauugcuacuuagaauacauguguauguuucguauaacaaacgaaacuuuugugcagcaguguucuggugacacauaauacauucuuuuccuauguuugucugguucucacucugcaaaccagccucaucuggaacuuaguagguaacccucuugaacucucaguaacccuccugccucagccucccacgggcucagauugcagaugugagucaucacaccuggguaguguauucuuaguuuuuaaucuccuaaaaaauuauguuaacaauccacugaagugauuuuacaauauaucauuugaaaacuuguaaucucagaggugcaugggaacuaauucuggagagacuugagccaagcuggaaccacuuuugauuguuuuuggcccuuuuagaguggaaauguaucauuguuagcacauuucugugacagaaacauccuugaugaggaaggauuggguuugcauguuucagauuugucaguacgucaugucaaagagcaugugggcuugcuuaggaagcagaaaagggggauauggaaagagaccagaauaagauagagccccuaagaacaugcccuaacaacauacuuccuccagauagaccccacagcccaccuuucgucacuucucaauaucuucauauuaugaauccaacaaaggauuaaucuguucauuagaucagaccucaugaccuagucaucucuggaagugcccucacagacuuauccagagguggauuacaaguucccuaggcaccucucgggcccaucaauguaacaagggauuuuaaccgucacaagaagucuaauugauagggaaucugagaacucaacaggacucuagcaugcugaagaccccuacaacuagaaaugcuaucagaaauaaucaguuuuagaaaacacaucucaccauuucucaccuaauuggugucugguguggaacaggucagagggccaagcacagaaagaauccuucaugguuuuucacaguaguggcagcuguacugugaacuccuguacugggagucagugucugcuaacauacccguucucaccucuguaucucagauucuuagagaaaggaaagcugucccauaaacaguaacucuuagagagguauguacagugucauagagaguggauaugagugaguucccaggaacagaaggacucagugagacuggccaccucagugguuugauuuauucccuuucuuucuuccugccuuucuugcucuuucuuucuuucugugaggaaaguauaguuuaauagucugucuccucauguauuucagacagaugccuuggggaaacagccugugagcaaaggauucacuaaggacaagguagguuucuaguuaaauauagaaaucuaagucugaagucaugugggacaucuauaauaagaggcugcaaauuuaaacauauuuguugugcucagggauuuuugucuaaggugauuuuucccaacaguagagaugagaaauauuugucuggguuauuguguccuugacaugacuucuaacuuagguuuggguccacagacacugcuagacauuugaaggaaacagaaagcacuccuuucuaaaucaaaacaccacauggagcaccuauugcacaaauacagagcucccugggggagcagcagccaaugcuucucccuuaccagcugcaaagugcugcaagacuggugagacuggagcaucuggggaugcuugaugaccuaauaguuacugcccaggaauagaacugugaaggaaggucugugugggagcagagacucacguucucugagccugugagaggcuuuuguacccacaggaggucugcuucacugugcugacauucuuuuccacaaggcuugagacagaacuaagcugggguuguuguuaccguuaauuguagauguuaaauuaauugcuauuucuucuuucaagacucucaguucagucuucaacguugagauggugaaagacaaaacugcggaggaaauaaaacagguaauagguggaaaugaauaggcacgcccccugagauuauuugcucuguaaaccaagucugagaacagaaaaggucagauguuuuucuuacaccuuuuucaaugccaauaauaaauaguccuaagggacaaaagugaugagucacauaaauaacagugacauuuaaaacgugucuuucuuugucuugcuuuuauaugucuaaugacuuagguuuacccuuucccuuucauuuaaagucaucaggauucuauaccuggcucuucacuaccuuugcaaauaggcucccguggugugcuggugggguaguggugagcacagcugcccuccauguagcuuuuccuuucccuugucuuagcugagugcacuugagguucugcuugcuacagagaagagagugugcugguuaaagcaguagagcugggcgugguggcacagaccuuuaaucccagcacucaggaggcagaggcaggcgaaucucugugaguucgaggccagccuggucuacacagugaguuccaggacagccaggacuacacagagaaaccucguaucaagaaagaaagggagggaggaaaggagggaggaacuuagacuuuagaaauaagcugacauuuuuaagcucuagcucuuccacuuaucugacugacaaguuaauuucucagagccucaguuugcccacuguaaagugguaacagcuauaugccuacuugucaaacuauuugagaauuaaaugaguuaacguuugugaagcacuuagaacgaauccuggcacagaguaagugcuauagauauguuuuaaaauaaaugaaaaaauacuguguugggaacauguuucaaaauauccagugacaaccccuuccccauuuucauuuccuuggcauuuguggccuaaagaccucccauaggcauuuccuaaccaucucucaaaagcauucaugauccgcccugccuguucugucauucuguguaccuugauuuacauugcucaucccuacuuaugacuguaauucuuuucucuuuagccuguaugaaacuauuugaggauucuuuauacuuccauuauauuuuagguuuaugugcuaaugaacacgauagcaauuaaaggaauaauaaaaacacaggcaggcauuaugcuuguugcuucaaaaguauuucuucauuaaauucuaaugucuacccuuagaaguagaugcugggcuggugagauggcucaguggguaagagcacccgacugcucuuccgaagguccagaguucaaaucccagcaaccacaugguggcucacaaccaucuguaaaaagaucugacgcccucuucuggagugucugaagacagcuaaaaguguacuuacauauaauaaauaaauaaaucuuuaaaaaaaaaaaaaaaaagaaguacaugcuguuauucccaacuuaaagacacgugguuaaaaaauauauauuuaugcaaaacaauguuccaaacauuggcaauuaaaauuuuuuuuaaaaaucagucaccucugaaaaaaauauugaagauuauuuauaucuuacaauaucgaauuucagucaagauuuaguuguuuaaaaauaagcacauaccucucaauaguauacaaguuuuuucucuuuaauaaaugauaaaauuauauguauaugaaagaauuauuuugaaauauuuuguauaauuuaauaucaguaaauauuugauuucuaugccuauuuuauauuacauauacccauaaucaaauuucauggguaaaaggaagucacaaguggaaaaacuuuaagaaguccugguauaagugaaauucccucccuuugcuugcccccucacaccgccaagcaguacugggaacugaaccucaugcaugcuaagcaaccacucugccacugagcuaugucaucugauacuguuggauugcaggacauuggugaugacauagacuaauauccugccuacucagugcuugcaaaccagugaaggaggugcauucaaugcuaaugaccauauuuaaguuaacguauuuguuucaguuaguuuuuuauuacugcaguaagacaccaagaccaaaagcaacuugggaaggaaagcguuuauuucagcguacaguuuguagucuguccucuagggaggucagggagggaacucaaaauggaaggaguagagaagcuggagcugcugcaucaacuccauugagaagugcugcuugcccgcuugcucugcugcuuuguauauguuucagggccauccgcugagggauggcgucaauccacaauaggcuggacccuuccacaucagucacuaauuacaaacaugcuggaggauuggcucagcaguuaagagcucuaguagcuuuugcagagaaccgagguuugauucccagcauccacaagguggcucacaaccaucuguaacaucacuuccaagagaucaaaaacucucuucugacuucuugggaauauaaauaugguacacauacauauguaugugcaagccauauagucauacgcauaaaauaauaaaauaaaaaauuuugaauguauuuuuuuacuagaaaauguaccauauucuuguccauaggccaguuucaugggagcauuucuucaaucgcagcucccucuuccuaaacgacugucuucugucaagcugacauaaaacuagccagcgcaaucucuagagagaugauaugaaauagacaaugaugaaggaaaacuacuuguggggagaaguaugaacuuagccuugaguuaaagaagaacugguggggaagguggucagagaugggaaaaggaaaauuccaguaaaaacccucaaugugaaaagccacagaggacaaaaauaauagaggucaguaaaaagcaugcgcauagaacaugcauucgugcugcgaggauacugcacauggacuauauacaauauauuguaaaaaacauuccuaaaaacgaccaaaacuauucuuauaguguaauaaaacuguggguuuucuuuuucuuuuucccuguuuucuuauuuuauacuuuauaaaccuacuuacuauuuuuggguauuuacaucaugaaaaucaacuguacucuguguucuuugaugccaggcagagaaauugugacugcucuguaucucagucagacagcagguucuaucuguucccuaaauguaggacuucuuggaugcagaauuuuaagagcugccugcaauaagcaauaaaagcuaacauuauuuuagugucugcucugccagucucaguuagucuucauaacaaucccaugagguuggugucacugcuguuuuaucaaugucgucuaaguuccagagauuuguccaagguggacuagcuaguaaaugaucagggccaggguuugcaucccaggccauugacuccagacccuaaccucugaguggccuguauucuuccucucugagaaaguccacaguuggcuggggagguaugguguggggagacgauaaagaacuugugaaagccuaucacaaacaagauaaauccugagaacaauuauuucagaggucauagaaacuauuucuuugacagaauuuauuuuguaaagguuauuuucucauuauauguauauggauguuuugccugcguacaugucugugcaucacaugugugcaguaccuguggaggccaagaguaagugucaaauucccuggaacuacaguuacagauggugugagcugugccaucugggcaguaggaguugaaccuuagugcucagcaagagcagccagugcucuuaacugcugagccaucucuccaggcccuuuaauuauuaucaguugucuguuuguaagggguagguaugcuuaaaugcaggagccugcagaggccgaagguauuggaucccacuggucuccuggcacuggaguaaaaggcagccaugagcugccuaauguggaugcuaagaaccaaaugggucuuuuucaagagcaggagauguuauuaaccacugcuguuagccauaucuccagcucccagacuugauuauuaagaaauaaacaguguaggauuuggagagaugacucaggagugaagagaacuuucuagcacuguaucuugguguacauuuacccacauugucacagaucauucauuuguuuguuuguuuauugcagauuuggcagcaguauuuuucagcaaaagacacagucuacgcaguuauuccugugaguaaucugaaggggagauggaaguguuucagcaugaggucagcacuccuacccucucaggcagcugccuuugcuucuccucuguuuaugacaucucaggaaguuacacuuuacagcucuaagaguuuuauuaugcccuaagcagcagcgauuggaagcuccauaugguguauuuaugacgcuugcuuucccuuguucugguuuagaaauguuuccagucugaccagggaggcuagugcaaguucauguuucugagugauuuccagaugcauuuuauuucauuuucacuuucuaaccaaacuguggagacacagcauggcuuucugcccucccuguguguauggcaaaugcucccucugggccucuccagcuuuuccccuuagcaaguggcauuuucuuggcuuugccuucuuggaauuguuuuaaaggugauugcuagccauugcuuuacuauagcuaagaaccagacaugauggugcacaccuuuaaucccagugcucgagagguagaaacagaggcagacaggucucgugaguuagaggucagccuugucuauauagcaaauaaaaaaagaaagagagagauuaucucuuaccuuaaagugcacugaagaacaccgcuguauucugagaggcuuaccuaaguauaagauuaaagccgaaaaugcauacagaaagaaaagucaggccuuuggcugugaggacucucuguccuuuguuuuaacuucuuauacacauauacucuuaccuucaugaacuccacaaccugugcaguuuguacuugcuguuuuagaucuuucauaccagcucauuggacaggccuucucaggucucccuugaguaccuaccugguuccuuggagacuuuaaagcauuggaggacuuagucuucauauauacucuguagcaaugagcagcaaagcaugcaucagguuuucuugucauuuuauuauaagagugauuuguagggcuggagagauggcucagugguuaagagcacugacugcucuuccaaagguucugaguucaaaucccagcaaccacaugguggcucucaaccauccguagugagaucugaugcccucuuuuggugcaucugaagacagcuacaguguacuuagauauaauaauaaauaaaucuuaaaaaaaaaaaagagugauuuguaaaugguggaacuuaaaagccuguuuuagccauaauguaguucuagaauucacucuuggaaaaaaaucuagugugauugugacuuuucauguuuuucuauuugugaguuaauuuuauucuuuucuaacuuacagaaagagaaguuugauuugaucuggaacagggcucaguccugcccaacaguaagucuguagugacuaugcagaauugcuuauaagugccaccaaauaggcaauuucaaaccaguucuucucaugauauaaugcucuauuaacaaugguacuuauaugcuaauuuuauugauaagugguauuuucauucuuauaaauggcuuuuuagcauucuacuacauauuaggccuuucugauauaggucuuaaucugucaguauauguaugaaaaggcaccauagaacccaguguacugauacgugucuuuaauccuauucagccuggucaacauagcagguuccaggccacccagggcuauauagaaagaaccugccucaauaaggaaggaaggaaggaaggaaggaaggaaggaaggaaggaaggaaggaaggaaggaaggaaggaaggaaacuagacagaaccuaagaccuuuaucuucacaacuuccgugagguuccuguguuagaguuuucuugacaguuuuauucaugcuauucugauaauaugugccagaaauaaauuaauauuuugaugcugaaguagugauccaccacacaguuccagggaaagggaauggguagccagugugacagcuaugauugcucaaacauugcuaguaagaaauaaagacuaccuuagcaaaucagagauauauaucauacuggugggcuggauagcaauauugcuaaaugucagcucucaaauuucaucucugauacgcuccuucuuagauggguugagaaaugugcauguguuuguuauacuaucacauaauuaauuucauaauuucaucccauaaagccaagcauuaugggaugggaguauaacucaguagguuacuuuaccuagcaugcacaaaaccccagggucaguccccaguaccccaucaacuggguauggcagcacaugcuuauucuaaggcuuacucaaggcagaggcaggagagucaggagucaggcaggcuucacuguguauaaguuugaggucagccugggauacaugagacauuuucuuuaaauuaaaaaaaaaaaaaaugaacagaggaaggaaagaaggaaggaagagaaaacagagaaacuauccaagcauugaagaaauaaagugcuacuagugauaagacauugaagaaaugacuucauuuauucaccggucuccuuguuuuucuguuuuccacaguuucuuugugcacuaccaagaagggaugguuaugaguucuuuguaggacaauggacagguacagagcuccacuucacugcacuuauaaauauucagguaggugacauaugcccuacaaaacacgggguauaaaaaagaagccuauccuuugguaagaguagaaaccuuccuggggcugggguuaggguccagaacacuggcugaguccagcaguaccugcugugcugcugcugaacuguaauacgcugaauguuaggccuccauagccgauaucugaagucagaacgccgcucucuagcuucauugucucucuuuugucuccuucugcaaccucuauggcaucuauugcaugugucucaacacaaaugggucguuguagcccaagcuaugagcccacugaggcaggccuccaugucuuaccuguguuuuauuaaccaagguagccuuuuccaaaaugcuagaugaauaguuuucacuucauacauauuaguuuauuugcuuucucuuuuucuuuguuuuauuuacaaauguuagaguaaaaaacauagcucaaaguacacuugagacuuaaaaaaaagagucaguauuuuaauucauaguaacuaggauuggcauucuauauucggagcacacaccugguuuaaaaacaaaaaacgaaaaaaccuguauuguuuuggcuuuaaagcugaggcagagggcacagaauaaagugaaggggcaagcuuugacauugugguguuagaauuuggcaaguguuagcauuggauagauauuaugcaguggguguuucauacuugucguuuaaucuucucaauaugucaugaaguggcuacuguuacuacuuguauugguagagaagaaggucaugugcauuacuaaguaaguaguaaacuguuuugagucccgcuugucuuacuccaaagucuauaaacuuaaacacugaccacuguccugagaaaccuacuagguccuacaagaaaaggacugccccaauggaguucaaagcuaaaauauaaaagcacagaggaauugacagauaccaaacacagaguagucgaugacucuagaaugggauuggaaggcaauacagcaggauccucauacugcaggucuguccuuguuuacuuucuauugcuaugauaaaacaccauucuagaagcaacuuauagaagaaagcguuuauuugggcuuacaguuccagagcagggcucuguaauggcuggggagacaugauagcaaguagccagagcaggacgcugagaggucauucuucaacaagcauacaguggauaaccacuggaagugggcagagauauaaacccucaugacugccugccuccaagguguacguccuccagugaggcuucaccuccuaaaaguuccauagcuuuccccagauagcaccaccaacuggggaacaagccuuuagaugccugaguuuugggggacguuuuccauucuaaucaccauaguaucuaaugagagguauaugucuuuuugugauaguaucauguaugacuuucauaacagacccugagaaaguccuucagaaacauaaugaucaaaauaauuaguauuaggauuuuggccagaaugaucaguacguuagaaguguggugagagaacuaagaggaugaacuguuaagagcgccuuagcaauagcucgguguaauacguacaggaugccugcuggagcuuuaaagcugaagcccagggaugugcuuguuacugagguuguuuucuuccaugcuagguaacggcauuggcuuuaaauucggcuucucuuccuagucuagacuugaggucuggugaccuugcugaucauucuuaugaaguuacacauuugucauuuuucucuccuuucugccccaaccagauagauaauauuuuaaagccacacaauagaaaucuggcuuguguacaaacucuccagugcuagcuauagcuuaaaagagcucagacuuuagagccuccacagggagcagaugaaaugcacuaguccguagaaguagcaauuacaccagcauaucgcuuucuuuagaccuuagcuugguagcugccuguaccauuuuguuuuuaaauguaugacuacaaugaaggauucacugccuuuguaaacauuucugggaaaaaagccaaaucuuuuccaauugaagacacaaauaacaccaugaaaacugucaguucgccaugucuuugcaggccugaccuuguccugcauaccagucuucuaacucaccagcacccaaggggcuguuaagagcuagaauuugcuccagacucuguugcuuuguaacugcaguuuguuguggugguaccuuauugagcuuugauaaguguuccucuaugcagacccgaggggaugcagcagccagccagcugauuuuauaucacuauccugaacuuaaggaagaaaagggcauagugcugaugacagcagaaauggacuccacauuucugguaagacucugcauuugucucuugggguuuaccuaguagaccuguaguuauuuagguauuacucuuuuugaugccucgggucuagauuaaggaaagaugccuauauguaguuuguuucucgugguugaaaacaauuuugucuugcuuacaguauccaaguugaaguacaguuauacacagauaaauaaaugcuuuuggugguggcgguauuuuguuucaguguacuuuuuaagugugugugcgcucgcaugcauacacacacacauauacacauugggaacaggacacauggcaagaugcauguguaaaaagucagaggacaaccucuugagguccauucucuuccuuccaccaucuagcuuccaggggucaaacucaggucaucuugcagcaagcaucuuaauccacugagcuaccucacuggcccugaaaauagguuguuauauuucagacugggacucacuauguugcccuagcuagccuggaacuugcuaaguaaaccaaguuggccuccaacuuacagagauccaccugccucuguccaagugcugggaucggagguguaagccaccauggcuagugcugaaaauuguuucacucucauuucaucccaacaguuuuccugccuuaaacucuuuuggagcuaaauuuucauuuaaacugagaugaggucauuuauaguuaugacacucauuugauacaaaauauuacacauuuuauucaggaaguauuaauguauuugauuauggaucauaacacaguuacauauuaucuucaccuauaucuuuauaaaauccaguaauacuaaaaccaagacacaucuggcccuggagaucucagguaaaauuacggacacauaggugacuuaugaagugugggaugagcuuacagucuagaguaauaguugugucuuuaucuuccucuccaccguugauggguguauaacauccaccaugggaccuccuuuccuccuuuuccaguugaaucacugagacagagcaucagccacaugccuugaacugaugaugcccauugcuuuccacguguccaggcaccagagacaguuuggggucugucuaaggcuugcuuauuucagucccaucugaccgacagugaugguguaggauguccucagaagacugggcacuuuaaagcuucuuccuccauuacaacuuauguuucuucuuugucuuuuaccagcugcauagagagaaggaaaugguuucacuagacuaccaugggaugucucacaguaacaguagacuccugacuggaacagaguggggacucuacuucccugacuguuauuccuaaacugcccaaucuuauuucucuggauuuuucuuuccuccuaaacuaugugucacucaacgggaagacagugacccagaauccuacuuauaguaugcauuugccauuaacuaagauaaaggcugaagaaagaguaguuuuggauggaaaaucaagaccucacuuuuggacuauuaaaucugagaugucuauuagcuauccauauaauguagucagguagauacaugcgccugguauucagaaaagcuggaguauauagguuguauuuaaagccauggauugaaugaaauaccaagaaaauaaaugagggugcagaagagaaaagauguaagaacuaaguccuaaagagaugaagaaacaucagcaaggaaaaguaagaaaaaccauugugauacugggugggggcggggaguuaagcugaugggugccuggaaaugaagauaaaguguucuaagcaacagagaguguuuaguuagccaacucuaacuugcuuauagggcaaaugagauaaaagacugaaauuuuacaagauuuacagacauggaaguauuugggagccuuuauaagaacaguuucagagaaauguugugauuauaagagcaugauuaaauuuaagaaagaugggaagagagauuugaaagggcaaacauuaacucuuucaagggaaagaaaguaagguguuuguuagaggaaagaagugggaacaaggaugucuuuuaaauauugaauaaauaauacggaaauauaugguagggagaagaauauuagccauauaggagaaagaaaaagaauaauauucugggugagcaagucuggaaaugagggcuuaaucuuucuccaggaguuuaauaguggacaaaagucaggaaaugaggauauagguauaguauaguuagaugaguagaguuaguggcagcuuguagaaguucuugucaguuuuuuuuuaaaugaaaagaaaagccaucagcucagaguaaacaugagaacaugggguuagauauuugagucaaaaagagauaguaugccagguauggugguauacaccuuuaaucccagcacuugggaggaagagacagguggaucuaaaaaucaagacccaggacauccaaggacuacauagaaaaacuaugucucaaaagagagagagagagccgggcggugguggcacacgcauuuaaucccagcacgugggaggcaggcggauuucugaguucaagaccaaccuggucuacagagaguuccaggauagccagagcuauauagagaaacccugucucgaaaaaaaacaagaaagagacagagagacagagacagaaagaaagaaagggagagagaggaaggaaggaaggaaggagggagagagagaaagggaaagaaaagaaaaaaagaaagggagagaggaaggaaggaaagaaaagaaaagaaagaaaggaaaggaaagagagaaagagaaagaaagaaagaaagaaagaaagaaagaaagaaagaaagaaagaaagagagagagauuauugucugcaagcacagccuaugggcuggauuuaacccacaucuuguuuuuguaagaccuaugaauuauaaaugauuaagaaccacaaaccacgaaaauuaguauuucaugggaugugaaaaguauuaaauucaauuucaggguauauaaauuaggauuuauuuacauauuacuuaugacugcuuuaguucuguaauagaguugaguaguuugagauucuauggcccccagagccuaaaauguuuacuguuuauagaaaguguuugcacagcacagucuaaggaaauagagaauuuuguguagauauaagcacagacuuaacuguagucggcugugugguauaaugauguaacugaggggccaagaccagaaaauaaagcuggguagagagggaaguaaaaggauaagacacuaggaacagugaacuucagcugcagacuguuagaguuucaagugaacuaggaagguaaaauaauggccacagugcagauauuucagacaagacugggagaagacaucaguauugauggcaaagucuguacucugagucacauggaaauaugacauagagauugugcuguguuuuaaaugagcccuagagguaggucacaggaaacuuuuucuugguuuguucuguuucaccauuucacuccgauagucucagacugaugcaguuguuguaucauuaagguuuuggagggauggugaugugggguggagcuuuguuguuguuuuggcuuuauaacauuugauuacauaccagacaaucaauuugccuugucuaaaccacagugacuaugaggucccaguauacaaggcucaacagauaaagggacccaucaucaagccugaugaccugaguucuguccccaggacccacaugguaggagaaaagaacuaacucuuggagcuuguucucugaccuccauuggaugagccauggcauaccugcuaacaugcagacacacauaauaaauucauaaguaaaaaugcauaauuuuaaaagauuuucuuuauuauuuuagucauguguguauauguauguaucuaucuauauauauguauguguguguguguauguauguauguguguauguauauauauaugccugagugugagaaugugcaugugagugaaaguguucucagcggccagaggcauuggauaucccgaaagcuggaguuacaugugguuugagccaccagacauggaugcuagaaauuaaacucagguccucuugcaagaguaaugcaugcucuuaacuccugagcccaccacuccagccccaguuuaaaacauaaaagguuuaaaaugaauacucuguagaaagaaguacagcccauguuuuuuuuaaaauaaacuuauccacaucauuuuauagcuagauacaaccaacuuuuuuucuuccaaugcuaagaauucaacuuaggacuugcauuuguuuuuauuuuuuguuuguuuuauuuuuguuuuuagcaacacaauuaauuuuuuuaauuagguauuuagcucauuuacauuuccaauacuauaccaaaagucccccauacccacccacccccacuccccuacccgcccacucccccuuuuuggcccuggcguuccccuguucuggggcauauaaaguuugcauguccaaugggccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccaaggguguuuuguucccaauucuaagaaggggcauaguguccacacuucaguauucauuuuucuugaguuucauguguuuaggaaauuguaucuuauaucuuggguauccuagguuuugggcuaauauccacuuaucagugaguacauauugugugaguuccuuugugaauguguaaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguugaggcaucuucuggauauaugcccaggagagguauugcuggauccuccgguaguauuauguccaauuuucugaggaaccgccagagggauuuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugcuuuucugaaguccaccuucuugaguucuuuauauguguuggauauuaguccccuaucugauuuaggauagguaaagauccuuucccaaucuguugguggucuuuuugucuuauugacggugucuuuugccuugcagaaacuuuggaguuucauuaggucguauuugucaauucucgaucuuacagcacaagccauugcuguucuguucaggaauuuuuccccugugcccauaucuucaaggcuuuuccccacuuucuccucuauaaguuugagugucucugguuuuaugugaaguucuuugauccauuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcagguuuuaccacaauugcucuguaguaaagcuuuaggucaggcauggugauuccaccagagguucuuuuauccuugagaagaguuuuugcuauccuagguuuuuuguuauuccagaugaauuugcaaauugcuccuucgaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucacugaagcuguuuaucagguuuaggaguucucugguggaauuuuuagggucacuuauauauacuaucauaucaucugcaaaaagugauauuuugacuuccuccuuuccaauuuguauccccuugaucuccuuuuguugucgaauugcucuggcuaauacuucaaguacuauguugaaaagguagggagaaagugggcagccuugucuagucccugauuuuaguggaauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcaucuaacgagaugaucaugugguuucugucuuugaguuuguuuauauaauggauuacauugauggauuuucguauauuaaaccaucccugcaucccuggaauaaaaccuacuuggucaggauagaugauugcuuuaauguguucuuggauucgguuagcgagaauuuuauugaggauuuuugcaucaauauucauaagagaaauuggucugaaguucucuaucuuuguuggaucuuucugugguuuagguaucagaguaauaguggcuacauaaaaugaguuggguagaguaccuucuacuucuaucuugugaaaaaguuugugcagaacuggaauuagauauucuuugaaggucugauagaacucugcacuaaacccgucugguccugggcuuuuuuuggcugggagacuauuuauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuucuucuuggaggcacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagagucuuguucaguuuccacgugaguguuggcuuucuguuauuuuuuuuuguuauugaagaucagccuuagugcauggugaucugauaggauacaugggacaauuucaauauuuuugaaucuguugaggccuguuuugugaccuauuauguggucaauuuuggaaaagguaccaugaggugcugagaagaagguauauccuuuuguuuuaggauaaaauguucuguagauaucugucagauccauuuguuucaucacuucugucaguuucagugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugagaguuccucuuggaggauuuuaccuuugaugagaacgaagugccccuccuugucuuuuuugaugacuuuggguuggaagucaaucuuaucagauauuaggauggcuacuccagcuuguuucuucauaccauuugcuuggaaaauuguuuuccagccuuuuauucugagguagugucuaucuuuuucucugagaugugucuccuguaaacagcaaaauguugggucuuguuuguguagccaguuuguuagucuaugucuuuuuauuggggaguugagaccauugauguuaagagauauuaaggaaaaguaauuguugcuuccuguuauuuuuguuguuaaaguuggcauucuguucuuguggcugucuucuuuuagguuuguugagggauuaccuucuuguuuuuucuagggcauuguucccguucuuguauugguuuucuucuguuauuaaccuuugaagggcuggauucguggagagauaaugugugaauuugguuuuaucguggaauacuuugguuucuccaucuaugguaauugagaguuuggcuggguauaguagccugggcuggaauuuguguucucuuagugucuguauaacaucuguccaggcucuucuggcuuucauagucucuggugaaaaaucugguguaauucugauaggcuugccuuuguauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucaugggcaucucuuucuuuagauuugggaaguuuucuucaauaauuuuguugaagauguuugcugguccuuugaguugaaaaucuucauucucauccacuccuauuauccguagguuuggucuucucauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguucuagauuucuuuccuaggguuucuaucuccaguguugccucgcuuugaguuuucuuuauugugucuacuuucugaaccuuggaaaugauuauaaaugauugcauaacagauuguuccacguuguagcauuguaguagauuauaauggcaagcauuaccucacagucuguggaacaggaacucaagagcagcuuagccaggugguccuggcuccagucucauaaaguugcugucaugaugucacaucugaagacugacugggcuuaaggguccacucguuuccuuggcucuucuuuaggacuacuugaauguccucaugauaugccagcuuaccccagaacaaauaauucaaaauauauucuuuuauguuccaauaacaagagcccuuuccaaucauuucaccauagucuacuugcuagaagaaacucauuaaguacagccucacacuaggaauagagaucaaucuaccaaaggaggaaggaccaugauaguugcagagauuuuauaucaucacaacuggcuuugccacuguguuucugacuggggugcuaucaauaacaagauaacagguaguacacaagugugucuaguuagucaagaacucaguacuugcacacuuauucuuagagcuagguaacucuugccccucuuccugggauguauguagugguuaguuaggaacuaaauagagaaauuguuaucauuugaacuaacuuacucaacaaacauuauaucacuauguauuggaacauaaaauaagucaugaugucuguaucuuugaagauuuuauauuaaagaguccaggccaaaaagaaaaacaaauauaagagaaggugcugagagugguaaacaagaugccuugcccauguggaaggaacaucuaacgaagauaugagaggucagggagucggggaagcuuuucaggaacagugacuccuccacagaacuugggcacagagcuucaggcuugugcaggaaagugccucacugcucucauugccuugcagaauguuguggaggcacagugcaucgccaaucagguucagcucuucuacgccaccgaucggaaggagaucuaugggcuaguagagaccuuuaacuucagaccaaaugaguucaaauauaugucugucaucgcugaguuggagcaaaguggacuuggagccgaacugaaacgugcccagaaccaagauaagacuuagagguaucuggauugucucuucacaguguuggcucaguccuggauggccugaagcccacccacacccuugaauuccagagcucagcaucugcaacaagcagucuguaaagaguuacuguguaagcuuauugcaagaagugauuguggacaugagcccuaauacuugauacaggaacaaagauauacaauuacucugauaauuaccucucagcauaaggguuccuuuucaguguuucuggccuuuggaaugagaaauauaucgcuucucggccuuuuggcuaagaugaaguguggaaugagaaauauucagggauccacaagacuauuggcuugguuuuauuuaguguaauagugcaguugcauucuggccauuuugaccucauagcucccacuucuaugacuucauaaacuguagcaauaagcuugaagaucuuagagauguuggcuuuauauacucuuuccaugcaccagugagcuggcuaaaaacauaacccaaaacuccuggccagacucuaauacaaccagcuauucucaucagaauaaagacuuguggaugccccuucagaguugccuucaguguaacucagugaauuacggguauacuucaauaaacagguucaaugccuguauacuguuaaacugucgcuuauggcccuacucccugaacucugccugugagaagcugaugaaucacuacaguguaaauaaaaccuuuuucuaaggagaucaaucuagauuugcaugauuaaaaaaaaauaaguguuauaugaaaacguggguggaagcaaaaguucccagauugagugcagggaauguagcaauaaaauaagucugguuuucagucucuguuacacagcauaguggaaacuaaacuuuauacuguugguggcaucagugccggggguucauuuuaucagaacucaucuuggggcucggugauuucuugaaacaccagaaauaauuaaguuauucuucagcaccagaagcacguguauccugcuuuguggccccaaggucauugauacaaaagaauaguggguccacaccaaccuuaugaccucaaagcacucccugucccacaccugucauuuggucuaacauccucuaccuuagucugccccccccacacccccacacaccccccaccccccaccccacccccaccccgccugauccugcugggugccaccaacuacggugaguagaaacuuaaguuguguuuucaguuuauguguguucuucauuacagacuuuuuuuuuaggguaggcaucucccaaagcuuuuuaagugggugugguaguuugaauaagaaugacaccccaccccgcaccucccauuccccaccaguaggcucauauauuugaaugcuuaguugccaggaaguagaaccguuugaaaggauuagaaagauuagguggcuuauuggaggaagaaugacacuguggguauacaagguuuuaaaaguccacaccaggcugugugugugugugugugugugugugugugugugugugugggcauagcucucagcuauuucuccaguaucauucuugcuuguugccaugcugugugccauggugauuauggucuacaccucugaaacuguaggcuagcccacaauuaaauguuuucuuuuauaaaaguggccuuggucauggugucucuucccagcaauagaacaguaacuaagagaguaggguuggccaucccauuauuuucugaaucaagaaacagauaauguuuauuuaacugaagaagcagaacuaaagguugaguugaucucuaaugcagcuucuagacccguuauuguuucaagugugcauuuugagaaacuugagaccuaucaacccugcaguuuuccuuaaaugccuuucaagcuucuggaugauacaugucccaagacucuuaggcguuggguaggguugcuuuuguggguauccaguuauguuuguuuuucucuccagauagacccaguucucagccauagaacauuuucaugaugccucuacuagauggugagaacacgauaggggaagaaagaacuagccauuuauuuccuaguucuucccagcuuugcccucagucccaucuuaccaaagaaggaggauacauccacggguaauuauagcagacgugacuaaagucccaucugaauguugauaauauuuacuuuaccaaagagaucuagcaaauaauaagugaaaaccauagcuagucuauaaauuuguucccugacucuugaacucagaaauccgccugccucugccucccaagugcugggauuaaagguaugugccaccaccaccacccggcccccgaaugguauuucuaagauggugguaggcuuugacacccauugaauuggguucaaauaucaccauuuucauuagcuuguuaaugacuaauuacuuacacucuuaagucuuccuuuucuucugaaggugaggaugauaucuaccucauaggauuguugugagaccccaguuagcaugugugcagaguacuguggagccuaggacgugcugaaucccuuccucuccuucacuucucuucuucauuaaagaccaauguggggcuaggacuauaacuugggcgcugaguucaguucccagcauuucagauguacagaucacucuucauuucagcuuaaacaacaaacccuaucucacugauucuuaacuugagauacaguggcgucacuuacgagcucuuuaaaaugcaguuccaggacccugaccugcugaaucagcaugucccagugcugaacaaagcaccaggaaccuacauguuaguauguauucuagccaauucugauguaggugaucaaccauugccuuauccauuccuuaugaaaauguccacugcaugggucuuucucaccugcagacauucacacgggacuuagauuccucuuccugauaguugcuauuguuccaguguacuccaguuacauuguguuauauuuauuucuguguguuuaccccacuagacugugagcuccuugagggucaggauuuaacuuuauucucagugcuagagacaugaccugaaccacagaagaaacucaauuguugaacuaauaaaugauacagauuuagcaaaaaaaaaaaaaacucuuauugacuuacacauuucucuguuaaauccuauagcauugugauuugaauguaaauuuccccacagcuccugaguuuaaacaugugguccacaguuggcagcacuacuuggggggugagggguuaugaaaccuuugggaggugggaccucgcugacaaagguaggucagggagcauggccuuaaagguaguauaccagcuucuaguucaagauuacuguuuccugauuguuggccucaaugugaacaagcuuuagcuaucacuuuccacugcauggacuuugccaggccuucugagccaugauagacucuaccugcugaaagcaggagcccaagaaaaauccuugcuuaagcugucugucagguguauguucacagugacacaaaaguaacuagugauacacuuggaacuuaaugccaccgccaccccccaaucucacucucccuucccccauccuguugaguuuauuuuuuauuacaaagaauuuauauguaugugcauuuggcugcauguauguuugcaugccaaugaaggccagagaggauauugaauccacuggaacuagaguucuagaugguugugaaacaccaagugggugcuaggaaucaaaccagguucuuuagaacagccagugcucuuaacuacugagccaucucuccagccccauugccucccagauauccaagacagggucucauguaacccagacuggcuucaugauaauggccaaagcuagccuugauuuccugcaugcaucuaccuacuaaguggugaaacuacaggcaugcacuuuuacuggaauuacugacuucuuucucuuuuagagaguaagacaauagagcuguuuuggugcuaggagucaaacccugggacuucacacugcuagggaagcacucuaccagugaaccauauccccagcucuaacaacucagcagcuguucacacagcaccuacugcuguguuaagugcugcacccaggaggaugagcuguguuccuugcuccaagcucuaccaucucuuucuugccucugauucugaaccuuagaucuagaaccuggucuugcuuugccuuguuuucaaaauauucauacuuguuucucuuucaacucauuuaggaggcaaagccauucccuacgauaguggccuuuuguucggucugaaagaagagacacagaugcccacucccccaggcacuugagaaagccuuguuucagcaacuacacuuaccaagcuccaguuuuuauacuuaaagugagaauauagcgguggacaggauaaacggggccucugcucucacuaguuuauauccccaaaacaaagacaagaaaguaagcuaguaaaauuaucucuacucagauaccagcuaugaaacaaggggagugaacucgguggcuuacuggccaggagagccaucucugcagaggucacuugcuacgugagcugggaugagcgucccagguaaaguaaggcaggugugaagauugugaaacauaagccugcuuguuucugggcauagguucagucccugcccuugggcauaguucaggcaagacacaugcacaaugacaguacaaggcagugaccggugccauucagagaagaacaggagggcuugccccuuucugguguggcaggagauauaaacuuugcuagagcuuaguaacugcuaaggugguaguuuauggccuaaucgaaaauaacagguaaauauuauuaaagcauacauauauacaacaaaaaggaaagagugagagaaagggacuuuucaugcagaaaauagaagauccugugagcccaaaacuggcuucugcuuuucaguguguacaauagccacuaacauuuucuggggccuuaucauaugccagacacucugucacacagauuauuuuaguccuaccuaugggacugaggaaccugcucagcagggagauguaccguccccucuccuuauacucuccugcccuccccaccuucagcucagaagagagcaacuuccggucaccucaaacuccagccacagcaguaaccucagcuauccagaagggauggggaguagcagaaccucagcuauccagaagggauggggaguagcagagccaggccaaagaaaccugucugcugacucuccuggaggaaagaacacccagagcguuucgaaagacaugcugcuuuagcucgggagaacccuccuggugcucugcuuuaccucacggagcaguugauccuuucagcuuggcuaguagagcagcaugguggcagcauuuuuauuccugucugcuaacagagacgucaggcacaggggagaggugauuugaagacaucggccugcaucaggagccaggcccagaaaagaagacuguccgugcacuagucuuugcugugucugcuaaagcagauucaugucucacauccauucauacaggguuacuuaaggacuguuugagccucaagaauauagaggcccaucuaucuuugcaguaaaacaaacaaaaauaaauaaauaaauaaacugggauaucuuuaagaaaaaaaaauguucccaaacaaaccuccuaggauccucagagcauucaggacgaagucccuuuggaucaccucacaagggcguccaguccagcucuggugccuccugccuucuccagguucucacuucuugcuggacuccuuagcagcagccauuuuauugacagagaagagagcaacuuccggucaccucaaacuccagccacagcaguaaccucagcuauccagaagggauggggaguagcagaaccucagcuauccagaagggauggggaguagcagaaccaggccaaagaaagucacugugcucugacuuccuuauucuguccuggucuuuuugacaauuuuugucugauugaaaugccuauacuccuuucaucaaacuauuuccuaauugucuuucaaaccuccacuaaagcaucucuaccuuuuuccuuuuaacuuuuuauugguucuuucugaauuucacaucgugugccccaaucccacucaucuuccccuucccucguaccugcccucuacccguguaaccuuccccaaaagagagaaaaaaguucuccuuguggacgcuguagugugucacagaguauacacccuuuguccacacuucuuuucauugcagugaguaggcuucugcuacucuguguugauccuggaaccucacugggaauccucucagauacccuguugaugcccugugucauggagauccucuacuucuggaucuguaggaccggccccucaugcacuacagcaguucaucaaagggauagauguuggggugggccaauucagagcucuggaucugggccugagaguuuucugaguuuucugucagccuaauagcuugcucaaaccccacugcaugggggcaaguucugcucucaugccugggcaggaggagggcaguggggaagaguugggcuaguauccaugccuauagugggggugauauccauacccaugcuaccagggccaguucuauugugccucuaggugaggaacaggacuugcucucccggcaucucggcuuucuuucccuaaguccuacucuccccuuguugccucugccugcauuauaugcuuuguuuccccagcauuuaguguucuccuuuagagauggaauuauacuucuguauuccagcaugaaaucuuacagagagaugggagacccuaaagauucugaauaaguucacuaaacucaagccaccugcgucuauaagcaucccugagguccagcccuggcaaaugugauuaugucccagucucagacaguggccauuuuguuuacucuuucuagaagcuacauguaauaaauacaggcaaggggcuaucauaagaagcaaaggagucucgagcugguaagccaugagaauagaaagauaaugacuaaccaagccuuuggaauccgacagucuuuucagaguagcagccuggcuuauucuuguccuagcucacuacaucucaacauuaaaagaguccucagagauuguccaugaaauuccaagagcuccuuagagguaggcauacuaagugucugguccuuaucccaacucacgaagagaauuaaaaguuuauuuacugcaaaguuuaaaauaccacugcccagucacucgugacuugugguucacuguggccccagaccauuuacgaugugacaucaucaacaccuugcauucuuauuucuucaaccauuucucacugugauuugguuucugggcaguugacagagugggaguagggaggauaguagacauuguaauuuuuacccugguauuacaugaagaaagaggaagcauagguguuugcugagacucauuucauacgugauugcaaacgggcucuggauguguuugcuuccacagcuuguuuccuuucauuugaucgucucagcaauacaauaaggguaauacuacauuuccauuuuacagaugagaacacuggggagacaacaucauaaaucuugaggacuaaauuaaaaccccagcuuuguc

SEQ ID NO: 2039 - RNA, 10530 nt, Mus musculus
cugccucuguccaagugcugggaucggagguguaagccaccauggcuagugcugaaaauuguuucacucucauuucaucccaacaguuuuccugccuuaaacucuuuuggagcuaaauuuucauuuaaacugagaugaggucauuuauaguuaugacacucauuugauacaaaauauuacacauuuuauucaggaaguauuaauguauuugauuauggaucauaacacaguuacauauuaucuucaccuauaucuuuauaaaauccaguaauacuaaaaccaagacacaucuggcccuggagaucucagguaaaauuacggacacauaggugacuuaugaagugugggaugagcuuacagucuagaguaauaguugugucuuuaucuuccucuccaccguugauggguguauaacauccaccaugggaccuccuuuccuccuuuuccaguugaaucacugagacagagcaucagccacaugccuugaacugaugaugcccauugcuuuccacguguccaggcaccagagacaguuuggggucugucuaaggcuugcuuauuucagucccaucugaccgacagugaugguguaggauguccucagaagacugggcacuuuaaagcuucuuccuccauuacaacuuauguuucuucuuugucuuuuaccagcugcauagagagaaggaaaugguuucacuagacuaccaugggaugucucacaguaacaguagacuccugacuggaacagaguggggacucuacuucccugacuguuauuccuaaacugcccaaucuuauuucucuggauuuuucuuuccuccuaaacuaugugucacucaacgggaagacagugacccagaauccuacuuauaguaugcauuugccauuaacuaagauaaaggcugaagaaagaguaguuuuggauggaaaaucaagaccucacuuuuggacuauuaaaucugagaugucuauuagcuauccauauaauguagucagguagauacaugcgccugguauucagaaaagcuggaguauauagguuguauuuaaagccauggauugaaugaaauaccaagaaaauaaaugagggugcagaagagaaaagauguaagaacuaaguccuaaagagaugaagaaacaucagcaaggaaaaguaagaaaaaccauugugauacugggugggggcggggaguuaagcugaugggugccuggaaaugaagauaaaguguucuaagcaacagagaguguuuaguuagccaacucuaacuugcuuauagggcaaaugagauaaaagacugaaauuuuacaagauuuacagacauggaaguauuugggagccuuuauaagaacaguuucagagaaauguugugauuauaagagcaugauuaaauuuaagaaagaugggaagagagauuugaaagggcaaacauuaacucuuucaagggaaagaaaguaagguguuuguuagaggaaagaagugggaacaaggaugucuuuuaaauauugaauaaauaauacggaaauauaugguagggagaagaauauuagccauauaggagaaagaaaaagaauaauauucugggugagcaagucuggaaaugagggcuuaaucuuucuccaggaguuuaauaguggacaaaagucaggaaaugaggauauagguauaguauaguuagaugaguagaguuaguggcagcuuguagaaguucuugucaguuuuuuuuuaaaugaaaagaaaagccaucagcucagaguaaacaugagaacaugggguuagauauuugagucaaaaagagauaguaugccagguauggugguauacaccuuuaaucccagcacuugggaggaagagacagguggaucuaaaaaucaagacccaggacauccaaggacuacauagaaaaacuaugucucaaaagagagagagagagccgggcggugguggcacacgcauuuaaucccagcacgugggaggcaggcggauuucugaguucaagaccaaccuggucuacagagaguuccaggauagccagagcuauauagagaaacccugucucgaaaaaaaacaagaaagagacagagagacagagacagaaagaaagaaagggagagagaggaaggaaggaaggaaggagggagagagagaaagggaaagaaaagaaaaaaagaaagggagagaggaaggaaggaaagaaaagaaaagaaagaaaggaaaggaaagagagaaagagaaagaaagaaagaaagaaagaaagaaagaaagaaagaaagaaagaaagagagagagauuauugucugcaagcacagccuaugggcuggauuuaacccacaucuuguuuuuguaagaccuaugaauuauaaaugauuaagaaccacaaaccacgaaaauuaguauuucaugggaugugaaaaguauuaaauucaauuucaggguauauaaauuaggauuuauuuacauauuacuuaugacugcuuuaguucuguaauagaguugaguaguuugagauucuauggcccccagagccuaaaauguuuacuguuuauagaaaguguuugcacagcacagucuaaggaaauagagaauuuuguguagauauaagcacagacuuaacuguagucggcugugugguauaaugauguaacugaggggccaagaccagaaaauaaagcuggguagagagggaaguaaaaggauaagacacuaggaacagugaacuucagcugcagacuguuagaguuucaagugaacuaggaagguaaaauaauggccacagugcagauauuucagacaagacugggagaagacaucaguauugauggcaaagucuguacucugagucacauggaaauaugacauagagauugugcuguguuuuaaaugagcccuagagguaggucacaggaaacuuuuucuugguuuguucuguuucaccauuucacuccgauagucucagacugaugcaguuguuguaucauuaagguuuuggagggauggugaugugggguggagcuuuguuguuguuuuggcuuuauaacauuugauuacauaccagacaaucaauuugccuugucuaaaccacagugacuaugaggucccaguauacaaggcucaacagauaaagggacccaucaucaagccugaugaccugaguucuguccccaggacccacaugguaggagaaaagaacuaacucuuggagcuuguucucugaccuccauuggaugagccauggcauaccugcuaacaugcagacacacauaauaaauucauaaguaaaaaugcauaauuuuaaaagauuuucuuuauuauuuuagucauguguguauauguauguaucuaucuauauauauguauguguguguguguauguauguauguguguauguauauauauaugccugagugugagaaugugcaugugagugaaaguguucucagcggccagaggcauuggauaucccgaaagcuggaguuacaugugguuugagccaccagacauggaugcuagaaauuaaacucagguccucuugcaagaguaaugcaugcucuuaacuccugagcccaccacuccagccccaguuuaaaacauaaaagguuuaaaaugaauacucuguagaaagaaguacagcccauguuuuuuuuaaaauaaacuuauccacaucauuuuauagcuagauacaaccaacuuuuuuucuuccaaugcuaagaauucaacuuaggacuugcauuuguuuuuauuuuuuguuuguuuuauuuuuguuuuuagcaacacaauuaauuuuuuuaauuagguauuuagcucauuuacauuuccaauacuauaccaaaagucccccauacccacccacccccacuccccuacccgcccacucccccuuuuuggcccuggcguuccccuguucuggggcauauaaaguuugcauguccaaugggccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccaaggguguuuuguucccaauucuaagaaggggcauaguguccacacuucaguauucauuuuucuugaguuucauguguuuaggaaauuguaucuuauaucuuggguauccuagguuuugggcuaauauccacuuaucagugaguacauauugugugaguuccuuugugaauguguaaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguugaggcaucuucuggauauaugcccaggagagguauugcuggauccuccgguaguauuauguccaauuuucugaggaaccgccagagggauuuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugcuuuucugaaguccaccuucuugaguucuuuauauguguuggauauuaguccccuaucugauuuaggauagguaaagauccuuucccaaucuguugguggucuuuuugucuuauugacggugucuuuugccuugcagaaacuuuggaguuucauuaggucguauuugucaauucucgaucuuacagcacaagccauugcuguucuguucaggaauuuuuccccugugcccauaucuucaaggcuuuuccccacuuucuccucuauaaguuugagugucucugguuuuaugugaaguucuuugauccauuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcagguuuuaccacaauugcucuguaguaaagcuuuaggucaggcauggugauuccaccagagguucuuuuauccuugagaagaguuuuugcuauccuagguuuuuuguuauuccagaugaauuugcaaauugcuccuucgaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucacugaagcuguuuaucagguuuaggaguucucugguggaauuuuuagggucacuuauauauacuaucauaucaucugcaaaaagugauauuuugacuuccuccuuuccaauuuguauccccuugaucuccuuuuguugucgaauugcucuggcuaauacuucaaguacuauguugaaaagguagggagaaagugggcagccuugucuagucccugauuuuaguggaauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcaucuaacgagaugaucaugugguuucugucuuugaguuuguuuauauaauggauuacauugauggauuuucguauauuaaaccaucccugcaucccuggaauaaaaccuacuuggucaggauagaugauugcuuuaauguguucuuggauucgguuagcgagaauuuuauugaggauuuuugcaucaauauucauaagagaaauuggucugaaguucucuaucuuuguuggaucuuucugugguuuagguaucagaguaauaguggcuacauaaaaugaguuggguagaguaccuucuacuucuaucuugugaaaaaguuugugcagaacuggaauuagauauucuuugaaggucugauagaacucugcacuaaacccgucugguccugggcuuuuuuuggcugggagacuauuuauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuucuucuuggaggcacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagagucuuguucaguuuccacgugaguguuggcuuucuguuauuuuuuuuuguuauugaagaucagccuuagugcauggugaucugauaggauacaugggacaauuucaauauuuuugaaucuguugaggccuguuuugugaccuauuauguggucaauuuuggaaaagguaccaugaggugcugagaagaagguauauccuuuuguuuuaggauaaaauguucuguagauaucugucagauccauuuguuucaucacuucugucaguuucagugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugagaguuccucuuggaggauuuuaccuuugaugagaacgaagugccccuccuugucuuuuuugaugacuuuggguuggaagucaaucuuaucagauauuaggauggcuacuccagcuuguuucuucauaccauuugcuuggaaaauuguuuuccagccuuuuauucugagguagugucuaucuuuuucucugagaugugucuccuguaaacagcaaaauguugggucuuguuuguguagccaguuuguuagucuaugucuuuuuauuggggaguugagaccauugauguuaagagauauuaaggaaaaguaauuguugcuuccuguuauuuuuguuguuaaaguuggcauucuguucuuguggcugucuucuuuuagguuuguugagggauuaccuucuuguuuuuucuagggcauuguucccguucuuguauugguuuucuucuguuauuaaccuuugaagggcuggauucguggagagauaaugugugaauuugguuuuaucguggaauacuuugguuucuccaucuaugguaauugagaguuuggcuggguauaguagccugggcuggaauuuguguucucuuagugucuguauaacaucuguccaggcucuucuggcuuucauagucucuggugaaaaaucugguguaauucugauaggcuugccuuuguauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucaugggcaucucuuucuuuagauuugggaaguuuucuucaauaauuuuguugaagauguuugcugguccuuugaguugaaaaucuucauucucauccacuccuauuauccguagguuuggucuucucauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguucuagauuucuuuccuaggguuucuaucuccaguguugccucgcuuugaguuuucuuuauugugucuacuuucugaaccuuggaaaugauuauaaaugauugcauaacagauuguuccacguuguagcauuguaguagauuauaauggcaagcauuaccucacagucuguggaacaggaacucaagagcagcuuagccaggugguccuggcuccagucucauaaaguugcugucaugaugucacaucugaagacugacugggcuuaaggguccacucguuuccuuggcucuucuuuaggacuacuugaauguccucaugauaugccagcuuaccccagaacaaauaauucaaaauauauucuuuuauguuccaauaacaagagcccuuuccaaucauuucaccauagucuacuugcuagaagaaacucauuaaguacagccucacacuaggaauagagaucaaucuaccaaaggaggaaggaccaugauaguugcagagauuuuauaucaucacaacuggcuuugccacuguguuucugacuggggugcuaucaauaacaagauaacagguaguacacaagugugucuaguuagucaagaacucaguacuugcacacuuauucuuagagcuagguaacucuugccccucuuccugggauguauguagugguuaguuaggaacuaaauagagaaauuguuaucauuugaacuaacuuacucaacaaacauuauaucacuauguauuggaacauaaaauaagucaugaugucuguaucuuugaagauuuuauauuaaagaguccaggccaaaaagaaaaacaaauauaagagaaggugcugagagugguaaacaagaugccuugcccauguggaaggaacaucuaacgaagauaugagaggucagggagucggggaagcuuuucaggaacagugacuccuccacagaacuugggcacagagcuucaggcuugugcaggaaagugccucacugcucucauugccuugcagaauguuguggaggcacagugcaucgccaaucagguucagcucuucuacgccaccgaucggaaggagaucuaugggcuaguagagaccuuuaacuucagaccaaaugaguucaaauauaugucugucaucgcugaguuggagcaaaguggacuuggagccgaacugaaacgugcccagaaccaagauaagacuuagagguaucuggauugucucuucacaguguuggcucaguccuggauggccugaagcccacccacacccuugaauuccagagcucagcaucugcaacaagcagucuguaaagaguuacuguguaagcuuauugcaagaagugauuguggacaugagcccuaauacuugauacaggaacaaagauauacaauuacucugauaauuaccucucagcauaaggguuccuuuucaguguuucuggccuuuggaaugagaaauauaucgcuucucggccuuuuggcuaagaugaagug

SEQ ID NO: 2040 - RNA, 3802 nt, Mus musculus
cugagccuuugaguaaaacaauaagguauguaucgcggcuaacacaugcaaaaucauagcugcuagauugugucucugacuugagcaaggugcaugucucugcagggggugagucugcugggauagaaauuuucucucagaauauagaccugcugcuucugggacauagauuucuauuaugcuauuuccugaacaaugcggccacuuucagaaauccucuuccaggaauuuugaaaggcuugagcccucgucaaaugaggggcagaugcugagaaucugagaagucuuaaggcuggagucagaagcuggcagggaggaacagagcucuuuagagguagucaaccugagagcccgguccuucaguccuucgaucacacaggcuaugguaaugcuuuagcacuaauuugucaccagucugcugggcccauugccucgacaacgcaaagacaagaggguagggaauaagauguaggcaggcagcaagcuaacaucuggaucagaauuuggggcagagauauagaagcuuaugucauuauuuauauguagcuuaucugagaauuuuuuguuuauaaaaauuguauuuauuuuaugugucugugugcacccacaaaaaguggcuuuaagguaagcuauuuguguguugaguauaaugguugcuuuuuuuguuguuuuggguuuuuuguuuuguuucugguuuuuuguuuguuuguuuggguuuuuguuuauuuuuugggguuuuguuuuguuuuguuuuguuuuguuuuuagacaaggucucucuauguagcccugacuguuccggaacucacuaugcacaccaggcuggccuugaacucacagagauccuccugccucuaccucugugcuaagauugaaggcauccaccaccaugccuagcuugugauggcugcuuuuaaugucaccuugcuacaaguuagaguugccugagcagcugugccugaagacuuguccuuagugucucagcugaugcaccagcucuguaagcugccguagcaggccagacuguucaaaggggacaugggcagaaggaagggucuuugucuggugcuuggccuucccucuugcugucguugauuaccucucuuguugcuauggugaucucuuugcugauacaagagccuccauuugcuggcuuccaucaucaaugaagagucaauggcucuccaggaaccuucagguuucaaugcuaaauuaguucugcugaggcccacaucuuaguggacugagcaacuacuagauugucugucucuucaguaugaaaagccaauacaugacuucuccaacugcugagaauagccaauguucuugguuacccuccagagcuugacaguaagacucuauugcugaagacaccacauauuugagucauagaacauggagaaaccaagccaacauucaccuggaaacuguaucccuguuggcuagcuuucauaggguuggaaggugcuaugcacaauacuggcagaaaaaggcagucacucuuacccagcagcuguuacagcaugcacaagaucuguacaaacucaagccagacaaaacccaagcguggagacagaagaggacacaaauuccauccccagcugaggaacuucuggcgauugauugcugcugagaaagggagagucagguuucuuuaagggugugguccuugguaggucagcugcucuccaguggaaggcuacgcauccaagugucuaugggcaacacaaacuggauuugauaaguuuaacaaaauaaaaaggaagagauaauacugaguggguagaaaaggagagggggaucuaggaggcacugggggaagggugaauaugaccaaaauauguuguacaaguuuucagagaacuaaaaaaaaagaaagaaccacaaugugaccugagagggaagcagagagaccuuuuuaaacccaugggacccagacauuuucuuuuuucuacuuugaggguggcaauguccccuggcucaugaucccuggacccaaacacuggauuagcuguagcuccugacgauuuggaccugaccccuguggcugugugaacuggguguugccuguaugggucgccgcuuuccuaccuacguccagugugcauucuuccuggccuguggugagcgagcagagggggaugacaaaugggaagccccagcagcagcucugaagaagucagggauuaaugggagcucagcuucagagcucacugggaaagcacacaccacugcagcugggguugaucagcugaagucuccugguuucagguugucucagagcagcagccugcugugcucucugggugcucccaggagaggaaauuacucuugaggccaaagaagagcugaguuucuuggugguucacuagaggccuucuuucgagaagcaagcagccugccucuggaaagcaagugacccucagguagccuucuagauccuaccuuaucugccuucuuucuguauguggccuccuuccaaucucucuucuuucggcccucagcucacacuaaaugguucucccuugggugccauucguacguugugugaauaugaucugucccagaagauuuugaucucaguagaguagagggaucucaauggggucaaaguuauugaggcugacugauguacuuaacucuguucauugcuuuaggguggacccaggcacaaaugacuguauuaucuucuuucccaggagaacauuccuggagugucuagcccucuuuccaaucuccuggugugucauuugagacagcucucuaagcaaugcauuugcuaaaugcuugggugggaagggucacaugggcaggccuugugacugagccugagcuugagucccaagugugccauuuugggccaugcuucuaagccaagacauuuccucuuuggaagucaguauucacuuauccagguuguagacagauucagaagugaccagauauugaaagcacuccauaagacagaaaguuccuuauagcccuuaguguuaccacaggguuccaugggguauaaaauaaauaagaccccacuuguacggguuuauagaaugaaagggaagacaauggaggcacaucugcacagcauuaagaacucuguaucaaagguuccaacagaagagacuguuucuagguagcugaggcuauucaggaaaacucuuggaagagaacacacacacuuggaccacucccccagcuguuucucugcagagccucacaugcagucuugugacaagccagauaacaagugcaggaagucacaggcuacgcuuggcauggaacccagacuucaugggguacagucaggucuccaccaagaagugaccccagcaccgucugaacugcugcacugacacaauuuccaucuccugaaagugacgucaggagggaacacagagcugcaggacaguuugggaccuuauccaaguguccuggcccugcuggugaaacuccuauuucuccaucccucccucugaagcaaacaaacuccccagguugccaaaaggagaaaaugagaaagcgcagcucacacaccaguguauagaaaucuuacugaaggguuuuuuguuuugcccuguuuuguuuuuaugauuuagcacuggaacaauccaugguucccagugccucaguuuucucaagcacuuccaaauuguugcuaagugacauccaaggacccauuuguaugagccacacacuucccugauaauggucacuaauguucuguuccagucucagugcuuugaacuagacgguggcaugacuaauccaaugaaaguuccacagaagacugagucccaccaggu

SEQ ID NO: 2041 - RNA, 8108 nt, Mus musculus
guugcuuuaguuuguaucuuuuauuuuacaaaaaaauagcaaaaucuuucuuuucacaaaaauagauuucccuccuccccccuccccuguggucccuuuucacagccuagauuucagaauauauucugcagcccaccguggggggaaucucccacuguccucaguucugagacauugccaaagcugcaggccagccuguuucccuuggggacuuuucuggagccagcagacaucccagguccugcugccccggagagccccacuguuucuuuggaaggcaggcaguuccucagccauaagaaggggccugguuuuggagguuugccucagcagccaucucuagccaggccagggugugguagggcuuuguggcaucaggcuagaaauccuuacucaaagcagaaacaguuguguccuggagagugucugacagccucuauuugcacaugcaucuugguguugcaaucagcaggcccuagaguagaagucaagagcuuugaauuuuuaccgguuucaauuuccuccaaugcauauugagagacagagacaauauucuuaugugacuucuugcccuccuggccucucaggauaaaggcucuggaagggcagaaaccuauuucugccgguuucccugccugugagucugugcagagggcucagcauggagguauuaaguaauggcuaaugaauaagcauccuagccucucuggauagcuguggcuuggaaauccaagaagccugaauguaucaggaggcugggccgaggcagguguuuuuaggaugggaaggucuccaucaguugcaugauccucaguguccugagauagaagaaaauuggauucuucaauucauucaaguuccaguggcucccuggucuggagggcuauuuugugcuggccuucagucaugucaguagauucuggguuugagauugaaguaucuuguguccaaguucaagauccaggggacccugagggaucaaucccaacccucaagaggcugaccauauguuugcuuguuuuuuuuguuuuuguuuuuguuuuuuuguuuuuuguuuuuugagacaggguuucucuauguagcccuggcuguccuggaacucacucuguagaccaggcuggccucgaacucagagaucgaaccuaccucugccuccuaagugcugagauuaaaggugugugccaccacugccaggcucauaggcuuaaugauaucaggcccugcuagaggcagagaugagugaacuaacaauccauagacauccuuggcugggcaaaucagcccacauggugauaggucagagguuuaaggaacucagggcaaagcugcacugucuaaccuccacucaaaugccagggacucauguuuauagaagaugguagucuagaagauucagagguacaauuccaucuauacacacacauuuguacacuuguacacauggucagaguugggucacuaagcugucauuacuccuaaaauggucauggacuuauaguuaaccucuccaucuaucuauacauccaucaucuauccauccauaaugagagccuacuaugugucuggaaggaccuagaucucucagacaaaucccacaaucacacacacacacacacacacacacacacacacacacacacacacacuugcuuacucaggaacaggcacucacucucuauaauuuucuugccagcacucagccacauccuuauucccccauggaguugggaacugucaugguagaguguaagguugaaauaucagagcagaacccugguagccugcccuacucuuggacuuaauaugaggggcuaaacuccuuuucuucuguggcccacuuggaacccucccuucuucaugcauucuaggaugcagacagacuucugagaaguccagagguguugggucuauagaggguuccuacucuuaagcaggccuucagauuucucuacccacaggcuccuaaggguccccucuccaggcuacacugucugcagaugguccaucugacaggcaacagcauccagaucuggacucagugacagauccguucugucaucucccucuguagagacacaaaguaaggaaggguuaguuugaucucagcuugccaggcaacuccuugccaaaucaugggguuuauugagccucaccccuccaccccuaagcugcaaaucauggcagcagaucuggaguuguaaacugacaucuccaugaauucucuaugagaguacagaaucuaaugauaaaugaguuguagccccuggguauaggcguuucauacagcuccuuuggaucugaacuuucaggagcgagcacugguagcacaggguagugagacaugaccuuaccaguggcuccaguucccucugguccaccaggcugaacuccuggaugaaguaguaaaagugcuuauagcagguguugacaugugccuccgcccccaugcugaggaugcugucaaagugguggauguagacauggacaaagacucggaagagucgggucaggaucuuggugcagaccugcuggaaguucuuggggaagggaacuccuagggauggagaugaguggaagaggaaucaaaauccuagggagaaaacucugccuccccccacccaggcagucuucaccccuccuccgcacaggacccguagagaaaggcagaacaagaguuucgcuuucuccuauaguuuucuuuuugagugggaagaagugcuggggacugaaucuaggaauccauucacaccaugagcccuaaccccagcagaucuuaaaaugccuucuuccugcucuaucccagaucaccuuccacauuucccacuccuuaagguagggcuuugcaagcuugucacuggccagucugccucagaccacagugaaaauuauggcauaaccuuuccucagaaaccugagcacccauacagauauacauacacaccacuuucuccuguacaguccaguggggagguugucaguacgugggccaguuuuuaaaaacaugggccuucgggguuaagucuuauuaucacagcauggcaaggugcaaagcuuuuaugagccaauccugauggcccucuccagucgcaugcucaguucugcugcuuacuguucucacagcuggcucauuacucucccgucccccacccgcuugccaacacuccaagaacugcuucagaauagcauucauuccuucagauauucaauaauauaagggacuuucccucugugagcccagcugugagcugggcccuuuguaccucugcccucugcucuucacaauugugcugauggcucugauagucauuccagauaugauaaaauguagguaauguguaaaggugaagccacccgccugaggacccauaauuauuacuuaguacgaaccggaggcaggacucaaacccucuuugcacagcaguaccucuuagagauaaauaauaucaauccugccuggccaggaaaggccacuagaggcaugggaaagccagugcaugugcaggccccacauccaggccagagauccuggugguuuacacccucauuucuacuaugacagaaucauccagucaucuaguggaaaguuuacccagggcucacaaacccagggauguaggcuagaggaaauaagagccaggaucagacuaagcccuaguccauacacauccuuccuucccacuguucccuggggcuugugcucugccucucugagaacccagccuaguccccacacuccugcccuacuuaucuggacaauggcaucugguccccacaacacagaauuccaguucugaagccuuuucuauucagugugcuaucccaccauuggccucaguuuccuccuguguaaaaugaagguaccuguugcacacaacacugcaggaaaugguagcaacagcuggggagggggcggugcuugaauugugacucagugcccagcuuuccccagcauucagacuucuucccucggggcuagaccaucugccccacccacuugagucucuauagcccaggaggaugcugggacccaguuugcagguggggcuucugugaugaauacaguucagcuucuggguggggucccugggccagggugacauuauucaucuccuauccacacccuaccugcccaaguccagcuggacccaacuagucuguggaaaagauaccaaaaauuuugggccaauccagcuuccaauccuuccugucccugaagccaggauucagaggggacucuggggaggcuggaagcaagaucagcccaagcgcaacaauauaucacuuguucuggagaguggaaaaaugggguuugugacaugcugggauaguucacagugaaacacucauguuuuagacacgaggugccccaaaugggaauuagauaguccuuguuaaauguuugaucauaaccaagaugcugccucaaccgguuuccucuuccacaauaugggaaggaccuucccuggcuaggcuaccucuccagucaucagugcucacccacacguguaggaaagacauccucaucauugaugagacccucgauccaguccaugagcaaugccauauagcggggugcugagagcuuggcgggccuucgguacugacgcucguccugccagcgguacucguagcggggcccaccagccaugacugggcagcugcucucacugcagugcucagccauggugccauagaugagguugauacgguugaagaaguccaccacaugcacagcgauccagucaucgaugcucuccccaggcggcagccucaccacacuccgaagguccaggccggacuugagugaagcuugugccuucuuauauagcucaaagcgcugugugccaggcucgaagcgcuuccggggccggaaagucuuguccuucgcaaacaccuguuucagacacagugccauggccaggcgggugcagcuggaucucucggcacagggacuugaagaugaccugccagagacaggggcaggggaaguaguggucagggccuuagaaaguggguuuugacuucccaacacaucauuuuucucuaagcugucagcccggggacaguuucuuuaccuccaugaaacucucauccccagcagcgucaaauccuuuguggucuacuuuagccgcacaccccaccccugaagcagcgccacaagccuuucuuucugcuuccuuuccucccugcuuucuugaaaucuugcagagggugugcccugggcuccaaaccggugcuuacaggacuuacuguugagcuuuacagaagugacagaggguuuugcaggccccagacaagguauccucuggaagccccauaggccaucuguguagugagagagccuggcugcgcuguacuugagagggggguggacuuugaguuccucugggauaucccgaaguccaucuggccaccggggauucccagggaacagaagggacuuuucuaccaaaaaugucuuuuccguuuucuuuacacugaaagaggaaagggcccucacaaggccagcugaguggccuuaaguguggcugcaggcucugcaggaagaggaggguggcaggcccagaacaguguuacuuccucugacagacacuagaguuccuuuccucaaagcuaaccccuccuucaauucccaaacaguaugagccgcugaccuuccccuugcacccaacacuccauggauuuucagcaugccuacuauguaugcaccuagcacugggggcugggguagaacagccagacucacccuaccuguccuucugcauguuugcguuaccucuuagaauagaaggaucccagacucagcacagacuucagggagcauccaccagagucucccaaaguccugggaucuugucccugcuucaaaacuagcuugcuugcaucaccauggauuuaguccaugcgaauccuugaacacccuacagguaggugucugagcaucucaggcauuucaucucgcgcaccaauauacaugagcuauuggaggacgcagauccaggcaauggccaagacugcaacagccacagacugaacacggacccugaacacagacuuauaaacuaagcucaaguuccaugcuaaauucuggcuugcccccagcccugguuagucugagcccugagccucacacugaaugaggcuugagacaguggcagagaaagcuuauccuuaccucugacugccucugacucaacuuugaagcaaguuuccuuuuucauugauaacugcuggggcaggacuggggaagaaagggaggggauaaggcauuucugaggccuccgcuuuccuuuggccuccccauuacugauugauuguuacagauucucucacucugccuuucaauuccacagccuaccuuuccugacccaccggccuccagcagccacccugggauucuucuugaucccuaaacauguccucacuguccugccugugugucuuuugcuggucaguuucuguuuucucuuucuaucugaccgaaugaucccuucuuuggcagcuuccuccagaucccaaccuuguguguggcuucucugacugcuuguuccuaccccucuccgucaggacuuaaguugguggcuaggcuuuagcuuagacucuagagucuuagaguuggcuggggagaugucucaguggguaaacuugccugaguuugauucuugggaccaacaugguggaaggagagcacucccacaaacugucucugaccuccacaugugcacuguaaugcgcacauaaauguguguguucccgagcucauacgugcaugcaugagcaaguguguggacacacauaaauaaauguaauuaaguuuugaaaguaaaucuugccucucaauaaaugaaaagugagggggaaagaacugauaucagcucugggccuccaucucugcaugcccaucuucauauacccacagcaccacacacacacacacacacacacacacacacacacacauacacacacacguugggauagcugagaggucaagugguacgucccacaugaacagauggcgaaacugaggccuaggaggaggauuugaggagccugaauuugcacagcaaguuagaaguaggggacugguauaaaaagggacucagccuaugacaagguacaaagugucccuuuccugcugucuggccacuggccugauauagauaauugugaaggaagggaguagagaggccccaccuccuuaguauagaacuuuaggccccaggacuuuuccuagaaagaguaaacuuggaggugaguacggaagguaagcuaagagggcaucccgucuguuagcacuauccucucccagccucacacggagccucucuuccucuucccuguggaccccccacuuuaauuacuagguagguggucagugguuugcuuacuccgugaccaagcauuuaaucuuccuagaugaagagcacaggcugacugacacugccuguuugucuuaccucguccccugccagggacacaccugcuccuuccuuagucuggcuuagaaucagccagaagauggucccaguuugaacucagaaucuagccuagcacgcccugcgggacaagaucuaaguuugagauucucagagaaagagggagcgacagacgcagcgcuguccagccagacccgccccuaccucccgcgagcuccuaagaaccuccccuuagcuucagcuguuagggccaaacagguccuaggacccagaggagccagccugacauuuccgcuccugaagacacgccccccaccaccgccagcuaccgccacccccaccccggacuucggacacugagagccucggacccugggcugaggacuguggccagccugcuuuugggccggagucgcuuccagaaggugccacgcgaggaccaagaagaacuaaaaguggaagcaagacugggcccuggggggcgcggagacgcggcgcucacucacccgcuccgccugaguggacagcuccgggucucugucccugcggccacaccgcaacgcgccggucguccuccggccugugaucccgccgugcgggucucagcgucuacccaccagucugaucugggccgcggccgccgucccgccgccagugcucgaggagacg

SEQ ID NO: 2042 - RNA, 8317 nt, Mus musculus
auuaaaaaucugagaacuaacaagugcaauuuugcaagacuuacaaaguaaaauagaaaggugagauacaguccagugguaagguacuugcuuagcauguacaauacuguggguucaauuuuaugggggaaauuuuuuuuuaauauuuaaaauauaauaaaauaauaaaguaaggguauggcaaaggaaggacaaagagcaaguuugcagaucaguuuauuaagaugaagucacugcuagucacacagaagagaagcuaccgccaaagucagugagguucucgagaacucacuccaucagacaccgacguccagaaccacaaggaacuguuccugauucccagugacaaggcugaggaggacgaaucugcacauuuacuucaaguuuuuaaagagcuugugggccaccuagacaagaaaaagaaaauaaugucauggacuccugucccagccaccgucagccacagucgcagcuggaccucgcuccucaacuugaagcaaaaaugccuacagagacugagagaugcauugagucccugauugcuguuuuccaaaaguacagcgggaaggauggaaacaacacucaacucuccaaaacugaauuccuuuccuucaugaacacagagcuggcugccuucacaaagaaccagaaggauccugguguccuugaccgcaugaugaagaagcuggaccucaacugugacgggcagcuagauuuccaagaguuucucaaccucauuggcagcuuagcuauagcgugccaugauucuuucauccaaacuucccagaagugaaucuaauccucucaguucccauccaaccaccaagucaucaccucccccgaccccauccacaccugcacugagcccagcacaccuaccacaacauguaucccacgccugcuggcgaaaauaaaacaaugccauuuauuuaaauguaaaaaaaaagagagagaaaauaaugucaucacuuagcuuuaaugucacagggcacagguccuuccuggccugaacaguagagcuccugucuugacccucauucuucagcauguuauccauacgcaggcccuaggaacucccaugggguaccugacuguccugucugcaacucugaaguuuuuuuuuaucguuuacuucuuuuagaaguugcauguuggggcuagagagauggcucagagguuaagaguaccaacugcucuuucagagguccugaguucaauucccagcaaccacauaguggcucacaaccaucuauaaugagaucuggugcccucuucuggcccacaggcauauaugcaggcagaccacuguauacuuaauaaauaaauuaaaacaaaaaaaagaagaaaguugcauguacucuccugcaagcuuccacuacaucaccacacaaaucuguuuuuacaauuaccuuggcaggaaugugccaccacccuacuagaaaucuaaaccuuuuuguauuucucuugauauguaugugggaauggaacugcugcucaguguuaacuguggccauaugcuagaucccugcuuaacucuuuuuuuuuuuaaacauuuauuuauuguuauauguaaguacacuguagcugucuucagaugcaccagaagagggcaucagaucuuauuacggaugauugugagccaccaugugguugcugggauuugaacucaggaccuucacaagagcagucagugcucuuaaccacugagccaucucuccagccccccugcuuaacucuuuacccuaaagaaaaagaucucccugcuuaaaccaggcuuggcuucaaauagcuggccuccagugacacuccugccacagacucauaagugguuaggacuaccaauguguacuaccaccguaggccucucuaaggaacugcuaagcuauuuaacacaucggcugugcuacuuuuuauuuuuucagcaaagugugaaauuuccacuuuuccugaauuucuaacauguaauacuacccuuuagacacucuacgcccuacaggugaccaaacccagaccucacuaggcaagugcccuacuaucuacauauagaauauauucucaggaaguuggcuacccaaucaauuguccuuggcuuuugaggcaagaucucauucuauaaccuagauuggacuaaaauuauguagccaaggcuggccucaaacucauggcaauccuugugucuaaaugguaaguacuaggauuauagaucugagccacuacaccuagcuuaccuagucacucacucuagaguccaggcuggccucacagacagaucaccugccucuaccuuccugugcuaggauuaaagguguugccaccagugcccagcccuaaccaguuuuuacagaaccaaucuuaucaaauucugcauauguguaguauguguaaaauacuguuacaugaaagugugaagcacaaacuuacuuuaaaaagaaaaaaacuauacaaacaacuagguacaagacacugaaggcacauauacacagaaagauuagacuauucaaaguauaaaaucugagccuggagcgaugaucacucagugguuaagaacacuagcugcucucauagaggacuuuagauauguuuccaguacccacaagucagaacuguccacaaguccaguuacagaaacggacuuucagcacauacauggugcacaggcauacaugcaggcaaaacccauacacauaaaauuauuuuuaaaauaucaauuuuuuuaaguuuuuuuuuuaaauauauaaucccaggcuggcgguguaucucaguggcuagagcauuugccuagcaugcauucggacugugcuuuaucuccaguacuaaaagaaaacaauguauacaauccagcauccuuaguauuuaacaaugcauguuaggucaucuuuuucccugucggagucuguuucaauauguacaguggagacaaugacaccuccagcauaugagguaaggaugggacaccuauguauauaaaaugcuucucacauaacuugacauuaugggccuauaguaaaugguuagauguaucugcuuagagcauacacacuguucaaacugauagccacuguuuagcuuugcccuuucugucuucagacugacuuacacaguggucccgugcaugcaagaagucaaagagcuccucuguacaauccucuucugucugugaccgggaagacacgcgauuaucacacaacucuagucguucccgggccuuuacacacuucuccagcuguucacagugcucucucacuguuguuaggggguccugaugaagaaacaggggguguggggggagaaaaggaacaaaauggaagcuucaggagacaucuacuaaauauaaacaaguuggucuuugggcaguauaaucaacaaagaaaggcgcuacucugaguuacuacccaggccagcaggcagagccauacuauagccagagcgguaccuauuuaauaccuccuggcucuuugaugcuuaagcaguagggaaguuucaaauuucugccuuccaagguugccgguauacacugaaagccucagcccuaucugagaaacgagagaguaaagggaaccuugccaagcaggaaguacaucgacuggaggcaucguuuaacccagcauuaggauucaauuucucuuaugcaaaacucaggccuggcccccaacuugcaaagucagaaaaaugcaaacauggagaacuaagaaaauuuccuucuagaguucuuuacuaaacacacacagcagaucagugccaggccuucaggaugcugauuccugguaggaccaaagaagccccagaccuaaaaagacauagcuuucuaaggcucacacucccacacaaccuacuacugcacaggagguauuaaaggcuugucccagcauuuuccccaaguugucacagauuccuuaaaauacccuggaguuucaauacagcucagccuuccaauucuaguaagguaguuccaaacuggaggccgcucuuaccacuaguucuuccucuucuuccuacaaaagggaaagaaaauuaaauuagcagccauuguauaacaugcauuucccuaaucacacuuauaccauaauuaugaacaagagacuaucagucacauucuuuuaugauguuuugucauccuagcuucaaucucagugcuaaaucuugccuucccagaacuagcuaauuuuuagggauaauauacauuugccugggaacauaccuuucauguaccaaucuaagacccaucuaccaaaucacuuucuuaagcaaaaaucucagacaccaacuuuguaucaccccgauccagagccaaaggucaacaaggaaccagcaccacaguucagagcucaccgaaauuacucaaacuaccuaauccuuaaacugauuaagcuuguucaccuugccuccaucauuccgccccacaggaaccaaggcuccgaaccuuguuuucccugugacucuuuauucgugcuugauauggucucacuguagcccagacuggcuucauuuuuguaacagacccccuaccuucccuucccaaguauugaaauuaaauacaugagucacuauauccaguuuccuucccaacuuuuauaaaaauacugguguguguguguguguguguguguagcauuugcacaugcgugcgcagguguagguguguguaucauugugcauggcggccaacgggaaugggccaucagguaucuaucuacaaaacaaaaacaaccacaaccugccuucauuuaaccagguguggggugcucucuuguaaacccaacacuuaaaaggcagaggaccaggaguccaaguuugaguucagucaaccuggaugauauaugacccugucucaaaacuauaauaacaaacaaacaaacaaacaaacaaaaaauugccgggcagugguggcacacgccuuuaaucccagcacuugggaggcggauuucugaguucaaggccagccuggucuacagagugaguuccaggacagccagggcuacacagagagaccaugucucgaaaaaaaaaaaaaaaaaaccaacccccccaccccccaaaaaaaaccaaaacaaaacaaauaacaaccuauaauaacuaaaaaauagcuaaacuuuguuuauaucccaaaccaaguuuagaggaaaacuaacuuaaaaauauuuucacuauuuuuuuuuuaacugcagggguguguauguguguacgcacauaugaaaaugcaggugccuguagaggugcucucaaguugaauuuggaauaugaauauggucaaaccuaaauccuucuuuagucaacuuaaaguuauaaucacugccuuuuaacuugcagauaaauauaagaaaagggaacaccaggccccacauaaucuauuucuaauuccacuguauaacuuuuaauuaguuuccuuucuuucccuaauuguaaaaauuaccuguuggagcacagguccuaaaucuggcacauggcacagugaucugucugcuguagauacagguauccacaguugggagaagauaaagacacacagggaaaugagcucaacaaccauguuucccaaauccuaaccaagacaguacccuacaagugaggacaggaggugccacuguaaccucugcucuuuacucuuuuugugauuggcaagguuucuccuaaguguaaagauguuacauagaauauagaugcuaguuuuucaucaauaagguuucuuaaaacgccuuucaagaauuuauuaaggggcuggagagauggcucagcgguuaagagcauugacugcucuuccagagguccugaguucaauucccagcaaccacaugguggcucacaaccaucuguaaugugaucugaugcccucuuugcuagcagggcuggagcaggcaagcaggcgggcaggcaggugggggggugggggggauauaaaaaaaaaagaauuaaagggauagagagauggcucaguagcuaagagaacuugcuguucuugcaaaagaaucagcuuugacucucuuuuuuaaagauuuauauuuaaguauaugagugguuuaucugcauguauaccugcaugucagacagaacaaggcauuagaucauuagauuagacagaagagggcauuauagaugguugugagccacuaugugcuugcugagaauugaagaacagccaguguucucaaccacugagccaucacuccagccccacuagauuugacucuuaacacccacaugucaccucaagaccaucucuaccuccagucccaggggauccaacaccaucuuccagccacauauguagguaaaacaauuguaugcauaaaaauaaacuauuuuuuaaaauucacaaagaaaaaguaucccccuaaaaagauccucugacaucagagcucagugguaaagaauaccugaggcccuggguccaaguccuaaaaccaucagguaaaauugcuugcuaccaagcccgacaacccgaguuugaucccaggagcccaugugaaaggaccuacagacagaagcaugcacaaaccaacaccuauacaugcucacaaaagauggcucagcaguuaagagcacuugucucucuuccaaaaaaacccuggcucuuccuagcuccuacaugguugcucacaaacguuaacuccaguuccagaagaucuagugcccucuuauggucucagagggcaucaggcauugcaaguggugcaaagguauacauguaagcaaaauacaaauauacacuuaaaguaaaaauaaaaucggggggggggggggacacaccugaaauuagcauucuagaagcaagacaacugugucauuucccaauuggcauuacuauaacaacacuaaugugcuaaaaacaccaugcuaaacaaauccaaauacaggucuaauucuguuuccaccaaugagaaaauccaaagucacacugaauaaaaagauuucaucuccauucauuauggaucuuucacaaaauuaauuuaacuuucuucauuuuauuauuugauuuguugguuuauuguuuuuuugagaaaggaucucuauaguccuggcugucauggaguuugauaugaagaccaggauggcucugaacuuacagagauccuccugccauugccuccugaguguugggauuaaagacacggaccaccaugcccaacuuucuuaauuuuaaaacuucuaucugcugugguauccuguuaaacuuucugagaaugaaaacuugaaaaaauuaagggauaaauaauuugccaacuaauuaauccauuaagcccugauggcuuguccugaaguagacaagacaaaugcacaggaaauggaagcaaagugagucucgggcuagagcucuggcucucaagccuggacgucugcauuggagucccaguuguauugucuugcuaguugugugcccucauucaagauaaacuuccuugcuugcugccucauguaauaaaagugacaaaaauauauaauguaccugauauuuaccucauggggaaacugugcaaguuaaguaucuuagugcauauaaagcacucagcacauaagcagccaauauuuaucacaaugaugcucaacuugggaaagagcucccucuugcaccacagaauuacacuacacauucuuaaacuguccccaaaggcacaaguccucggccaucuccaucccaaaagauaaagaaccgcuuuuuguuggagaugcugggaagcgaauacagggcuuguuaaugcuaggcaagagcuuuaccaugaagcuacaccccaacuccugaaagcacuuuuccgaagacuaggguccccgaaaucuccauaaauaaauucugaccuaagcuacguuaaagacuaacguuaguuuuuugcuucacgcacuuaucaaguuagaaccucaaaacauuuaucaaauuagaaccucaaaaaccuggggggggguuguuuguuuguuuacacaaguuuaucagugcagcauuauaaacuccaguuacacuuucacauuccugguuuggggaagccaaucccgagaaagacuagcuauuaaucugcccaaggucaaccaaagaauucugaagguaaguaacggaaaccaccucucuggaccccgcaaacccuaggcuauaaacccggacuaagagagccccgggaggugcuuuguugagcuaggucccgggcccgccaaccucgaagccuuaccucuuuggggucuccagauccagugagcaucuuucguucguccucuagucccaugucgggagccgguuugggauccaacaagcgcaaccagaguaguacuccacuucagguuuaagaaggacuaguaagggucacucgacggauauccggcgaccuggccggaagug

SEQ ID NO: 2043 - RNA, 8354 nt, Mus musculus
cacuccggaggcagaguuggguggaucucuaugaguuccaggccagccaagauaacacauagugagacccagucucaaaaaacaaucaaagaaaccagaaugacuucuuggugauuaacccuuugagucccagguaacugcccugucuuccccaucucauguugggggagguagccaaguugacuacucuccugucuccaagcuccaaugccucaauaguuguuuugcaaccaccaaauccaacagcaguacagccucuggcucuuuaaagacccucuccuccccugccucaaaguggucacauuucaaagugacuucagccucuucucugcuguugcuggaucuccuuacugugcccauagcucugggguucagacucuuccuuccucugggcacccauuaucuguggaguucaaccaccccuuacugugcccauaacucugggacuccugcuuucuugcccucaggcuggaauuuugagugcuguaucccaguccauacucugaguugaucuguagcgcuccccuuccucuuugaagcuauugcauuccauuuuuuugaggcucauuucuucagcuuuaaauugagcugaagagauugccugccuccuuguggccauuaugcaacauugcuugaguugcugagugaaaucuccaaguuuaaauguagagaggauucggccuagagauggccuagauuuguccaguuccaccuguugugaagcuguagcaauagcuauguuacagacuuuacugucugucugcaaacccacaguuccauccuuagacccacuacccagucaacaccccaaagccccaaaggauuugaaaacuauuuuccucauugucagauuugagacuugccuggguauaguggcacacaccuggccuguaaucccagcacuggauacagaucaggaguucagagucaucuucaacuacauagcaaguucaagccagccugacuguacugacuauaugagacgcucugucugucugucucucucucacacacacaaacacacccuaccccuaaagagucaauugagucuuuagaggagaggagagggauuucaaccugacuaggugaagggcaugcuggucuggacaucaggcaagcccagaccaguaauuuuuuugugugugugugggggggagacaggugagaugguucaggcaugggggagaaguuagcacuuuggagcuggggcuuagaagcuggguugggugaaauuaggaaaccaaguugaucuuguaaagguaaaagugcuccacaguucuaaaaugguuugaaagcguuggacaggggacaugcgggagucauucugagauucccguguuuugagacaggaucucaauacauagcacuggcugcccuagaacucaacauuguaggccaagcuggcuucaaacucacaaagaucugccugccucugccuaccaagugcugggauuaaagguguguaccacuguauccagaguuguaauugucuuuaaaguugguuuuaucagaaagcaucuauuguagucaguguuggcauggcacucacuacguaguucaaucuugucuggaacacauggcaauccuccugccucagcuuccugagugcuggaauuacaagugugaaccaccacacuuggcuuugaguauccugucuuaauuuuagacuucaucaggaggaguccaugagcagauguaucccuaguccauccuagcugccucuaaacggccugguugagaccuggguguccuguuagcaugaaucuuuaggaguuauaggugggagcuguuuucgagcucagcaaaguauggagagguuagagaugcagagagacaagagagaugaaagcaggaugaagucugaggaagcacacugcucuccaaguaugccagggucuuccucagaacucauaauuccaagaugguagcuuuggaaacaggaccugggagggguaagaugggucuggccacccugauuucaucuguccaggcaacaugagacugugggagaggucagguguuagggugaguauuugauagaaguggggagugguggugguugaauggaagcuuaguggcaguuccaguuagacauauucgggguuacagugaacacaagcgcuuuguggguauggugccagguacaggcugaguauucaauuacgcaugcucagagaauacuguguauacacccacaaagaaauguaagauauaagaagaaaauuaaccugguuuauacauuaagcauuuaaaaacauuaauucuuaauccuacaaacagugcauuguuaccaacauauuguugcuuagaaauuuacuaauuucaauagguaaucaauaagccauaguaggaggagcucagugugacuguaaggccucuagggaaccuauggccccucacuucauccccgcucggccacacuuccucauucucccaggagaacagcaguauaucgauuuguugcugcugauguaaugaauuacuauaaauuuaguggcuuaaaaaccaguuaggcugggcaugcuaguacaugcuggcaaucccagcucucaggaggcuggggcaggcaggucgcaagcuuuaggcuggccucaagaaaggauucagacuuauauccuuaggguuuuuaaaaccuggagcccuugugaccaaggguuucugcaggccggguucuuggcaguuucucccuuccaguuccacugugcgugccuguuccuccaggcagagguaauuacacucccagcagacuaacccaggucccccugagaagcagacaugucuccuuuuuaaauguuuuuuuuuuuuuuuuaauucccuagugguuaauuaucacugauacuugacucuuuuuuuuuuuuuuuccuuuuaguuccugaucccuagucucaguuuucucuuggacagagauauucacucaaacaugucaauguauguguuugugcaugugugcauggauauaugauucuggcuuuuauguguuuuauguguauaaauggcuauuugaugagcugcucccauuucagugacaacacaguggagggcguguuuuucacuuauuccacagaguacaauauuccugggcacgauccucucuugcacauggcaggccccagccuccuccucauuucagaugugauagccauaaacuuuucuaccaacuuuucaccaaguugcuguacuguucaccggugauccuuuuauuucaccgggauuacaaaaauaugauuuccugacacuauuaguacccuuucauuuauaagucuaauucuguacagaaaaacuucacaucucagaggaccacuuagauaaucugaaaauaaaguacauaccagugauaagugacaaaugcuuaagugucuucccucccucuuuucucuggacagucuuauuguucacacuggccuucaacucacuauguagcugagcugaccuugaacuccugaucuuccugccuccaucuucuaaguacugagauuauaggucuacaucacugugccuagcuuuacagaaauaaaguaaacccaaacagggucucccuuuguaguucagguuagccuggcacccagggauccuccagccucagauuccauguguuugcuaccaugccugguuuuccauaucaccuuugaagcaguaauugcauuucaugcuuuuguucugguuuauucucuguaaacuuacugguaugaaucuguagucauuguaaaugugaugucuuucaauuaugcaggguuuuuuuuuuuuugguuuguuuuaaauauauaaaauauaaaacaugcgggagcugaagagacggcucagugguuaagaacgcuggauccucgguucuuugcacacucagcaacuuaugaucacuuguaacuccagcuccagggggucagaugccugcacucaucugcacuuacacgcucacacaccuacacauaacuaacaauaacaaauuuaaaaauuauuuuaugugugugcacauaugugacuguauguaagugcaacauguguacgcaggugggcacaguggcuaaaaacgguauuagaucuccuggaacuguagcuacagguuguaagaugucccaugugggugcugggaacugaucucugguccucuaaaaaaaaagcaauaagugcucuuaaccacugaacuaucuuuccagccuuaaaaaaaauaaaucgccaggcgugguggcgcacgccuuuaaucccagcacucgggaggcagaggcagguggauuucugaguucgaggccagccuggucuacaaagugaguuccaggacagccaggguuauacagagaaacccugucuugaaaaaacaaaaaacaaaacaaagcaaaaaaaauuaaacaugggacugggaauauagcuccauuguaagguggagugcauuucuggcaugcacgaguccuaggguaaaucuacagaagagugaagugaauaaaguguggugugguggguacucugaagucauggcauuugggagacagaggcggaaagaugagaaguucaaagucauccuuagcuauauagugaguuugaggccagccugggcugcacugucuggagaaaugaaauaaucaagaaaaaguagagaaaauagaguacugaauacuuauacacuuaccaagcaacuuucuuuuucuuuuuaugaagaacuuaguuuauugcguuucucaggggugggggugcaccugccaucaugccuaggagcuccaaaugacaaugccuaggaguugguuuucuccucucacugugaggguccugggauuggaacucagccacgguuaaaagcaaguaccuucacccacugcacuaucucacauaucgaguggaccuggguuuaauccuuagaauccacauaaaagagugagguccgguggcuaacacuaagggaaggucaaacaggcaagccuaugaggcucaugagccagucuaacuagaguaugaggcucaugggccagucuaacuacuuggugaguuccaggccagugagacccuauuucaaaacacaagggaggcagugcauaaugaacaauacccagcauuguccucugccucccagacaccaguacacacacaugccuacacagcuacauauauaugugcaccugcauacacacaacauucaaaacccagcacugaaaaagaaaaaaggcagggcgaugguggagccugcuuuaauccuaguacauaggaggcacagagacagggugaucucugaguucaagaucagccuagucuacaaggagaaacccugucuugaaaaaaaacgguaacaauggggcuggagagauggcucagugguuacgagagcugacuguucuuucgaagguccugaauucaaaucccagcaaccacauggucacucacaaccauccauaaugagaucugaugcucucuucuauggucucugaagacagcccuggagcaagcggggccagagugagagcuggagaguuggcucagugguuaagagcacugacuguucuuccagagguccugaguucaaaucccagcaaccacaugguggcucacaacgaucagaucaaaugcccucuucuggugugucugaaaaaacagcuauaguguacuuacauauaauaaauaaaucuuuaaaaaaaaaaaaaagaaauaaagaaagaagccagguaugguggcguacgccuuuaaucccagcacuugggaggcagaggcagguggauuucugaguucgaggccaagccuggucuacaaagugaguuccaggacagccagggcuacacagagaaacccugucucgaaaaaaaacccaaaaacaaaacaaaacaaacaaacaaaaaaacccaacaccccccccaaaagaaagaaaaacaacaauaacaaaacaaaaaaaguaaaaacaagauaucaggcagguaaagagaaauguugcuaagcccaagucugaucuccaggacccacacagugcaaggagguuuugaaugugguggggguugggggaaagggagacaccacacagauuaccagaaacuaaggaguuaugccaugugguugcugggaaucaaacuaagguccucugcaagagcagccaguguucuuaagcagcccaugaggauuuauucgaaggguucuuaacaaugaugaaccagccugccuccaucuuagcuuuacagcuauccuauaguaaagacaaacuagguucauuccugcuuaugauuaaaucucuauuucucaagaacugggcucugcccaacccguaaccuuaacuacaaauggucuguaccgcauguuccaggaaauagcaaacaugucuuuguuucaaaaaguuauuauaacuaucuggcgguucuaucuuuguuucaaaagguuguuaugacuaccuuuuaugaccacuuugcaaccaugccuuuauuucaggauacuguuaugaguaacuuguuauaauuagguuauuuuccuguagcuccaccuauucugccugccaaauccccaauuuggauucucuaccccugagcuauaaaagcuuugucuuucccacuucuaagacugauuuuuuucuuuucuuuucuuuuuuuggagacaggguuucucuguguagcucuggcuguccuggaacucacuguguagaccaggcuggccucuaacucagaaauucaccugucucugucuccggagugcugggauuaaaagcgugcgccaccacugcccagcuuucuguccuuucuugauccagcucucugcugaagccucuucaacucuccucaugguucccuccuucacaugcugucucuuuuucuccccucuuagaaucugaagucccaccuuauucucucuaaagcucuguauuggcucuguggcuuuuauuggcaaggcagagaaugaaugaggagcaauguuuauacaaaauugagacaggagauucuaagaauaaacacaacaaugccauguccagauuggaacaagaugugggggcagagaaaccagcauuugaaucacacaaggauaaccuuuacacgggcacaaaaacauggcuacaccuguacacaaauaaaaaaaaaaaucuugcuuuaaauuaauuguuugcuuuaacuaauuuggucaugaugauuuggguuugucuuucuccucgaaucuuuggaauuaacaccuaagacagacagagggacaauaguguggugagagugcaggccucagcaccaggggcauggugggaucucugaacacaaucagagcaauaaggcagaggagggagccucuuuuucuuuuuguaaauuuuaagauuuguguuuauggaugcaugccugcugugaguaccacuaugugggugcucuauaucucucccugucugccugucauagaauccauuuaacuccuagugccuuacuggaauacacccagguaaaauacucaacauacauauaauucuaaaaauauauauaccuuuuaaaaaaguauguuagcgucugaccucuccucacggauacugacaagcccccuggugggacauugcuuuuaaggcccauggcuagauaaaggaagauaaugaauuuucaggaugacuggcugcugcuucuuccucuugaccuaagacaaaagcguagcaucugagaacaaaggcucggcaggcuuuuucucugacuguaaggccccuugcuuguggaugggucugucaaauucaagggcagaccaggguguguuuaccucagaguucuggaccuaucaggcuuccaaucuuugucaaaaucuuaaaaucuucgagcccucaaggagagacaaagauccuucauacaguccuccccucugcuuugcuggcuacgggucuuccgugcaccuuuuguuuguguuauucucccacaccuaaaaacagccuuuuguaccuaguggugcaccccuuuaaucccagcacagaggacagaggcaagcagaucucuguggccccuggguauaaaaaaagaaaaaauaagaaaggaaaaagaaagaaaagaugacaaauauuugaacauagggaauguuuccagaaauauuugaaacucaaguuaucaauauauaaaauuguuacuaaaagaauaaguauacaaauugggaaccuugagugguuuuuacuauuaaaaaaguauucauacugucagaaguaaaccaagcaauauauuaaacuuuaaaaaauguaguuauugccgggcagugguggcacaugccuuuaaucccagcacuugggagguacaggcaggcggauuucugaguuugaggccaaccuggucuacagagugaguuccaggacagccagggcuacguagagaaacccugucucaaaaaaccaaaauaaauaaauaaauauauaaauaaaauuuaaaaaaaaauuaaaaaacccaacaacaaaaaag

SEQ ID NO: 2044 - RNA, 9350 nt, Mus musculus
ggccgggccggggcggggcgcgagaggcauggaggaggcggaggccgcggaggccgcggcgcgcggggccgagcugugcgggcccgagcgcggcccgagcggggcccggggccccugagccguaagugccucccagugcgggucucagaggggugaugcgggcugggugggucuucugaaccuuccggcgucccugaucccugagaggagaggaguugagccagaugggaagagacgaggguggaggauuggggugcaggaggucgcuguuacuguucuaccccagggcugggaaggacugggauuuggaccuuuuaaggacugaugaaucguuaagaguugauugaguuacuggccuccgccgcuaaggcccugauccugcacacaguuccucuagccccagggaauuuucaggugauccaacuccuccaaagauuuucuggccagacccagagaaguuaagccacguugccuagggcacacagcucagcaguuugcugagagaagucauuccagaaggcauuaagcuuugggacaagcaucuuacucuaugugacucuauauauaguccccucagauuccugaagucauggacuggccgggacaggggugacucccuaauccaguauggaugacuggaagcccaguccccucaucaagcccuuuggggcuaggaagaaacggagcugguaccuuaccuggaaguauaaacugacaaaccagcgggcccugaggagauucugucagguaaaugaggucccacgugucccaaaagcugcucccuaacuuuacucuaacagacuaggaacuaacuaccuuggcuaucaagaagaggcagcaaauuccuggaggggaaaccucugucuguuacagccuucucaggcagugguuuagagccaggauucuggaaucagaacccuagucugaccucggcauccaacagaaaccagaagucuggucaggcaggcuuugccccugacacccaacugucaggcaguguggcccacguucuucugugucucuggcucuccgcugugguucucggguccuaaauccaucucaaggaacuaguuauggaggggaccaaggaagucaaggacucaaaugggaaaauacaagaccacgggguaggaaggaccugguugguggagggaaaccugccagggaacauucucugggagauggccacaaauccguguccuuauugggaaccagaaaguggagagacuggucccuguguccucuucagccaaggucauacuuucagaaggcccuugugaucuggagagggcuggcugcagucacccccauuuuccuacucagacaggggcugugcuuuuccugcuggugaccgucauugucaacaucaaguugauccuggacacucggagagcaaucagcgaggccaaugaagacccagaaccagagcaagacuaugguggggaccagcugagggugcgggaggggggcgggggacgggacgggaccuggggucucauggcaggaauggcgugcacaucccacagggugugacucugcuagugagucaucgcccacgccuguuacaauucccucuccagaugaggcccuaggacgucuggaguccccucggcgcagaggcagcaguccccgacgggugcuggauguggaaguauacuccaguagaagcaaaguguauguggcuguggauggcaccacggugaguuggaccagcaucuucaguccauucagagcacggugggaaccgucacccucugccuauuggcuuggacuuauuaggauuaaguaaauggucuaugaaaugucuauguggcgaaggcuuggcagugaucaggggcguuagcgggcagcuaacucccuuauuuacuuauuauguaaccacuuccuaaucccuuuggcuucagccuugggccagccacugggguccuagagguaaugggacuugcccuucccagagaggcucacugguagagaguuagcagagacaguccagggcucuuggugccagggaaguguuaaaagguggaugguaaagcgacgaaaccuuugccgaugaggguaccaugggggcuuucugggagagucagccuucugucugaguuagaaccguagacagugauaauagagcaggcugcugugguuccugcuucuaagauggagucaccgugagcgccagggugaauagcuggauucuguuucugccgcuguguaggugcucgaggaugaagcccgggagcagggccgaggcauccaugucauaguccucaaccaggccacggugagcuuaaggaugggagagcccgagggccgaagcugggcuugcuuugcugaugaccccgucucauaagaggguuugcuccugccagggccacgugauggcaaagcgcguguuugacacauacucuccucaugaggaugaggccauggugcuguuccucaacaugguggcccccggccgcgugcugaucugcacggugaaggucagugaggcccccuagcucuggcucugcucggcagcagaaagaacaucuagagaaagguggucaaguuccagacugagccuagcuuuuuguuuuucuuuuguuuguaaucaguacagugguuucugagcucugugccagguacugcagcauugaaugcugaagauacaauacaagacagauucccuaccgccccggagcucacaucucagugguggcgaugaaaacagucagcucagccaguagucucaggaaaugaaauaaagagggggaugauggggcugcauuuuagggagggagcaccucuuuuuggaggguggcaggaugcaggcgccgggcacauggguaaagggcugacuuuuaguaucugagugacuugggaugagucucagacucuuaagccuuucauacuuuuuuuugucugugaaagagaguaaccaaagaguauuguuggagucggugagucgacuuacguaaaagguuuuauauguagugcuugaaacguagccaguacugagugaggccaggucuccugggcccacacaagucaugacuaucuguuuugguccuccaggaugaggguuccuuccaccucaaggacacagcaaaggcucugcugaggagccugggaagucaggcaggcccugcccuuggcuggagggacaccugggccuucgugggacgaaaaggagguguggggaccaaggcuguccacccuguaguaucaagggaggagaagaacgauaggagagaggaugcugugggaagggaguagauuagagucaaugaaaaggggcaaggguuggggggaagccccauucucgaggcugggccuucauugucccucauuccugccuuuggccagguccuguacuuggcgagaaacauucuaaaucuccugcccucuccuccuggggugacccaguccugcugaagacagaugugccacugagcucagcugaaggugggcuuaguguggguggggcucgggcagcguuugagcagagaauggacauuuggauccucaaugaggcugguuuuuccuugccugugugcuuggggcuuccccaacauagcugguaagauucccgaauccuguugacuuccucccucagaggcugagugucacugggcagauacggaguugaaccgccgccgcaggcgcuucugcagcaaaguggagggcuacgggagcgugugcagcugcaaggacccgacgccuauugaguucagcccugacccaguaaguggggucagggcagugagguucugacuccuucccagcuuagcagaaggccuuaggaccaguccacaacguagguuuccucugccuugaucugguaggggcugaggauguguguauacuaaacucugaagacagguugggguugggacagacuguguuuccagggcuggguagacuguguggaaagacaagaacaaggaagacccuuggcccuucacuaucugcucugagacccuucacugcacugagaauucgucccuaaauggagauccuaguuggaagggggaauaagggaagcuaaaagcuguuucucacacagcuuccagacaauaagguccucaaugugccuguggcugucauugcagggaaccggcccaauuaccuguacaggugagccuggaagugggcgggacucagcacugaacagggggugcucagggaguggguggugcuuuagcucgacuucuuguacgaggaacuauuaaaggaggcaaaaaggcagcagaugcuaagccuguucuacacagagcauaugggccuguuuauaaacacgggaguugugaauugagaggagaaagagcccuaaucuacuuuccugggcuccucaggaugcugcgcucucugcucucagcccaagggguaucuccacagaugauaacggucuucauugauggcuacuaugaggugagugcggcuggggccucaggcggaccagcacagcagccuacgggugcuaaaaagcagggaucagugagggcugugaaauaugagaggcuugacauguuggggccugcagagguggggacgguagcacacagugacuggugaccgugcccucaggagccaauggaugugguggcgcuguuuggucugagaggcauccagcauacuccuaucagcaucaagaacgcccgugugucucagguauuccuuggcaaggguggaaggggcagauaccuggccccacccccugccucaggucuuaugugcccaauuccccaccuagcacuacaaggccagccucacugccacuuucaaccuguuuccggugaguaccacugauacaauccuugggucuauagagagaaaugauguaaugaaaacucuucccucacucgaccuugcccuugugaucugaaggcuaggguggguagugccugaacacuaggucugaagacagauccgugggauaagagcaaccuccuuggaaccaugauguucccucccgucccuguaggaggccaaguuugcugugguucuggaagaggaccuggacauugccguggauuuuuucaggugaccgggguagcccacaauugaaggaugugccuuggagagcuuugaaugagcugagaaguugggggagagcuugucuagcuaggagggcaggcuuguauagaaggugggaaggaugaaaggagacagugggacuaccagcccugcacuuccaacaucauuguguaucucgggaugccucucugaacucuuaaacucugucuuucucaguuuccugagccaguccauccaccugcuggaggaagaugacagccuguacugcaucucugccuggaaugaccagguagccuagguggccagggcuuaaucagcaugggaaucugucaaggccuggggcuaaugccucauauguugccccuguccuuagggguaugaacacacagcugaggauccagcacuacuguaccguguggagaccaugccugggcuaggaugggugcucaggaaaucuuuauacaaggaggagcuugagcccaaguggcccacaccagaaaagguacccagcagggaagggugaaugggcuggaaucccuguuaauuccagacuuguagccuucauaauguccugugaccacagcugugggauugggacauguggaugcggaugccggaacagcgccggggccgagaguguaucaucccggauguuucccgauccuaccacuuuggcaucgucggccucaacaugaacggcuacuuucaugugagcgggggaauuaggauguaggaugcuauauggcuuaguugucaaggacauggaugcuggagccuagcuuugguacauacuagccaugucaguuuagggagguuauuguucuguuucugccaguuucucuaucuguaaaaugaggauuaaaaaugcugccugccaagggcccagcaaaucaccuccuugugauuccagcaggaggaggagcugagacaggaagagcauuacucugaggcccugucucagaaaacaaaaccagcaacagcaaagccagcugggccuaaucccaguccuuaggaggcagagccaggaaggugacugaguuugaguauacagacuaacaaaaaaguaacagcaaaaacucagaacucuugaacuacuucucucauuauaagguuugaucugaaauuaaaacaaaccaaaaaauuuagggguggugguaauaaaaauuaaaacaccuuucuucccagcacuuggaaggcaaagguaggcuguucaacgcuauccuggacuuccagucuugaaaaacaaacaaacaaaaaauuuagauuuauuuuucauuuuuugucuaugacugugcacugugugugugccugggccugaggaagucagaagagagcaucagaugucccuggaacuggaguuacaugcuugugagccaccauauaggugcuggguacuagaacucugaucuugugcaaaaauaucaagugaucucaaccacugagucaucucuccauccccugaauauguuuuuaaaugauuuauuuuauacauaugaguguuuugcuugcauguguauacauguaucguguuugugucugauggcuaaggaaucuaggagaggacacugagucuccuguaacuggaguuacagaugguugucaaccaccaucugggugcugagaaccgaacucggggccucuauaacagcaucaagcuagacgguggugguacaagccuuuaauccaauauuugggaggcagaggcaggugggucucugugaguuugaaaccagccuggucuacagagugaguaccaggacaguuggggcuacacagggaaacccugucucaaaaaaaacaaaaagaaacaaaaaagugcauuugaaacaguacagcugaaagggauauauuuaauuuagaaccuccuaaaagcaagagaagcuaauaaaauccuuauuuaccaauauuuaccauauuucuuaucuacuaaggaaggacaagugcuuccucgcgccauucauggaaccugaaucagcaguuuccuuccuucuaacccaucuuugcaauuggcuacauccaacggaccggugucucuuucucagucuucccuuccucccccucugauacacacaccccuaccccuuguguuuucaggucucuuguagcucagccugagacuggucuugaaauucuaauccuccugccuccaucucucuuuacuucuaagucucuguagcaaaucuggggaaagccagugggaacaggacuaguuuacgggucaguagcuugagccaagggaccagaccaaauuaaagguaguaagagcuugccaaagacagcaacucggagggcccugggucuuguagaucuucaguaggucagugagcaagugugggccacaccaagaaguccuggccuucuguccucauuccuguuucaggaggccuacuucaagaagcacaaguucaacacaguuccagguguccagcucaggaauguagacagguagagacuggcagcaggcuaaggggguggguaucuaaggcuugauggccagugcuugcuaguccuuuccugucuggggccuugggaauuuaccucagcccugcuguaccuuuuccccgugugacccuuugcccugcucauuccuuuccauggaccugagggacucuccugauauguuucucccuccccuucagucugaagaaagaagcuuaugaaguggaaauucacagacugcucagguaugcccuagggcaauugggaugccuggcagggaguaaggaaucuagcuuccuuggugacaccguuaaugggcacuauagaaaauaaaaaccagugugcucugguacagacauuaagaacugaaagaagguagcagcggagcauuaacucaaguucagggcccugugugucccaucuaggaaguaggcccuguuucggccuuaacuuuuuuuuaccccaaugcagugaggccgagguuuuggaccacagcaaggacccuugugaagacuccuuccugccagacacggagggccacaccuauguggcguuuauccgaauggagacagaugaugacuucgccaccuggacucagcuugccaaggugccucaggcugcaccucccucaguagcgcccgcaucaacaugcgcugccccugcuaugcuagcaagagucuuuguuagagagcuuucaaccucagaaccuucuccuacacucuuacuucucucaucucacuuccuggccagguauagugcgggccuuucaugcagcacucgggaggcagaggcaggcagaucucugauucaagggccagccuuggucuacagagugaguuccagaauagccuaugauuacacagaaaaacccugucucaaaaaaacaaagaagagaaccucucuuuuaagcccuugcucaaauccguacuccagauaaugcuuccucuugaagggugaggcuccgcaaggccuucagagaaucaucuccacggcuucuugaccaucucuuucuccuacucuaucccugcuagugccuccauauuugggaccuggauguucguggcaaccaccggggccuguggagauuauuucggaagaagaaccacuuuuugguggugggggucccagccuccccuuacucgugagucaccccguucugcccuaggaaauggccuucugggucugaagcauguccucuccucuguaccguucaucuguuauguuucagagugaagaagccaccaucagucaccccuauuuuccuggagccacccccaaaggaagaaggagccccaggggcugcugaacaaacgugaagccuccuccaggacucugcagggcuggguacuguguacccccagacaggcuagcccguugcccuacccuguaggauuuaguagaugcugguagggguagggcugguuuguuuuuaacauggaauuuaauuacuaacuccaaggggaaggauccccugccccaacaccccuauuccugaguuuaaggucuauuuauuuacuuccuugucaaagaagagcaggagaguucccaggaccucuuugggaucccuggguagcugauccacucuuuucauacccuguccucccaggccuggcucagaaccuauuuauugacuguccugggggccuugggaauaggcccaacccggggccuuuauuccucucuggaccaggaugcugcccugagggugggacuggcucauacucaggaaaacuguugugcccaacugauggacaggcccauaugggguccaugugcugacagacucacacagagaccuuuagacacuggaccaggucuccucuuagccuucucuuuguccagauuuccaaaacuggauaaagauggucauugauuaaaaaagaagaaaaccucug

SEQ ID NO: 2045 - RNA, 1022 nt, Mus musculus
agacagcuuaagcagaaugguuguauuugcugucuaccaucaacagccucuggagcagcaggucaagugcaggccgagcuucugggcauuucuagaggaccagaaagcccccagguugacagagaaaucugagaacuggagaaagaaaaaagaaggaaggguauuuaaaaaaacaaacaaacaaaaacaagaccauauguggaggcugacagguagcacaguaaaguguuagucuuuuaaggauccaagucaauccagaacccggaugaaaaagcugggcauggugguacacgcugaucaaugccagcaauguggaggcagagacacauggaccccuccuguuagccagccugaccuacuuaaagucuaggcuagugucgccagaaaaggcagauguccuuuggcuuacacauacaugcacacaugcauauauguacacgcacacaaagaaaaauaggcauuugugaaaaccccacuggccccuugggcucaccccucccaaccuccccccaggccuuccaucucaguuccagggcugacauuguccacugaagcucucuugucaucugaggaugugugcucucaggguagacuuucacagguuguccuuacagugcaaaagcaggacacuaagucacagauucuccaccuccauacuuccccacuaaccucgaggugacagaaucaauacacuggugguaguguccgugucacugauguuuguggccucagaggcaggauugguggcaguugggccucgggguuucugccgguauguccugcggcuacacuugaacauacugggacaccggcgccugggcccacccaucccuggccuucgguagggagaagucaagcccggaggccgaggggcucgaacaagcugagaaggccccauggcuacagggagcuccugagggguucugcuggccaagcacugaaucucuaugacauaugaagccugccuaaggguggugcucuuuguuacagguuugucccaucccccacccaaccauagcuca

SEQ ID NO: 2046 - RNA, 750 nt, Mus musculus
cuuuuuuuuuuuuuucaucaccaaagagauuuuauucaaguuucuaacacaaaugaguuauuuugguuugaauuacagaacuaaguccaaacugaaaacaaaguuucugaguuuuuuguuuguuuguuuguuugcuuguauuuucaagacacaguuucucuguguaaaggagcccugggugcuuuggaauugcucuguagaccaggcuggccuugaacucacagagauccaccugccuccaccucuugagugcugggaugaaaggggugcaccaccacgccugucucccuugccagucuuuaaggucuaccaggccaggcccuucucggccuuugcucugcuuuucccuuguuucuuuucucucuuggccuucagucuuuuucuuugccucugguucauccacacuggguccuggccaugcuggucuagaagagucuuucuguuucucuuaauuucaguuuccauuuucaugucauccuuuuccucaucugcgucacaccgcccuuccucacacugcauuuucuccuguagagguuuggcuaccaccacgguugcuaucuccucaacgucuuucauuagagcauccccguccacucugaggauacucuucagucuguugagcucccuuggcgcauucuucuuucucuucucggcccgcaucuuccucuuccacuuacuccgcaggcuuuuagccaugcuucaccugagagacacaaccucguaccacgcgugggacgccaacccagacug

SEQ ID NO: 2047 - RNA, 4418 nt, Mus musculus
gaagugcuaaaaaaacuugacagcaauacuuuuauuuuuaagguucuuaguagugccuuagauucccaucgcugugaggagacaccaugaccaaggcaacucuuauaaaggacaacauuuaauuggggcuggcuuacagguucagagguucaguucauuaucaucaaggcaggagcauggcagcacuggcacugcugagaguccuacaucuuguaccaaaggcaaccaggagaagacugucuucagggcagcuaggaggagggucucaaagccuacccccacagugacacauccuccaacaaggccacacaucuaauagugccacucucugggccaaacagauucaaacacaugagucuaugggagccaaaucucuucaaaccacaaguaggauucuuuucaugaaauaugacuucaugauugcuagauucuaauacaggauuuuucaucuuuuacuuuucucaguauaaucaaaacacugaaauguuuagguacaugacuauacaauucacagacacacaaaaauguaaacuaaccuuauaugacauaauaaggauuaggacauuuuucaaaauaaguuacuuugaaauaauuuuuuuuuuuuaaagauuuauuuauuuauuauauguaaguacauuguagcugucuucagacacuccagaagagggaaucagaucucguuacagaugguugugagccaccaugugguugcugggauuugaacucuggaccuucggaagagcagucgggugcucuuacccacugagccaucucaccagcccugaaauaauuuuuauaaucccaacacucaggaggcaaaggcagguggauaucuguaacuuuuugagacaggguuucucuguguagccuuggcucuccugaaacucucuuuauagaccaggcuggccucgaacucagagauccaccugccucugccuccuuucuucuaggauaaaagguguguacuaccgccaucuggcuaaaagaaauacucuuuagaaaacaaaaacaaaaacuauguaugaagaauaaauuccuaccuguggggggguggggguggggaggaaggagccaaaggaggaacauaauugugaugcuaaaaugcagcuuuacaggauaagagauacaggcucaaugcucaagacuauguacugcucuagacccaaguuuagcucccagccuagauauugaguagcucagaacugucuguaaagcuagcuccaggggucucuggagagauggcucagugguuaagagcacugacugcucuuccagagguccugaguucaauucccagcaaccacaugguggcucacaaccaucugcaaugggcaucugaugcccaccucugguguguuugaagacagcuacaguguacucauauaaaauaaacaaauauuucuucaaaacaaaacaaaaaaaaaaagcuagcuucaggggauucaacagucuucuggccuccacagacacuguaaauaauaccaagaaaguauuuuuauauuucuauuuaaucgggucucuugggcccuuuuucuggauaaauauuuucaaguauuaaagugacuacaaaugagauaaaagccacuaaaguacuuacaauccuuaaggcuuugaaccaguugggauaaugugguaagaggaaaaguucauuguguaaugcuaucccuaaaccuauuauuaaugugacuauggcuucauugagucuuucagaaaauaggauggcugcccaugaaaacagaauaggacucauacugcuagcuaaauuaauguagucugguuuggcuggacuacuuucuggcagaacaaaaccccaucugaucccucccaagaaagcuaggaaaccggcuccauaagccaucugagugaaagcuaggacggggauauaagacuuuguuauuaccaugagaagugggggagcaguaaaggggauuaaccccgccagaguuauauauaaagcuggcuuugggcuaucgaguagguaagugauggugcuucguuucuuuggaggaaggacugccuucugcuuuuuaaaguugcauggugacacaugauagcauuguaucuuccucauacacacuugaaaugauggggaaagccaaguucuuggaggcaaagaggaaaaguucugcaguagacaugucuugagagaaaguaugucuauucugccagcuccaagucucacuguaaaaggguucuucagcaucuaugaaggaaacagaaccagaagacaaaguuuaaaaauaagaacacaugguacagagaaauacauguaggcaaaacaccacauauauaaaguaauaaauuggaggugggggggauggcucagugauuaggagcacuggcuguuucuccagaggauccagguuugauuccugccacaugugguggcuuacaaccaauuguaauuccaguuccaaggagaucuuacaccuucuccuagcuuccacacacaucacauacagguggaacacagauauacauguaggcaaaacacccauacacauuuuuaaaaaaaagcucuuuaaaaaauaucacuuugaaauuaaaaggagcacuacuuaccagucauggugagccccgagaagcaugcagggacugagcuccugcuggucuuuacuccuuuugucuucaguaagaaugcuuuuccuucagcugccuacauggccauucuucuuuucuaaccuccuauuuauguuauauaauccugucuauuauuuucugguaggauuuauucuuauuuucauguguguggguacccucaguggaagcuucaaguccuuuaaugaugaauuagcagugguugugagccacccaacaugggugcuggggucaaacuagagcccugguccucucuauuuuuuuauuuuauuuauuuauuuauugguuuuucgagacaggguuucucuguagcuuauuuauugguuuuucgagacaggguuucucuguguagcucuggcucuccuggaacucacuuuguagaccaggcuggccucgaacucagaaauccgccugccucccgaaugcugggguuaaaggcaugugccaccaugcccggcuucucucuauucuugauauucccuauucucuuucccugauguauaguacuccauagcaguuauuauuugacauaguaaauauuuuacuuauuuauaauuugcccauuguuuuccuuccucacuugaauacauauuucuauaucugccauagccaaacaguuauugacaaauagugcucaacuaaccuuugaagaugcuccagaaacuuucuggaugaaguguagcauucugguuucugcucaggguuuuguccagggaaaaugcaauuccgauucauauauuuuuauaguugagggggauggcugaauuugaagcaacgcccuauacauaaaacaagauaucgcuuaauuguauacauuuuauacauuuauaagaagucguugcugggcagugguagugcacgccuuuaaucccagcacuuagcauugggaggcagaggcaggcggaucucugaguucaaggccagccuggucuacagagugaguuccaggacagccaggguuauacagagaaacccugucucaaaaaaaacccaaaacaacaacaacaacaacaaaaagucaagaaaaucucuucgaugaaacauaauuuauuuugauuuauuuauguauuuauuugccaaagugucacauauuaaggaaauacguuuugugcuguuuuuguuuucugaagaauaauuuuaguuuuggcuguuugguuuaauaaaaagagcaaugugaaacugaacauuuggauuuagcaaacaucucuaccacuucuuaggcaccagugccucaucuuuaaaacugacaguuauaccuuuuguucccaauaaucauauauucucuuuaguuauuguguacucggggcuguggaauuuuuacacuauaaaugagagcagccacaaauaucgcuuuguugugaaucaagcaauguaauuaaauguuuuccauauauucuccaccuuuuggaauucaguaaccaguggagcacguguuuucuaauuuuggaggauuauaaucaggcugaagcccugagacagaagcugauguggagauuaaaaaacuaaaagccguggccaacucgcucauuccacgaaaaaaaaaaaugaccaaauguuuucauuucgccaacgcaacuaccacaaacuggaagcuccuagcugacauuuuagcgacacgagcggaauuuagacacaaaagguccuuaagacgcgugggguaacuauacaucuauauaccaauaccaauccuuagugaccccaccaccaccuccuucccaaaguguacccuugacaacccugaaacguacuugccaccaucacacggcgcaaaaguugaacaaauucaaccagaaacaccgaaacaacacuuccggcaacug

SEQ ID NO: 2048 - RNA, 7904 nt, Mus musculus
gcugcuguauugaauucuugauguuggugauucugccaccucaguacugggaugacaggccugugccgccaugcuguucccuucucuaaacaauguguaccacagagcagaaaugugcuuuuaaggaagcccauguaagggguuuguggguuguucuagguuccuuuaccuaguagucauaucaugcucaagauguugguugguuccuguguauaucuucagguuuucugugcaggccgcauuuggaucggugcaccccacccccucuugguguuagauguucuggaucuucugacuuucccaguuaguuuauugucacagcuggucucaguuuuaaaaugggaagaacuguguagguagaggguagggugcagucugaaaaacacuguucuccucaguauuguugguugcauccaucccuuuccuuauuacaguuggagggcagccacacacccgaaccaaaggaaaauggagaacaagguugucuucagaacggucuuucucuacccaugguagaggaaggggagguucugucacacucucuggaagcagagcacagguaagaauaagauguauggcauguaagacucuuaaagguacuuaaaacguaagagggguguggccaugaaaaccuaauuauucaccauauaucccuccugguuagacuauuuaggggcauagucaagagcacaaggauuuuccacauauguguugcugucucaucugagcaguuacugugaagugucuuuaaaggggcuuugggaugccugggaauccuauauauggaaccaacuauuaacugcaagccuugcauacauagaguaaucugcuauauacagccuaccaaguuugacuacuuccucaaaggaagcuuccugguagugcccuuuaauacaguuccucauguugaaguggcgaccuccaccccaaccauaacauuauuuuccuugcuacuuuauaaguguaauuuugcuacugcuauggauuguaaguauuugacauguaggauaucugauacgugaucccugugaaagggccacuggauuccuucccagugggguccauacccacagguucagaacuccuuaucuagaggaaccugaaagguuagugagauuguaagaguuccacagugcugugaaauugaacaagcaaugaaccacagagaugcgcuaauuuguucacaaggaacaaaggaguaauuucuuccuccucuuugggucuaugaaaagguuccuugcaguggggguuuugagauuuuauuucuaccaucuuauuuguuauuucuacuaucuuuuccaauaggucauuuucccuuaaaccaugaagcgccuccauuuaauugugagcaccugaguaccucgcccuuuagggagaauacaaaguuccuucugcagucuucauuggcuuuggacagacucuuucuaugggugcuagugggcugcacagucaggcuuacuagcguguuuuccuugcugucuguccuuuugccuccagguuauuaaaagcaaugggguggcaggaguacccugaaaaugaugagagcugccuuccacucacagaggacgagcucaaggaguuccaccugagaacagagcaggucuguacugagcucuaagccuucagugacucccagugaaauguuugcaguggccuugccuuuaggaaauuucuaguguuuauuugcaguuuggggaccaguuuuugcugacgggaucucgacagguacaugccuuuauucccagccugggcuuacagaguucuaugucucaaaacuguaaaacagaccaaaaaaaaacaaaaaagagccgggauaucacuuuauaguccuggguaguuuggaacacgcuauguagaauaccuugaaccuacagcaguccuccucccuccaccucauaguuacugacacuacagcccuguguugacugucaaggaugcacuacauuuaagaaagagacuuaaauuaccacaguaguauagcauggugccagaccguuucuauaguaggaaucaaaaaagauagagcccaggccagugaauagcagacuuggaggauauaggugccaugcucacagcucuaaccccuuaucaaaagguaaggucugagcuccugagucuugaaaaacacucugccucgcccucugcagcauaaauccugggcuggagagaaguagcucaauggugaggguagcguguguguagcuuuugaauagaaccccaugcuggcuuagaaccacauguaauuccgccuucaaaggauuugacaucuccagcuuucauaggugccacacauauaauuaaaaauaaauaucuugcagggcagugguuucaucccagcacuugggaggcagaggcaggcggauuucugaguuggaggccagccuagucuacaaaaugaguuccaggacagccagggccacacagagaaacccugucuugaaaaacaaacaaacaaauaaauaaaaucuuuaaagcuuaaguggcggcuggcaagucucacaguagggcagccuacggccugacaugagauuuuaccacuuagaacuauuuuagagccagagaguccuggcccacgccugugaucccagcgcuugggugaggcgugaggcagguggaucucugaguuugaggccagcuuggccuacggagugaguucuaggacagccagggcuacauagaaaaacacugucuugaaaaaccggggcggggggaacaggaacuguuuuagaaauaggaacucuaaacccgacacccaucauacugaacucuagacugacuuuauaggaaaggggggaaauguuuggguggcccagcuuugguugcauacaucuuuaagccuagaaccugaggcauaaauaggcagauuucugaauuugaggccagcguggucuauauaggguguuccaaaacuacaauaguaagacugucucuaaacaaaagaaauuaaauccuuguaaguuugaaaaguacugcuuuaagagauguuaggucucuugggaauuccccuccacauacuccucuagaccgguguagucauugaagguuuuuuauuuucuuucuccuaugcucuguagcuacgaagaaauggguuuggaaagaauggccucuuacaaagccguaguugcagccuguccuccccguggagaagcacuugcauugcagagugugaggacucagacucggaaacgagcagcagccagacgucagacgacgaugccuggaaguagagauaaaaugcucacagugaccugccccgcugagcucagccuuguguuuagagaauauaaaguguucuuuuccuuuucuuauguuguugaauacuucaugcacaagggaaauaaucauaucccaaagagagagcaauugucuugcuuagccuuuguuuucuucccuguuaccugcuuaauaggcauuuguguggugggauuuuuuuaagcacacacacaguaccuguggggcugugcacaagugggagcugucagggcagagaugcagggaggagaugcugcucugcucaacagcuucuacuaccagcccuuggggacucaccccugugcucaagcaaucauugucaaugacaaagugacuauugaaguuauaauuguauuaaauuaaugcuaauaauuuggauauuuuauuuuauuuuuggcugcuggguaacuuagcccuuaaccaagcauaugugguuguuuuuguuuuuuuuuuuuuuuuguuuuguuuuguuuuuuauuuucucuuuuuuuuuuuuuuucuuuuggguacagcuguaaaauauuuggauauaggaaauguuauucuugcagccuugauauucaggguggauuguaaaauaugaauuuuugugagauuucaaagauuaagauuauuuugauaacauuauuuacagauuuaaaagaugugguuaccacaagucuguugaggggaaaaacuacugcauaaaauaacuaacgucgaauaaauauuuugcaucaguuuggauugucuuguguaagaaauauauuuucuuuaaaauuagagaguggauucuuuuuuuaagggaaauauuuuuagaaaacuaggggaaaacugaauucagccccaccuguuucucuuuucagcaaaaauucuuaauguggaaaaaaccugugcaauaaauuauucauaauaaacuacauuuuuuuuacugaaggaauuuuuuagugcccaggauuuaucaauauaccuggguuuggaggccuccccccaccucaguugguuguguuuuauguguagguguuuugccuaugugugugucucugaaugccaugcugcacugauugccagaggaggccaaagggggacuucugcuccucuggaagaacagcucugaacugcugcugagccaaguguccagccaccaauaugaauauuuuaaagaaggccugacaagugcuuccuacuuaauuaaaugggugcaugggggugauugaaugaaguaagacgacaguggagauggaggaaugagaaugacuccguguaggguuagcacuugcccacuaaguguuuacaucuuccauaccuagaaacacauggugauggaaguugagaaaugguuuccacaauuuguucuccgaguuguauaugugaacuugauaugcacauauacauacaaaaugaaugaagagcuggagagauggcuuaguggguuaggagcgcuuguggcuuuugcaguuuuuaugguugugguuccacauuuuagggccaccaagauggcucagugaacuuaaguuuaugucaccaaguuugaggauuucgguuugauucuugggauccacaugaugaaaguagacaaaugacucccuugacaugauacuuuaccuggccuaccugugcuaacacaaauacaugcacaggcuaaauguuaagauauguuaaggaaauuggcagcuggaggucauaguucauuggcagaacauuuacuugcauugcauggccaaggcccucgauuuacuaccugaaaccaccacaaaagguaacacuuucaguauaaugcucauguagcccauuuuucuaaaucugcuggaauuggaaggauggccccauggagcacucaacuagcugcucuuucaguuggcuacgguucaaaaugcaacuagcaaucauaaccuaagccaccccaauucuaaccucauugggaacugaaugcguugguauacgugcaggcaaaauacccauacacuaaaaaagaaaaagcaucuuuuaaaucuaugaaguaacaguuuauuaaggcaguggagagaaugcucgccuuuuauauaauguuucagagcacauaaacaucguguaacuugcuccucuuuggauguuuggagagaacuaccuuaacagcucugucuuacugaggaaaggcugcuucagaaaugaggugcauggaucuguguagacgaauuuuaaucagggaacauguuugcucuugaaaaggaucacauccaaaagauagaugucuguaugaccucgcuggauacagacaugcccuuagugugaugaaucagaaauaucugaccaaaugagucagagagaucagcucaggagcgaggauuaaaaagaaaaaaggcaauuuucauuguaguaugaacucagcaaggucugaggcugaaguagguuuauuuuuuuucccccaauuugcuuuuauaucauuuuaauuacaugcaaauaauaagaucaguucuaggcuggagaauaagcaagacaauaaaacucccaagcucacuguuucuaagugcuuaucaggaugaccaagauaucugagccuacuucccuguccuagcccaaaguaaaauucuugccuuaagccuacuacuuuguucuagccaaauuagauuccugccugagcuuacuuccuuguccuggccuaaugucaaaucccagccaaguggccccacaaagcucuccacagaugggcaaagcccaacucaggaaagaaaugcuacuuaagagcagugcaggggggcuggugagauggcucaguggguaagaguacccgacugcucuuccaaagguccaguguucaagucccagcaaccacaugguggcucacaaccauccgugacgcccucuucuggugugucugaagacagcuaccguguacuuacauauaauaaauaaaucuuaaaaaaaaaaaaaaaaagagcagugcagggaaaauccaucuuggaguuaguucaguugaguguaguuuagaggcagcuucaccaaguagagcacuucaaugagaagcuaagagaagccgguuugaaccaguucagagaggacuuugagacagaacagcugaguugagucagccagcuuugaggaagagcuagagugaguuuauucaauagucucagagccugaaaacauuuuaggcauagauucgccuaggagaugaggaugaacguugcuuuuacagaucuguguaaaggugacgauaacuugaccagcagaaagagcucguuuaacucacaaguaguauccaucugacaaauuguauucuccccaacgggucucccaguucucauuacuggaaagguucagaucauuccugucccagaaugggaauuagaaagacuauuccauugugugguguguuaauucuguaaaagauggguuuaugcaaagacauacugcuaauaugagguuuaccuugugcggaaauguucccuacaguggagaauucuagcuugaaaucuguccauuuuagagaacagcugugguacagaugacaguugccuaucagaggcuaaauaggcaaugaagucaaagccgcaguuaauuaaauacuuggccaaacucacuguaauugguggaacaaacugacauuuucacaccugggccccacccaaagguggccaggcacauugcccaggccugccuaagccuguacucgcugcccagggagcuagggcaccuccccaaacauaaacauacauuugaaggaccuggcgauuuagcagacuuggucuauucuuugucccuuuucucucuuuucuguccaguccgccuuuucucuuuugucacauccucuguaggacgcuggugucuauaagagauuccauuccauggccgauuacucaggggaaucaggacuuuuauccugugaauccugugauaugguuuuccgcuccugggcucuguuggccacacacaccaaacgauucugcauuggccggcugacuccggagguaacacuuaaaucacagccuucagucgcgaucaaacgaggcaccaagguaagggccgccaguggccagggguagguuuuccaucaaucauuauucuuacguuuuuugccuccccgccaccagaucauggcacaagaaaagagccgugaucaggaagccagcacaucugcucuaaagaggcugacagaggagguacacaccaaucaugacuacaaacuucaacuuuacauguguagagauuuacaugcuggaaaucacccaguacagaaauagcggguccgaguuauuugcaggugcaguugcugucccuacagaaaauagguccccgagcgacugagggucucacuucccagacugcagggagcccuggggagaggcugcgagucuugcagggaacccgcgccagacgcauggcagaaacagaagcacagagccgggcgcuggagcgucgcggcgaaggugagagguaaggacucggcccugucgcugugcucggacucacccugacucugcccauuugucccucagaauuaaaacggcgccuccacagcguggcgggacccaagggaggauuaccccgcccauucgacuuggagcgcgagcucagagaacucaaggaagaggccaaccggacccggggagcacugcaaacgcuaggugcgcauuuccaggcgcuccagcuucagccucggugaguugccggcccagcuuugguaggagugcggg

SEQ ID NO: 2049 - RNA, 27636 nt, Mus musculus
cuuuguuaaaauuagcauauuuauuuuuauagacaaaacugcagacaauauaacaauuccacuuauugacauauaguaaccuuucuauacagaaaauaacacacuuucuccccccagugucuuauacuacagugugagccugagucuaacaacuguuuuccucaggaacaauuucccagguuucuaccaguuuucccaggauaggauuauggccuuaaauggaaaccagaugaacagcagauagggacaaaccaagaccugggucauauuccaucauccauuuucagcaccaaacugauuucuaccaguucuuauuuagcagaccccauccaaggacagcaccacugaaagcuuacacaguaauugauuucagccaaguauugggaaauagaacauagcaccaguagaagaugaagggcuucuagccacacuugaucaccuccacauuagacaggaaguggguugugcaauagcaaaacacaaacauguacacacaagaaauguagagugccccaaagcauuccaccaauauuuaagaaaaaaagccaucaaagccucagcuguugccuacaaucuuuauuggaguuauacaaaaagaauccccaaaagugaaaaaauacauuauguacaaaaccacuuucccucaggaggaagguucugcucgccucuuaacaugcagugcuuuuaauuguagcugcagacuccacgguccccucugcuguuuggcucucagccugauucucagccugaaagacaaagauccuagcuauaacuuacccugacauaagucaucccaucauauaugaccagaugauaagguugacaaacccaggagaucacacaaaggaucaaauaaauuguugaccagguacucuuccauauauucauuauuaaagaagccauaaaucaaauccaucucccagauacccaauaacuucauaugcaaaauauuuucaguacauucauuuuucacauagacacuugagaggccuggcuucccaguccuaagaccagugugagaagcaaguggccaugucuacccaccucggccuccauguuuucugaaacuuccuuuccacuggagacagcauccccacugccuccauucaccucuggcucuuguuuagcuuucuuugcaucauccuuccggggacucucuuccucugguuuccucuaaagguagaauuguaaaguguucauauuuaucuuaagaaaacaauugcagaaaaauccuguugccccucugguggcaacaucuuaaacacccugacucacagcccuguggaucugcaaucuaugcugaccacaacauagaugaugccacaauguauuuuacuuuaaaauugacauuguugaggcacauggaacagggagagggugacagagaucugaacacugaagaagcacaagcaagaacacagaagcaaagacuuacaccacagggaaaggauuauugauucgggcuaaaggcagaagugugagaaggccuacaauggaggaaaccaguaagaauccuccagcuuuccaaacagccacaagguuaauuaagguggaaguuugccagguaaguuauccccaaugaaacccguagcuuccuaguguauuauuacaaauugcccacccucaaaaaugcagacauugaaaaaguuuaaaaauacaaaaguucauauaaauuuaccuucuuucugacaagaugggaaauaucagucacacaauuugaugaggaagcgccaucuguugguuuucuacuggcaaucuagcaaaaauaagccuuuguuaauuaucaguuuacaaaaaccuguagacucauaguaagccuaaugacaaauaaaauacucaccauggauacugaggcaccagcuccacuaggagugaaaccggaaguagagcucuccaccugugugagacacagacaauuuuuguugguuuuuaggggguuuuuguuguuguuuuuuuggguuuuuuuuuuuuuagauaggguuucucuguguagcuccagcugugcugaaacucacucuguagaucaugcuggccacaaacucagaaauccuccugccucugccuaccaagugcugggauuaaaggugugcaccaccacugcccagcuugauacauggacagguaaauuacagaauagaaccccagccacucaggcucaaguugccuaccucgaauaacagcugauuaaaagguaaaauuccuuuugccuacagcaaagaguucaacgcagacaccuacauucagaguaggcaagaaacuaaaccauucucauguccuauuuacaauacagauuauauauaccccagcaugucaggccaagaacagagccaggcaauuuauggcuaagacacuccaucuaugacguaagcuuuuuuuaaugguauucucaaaaacauuuuacaaauaguaacacaauauuuauacugaaaggcaaagaaauauacaagguaaaaaacaaaguagcagugacagaauguacaccugucuccugcauucagaacacacuuucuagccaugggacaacuuauacaagugaaaugagcucacauucugaccaacuaacucaagucaggaaaaguaccuuuuaaauggacuauaaacauuuauuguaauacacguauuuuauuuaaaaauaaaacucgggcuggugagauggcucagcagguaagagcacccgacugcucuuccaaagguccagaguucaaaucccagcaaccacaugguggcucacauaacaagaucugacucccucuucuggugugucugaagacagcuacagaguacuuacauauaauaaauaaauaaaucuuucaaaaaaauaaaaaauaaaaauaaaacucaacaaaccagaguagcuuucagugccaguucggcuacauucccacuccgcugagauuccuuugcgucuucuaucuucucucgaauuucagguagcaguucuuucagcuccucaauuucuuucucauauucaguaaacgauccuucggccuccuucaucugcucauggaguacagcuacaaagaacagcuuuaaaucacuaacaaaaaaacccaguuuccccccacaauguaaaugacgguaucaccuaaacauacaguaauuucuguucacucacccauucucuuuucaaugacaucgauagauuugccaaacugugcuacugcuucaucauacugagaguuguaaccauaggccaaaccuaauugguagugagucucugcaaggagacgaucgugagcuuccaaauauuguucuugcaggcuuaggcaagccugaaacuccuccacagcuuggauauaauucucugauaaaugaagaaauaacaccauggacagaaguuaacauaaauucaguuaugaauggacucaucucuccccuuugcaaacagggucucacuauauagaucuggcuagccuggaguuucugcuuccccuccggaaugcuuggacugacugucagaaaacaccgauuuacaaggcuguuuaaugcuccagauacuauagggaacucagaccuccuauucuaugggauuuuguuauauacagauagcucguggcuaacacauuucuccuuuagucagcagagggcagaaaaaccugccuuuguaauuuuggauguucaaggucaauccuaaggaaaacaggaagggagaauggagaaagguaggagacggcauaaaagaaauugcauuaccagauucaacacuaacuucuccaaguuuaagaugggcuugugcagcauaaagcugggcuucuuuuguuucuugccuaaaagaaagauuaguaaagccuuaaaaauaaucuuaaacugcuuucuauuuucaaccacaacaugagcccaaaaacacccagaguuuuuuaccucuuaaaaaugaucuuggcuaaauccagcauaucccaggcaaguuccaaauucccuaucuccuccucuucauuuucuugaagagacugaaauuccaagucauuggcauuaggcaaaagaacaaaacaggcaucuuuuuagagaaucaaucuuuuuuggguuuuuuuguuuguuuguuuuuugagacaggguuucucuguauugcccuggcuguccuggaacucacuccgaccaggcuggccuccaacucagaaauccaccugccucugccuuccaagugcugggauuaaaggagugcaccaccaccgcccagggagaaugaaucguaaauguauaauuuaauauaauuaaaaacaaaaaacaggccgggcaugguggcacacaccuuuaaucccagcacuugggaggcagaggcagacggauuucugaguuggaggccagccugguccacaaaaugaguucaaggacagccagggcuacacagagaaacccggucucaaaaaaacaaaacaacaacaaaaaaacaacaacaacaaaaccuggcugcaauucaaaaugcaggccuucucccuaaagccuaccaaaugugcacccacaauaaggugucacuucaucucagugaaauauaauuauaauguuguauuucaucuuauaauggaaaaaaaaauccccaggcacucgcaaggaccagaucuuacaggaaucuuuccuauauuagcaacccauaacccuauaguaauaaaguuguaaugguacuaaaagaauaacagcuuaccuuuuuuucaagaacugauucauuugguguuucuucagccuugucauuuucucuguccucuuccucugagccuucaguuucuacaagaagaaacuacuuaguauugagauauaacaaaguauuugucgucuggugugauucucacaauaucugucacccuacauucuaagguagaauggaaaggaagcuaauccaaggcagucagcaucugcucugaagggaucuucaguucauggcuaccaucuagcucacaucuagccuacacuaccauauacacagccuuauaguacauucauccaaaugucagacguguaaaacuaaaccugcugugauucacaauaagaaagauaaccuauacauugccucuugcaaaaaaucucccaacuacucaaacagguuuuagucauuuguuaagauaauuguauuauacucaaaguaucaaaacccaaauaauucccgaccauucagaauaccaaaaacuggcuuuccuacaauaagcuauggggaagaagagaaaugucuucaucagcucuccccauugagcaagucacagacuccagccagcucaaaaaaaauugagaacaacuaguuacuuuaagauuuauguguguagccacaccaacaacuauucugauauacaguuacacaucaauuguucaaauaagcuuuuaaaauucccauuuguaagacaacuuaaaauucaaaaugucagcaguuuuacuugauacaaucaauucacauagauuaaguauauacucaugucaucuuucauuaagcuaguuggggauuuuuuuugcucuuguuuuuuuccuucuccacgaaacaaaaucuuacuauaauaccccaaacuacucucaaaaacccaggaaucagcaauauuucuucauuucccuaguaccuggaaguauauagcuaccagcuaaacguucuuaacacucacccaccaaaaaaaaaaaaaaucacaaaugucacaacucuacaaccuauauaugagaauagaaacaagaaaaguuggguuuuuuuauagccuggcuauucugaaacuugcuauguauaccaugcuggcuucaaaccaaccucuacuuccaaaguacugacaaaauaugcauuccacaaggccuauuuaagcuaaaggccagccauguuuaucugcaaaucaacugguacaguaguaauugguacugaaaauuccgauauauugccaauugcuagcaauaucaaaauacuugaacaauuugcaaagaacaaccugguuaacuauagugaacuaguaaacacuguguaaucaaguuucacauuuuuguauauaaggugugcaucccuauggaggccagaggccaaugucuuccucagucacucucuaccuuauuuucugaaauagggucucuaacugaaacuggagcucaacaacuggcuauuucccaaaauauaaaaagacucacuuuuuuguuucugacuaugcaauucauugcuucugaaauacagcccaccaaaacauuauuuuuaaagaauuuuuuuuucgaguuugagagauggcucaacgguuaagagcacugacuguucuuccagacucuguucaauucccagaaaccauaugguggcccacaacaucuuuaacaggauccaaugaccccuucugguauaucugaagacagugacagugcacucacaugcacaaauuaaaaaaaaaaaaucuaaaaaggcuguuuuguuaaaaaaucaugggugcccaugcccaugagugcaaacuguggaggcccaaaaaaggguuccacccuggagguggauuuacaggcaguugugaacugucuaauguggguguuaaaaagcaaacuccuguccuuuucaauagcaguaccugcucuuaaccacuaagcuauguauccagcuccaacauuuuuuuccauguccuuuaguuuucuaaguuuaaacuagauaaugacuucacccaaccuccaaaauaauccaagaaugcagaauuaaauacauguauuuucacaacacucauuagaccaggcaggaggaucauuaagaaguuggcggcuagccgggcaugguggcacacgccuuuaaucccagcacucgggaggcacaggaaggcggauuucugaguucgaggccagccuggucuacaaacugaguuccaggacagccaggacuauacagagaaacccugucucaaacccccuuccccccaaaagaaguugucggcuaaggccagauaguaguaguaguacaugccuuuaauaucuacacacaguagacaaaggcaggucaaccucucuguacauucaaagccagucuggucuacagaguacugaguucuagaacagccagggcuauaaaguaacccugucuugaaaacaaacaaacagguugagacuagcaagggcuauacuuuguuacuacugaaacuaagcuauagcgugagaugcagucucaaagaacaaaauuauagacauauauuuaauuaucugguaccuguaccuauuuauaccuuuaccaaaguguuaugaaacuuaauuuggcauaaaauaucuuagaacuuuauaggaaauuuauacauuaauguucuuacaaugaaugaccugagaauaauggguuucauuuuuauggaauaauggagaugagcuagguuaguaagaaauccacuaauuguaaagcucccaaacuuaguaaccagugaucaagcacuagugggaauauacuuaauguccucagcaaauauaaauuuucugaacuugcaaaugaguauuacuaguuaugugcauauuccauacaucugaucuugugacauacuuaaaauaugccaaaaccaaaauuagaaauuaagaaaauauauuaaagauauauaagcuaugcaauccuuacaucuguaaacccagagcagaggacaugucauaggcaaggggacugccauuauuucaggccagucuggauuauagugauacccugccucaaaaacaaauaaagacugcuacuucuagaauuccuacagguaaaucaaguacccacccgaucaguuagcacguaucaucugagcauagccaaccuuuaugacuacaauguaaauuuuuguccacuuaccaaccacaucuaacaugacaaaaagaaaagaguacacugauuuccuguaugagggauauagauaucccagaaaugguaacaaaccaaguaccaugaaauggcuuguuacuuucuugugaaucuagaugaaaauuuccaugugccaggcaaguauucuaccacauguuaugcacugggguuuuaauuguguguagaaaugcauguauaugagugaaugugggugcaccuaugucauuguaucugugcugggaagaagauagccuuggguggcucagggaugagacagggucucuuaugugccaggcuaguuguucuacaagcuacacaggcuaguuguucuacaaguucuauacauauggaguauaugacaacuuuuaaguggguucuggaaacuaaaucaaacucagguucucacacuuguggcauaugcuuuccucacauauaagauguggauuagcauuuauccaguauaauggaaccaaccauagaaaguggcugcaccauaaagccagucucacccaucucuauuaggugugaugaaggcucuccccagaccauauuuauaaaaucucacaaaauuuuacuagccaaagaacacugaaaaugucacuuauagggcugagauuuugguucaauaguauaguucuuggcuaacacauaugaagcccuguguucaauccucagcacuuccaaaaaacaaaaaccugaggaauucaauucuaagcuuuuauuaaagaacuccugaagcucaagaagcccaacagugcuaccaguuagcaaguucacaucugacuaugucucugcuggcuggagugcagggaccugcacacaggcaaaugcauaccagaauggucaaguaauaaagaugggucacugaaaauccauuaagacaacccguaaaauaguucuuuuaugcagaaaauuauuaaucgaaaaguaccuguaauuauuaaugccaauguuagaugaaacuuaauacaguagaauccccaacugagcacaacucaagucagacgugccaauuagaggcuucaaaauauugauaaaauugaaucugaauuaagccaguaacacuauaguugauuagcagccaaagcaagcauuaaaugaagaaggaaagcaacaaaaggaauggcuacguacuuugcuaucucucuugucccugaagauuaaaauuagugugaauaauccucuaaacauuucuaugaacuaaaauugauaagggcaccagaagacuuaaauggcaugccugcuuaaguguaccaauucaguggauucuacugcucuguuccuacuuccuacaacaaaggagaaaccaugugaacaguaaacuuaaaaauccaaaggcaugcaagugaacauccauucagcauucucugccagccuagccuacuaugucccuaucuaucccacaacccauuucuaauccacccuucauaucauuucauuggcuagcaugauggcauaacaaguuaaugacugcuagccaaguuucagaaaucagacgaccuacuuuguaguuucuaaaggcagacugaaaauccugaauggaaggcugacuuuuaccaaugauuagugcgucaaaucuagaaauguacuccacccacugcagcucuaucauaucccgguuaccuucacccucuuucaucuguucgucucucucuugugucucuucauuagcagcuaucuuaaauuugucuucaggugcuuucuccguggcccucugggcuaccuuggucucaaccccaucuccagcugccucagacucuucuacagguagcauagcuuccuccuguucaggaaccagcucugccuugaccuccucuacacuugagccaucuuuaguuucugucagucuuucugcagaagucugugguucacuaggagucugaucuccuacaguugauuguccaacaacuggaccauuguugggaauaacuguaaucuccugcccuggcuucucagagacuucagcuccggccucugcagccacgacuggugaugcuucaacaucuugcccugacaguuccauaagaacagccuuaccuaguucacucucagagguagcuaccugaucuuuuggcuccuccccucccacauccgcugacuugacuugagggucuauuucagcuucuauuucuaccaccuucauuaaagugcccugcuuuucugcagcccugauaggcugaucuucugaaguuucuuuuggcuuuuucucuaagcuuauuauuuccucucccuccuccacuguuucucugaauucuuuauuuugaacauaagcuccugaaauugauuuuccuuucucaguacacaaugauuccugcucugucuucccagaagcgaccucaucuucauucaguccugguauugcugcuucuuuugccucuucagaggauucaguuaacugcuuugaagucgguucaacuguuuccuggagcuucucuucaggcucacuuauauccaugucuucucuuccacccuucuccacuucacuuuccuguucuuuaucaguuucaggcuuugucagagacuugccuucugcuuuuuuggcuucuuuuucucccauggcgucauaaaccuguucucucaacucuucccuugcuuccucuacaugguuaaagaacaugaagcauaaacaugucucggaguuuaaugauaaaagcauaaauugaaaguagaaauacauucccuuuaagccuaaguuuuaucagaugcccccaugagaaaagcaaagggagaaagggagaauccaagcuagcaaagcaacauacugcaaaagaaaugaguaaucugauaccagucagaagagaugucaagcuucccucccucucuuaaacaauauacuuauuugauuucuaacagccaaacuuagaaaauauuuacuuuucuaagauauagaaaacagaaguccuccaaggacuccuaauaacugaguauggaagguuuuuuaaaaaauauuuaucagaaaaauauuugauguucucuuaauauuuaaugccaauuuaaaagaaucuaucuauuugauacauuuaguuauucucuuaaaagcucacuaucacuuuaguaauggccuacacuuacugcaucagcccaaguaucuuuggagagaccaaccaccauaaggagaacccuauuuccgugacuuauuuaaaggaagaucagucgucgcaacucuugacuguaacaugcaacucuacauaccaucuacauuaucauuauuuucuaccaaagauucaucuucuguuuuuucuccuucuuccucuucuacaugcacuccuucuaaggcauuucccaacacuccauucuccauucuauaagaagaaaaagcacaaaaguauaacuaguuccuagcaauguauuuuaugauugugacgaaaaaagcagaaaaagaaaucauguaaaaagaauacaaaaauauauauucaaaacagaaguucuacaaguuccaggccaaccagguccacacagcaagaccuagucuuuaaaaauaaggaguguggggagggagaggcagugcccaagcaauggcucagugguuaaaagcacuuuccucucaagaggaccugauuuccguugcuaccauccauauuagcuuacaaaugucaguacucaagacucuaugagaucugagaauucuggcccugggaaguacuuugcauuuauaauuaaagaaaaagaauuuuuguuuaauuuuuuuaaagacaguaccuuuguguagcccuggcuguccuggaacuagcugugcuuaccaagcuagccucaaacucaagagauuggccugucucucccucgcaagugcugugacaccacugacuggcuuaaauaagaaaaaucuuaaaagaaaaaaccacagauauaguaacaaaaucacuagguccagucuugugucacaugccuuuaaucucaacucaggaauaagaaucaggccauucuuuaugaguccaagaccaggcugaucuacauaguaagaccuguaguggucugaaugagaauugcucauguuagaaugcuugauucccuagcuaguggaacuauuuggaaaggcuuuguuggaaggagugucacuugaggguggggacugacauuucaaaauuccaagccauuccaacaaugguuacuacucugguagcaugccuacgagcccugcaccaugcucccuuccaugacagucaugaaaucgguaagccuccaauaagcucauuucuauaaguuacuuucaucaacuaagacauccccauaucaaaacaaacaacaaacaaaaaacaaaaaaacaaaaccaacuacaugcuaacagaagacaaccaaugaucaaaaccuuaagacuaaugaaugcccacugugaaugaacuucucuaucaccucuuccaugguucagagaccuucaagaagaggcacagaggaugaaugaacuaaaguggaaggguagggacacugacuucagauaugacaagacaugagcacuuucugaucaauagcaacugugcuuaagccuauaucaccacaggacuggcugauuauuauaaacaauuaaaauacacuaaagaaaccauuuaaaacucuaacaaauacuaaugugauaauauccuagaagaaaguggacucucaccugaaaaguacaaauagugauuuucaucuagagaauaaaacaucuuauccuuuucauucuguagcagggacacacuauuuucucaacuauguuaaacuaaaaucuacuccaauuucccuuaaauggccagugacauucugugaacuuaauguuauuacuaacucauuuaguacuagugcauuaaguguucugaauauucacaaaauuaggaaacguaacaaaacuguguaaagacugaucacuuacuuuguauauccucaaaauagcuuuauuuuuuauacuauaguuucacauuaacuggauauuaauuauuaaauaauuaguaaauuaauaaacauuauauaauagauuuguugagcaguuuccaacaauguuaauaguaagucuuuguaauuggagagaaagaggucuccuacaggcagugguggcacacgccuuuaaucccagcacuugggaggcagaggcagguggauuucuaaguucaaggccagccuggucuacagagugaguuccaggacagccagagcuauaaagagaaacccugucuugggggggaaaaaagagaaaaaaaaagucuccuuuugaguuaggcuauaaaacuugaacauaguccuucugcuucagccuccucagaucgugggaaauucaggaauauggaacccuaacaagcaaauuuacuagauacuuucauguguuacuuauucaaauucuacuccauacaguccuuguugaguaauuguuuugagcuugcucaauguuucuaaauguucuuaucucuguaucaaacucugaacaaccauuaacuuauuaaaauacaucuacuaauucaaauccucaaaacauaauuucauucuuugcauaaacaauuuuagccaacaaggaaauuucaacuuuaaagaaaccaaaguguuauaaaauauucuauucauaaaaugagacuucccaagacauaccuggcuaacuccagaagugacuucccauaaaaaaagaaggcuucuccacacucauuagccguuucuccauacuucuuaccucuacaaagaaaguaaauaccuagucuuaacauuuuuaauugcuaguuaacaacacaugaaguuaauguuacauguucuaaaucuauuuauaauguauauuuuaagugccaccaacuaaguuuuuuaugagauauucuuccugccacuuuauaaauaccauguggaccagaaguuagaauauuucuggguggaacuuacgugaugaaaacgaaccaugugacacaugcuuuugaucccagaacuugggaggcagaggcaggaggauuucuuuguuuugaggccagccugguccacagagugaguuccaggacagccagggcuacacagagaagcccugucucgagaaacgaacgaacgaacgaacaaacgaacaaaagaaagaaagaaaggaaaaaagaaagaaagagaaaggagagaaagaaagaaagaaagaaagaaagaaagaaagaaagaaagaaagaaaggaagggaaaggaaaggaagggaaaggaagggaaaggaagggaaaggaagggaaaggaaaggaaaggaaaggaaaggaaaggaaaggaaaggaaaggaaaggaaaggaaagaaaaaagaaagaaagaaaggaaagaaagaaagagaaaggaaaggaagaaaggaaagaaagggagagagaaagagaaagagaaaaaagaaaagaaaaggaaagaaaagaaaagaaaagaaaagaaaagaaaagaaaagaaaagaggagagagagaaaaggaggagaggagagagaagagagagaacgagaauaccauggaugggcauucugaaacaaaaaguauuguuucugauuguguuuuuaauuuauuuuuauuuuucauucauaccugcauguaugucuaugugagaguguccuaagcccuaaaacugaggauacaaacagguaugagcugccaugugggcacugagaauugaaccuuggauacucuggaagaagucagcgcucuuaaccacuacacaguacaccaucucuccaguccccaaagaccaguaauaaugaaacugaacuacuuaaaccaaaaccucuuuuuaauuccuaaauagcaauacacuauuagacagacaaguuguucuaucucagugccuaaaacuuuuuuguaaaaugaauauguauuaaaugcucagagcuauuuuccuaaaauggcugcacagcacggugguaugcaagguuuaaucccaacacucuagagaaagacagacuaaccucuugaguucuaggccagccuagucuaaggaagaguuguaggacagagaaacccugucugaaagacaaacaaaacaaaacaaaacaaaacaagcaaaaaacuaaaaaguuggcuggaaaagcugggcaaugauggcauacaccuuuaauucuagcacuuuggagacaagaggccaaugaucuggaguuggaaaccagcauggucucuagaguuccaggauggccagggauaaacagagaaaacucuuguccccaaaggaaaacaaaacaaacaaaagaagauugguuagaagcacuuuugccuggcacccaccugguuaacaaccauaaugccaguuccaaaucuucuucuagccucuuccugaaggcacuaaacuaagcaagcacacauaaauauauacucauacacuuaaagcuggagaaauggcucuguaguuaaaagcaaguacggcaaacuccaggucuaaagaauccaaaacccucuuugagccuucaaacuaaugggcaugcauaaaacaacaaaaaccaagaaacaaauauaucagcuucuaugggauccaaagacuagcauaagucauagaaaauuaaaccaauuaauguuuuaagacuaugagacaaggggacuagagagauggcuuaucaguuaagaacacuggaugcucuuccagaguaccaggguucaauucccagcacccacauggaagcucacaacuaucuaacuccauuuccaggagauaugaaaccuucacauagacaaauaugcaaguaaaacacuaaugguuagccaggccuacaaagugaguuccaggauagccagggcuacacagagaaacccuguuucaaaaaaccaagaguugagucaguuuaucuuuuuuguuuuuccaaacaggguuuaucuguguagcccuggcuguccuccaucucagaaauccuccuguuucugcuucccaagugcugggguuaaaggcguacaucaccacugcccggcuagaacaguuuuuuuuuucuuuuuuuuccccaggcaaugagaauuuaacucaguagagcucuugccagaaugugugaggccuugaguuuuuaagccaauacugaaggauuccaauauauccuuucuggcaggauagugaaaacaaugaucuuuacaaaauucuaaaaaauaaacuaagaguguuuacuuucaccuacaggucagcuuacaagcacuuguaacuccuguuccaggugaucugauguccucccggccuugcugacaccaggcauguauguccagacacaugcacacaaaacacccauucguaugaacaaaaaaaaaaaaaaaauuuaauuucuaaaccccacuuuuuuuuuuuuuugaaaacuuuccaauacuuaacaguuuacacugauuaguuuuugaaaacaugacacaaacuggaguuaucugggaagaggaaucucaacugagauaaaguggagacaaaccugcgccgucuauaugggaaggccuucaguccauuguaggcaguaccaccucuggacagguggucaugauaguauaagaaagcagggggcccaagacauuaagaacaagcuaguaggcaguguuccugcccuuaauucccucaaugaugggaguaugaucuggacauguaagccaaauaaacccuuaauacuuaacccaaguugauuuaaaggcaugaugcuuaucacagcauacaggggaauaagacaccagcacaguacuaaauaccacagcccaaaauuaaucaguccagacagaacaaaacaaaggcaggcccaaagauuguuacaaacauccaagaauaacauuguucugcaugcugaaagaaggaaucgggcacagggcuagagauggcucagcagugaaaagcagacugcucuucugaagguccugaguucaaaucccaacaaccacauaggggcuuacaaccaucuguaaugagaucugaugcccucuucuggagugucugaaaacagcuacaguguacuuacauauaauacagaaauaaaucuuuaaaaaggaaaucagaaaccuacaaaaacuuuuaagauuuuuuuuucccaguaugaaugaaaacaaugacuaaccuucaauugcuauuagaaaaaaacuauccuagagacaacgcauucagacaaagugaucagaaaaagauaguuugaagacuaagauuacuaaucuguuucuucaauauauggccaacucauggcucccaccauauuccaaucaguuacauaagauaagaauguuugaaaaaugcuauucuaauaaaagauuuaguaggagaaauuaaaucaagagcagucaagcuggagagaaaguugagaguuuuaaaaaagcugcugcugcucuggcagagaaacuggguuugauuucaaguacucacauacuugacaacucacaauuuacuaccaaagguaucccaauacucaaucauggauuccauaggcacuuggcacacauauggcauauguacauacuuucaggagacauauucauacauauaaaaaauuaaaaaauaaaaaccaaacugaagccaggcguggugucgcaugccuuuaaucccagcacucgggaggcagaggcaggcggauuucugaguucuaggccagccuggucuacaaagugaguuccaggacagccagggcuacacagagaaauccugucucaaaaaaaccaaaacaaacaaaaacaaacaaacaaacaaaaaaccaaacugauaucccaguagaauaagggaauagcuuaaugguaauguacuugcuuaucaccuaaaaggucuuagaauugaaccuaaguaaauuuuucaugaguuucucuguauaccuggaugugcuaguacucccucuguaaacgaggcugacaucugccuccaaaauucugagauuaaaggagugccccaccaauacucgucucugaggcauauuuuacauaauaaaaaguaaaaaaugaauuaguuuuccucuuaaucauuagugacuaugaugaaaaucaccuucuucaaaaguuaaaugaaauuacuuuauuauaauaaaaacucauccacagaaaauaaaaagccagaauuguuuucaugguucagacaauuagacaugggauuucacguauauuagguaaguauucuaccaucauacuccuauacccaccccacuuucaaucuuccuucuuucuccccauagaaaaccuguuacaaguuuguaagcuauuuacuacuguuuuacaacagaacauauacuuacaaaagacuagcugcuuccuggaaugcauuaacagcugcuggaaugucacccaucaccagauguuucuguccuaaucccaguaguuucuuagcuucacuauccacauccagacugaaagaaaaaaauauauuuagugccaaauacuguuuacaucaauauuaauuggauauauuacauuuacaccauaauaguuaaaaagaccuaauaaagccgggcgugguggcgcacaccuuuaaucccagcacuugggaggcagaggcaggcggauuucugaguuugaggccagccuggucuacaaagugagcuccaggacagccagggcuauacagagaaacccugucucggggggaaaaaaaaaaaaaaagaccuaauaaauugaccaaguagaugcauacacccaugaucacuguaaagguaaaggcaggaugacugagaaugagcuucaacuacauaccaagauacuauaugaaaaaagagaagaccugcuaugucacauuuacuuuaaaaaaaagaaaaagaaaaagaaauuagggcuggcgagauggcucagugcucuuccgggucccgaguucaaaucccagcaaccacacacaugguggcucacaaccauccguaacgaaaucugaugcccucuucuggaguaucugaggacagcuacagugaacuuacauacaauaaauaaaucuuuaaaaaaaaauuaaaaaugcaacuuucauaaaaccuuacaaaacaugcuauuauaaauagaugcuaauuacacaacaaaagaaccaccaaggaaaccaaaagauauacacgcuuacuagcuaaaauuaaaaguaaaacauauggaaaaaauaaacagguaggguugagaauggagauauaaccgugcuuuccuagcaugcacagagcuuuagaucagucucuaguaccauauacacaaaacaugguuaguagauaacuauaauauccauucucagauuauagaaacaggagacccugucucaaaagcagagagauuaugguggcacagcuuugaucccagcacuuaaaagaaauaugcaagcaggcugggcagcaguggcacacaccuuuaaucccagcacuugggaggcaaaggcaggcuauuucuguguucaaggccagccuggucuacagagugaguucuaggacagccagggcuauacagagaaacccugucucaaaaaaccaaaaccaaaacaaaaacaguaaagagccaaauauuucuguuuuacacacgcacgcacgcacgcacgaguaucucugaaaauucacugacacccaagacuacauagugagacucugacucaaaaaauaaaaggaggaaauauggaccuaacucaguugauagcauuugucuaguauguaaacacagaaaucucuggguuuaaucuccagcacugcauaaaagcagguaugguacaacagaccugugaucucagcaguuggaaggaggcaaaaaauuuaaaauuuuaaggucaucacaggaaauacagggagacuaaaaccaaccaguguuauaugaaacccucuagaaggagggguaauacccuaaauaaaugagcuaggugugguggccugugcuuuugaccccagaagaggcaagcagaccucuaagaauucacggccagacuagucagcauagugaguuccaggacagccagggcuguuauacagagaaauaggaggcuacaguauuagcucaguggguaaauaucuuguugaacaagcaugaggacuggagguggaucccuaagacccucuuaaacgcaggguagaccaacuuguauuuccaguacuuagaaaguagagaagggauccuacucagcaagaucuggguucaguugagagagcuguauucaauaaaugaucaaagauucccaauaucaaccuuguaccuuugacugaacaugugugcacagaacacacacaccauacaaauauacaagcacauauacaaaguaggcaugccacaaacauaaaaauaaaauuaaaaaaaaaaaaaaaaaacuaaagcauggugacacacccuuuaaucccagcaccgagaagauaggcauaggucagcauggucuacaugguguguuccaagugagucagggcuaaaauaaggccuuguucucagaaggggaaacaugguacauguggaaugugagugauacagagaggcuagcaacagcucaguauaagcauuggaccuagauucaauucccagcacccauauggcaucuaguucaaggggaucuaguaaccuauucuggcuuccaaguaacacuagguacacagugcauaaaugaacauguagacaaaacaccuauacacauaaaauaguaaaaaauacuaaguaaauuuaaaaaacuguuuccaagagguguauguggugugacuaaguugagaaaaugucuaccuguggaugaauccuuagauuuaaagccuagaauagcauaaaaccaguauggugguauaaauccccaguuacauaacaaguuaaagauuaaugccagcauuuaguagaaaggaaugggaguggaucucacaagccacauugacagaccaugaacugaagcuaaaggcaaucagccuuccuauuucaacucacagaauacaauuaagagcuaacaugcuucuuaccacauuuuuuuuaaagucacuucuaauaucaaaaaugauuuaaugaaauuagaagugacuuuaaacuauuggggcaugaaauucaccgaugaucaaaaauacuuuuccaaaucuugaaaaaacaaaaaacaaaacaaaaaauuuuccaaaaguuuaaauuauuuuuaagguuuuguuguuuguggguugcuuuuuuuugggggggguacccaaaauaacuccuaucuuagcauuccaugugcuggguguccuaguuaguuagcuuuagcugccaacuagacauacccuagaaucaccugagugucaacugaggaauagcccagagucagacuggccuguggggccagcccauugaggucagcaccauccuuagaaagauggaacuccacugcaaacaaagaaacaaacaaaaacaaaaaaguugcugagcaugagccuguaagcaaaccaaagaaaaaaacagcaguguuuccaugucgcccacucugauuuuccuuauugaugauuuaaguguuaagcccaacaaaucucuucuuccacagguugcuuuuacucaauguuuuaagauaacaaaauguaagcucaauuuuuuuuuucuguuacuggagacuaaaccuugauucucaugcauucuaagaaagcacacuaacaagcuacauuggaaaucuuaauuuucauuuaccucaaauuuuauuacuggaaacaacacugugaguugauuccccuaaggaaugcucucauuuuggacaaaauguccuccaaauaccccgguauuugaaaaaucuguuagcaguucauaauggucaucacauguugaagggauaucagguuuaccuacuacuguguuuacauuagugccaauuaaaaaauuaaaggugcaaauuuucuuuauaaaagugaucuaaauggcggggcaguggugguacacaccuuucaucccagcacuugggaggcagaggcagacacauuucugaguuugaggccagccuggucuacagagggaguuccaggacagccagggcuacacagagaaacccugucuuggggaaaaaaaaaaaaaaaaaagcuaaaugaaucccugaacagguuuugcugacccuagagacaucuaagaaaaggagaggagcagaagauacaauuucagagauacuacucuguguaaagccuucagauuuuauccccagugagcagauauaaacuguuucagauauguuucagugagcagauauaaacuguuuacauaauuguaucauauaaucuuaccucuccauuuuaucugccgagguagaaggagcaggagcaucuucaauucuauaaucaauaaaaaagaaaaaaauacaauggaagcucuuuuuagcuuggauauuaaguaguaucagaaaaacauaaacacauaagaaauuuucauauuuuaaacaacacacaucuugaaggacuggugguauaugcuuuaauccaaguacucuaggauaaaggcagguggauuucugaguucgagaccagccuggucuacaaagugaguuccaggacagccaggacuacacagagaaacccugucuaaaacaaaacaaaacaaacaaacaaaaaaauauaaaaauauugccgggcagugguggcuuacgccuuuagucccagcacuugggagucgcagaggcaggugaauuucugaguuugaggacaaccuggucuacagagugaguuccaggacagccugggauacacaggaaaaaaagaaaaguaaaaauacuaaaggcacauauguaauucacacugacguagaacugaauaagaacaguauggauaauauacuuugaggccuacguggggacacaaugaaacaccccaauuagggguuagagagauuuaucagugguuaagagcacuggcuguucuuauaaaggaacuagucuggguucccaauuccaauauggugucugacgaccuugcaaaauuccagauccagagguucagaaagccucuauuuuccacaagaauuguauguacacugugcucaacauacauacagccaaaauccauacauguaaaaaaaaaaaaaccuuuaaagaaagccaggcauagcugggcagugguggcauuugucuuuaaucccagcccuuggaaagcagaggcaggcuaggcaaucauggucuacagagcuauaguucuaggagagccugagcuauacagagaaauccugcuucaaaaaaacaaaggagggggcuggugagauggcucaguggguaagagcacccgacugcucuuccgaaggucagaaguucaaaucccagcaaccacaugguggcucacaaccauccguaacgagaucugacgcccucuucuggagugucugaagacagcuacaguguacuuacauauaauaaauaaauaaauaaaaucuuaaaaaaaaaaaaaaaaaaaaaaaacaaaggagugagaauaucaagugauucuaauaggaaacuaaccaauacaaugaggaaauagcuaaaaagaaauaauaaagaggacuggagagauggcucaacaguuaaagagcacuggaggcucuucaagagguccugaguucaauucccagcaacuacaugguggcuaacaaccaucuguauguaauaggauccaacgucuacuucuuguguuacuguggcaagugacugucuacucauauacauaaaauaaauaaaucuuuuaaaaaaugauaaagaaaaauccuuguguagugugggguuuuuaauugguuaauauucacaauguggggaaagcaugguacauacuguauagucuaaauuacccaaguguguguaugcuugcaggaucuagaaugacacauugaccugaacugcuugugacuggguaacuuuguucuugcuuucuuguguuuuguuuccuguaaugcauauacuaaaaaaauaaagcuucuuuaaagaaaaaacaauaaagaaauguuuaaugauuuuuuaaagacuuuuuuuucauugugugcuaugaugugagaaggggaacaaugugcauguauaccagaguacacauagggaaaacacuuuagccaucucuggcuaccccucauaauauuguaaauccaaccauuuuguaguguuuaaauagaaaauacagcugucauaugaaaaaaaaaaaaaaacuaagagacuaagaaugcagcagccaauaaacagcccuggcugucuuggaacucaaccguagaccaggcugaccuugaacucagagauccaccugccucugccucuucaguguugggauuaaagccauguggccaccacugccaggcaagacauaaaauucaaauugaacagcaagaggcugguauaggcauuugcuaugcuagaaagauggcuaagguguuaaagagcacauguggguucaguuuccaacauccacaugguggcuaauaacaaccaguaacuccaacuccaguagauccaacauccucuaauagcuucacauggcauacacucacagacacacacauaaaagaaaaacccagccgggugugguggaguacaccuuuaaucccagaacucgggaggcagaggcaggcggauuucugaguuucgacaccagccuggucuacaaagugaguuccaggacagccaggucuauacagagaaacccugucucaaaacaacaacaaaaaguaggcauguaauuuucuguaaauacccauucaggaaggaagcugguaauuacuucaccaacagccaaaguguaacugaacacaaaugaauacaugaaaaucucuguaaaguuuguuuauacaguaauuuaaaaaaaaaaaaaaaaagcugggaacuggcaagcuggcucaguggguaagagcacugacugcucuucugaagguccugaguucaaaucccaguaaccaugugguggcucacaaccaucuguaaugagaucuaucucccucuucugauggucugaagucagcuacagugucuauguauaauaauaaaucuuugggccagagcaagcaggggcugagggaguggaguugaccagagcgagcagaaauccuaaaaauucaauucccaacaaccaugugaaggcucacaaccaucuguauagcuauauuguacauauagcuuacagauagcuuauguacuuucagacauaaaauaaauaaaucuuagagcagcuggccaggcagagguggggcacaccuuuaaucccagcacuugggaggcagaggcaggaggauuucugaguuugaggccagcaugguccacacaaugaguucuaggacagccagggcuacacagagaaacccugucucuaaaaaaaaacaaaaacaaaaacaaaaaaaggcugaagguugugguauacuccuuuaaucccagcacuugggaggccaaggcagccaggacuacacagaaaaacaaaaaacacaguuuggaaaucugaggagaugcuaggcauucccaaacuguaaaguacuggaaggaaagggauccccaacguaauacaagcagcuguucagaaagcaccagaaauggaguuucuaccgaauuccuaaacuuaaucuacucuggcccuaaaaauaucaaugaagaggaccuaggaaaguggaaucugaggguaaaacugcacuuucccaaaugguugagugguuagagacccacugauuuucaagaacccacuaggaaaggaaccaaaaggugauaggguaaacuguacggagugaaacgucaucuaaaacauaaaccuauagaaaaaccaaucaaauaucucacagacaccuuuacuuuuacccaaggcaaaacuugguuaaaaaaaaaaaaaaugcucaagggacagaaaaaaauagaauccaggaccuaaaaaaggcaagguaaacuggaaaaucgaaccuguauggaaaauaacuucuuuccucgaacugaugaaugcuucugugcauaugggagagaucaaguuagauuagcacuuuaaagcucucaaaucaagcauuccuccuuugggguccuuucgcuuagcaaacucaucuagcaaguaaacacuagacugauagcuacauacagccuuuaccgaagacacuacgcaaguaaagugucccuugaagcaacaaaauccccgucccacauaccgaaaaccuaacgaaucaagacacuucuccgcaaagguuaagaguuacaaagcuucagucccguagccacccucaagauuacuguaaaccugguagugaguauauaauaaaauucauugcgccccaccgacccggcaaaagcagcauccacuccaaacaauggaguuuucccgccuccuacaggccccgcccacuccuaagagccaaaacuacgacgaucagcgugcaaagccccgcccucugagaggccccacccacccgcguccccuguuccaagccuccauccucguguggguuuuuuuuuuuuuuuuuuuuuuuuggcgccaaaucuguuggccaauuucucgguacgucuacagacucucuacagagacgcacccuaggagugcgcgaucaggaggggcucaaggaccgacuggagccgggccccgccuaccuaccggcaaccucgggcaagggguggaaaaaaggggccggcgauggagccagccaccgcugcccccggcaagauggcggccgugaaaagccgggcagggggcgccagccacccgccguuaccgcuggcgcgccagcucuucgcaaguagggcuucuccacagagcaacccucuccgcacggccgccguuguuccggggaaggcagcugucccacccaccagcccgucccgcccgggaagccaaguccccggacucucccugaggacuggccucaagcucgccacagucccgcuuacuugucagcggaaaccagcuccgcggcgauggcagcagcggcuguagacucuguggccaucguuccccugagguggugggccagugggcagaacacugccugcgaagaaaaccagagaauuccggacagcagagacucacucagguagagaaaauggcagauuggagaccccgcgcgguugaggcccucuuauauaccaggucccuugucccgcccauccacuuccggauccuccccccucggauuuaaaggacuaggacucaacaccuuucugucacaaggacacagcccuguaucccuucccguuuggguaucuucccgcccuagcccguuuuuccuuaaaaaaagaaaaaaagaaaaagaaaguaagauagaaaggaaaaagaaaacaaaaaucaaacaauuuccugcuucuguggcuagucgugauagaagcaaaaucucaguacuacaacuucugaaugggagccagccuagagauuccacaauuaaguggagccagugagucucugcgacuguggaaaaaguagucccgaaggugucuuucugacggggauacccgagaaggugacagguauucccuauguccucucagucuuaacggauggaaacgcaagagcugagcacgaguacagcagcaacggcuagaacugaccagacagacgcguggcucugggccucagcaacuacugacgaaacaagaugcugcucuaggauuggcuacagauaaaacuaucgcgcuugauucaaaacucuuagaggggcaaagggaugcggguguuuagauccaccgccuuugacugauccaauccguugcugccaucaucuuacuuuacccacguccaaguuguuaaguuaaauccuguacuuaaaacacuuuaaauauuuuagcugucucucuuuuuuuuucuuucauauauauuagguagggacuuacagucuaucccuggcuagccugaaacuugcuauuuagacccacugaucucuaacccacagacaucugccugccugugauugcgagggcugggauuacaggugagcagcaccacacacgccuucuuuuacaaccuuuuguaacuccaguucaagggcauucaaucaaugccuuccugugaccaccagagccacuaggcacacacaugguacacauuuauguaugcagauacacucauacacauuaaauaaaaguaaauguggcuggaaaauucgcuaggagguuaggagcacuuguuauucuugcaaaggauccuguuucaauucccagcacccacaaggcgccucaccacuucguuaagcuccaggcaugcauauggugcacagacauggauguagguaaagcauuuauucacacaa

SEQ ID NO: 2050 - RNA, 1845 nt, Mus musculus
agaggccccacccacccgcguccccuguuccaagccuccauccucguguggguuuuuuuuuuuuuuuuuuuuuuuuggcgccaaaucuguuggccaauuucucgguacgucuacagacucucuacagagacgcacccuaggagugcgcgaucaggaggggcucaaggaccgacuggagccgggccccgccuaccuaccggcaaccucgggcaagggguggaaaaaaggggccggcgauggagccagccaccgcugcccccggcaagauggcggccgugaaaagccgggcagggggcgccagccacccgccguuaccgcuggcgcgccagcucuucgcaaguagggcuucuccacagagcaacccucuccgcacggccgccguuguuccggggaaggcagcugucccacccaccagcccgucccgcccgggaagccaaguccccggacucucccugaggacuggccucaagcucgccacagucccgcuuacuugucagcggaaaccagcuccgcggcgauggcagcagcggcuguagacucuguggccaucguuccccugagguggugggccagugggcagaacacugccugcgaagaaaaccagagaauuccggacagcagagacucacucagguagagaaaauggcagauuggagaccccgcgcgguugaggcccucuuauauaccaggucccuugucccgcccauccacuuccggauccuccccccucggauuuaaaggacuaggacucaacaccuuucugucacaaggacacagcccuguaucccuucccguuuggguaucuucccgcccuagcccguuuuuccuuaaaaaaagaaaaaaagaaaaagaaaguaagauagaaaggaaaaagaaaacaaaaaucaaacaauuuccugcuucuguggcuagucgugauagaagcaaaaucucaguacuacaacuucugaaugggagccagccuagagauuccacaauuaaguggagccagugagucucugcgacuguggaaaaaguagucccgaaggugucuuucugacggggauacccgagaaggugacagguauucccuauguccucucagucuuaacggauggaaacgcaagagcugagcacgaguacagcagcaacggcuagaacugaccagacagacgcguggcucugggccucagcaacuacugacgaaacaagaugcugcucuaggauuggcuacagauaaaacuaucgcgcuugauucaaaacucuuagaggggcaaagggaugcggguguuuagauccaccgccuuugacugauccaauccguugcugccaucaucuuacuuuacccacguccaaguuguuaaguuaaauccuguacuuaaaacacuuuaaauauuuuagcugucucucuuuuuuuuucuuucauauauauuagguagggacuuacagucuaucccuggcuagccugaaacuugcuauuuagacccacugaucucuaacccacagacaucugccugccugugauugcgagggcugggauuacaggugagcagcaccacacacgccuucuuuuacaaccuuuuguaacuccaguucaagggcauucaaucaaugccuuccugugaccaccagagccacuaggcacacacaugguacacauuuauguaugcagauacacucauacacauuaaauaaaaguaaauguggcuggaaaauucgcuaggagguuaggagcacuuguuauucuugcaaaggauccuguuucaauucccagcacccacaaggcgccucaccacuucguuaagcuccaggcaugcauauggugcacagacauggauguagguaaagcauuuauucacacaaaau

SEQ ID NO: 2051 - RNA, 1845 nt, Mus musculus
auuuugugugaauaaaugcuuuaccuacauccaugucugugcaccauaugcaugccuggagcuuaacgaaguggugaggcgccuugugggugcugggaauugaaacaggauccuuugcaagaauaacaagugcuccuaaccuccuagcgaauuuuccagccacauuuacuuuuauuuaauguguaugaguguaucugcauacauaaauguguaccaugugugugccuaguggcucugguggucacaggaaggcauugauugaaugcccuugaacuggaguuacaaaagguuguaaaagaaggcguguguggugcugcucaccuguaaucccagcccucgcaaucacaggcaggcagaugucuguggguuagagaucagugggucuaaauagcaaguuucaggcuagccagggauagacuguaagucccuaccuaauauauaugaaagaaaaaaaaagagagacagcuaaaauauuuaaaguguuuuaaguacaggauuuaacuuaacaacuuggacguggguaaaguaagaugauggcagcaacggauuggaucagucaaaggcgguggaucuaaacacccgcaucccuuugccccucuaagaguuuugaaucaagcgcgauaguuuuaucuguagccaauccuagagcagcaucuuguuucgucaguaguugcugaggcccagagccacgcgucugucuggucaguucuagccguugcugcuguacucgugcucagcucuugcguuuccauccguuaagacugagaggacauagggaauaccugucaccuucucggguauccccgucagaaagacaccuucgggacuacuuuuuccacagucgcagagacucacuggcuccacuuaauuguggaaucucuaggcuggcucccauucagaaguuguaguacugagauuuugcuucuaucacgacuagccacagaagcaggaaauuguuugauuuuuguuuucuuuuuccuuucuaucuuacuuucuuuuucuuuuuuucuuuuuuuaaggaaaaacgggcuagggcgggaagauacccaaacgggaagggauacagggcuguguccuugugacagaaagguguugaguccuaguccuuuaaauccgaggggggaggauccggaaguggaugggcgggacaagggaccugguauauaagagggccucaaccgcgcggggucuccaaucugccauuuucucuaccugagugagucucugcuguccggaauucucugguuuucuucgcaggcaguguucugcccacuggcccaccaccucaggggaacgauggccacagagucuacagccgcugcugccaucgccgcggagcugguuuccgcugacaaguaagcgggacuguggcgagcuugaggccaguccucagggagaguccggggacuuggcuucccgggcgggacgggcuggugggugggacagcugccuuccccggaacaacggcggccgugcggagaggguugcucuguggagaagcccuacuugcgaagagcuggcgcgccagcgguaacggcggguggcuggcgcccccugcccggcuuuucacggccgccaucuugccgggggcagcgguggcuggcuccaucgccggccccuuuuuuccaccccuugcccgagguugccgguagguaggcggggcccggcuccagucgguccuugagccccuccugaucgcgcacuccuagggugcgucucuguagagagucuguagacguaccgagaaauuggccaacagauuuggcgccaaaaaaaaaaaaaaaaaaaaaaaacccacacgaggauggaggcuuggaacaggggacgcggguggguggggccucu

SEQ ID NO: 2052 - RNA, 1063 nt, Mus musculus
guuuuuguucuuaacgauuuauuucuuuucauuuucugugcauugguguuuugcuugcauguaugugugaggguguuggauccucuagaacuggaucuacacaguuaugagcugccaugugggugcuggaaauugaggcuggguccucugguagugcagccagggcuuauaacggcugagccagcuuuuccagcccuagaauagguuugugaggcuggggugcgacugagaaauauuugggugcacaguuuccccugaacgugguuuaauuuuagacguggccuuccaagagcaguaaaacagacccuucuucuaguuugggucuugauugcacagcacacagugguccugggaauaaagagaggcacggauuacccggguaccccgauuaaacgaggaaaugacucaaagggcagugcuuuucuaccucugggaacagcaucacugaaagugugagcguuucccccuggagacccccuccacuccaggcccauccagggaaagcgcugagucaucccccguaggccggccaggguggggcggggcucagccaggucccccucuucccgcacccccggcccgugagaaucucgcgagaacuuuguaggcuauaaaagcagcuccccgcgcgcgcugucgggcgaccucuuccugcguucucacggcucuuucuguuugugagaccuguggcucgacccuggugagugugcggguaucgccgcugagaaacgcggcucgcgcccaucacugguuccuucucccucuggccggucccggcucgucccgggcgaucacgggcugaagcggcagggcgaggccuggucccgcgagugcuggagcucuacucgcauucuucacguggcgcuuaguucccggaccuguuggaacccugaggcuaacguucaguuuccuccucucccgcucaccgauagagggcggagauggcuuggugggacgaguuugugcuggaacuuaccgcgcgcacugggcugugucguuguguuuucugaugugcuauagugggugauggcgugagugguaggaacguaaccuccagcgagcu

SEQ ID NO: 2053 - RNA, 5955 nt, Mus musculus
uggacgcauacaagccuaaguuagcuaugagacuccauuucccagcaagcucagcguucagcgugcguuauggagccgcgagucgcagagcugaagcagaagauugaggacaccuuguguccuuuuggcuucgaaguuuaucccuuccagguugguuugucuucccugugguccuagggugagcucuaggauuggccuuggugccaaaagugugaaggccggugagcccuucugauccucucaaccuacugcagccaucugaugaccaggucguguuguaaaauggggcuugauuaaaaaacguagagaaacacauguuugcccuuuuaugucuuuaugaugucaaacaaaugaaugggauacagcccaagauccccuaaccugucaucauuauaauuuaccagaaaacggucucccggugugggcgggaucaucagauucuuccaaaggaauuagaagaggucaaaacuuggaagguuggugugacaguguacucgaucagaugaagagagaagaguauuccuaauguugaacaagagacaauuggcuaguuuguucggccagccaacagaaggcuaauucaugguguugcuugccaucaauacgggacugagcauagaaauuccucacgcucgccugguacagaagucucuguaaccacagucccucuccaccccacccagccccgcccuauuccacacuuuccucccacagugcugagugaacaaaauuauguuuaagacacaaacuaaaauccgccuguguccuuuggccuaucuuaagauuccuaggccauugagcuuuccaggggaagacuuguaagaagauacuauugagaaguuaagucuaguuugaaagccaugcuugaggucuuggguucaauuccuaguaaugaggcaaaaacaaaauugaaagcugaggcuauaaaacuaagugagauguauaucuaucuauccaucuaucagaaauuuaucugauagguggauggcuagcuagcuagagugcuggcuuagcauuugcaaaucucagucaccagcacaaaaacagagaaauguauaugaaaagauggauugaaaggagaggagaauuauguacauucuagagucagauugggacuggaaagagagcucagcaguuaagagcacugacugcucuuccagagauucugaguucaaaucccagcauccacaugguggcucacaaccaucuguaaugggaucugaugcccucuucuggugugucugaagacagcuacaguguacucacauacauaaaauaaguaacuaaaucuuuuuuuaaaagucagaauuuggaggcagugauggaagguagugauggaaggcagauaugggaaagaauagaagugccuaugugaaugugaggcaugguggcugaagccuuugaccccagcacucaggaggccgagucuuccagaccagccugauauacauagcaagcuccaggucagccagagcuauagugagaccccaucuuauuuuaaacuugugugugucuagucuggauaauaggaacuauuauacugagcagaguuagccccgccugucuccuaaggucuugcuacucaccuuuccaguccuauauccaacagccaccaugaauaucaccugaaucuuccaaacacagguuguuguuuuuagcccaccaaccuauccuauaucccagaacacuucucacauaugaauuauuauaaucuccuugcugccaucuuggcuccaauccauucucuacagcgcaaccagaucuuaguaaugcaauuauuggucacuuuauucuuuuaaggguuaaaugacuccucaucuucaccaaguuggugccauaguuuuuaaguugauauguaaggccaggcccaaccucucuccuacuaaucucucaagccuuccccuagugcauuuccuucuuuuuuucuuuccuuuuuuuuuuuuuuuggugggggagaggggcggggggaugggguucuuuuuuuguuuuguuuuuucgagacaggguuucucuguguagcccuggcuguccuggaacucacucuguagaccaggcuggccuugaacucagaaauccaccugccucugccucccaagugcugggauuaaaggcgugcgccaccacgcccagcuucuuucuuucuuuuucuuuuuucuuuuuuuaauucuccccaccccccccccaaaaaaaaaaaaaaaaaaaaaaaaaagacagggcuucucuguguaucccuggcuguccuggaacuugcucuguaaaccagacuguucucaaacucagagauccaacugccugagcuuucuguguuccagguggcgugguacaaugaacuccugccuccagccuuccacuugcccuucccaggaccuacccuggccuuccugguacucagcacaccugcuauguuugacagagcccucaaacccuucuuaaagagcugccacuuccaaacacugagagacccgguggaucaauguguguccuaccaccugaggaguguuacagagguaauguggaacuuuccuucaacucccaaauccacaucugcuucccuguugaccuagcuuagggcacaaucuagccuuagggcuaggagcccugacauucugcaacuucuuuuuuuuuuuuuuuuuuuuuaaagauuuauuuauuuauuauauguaaguacacuguagcugucuucagacacuccagaagagggggucagaucuuguuacagaugguugugagccaccaugugguugcugggauuugaacuccggaccuucggaagagcagucgggugcucuuacccacugagccaucucaccagcccccuauucugcaacuucuuacacccagguuuuacccuuuccuuuagcagacuccccaucugaaaucaguuucguagggugacuacacugauagacaacuagaggaaccucuagucuuaaucuuuuuacaaaucuuuuuuuuccuuuguuuuuauuuauuuauuauauguagguacacugcggcuguccucagacacuccagaagagggagucagaucucauuauggaugguugugagccaccaugugguugcugggauuugaacuccugaccuucggaagaacagucgggugcucuuacccacugagccaucucaccagccccucuagucuuaaucuuaaagauguuggaauauuaguaauccaacaucuuuagucauuggucauugacuuuagucauuggguucuaugcugucuguggagccuuugaaggcagaagacuauuucccagccuguacucauuuauauacacauaaaucuuuacauauacauucuaggucuuuccacucuagaauugccacagacaacucaauaacuccuauaauggaggcuucugagcaaggcuuuuauauuuccuuucaagcacaggcccuucugagggggcagagaaacucuaaaauccuucacuuuguagcuccuuagguuaaaguuguuuuuccuucaaacagacauuuaauggugaauuccagcaguagagagauagaggcaggagaaucaggaauucaugaucaucuuuagauauauaaagcauguucaaggucauucugacccggucacacacacacacaaacaaacaaacaaacaaaaaaauccccuugggcuuauaaaaacagaaggcauauuaauacauaacuuaggacuuagaacaaaaucaugacucccaucaugcuaacaagcgcccuguauucuguuccagaaguuuccagaagugcauauggaagucauugcugacuaugagguacaccccaaucggcgaccuaagauucucgcccagacagcagcccauguggcaggugcugcuuauuacuaccaacgacaagauguggaugcagacccaugggggacccagguuagagagugaaugugaaugaguggguggggaccaagggaaaggauaguaaaggcuccuaaaggauccccuacaauauaaggucuguauaagugcugagauuaaaggugugccccaccacugcccggcuagauuuuuuuuuuaaagauuuauuuauuuauuguauguaaguacacuguagcuaucuucagacacaccagaagagggcaucaguucucguuacagaugguugugagccaccaugugguugcugggauuugaacucaggaccuucagaagagcagucagugcucuucaccacugagccaucucuccagcccuagauuucuuaauuuaauagaagggacagagccuucugcauggaaugagugugcacugagugggaaagaauuagaaaaagauuaggaacauuuguugcuuuuguaugaaccauguucaaucccaagcacucacguggcugcucagaaccaucugcaacucguuuuuagauugacacccucugcuggccgcuguggguacugcuugcaugcaagcaaaacacucauacccauacuugggggauaaaaaguuuccaauagucguugaaccuagugucaaaaugaccucuguaacccugcuuuuucuuuguccucuccccagcacauagcaggugugugcauacacccccgauuugggggcugguuugccauccgagggguuauguugcugccagggauugaagugccaaauuugccacccagaaagcccccugacugugugccuacaagagcuggccgcaucacucugcuugaagguuucaauuuccauuggcgggacuggacuuaccgugaugcugugacuccugaagaacgguacuccgaagaacagaagaucuacuuuuccaccccaccugcccaacgcuuggcccuauuaggcuuagcccaacccucagaacacccuagcacuacaucugagcuuccucuuuccuugcuuacuaaaccucagaauuccaggagagcucgaagcuggcugaguccaagugucucaccaccuguauccccaggcccuugauaacuuuuccccuucaggaucccacucauaguagauuuauuuuaaguaggauuuggguuuugaaaaaaacacuuucuccuuuuuuaguuuuuuugagacaagguuccucuauguagcucagaccagguuggccucaagcuaagagagauccaucugccucugucuucuccagagugcugauuuuuugcacuguggaaaaaccauuuuauuuuagguaggauuuccugauaauagugcuucagacagucaagacucaauuuacauuggucaagauaaaucauaugccaaggcagacucaaaaaucagcaguugacuucaaauauuagacucaugcccauuacuauuuuuuuguuuuuguuuuuuguuuuuucaagacaggguuucucuguguagcccuggcuguccuggaacucacucuguugaccaggcuggccucaaacucagaaauccaccugccucugccucccgagugcugggauuaaaggcgugcacuaccaagcccggcuuuguguaguacucuuaagauacuauuuaagaaccaugguucucacuguucguuccuaaagcugcuaucauuuaaugcaguuccucauguuguagugaccgcaaccauaaaauuauuuuuguugcuaccuaauaauuuugcuaguuaugaaucaauugucuuagggaauccagugaaaggguuguucaacaaccccugggggcugagaaucacagauuuagcagcuccuagggguacccaccacauugagcuaugcugaauuaauauuuaaguaaacuacauugaaacugccccgaccuacagugugcuauuacuaaaggcucaggcaaucuuauacuuaugcucaaauagauguacuuugaauucuggaauguuggaaggacaugaugucauaggauuauuuugucaacccuaaccaagaauccagaagaaacuuccugacuuuacaggaucagaaaggaauauucucucaucacagcuaaaauacaaguaguugaauacaaucauauccaaagccac

SEQ ID NO: 2054 - RNA, 13333 nt, Mus musculus
ugcuuuuccuaauaugacaguagggauucuauuuaucagugggcuuaaaacaaaauguagggagaaggcucaucaguuuugaguacugguugcucuucuagucccauucucaucuucagcaugguggcucguggccuucugugauccagugcccucuucuggccucugcaggcacuuaauucacagggcauucagauguccuggcaaaacacccaaacauuuaaaaagaaaacuuagggacuuacaacacucccuggauaaggaacccucacuggcuuuaauagggcaacccuugucucugccucccaaguacugggauuguagacacgcaccaccccacaucagucuaaacuuuaaggugguauugaggauccugggaaguggagagauuuaaugacuuuuuaaaggucuaauggugguauagaaguucucuagaauggaacucaaauugaaaagaguagauucaucuauucuuguuuugcaaugcuugggguugaacauagagauguauucaugguagguaggaacucuaccggugagugauaucacuggcccuccuuuuuuauguaacuauaacuggucucaaaauuguuguauagcccugguuggucucaaacuuagcaaucuugucucagcauccuuggugccagaauuaaaggcuugggccaccaugcuuagccuuuguuugcucuuuuguuguuguuguuguuuuugaugauuuguuuuuuuuguuuguuuguuguuuuuuuaaauuuuuaaaaaagauuuauuuauuauaaucuaaguacacuguagcugucuucagacacaccagaagagggcgucagaucucauuacggaugguuguaagccaccaugugguugcugggauuugaacucaggaccucuggaagagcagucagugcucuuaaccgcugagccaucucuccagcccugaugauuuguuuuuuauuauauauauauugguguuuuaccugcauguaugucugugugagagugucagaucucuuggaacuggaauuacagacaguugugaguugccaugugggugcugggaauugaaccugaguccuggaacagcagccagugcucuuaacuucuaagccaucucuccagccccuguuguuaacucacccacauacagacauacauacacacauaccuaguuucaaauaauaaauauauuuaaaaagcacaaagguagccgggcgugguggugcacgccuuuaauccaagcacuugggaggcagaggcaggcgaauuucugaguucgaggccagccuggucuacagagugaguuccaggacagccagggcuacacagagaaacccugucuagaaaaaaacaaaacaggaagcuggugagauggcucagugguuaagagugccgacugcucuuccgaagguccugaguucaaaucccagcaaccauaugguggcucccaaccaucuguaacaaaaucugaugcccucuucuggagugucugaagacagcuacaguguacuuacauauaauaaauaaauaaauaaauaaauaaauaaauaaauaaauaaaucuuuuaaaaaaagaaagaaaaaaacaaaacaaacaaacaaacaagguaucagaggguggaagcagacacagagaugguucgguggguaaaaguauuugcaccacgcuugaugacccgagcucugcccacaugguagaagaaacuuacuccugccaaguuguuuugacuuccacauguuugcuaggugcacaucuacacacacacacacacacacacacacacacacacacacacacacaauuuaaaauguaccaggguaugccggcucauguuuguaaucuaauccuggauuucagggugucugaggaugaggcgagaggaucacaaguucaagaccaguuugagcugcaugggagauacugucccaaaacagaagaugggaacauuugagagaugcagggaguggcuguuagggcaccuggaguuauuaccccuuuuuuuuuucuucugagacagggucucacuauuuauauuacuaaauguccuggaacucacuguauagacaagcuagccuccaacucacagagauccucuugcuucugagcacugagauuaaaaguaugugucacuacaccuggucagaauuucuaaaaaccaaaucaaacagcaaauaggacaguagaacagcccuggaaacagaagucugaguuguuggugaaccaugaagaggaugagagaaagaaguaauggaugugagcugucacugucucacaggcugaccuagaccuggggcuuuagcugacaaguuggcauagggcccaucuuuucauagacaaagucagagaucuggaguguugauccagcagaacuuagagacgagccagcacaaggacaguccuugaaagucacccacuuuacuucucugggguccaggauugauugugauggaauaauaacagggaagaauagccagaguacaucaagaucagaauaaucaguuaauguguaccuggugugcaauaaacaggagguaacucagccagacuggcaacagagagagggagggagggcuggguugggucacauggggccuuguuggccccacaaauguuucugugagccaagaauuccugcucucugcugccucuggaagagguggggugugggucuccugagccuggaguguuggggcuauuuccacuacagcuauuuggggagagcuagcugcagcuuggguuauuuauaggucauuuggggucauucuuucucuagagauggcaguguuuguucaguaccaugcccuuagccucucccacaaacugacuacuaagaaucugcuccagagauguucuucuagacugucacaagaguggcacagaggaacucggggaguuaagaagagaaaaaggugaagggcuggagagaucaggguugcaaagauaggguugccuucaaggaaggugugguagggcuaaggguucaguggucgaguagauagagcacucuccaugugugagcacugaguuuaauccaaguaccaaauacauacauacauacauacacacacacacacacacacacacgcaugcacacacacacacauacacacacacacacacacacacagaaaaauaaaccgggcuggugagauggcucaguggguaagagcacccgacuucugacucccucuucuggagugucugaagacagcuacaguguacuuacauauaauaauaaauaaaucuuuaaaaaaaaaaaaagaaaaaaagaaaaauaaaccuuaugcacucccaaaugcguagaucagaaaauauuccaaauggaaaaaaagagaaaacauaagcaaagacuuaaaggaguucuucaaguuugcuagguccaacuugcaugugacacguuugggaaggugcauugcauagcaggagcagggauguggaaagugggccacaucauauuuuuaaugagcagaugcuaggcacugaaccaagucucauguaggcuaagcucacauuguaccacugagauaugaucccagccaggucacaaacuucuuaugccagggaauuugguuauuaucuuuuggucaaugaaaaauaguauauguaaacuucagaagcuguccugagccucccucuuuuugcaagauuaggguuggguuuugguaacuguauacugaggaaacagggaagccaguggccugauaguuuguccuucuacaguacauuauaguaaguuauuuguuuguuuguuuguuuguuuguuuguuuauuuauuuauuuauaauaggauuugacacucuuaggacucgcucuguagacuaggcuagcauugaacucacagagauccaccugccucugccucucaagugcugggacuaaggcaugcaccuucauugcccgccuacauuauaguaagcuuuaagagacaggauuucuguuuuauuugcagaaggauuucuguuuuauucgcagaaguaucuuugauucuuaagaccaugcuuagugcugggcagugguggcacaugccuuuaaucccagcacuugggaggcagaggcaggcagauuucugaguucgaggccagccuggucuacaaagugaguuccaggacagccagggcuauaaagagaaacccugucucgaaaaacaaaaaacaaaacaaaacaaaaaaacaaaacagaaagucaacgguggcaccccuuuaaucccaguacucaggaggcaaagguagguggaucucugugaguucuaggccagccuggucuacagggcaguucuagaacugccagggguauacagagacccuuauuugcgggugugggugugggugugggugugggugugggugggggaaccuuaaaaaaaaugugcuuuagaaauucagcacuugugaaguggaggcuggagaagcaaggucauccucagauacguaccaaguucuaggccaaccugggcucuaccaaaaaauaaaauacaggagucugaguccaaaaucaugguuuugucuggucaugguggcucguaccuuuaacccuaucaccccagaggcaaacagaucucuguaagccauccuagucugcacuuuuaguucuaggccagccaagggcuacauagugagacuguccugacaaacacacacgaaaacaagagguaauagccacgugugaguucuggccuucuucagcugcuaagggcauuucugcccauauugauccggugcgcacuguggggaaugugaaaguuccucguccauuuccucacacugcccuggaugagaagaaagcuguguauuuuccucaagucacccccuauaagcauggcugaccagaguuuauugccuaccuucagcuuuuccacugggaagaugguagucucccauaacuguccugugaaccugcuucuugugugcuacaaaaaggagaagagagauucuggaccaucacucggccuuaagcacacauuuguuguuacuguuggaucaaaugaugaccguuauauacugauguucuaucccuuugcuuguggaguagguugcuuacagaaacauuuagauuaaaaaacaaaaaaacaggggcuggugagauggcuuaguggguaagaacacccgacuguucuuccaaagguccggaguucaaaucccagcaaccacaugguggcucacaaccacccguaacgagaucugacacccucuucuggugugucugaagacagcuacaguguacuuacauauaaucaauaaauaaaucuuuaaaaaaaaaaaaacaaaaaacaaaauaaaaaacuuguuugaagccugaagugaaaccuaaggcagucacucacucagaauccagaauuaucuucucacuuggccuuuuuuuggaggugggggagaugggguguauuaggguucucuagagcaaugauucucaaccugugggucaugacuuuggcaaaauauuuacauuacaauucauaauaguagcaaaauuaguuaugaaguagcaauaaaaauaauuuugugguugggagucaccacaacacgaggaacuguacuaaaggguugcagcauuaggaagguugagaacacggguuugaagaacaaaacuuauagaaugaauagauuuauuagaauaguuuauaggcugugguccaguuaguccaacaauggcugucuaccaucagaaggggcaagaauaccguaguuguucagucugaugucucagcugaucgucuaucuaugccagaauaucaaaguaggcucuaaugccagugagggcguggcaugucagugagaguacaagcaagcaggcagagaggaagcaucuuccuucuauguccuguauauaggcugccagcagagggcgugacacagauuagaggugggucuucccaccucaaagaucuggauuaaagugggacuucccaccugaaauaauuuaggaaaaaaaaaaaaaaucugucacaggcguucccagccaccuguguuuuaguuaauugcagacauaguugacaaccaagacuaaccauggcacagacucucaguguguaccccagcuggccuggaacugcugccuccccagggcugguuaaaggaucacagcuaaccucaccccauuuugaccuugggaucaggcuaagugugugguucaccaauaaacaggacaagcuauucuuguagggagacaugaguguuaacucuggcuggcugaucccuccuucuaagcuaccuucuuugcuuugggaacccuagaacugccugauaaagagagaugaaaacgguuacucugcugugguagcugacuucggccuggcugagaagaucccugacgcuaggugaguaacccuaauggacaccaagcccacaggcaguggucagaacuaaggcagaaucaggaccuggccacggcucagguucacuccuugaauugacuccuccaagucuauacccauccuugggagcaacaaaaccccagcgaucaaaagauccguguaucuuguuauaguagggcauaguggcacacaccuguaaucccacugcucucugacuguauggacagacaugguggcacacucuaaucccagugcuuucaaggcagaggcagacggaucccugcaaauuugagccuaguaggggcuuuaugagccugugucucagcaacaaagacuuaaaaaagggcuggggacacagcccaguuaauauagugcuugcucaccucgaaugcacaaaucccaacaccagaacucugaagggagaagcuggaggaucaauagcuagaagucauccuccauuauauacaguuuaggcuaugugaaaccuugguuuuauuuuguuaauucccauugcaccaggcacuggcaaaguuucuuuccuucacaguauagggagggagaagcuagcuguggugggcucgccuuucuggauggcaccugagguucuccgagaugagccuuauaaugagaagguaaguauuagagauuagccuuuguggcccagguaaggaucugagucauucaugcuagcaucuggcaguuacccgguggaugacuugaauagaauaugggaaacacggccuagaccuaggcuguuaaagagaugugggugaggcagggaagguaucccacuccucacuccacugagggaaacugagcucugacuacuuaaccaggcagaugucuucucuuaugguaucauccucugcgagaucaucgcccgcauucaggcugauccggacuaucuuccccgcacagaggugagcugcuggcauggaacgaacacuacggggauggguuggcuugacgauggaacuguuuuacccuugggguggagugcuggaacuacuccauuucugaggcagcucccagcuucuaaguguguguauaauuuaugacuuuccuguuugugucccuuguacacuuuuccaccuuauucauccacagaauuucgggcuggauuacgaugcuuuccagaacauggugggagacugccccucagacuuccugcagcucaccuuuaacugcuguaaugugagugucuuucuucaccuggcuuuggucaggugcuggcugaguccuuuucauuugguuagcauguagggaaaggcuacacauuugccucauaaggggcaugccaucauuucccccagauguguaacaccaaccauauuccuacucugaucuguacaggcucuccagagagcccuggaccaaagacagaaaaaaaggcuguuuuuuauuuuucaguccucagccugcagguuaaacuccauagcucuccuugagugcugaccaagcuuugucagguuuuauuuguuggaguccuaauacuagagaaaacuuuaguuacccaaucugaaucuucaaagaugccagaaacagacucacacuucaucuuuggggugagaagugaacuauagggcucauggcugguauggaugccugcagauggaccccaaacugcgcccauccuuugaggagauugggaagacccuaaaggaaauuaugagccgcuuaccggaagaagaguuggagagagauaggaagcuacagcccacagcuaaagguaagagaucagaucagaaccccaaacuugaccccaaagggagggaagagacugugagacauuuccucuagggaaggcuggguucagaaggaggagggcaguggucaugggcaguaaaguacuaggcucucauacaggggugacuugucacacugcuuccccguuugcucccucguugaugaaauggacaagaaaaguauguaauaaaauacugcuuauauugccugagaguaacccaggcuugcuguucuuuaggaccacuggagaaagugccuggagggaagcgacugaguucacuggaugacaagauuccccacaagucuccacguccaagacguacuaucuggcugucucgaagccagucagauauuuuuucucauaagcccccacguacagucagugucuuggaccccuauuaccagccacgagauggugcuacacauaccccaaaagucaacccuuucagugcacgccaagaccucaagggcgggaaggucaaauucuuugaccuacccagcaaaucugucauuucccuuguauuugaccuggaugcaccggggccuggaaguacaacucuggcugacugucaggagccuuuggccaugucuuccagacgguggcggucuuugccugguucaccugaguucuugcaucaggcuuguccauuuaugggcugugaagaaucacucucugaugggccuccaccacgacucaguagucucaaguacggaguaagagagaucccaccauuccggacaucugcccuaucagcugcuucaggccacgaggccauggacugcucuaacccccaagaagagaacgguuuuggacccaggcuuaaggggaccagccuaugcacuggggcugccucugaggagauggagguggaagaggaaaggccacgaagagcuucugucuacuucucuaucucuggaauaagcuugcaaacccaggcaaagcaggaugggugagaugggggcaggacuagucccugccugccauaugagaggcguuucaguaguuagggccaaccuaauuuuaagccucugaaauccagcaaggagguuugguucccauggaccacagugcacguccuagacaggaccaaaaaacucuucgugcuaggcugggcuggcagguaccauguaccagucccuuuccuacucuuaagucucucaugccgauucuggggcauguaagcuacaggauggaaacuggaguuggcaggaggccgcuaggguguggcuguuucuuagacaugacgacugggaugccucuugccagugugucucagacacuugaauaauugcgguuugcacuuacuguaugucagaccacaucacuacaucucuaugcaagggggacaaggcaaugugguggucaaggaucuuuuagcuaaccuagucaaagacuuuuccaguugauuaaucuauuuucauauuuauaaaggagucuuaauguuuugccucaagacuuucaaccuuggcguugggaguggggcugguauuguaggcccuagggccugcucuauguaugugucaacaggugauacaacccuuuaguuaaugguuuauacuuggacugauuuucuuuccuccuguagcuggagcuuugggaacagucuguucuuaaagagccgcgauaagaaauaaccaaagaaugaaguuggucaaauauuuucauauuucuguugauuuuuuuuuuaaacuuuucccaaaacacuuucagauuaaaaaaauaauaaaguugauguugcaggugcuaguuagccuuauuuguacccaggccucugagucugcaaaagaagacaguacugaaguagucaguguuugccaggaccugcucgacaacucuguagcaguuaaaugugacauaauuagauuaaagacucaaaugacuuauuuuugaaauaugauuuugcuguauagcucugggugacuugggacuauguagaccaugaacuuguaacaguccuccugccuuagcccuuagguuccuggaaugaccaacacaagccacuacacucugccaaacaucucuucuccuacucuucgcuucuuucccugggccuaguuaccaggcagauguuggagucagcugcugccccaagccagcuucauuuucugguugugggcuuuggauggacgggaaaacuggcucuuggucacugugagggguacaguuuugccacuuagauauaccuuguugugacauucaggaagccaagguucagagcugcagaguugaagucccuggcucaggcccacauaggccaucacauagccugucauaaaggcgucaaaaccagcacgaugcaguccguccccaggcacgggguuagugcuggcuugguucaccagcagcucugagguggccacaucagcuguuucagcacuuguccuccuaugugccaucuccaagcuacuugugugaccuucccuggagccaggcugauccccagccucaccuucugccacuuuuuguuccauuuucucagucucgaggcuaucuucacagaccuguuuugugggaggaccaucuucagcuuccgcaagggucugugucccugguuggcucuguaaagaccucuuccguuuguccuuacgucgccgucuccgccgcuuaucuucugccacagccucaucagugucaauuauaaggucaauaucgugugacugaggacacuguggucccagaggacaccagccauaggccuggagguuggaaaaguguaagaaggggcuccauacaucagagccuucccuccccaagaaauggacauuuacucaccgagaacuugucacagaugccagugguacgagaacgacggcaggucccaggggacauacagcagcgguagucaaugugcccgcucaugcuagauggauagcugcagaauuccagggcaagaugugggcugccagcugcccgcugcuucccauucucccgcucacugcaacagcgcaagaagguauugcuucacuagcauauaaguuccaccagaacaggggggguuguguuuuguucacugcugaaucuucagcaccuaaaaacagugccuggcauaugguagguacuagauaaauaagugaaugaaacaggcucaugccaggccccaccccuucccaucaaccauguucucaccauuuccggaaagcguauucuaaguaggaagcuacaaaucgggcauggaacucggcggcauauuuggugucauagaugccugcugggaacaucucacacaggucagcagugaagguccccaaguucucaggcaggugcgcguagaaauucugguacaggaacaccaagucuauaaggccauuauguagcaccaggggccgucgggcccgaaucaguucaaggaacagcguccguaccgacuggcucuggcucucaucucccuagguggaaggggaaggacaacgaugcccagucagcacccagucagcacacuuaaccagguuucccacuggggaagcaccgccucauuaucuaaccccgcccugccccuuccacaaaggucuuguuucucgagccuugucacacacaugucccccaccccccaccccccaggccuaugcaagcaagaaauaaaccacacgggacucgaacucaaggccagaggaagcuggagagcuaccuugucauugcccuuaugguaggggauacccugggcguacugccgguugaaguugaagccaugcuguaccaggaacugcacagacuucgguucuauaacguacuccucuaugcauagcagggugagauugaacacuugagccaaguaagaauuuucacccugaaaaacaugaggaucuacuuuaccaaaaacugggaggaaaaauuuccaccauuaagaucucaacucucaggccccaugccucccucagaccugggaugaagguaauuccuaccuuaucugguugcugccugaagcaggcgaggcccagggacaggacagaacggguccuggcagcaugacacacggccuuguaacguuccucaaugcaccuuagaguuggguuugggcaugaguuaguuucacaaagaacccaaacuaccagggcuggcagucccuagcuucuggguugagaccuacauauuuguuagagcugggaucacaggcaaggcuuauacuuacugguucagcaaacucuuccuauccccgagcccacucagcuccuauggguggguaaaggaagugugguuauuuuccacacccaucaccaaacacuucacagccaccugcccucccuuccucccacuccucaccguguccacagccacaaagcuagcugucuuuaaggcuagcaagagugauggccauaucuccuugaaguugucacucugcacgucuaccacaggaacccgaaccacaaacuccucugcagguuguguguuuuuguugacaccaccuggggauaagggcguugauggauuuagaugguuucacaaggucccuguggagcaaacaccaagcuagaugugggcaaaggggugcccacugacaagcuuucacuuaaagauuuuacaucuaccagcucuaaacacaagcucugaaaugggcagugcccuaaauuuggaaaaagggcaucugugucuuuuagugccuuuaugugggacugggaaaucauuucuuuuuugcaucaugaucaggagaaaaguggacuagauaaccuuugaggauucuuuauccuccagccuguaaucccaggacuagggagcauuaggcugaaggaccacgaguucaaggcuagccuacagagcaugcuccuaucucaaacacaaaccgaucccauaaagccacauauacaugaugccucaacagcuaccggagugcuccaaaguuaaacccaagcuccacuuacuguggacgacuacgcacucugguauuaccgacugacaaccaccggcuccguccaaaacacaccacccaucccaccucacugcuccacucuacaacaguucggguuuugcaguugcacgcgcugcacacugggaguuguagucuaagauagcugaggcaagaagaacuacaggccugucuccgagcuaccgggccgaggcuuuucccuccccaggaccccuuaggcuucuguggccaucccuggggagccgcucaccgucagagggcguuggaacuggaggcacaucaucgucacuguccgcggccaugacgccccucgccagccuucuggagguacgcagagacuuccgcuucgucuccagaagcgacacggaucuaggauggggcggggucucggcgucugggucccguagggucaacuuccguuccg

SEQ ID NO: 2055 - RNA, 1806 nt, Mus musculus
gugugguugccuuacgaccggauuccuuuauugauauuaccuagacauuuuagggguucuugcuguucuaaaucccaucucagauacuguuugggaugaagaucacaccugacccugagggaacuagagccuuucuaucuggguguaguucuguggaggugugguccagcuccugcuggcgugugucaguuccaacaggcaaggagcaccaaggacaaguggcaacucccaggccuagccuggguuaggcucccugggcccuggcugcuuccucuugcaccgacugccauagugcccugauguuguucuggccaaagccuguggcccccugucucugaaucagcuccaggaagaaagugucuucggcgaagagggacuuggugaagaccugaagcaaaaauucgucuuuaucaccauccagcaggauucccugccguucuagaaggccaggcuugugcccugcggcuagaauuuguucuucuuugccgggcugcugguaauaagcuucaggaggagucagaagccggcaucccgccuucgccauucccucagaagcaucuaugauguuaggaguguacaguccuacgugcugcaggccuggccccccaugccggguuagaaauugcucuaccugguccuguuugcuguugagucccgguagggacuccgccagcacgaggguggggacaguauuauucggcggagucugcaaggcaguaagccguagucccccucgcccagacccugcagccaccuugaggcccaucuccggauccucaccugggcucagcggcaagugaugaaagccuaggcagucguggaaccagcgcauaagcauaggggagcugccggaggugcaggccaaggucaagugguccacguggcugacccaaccugggccaggugugcaaggcagaggucugaacccgggcaggaaggauccgcgauagccagcacgcugcagcaacguaaggcuuagauuaccagccggagagcugagcacuguguagguggcugugcccugugcaucucucacccuagugggugguaccggcaugaugcagccgcgagccgccagcgcgcgggcggcgccguccacauccuccacgucgaagcacagguucguggcacugggcaccgaaugaugcggguccaggcuguacaguggcuccuggggcccgguacccucauucacuagaaagacagcguccccgcugcgcagggccagcugucuccagccgccugcuucccucaccgccaggggcuggaagccgaagacacgauguaggucccucgcuaggggcugcccagcugguacauggaaagcgaugugacacaggcgacgggcgggcgcagucauggcgagcccaauugccggccacccggaucuguucuucugggaccgcucacuuguuuagaacuccaagacucuugguccaggacuaguaguuggaagccggcggaguccugguguauccgaagaucguguuucuuggucuuuucugggcagaggucgcgaagucaaacuuugggggacugacccucucggcagggccaccucaaccagaagccggcugaggaccacaggcucugcaggguaaauuguaugagaaccacgcggacgcugugcggggcggaccaggaggucaggguggagccugagacuccgccuuugacacucccuccgguccagaaccugucucccggaguacaguggggacgaagggcaguuccuucacagggccuuggaccaggucacacccuugggcaacuagccaccccuuccggggcccgggaaguaacaau

SEQ ID NO: 2056 - RNA, 4451 nt, Mus musculus
ugcugguaccgccuuuaauuccagcacuugagaggcagguagguggaucuuugugaguuugaggucgugugugugugugugugugugugugugugugugugugugugugugugugugugugagagagagagagagagagagagagagagagagagagagagagagaaacgggggggggcugggcaggaaaggagggggcuucagaaagaacugaggaucaggacauaagccuuuacaaaagaacaugcuagacuccaacucuggaaguuuuauucuccuggaaacaaucucuguugguggcacuugagcagaaaggcauguacucaauucugucgaagcaggcgugaauguuuguguacagcauccacaaaggcuccuacacguucuggguccaugucaggguaaagcccaugcccuagguuggcaauguagcguugaggcccaaagucauccagcauuugcugcaccagccgaccgaucucuuccuagagaaccaagaggguacugucuacaggagaggccagcaaagcugcauccucccuccacacacaugcacaggagugcuucuacacagugugacugucauuaacaacguaucagacuccucauaugucccaaacauuaagaaaauagaaguggggagccugugaggugacucagcaggucaggugcuugcuaugcaaccucugaugaccuccguucaaucacuaggacccguacaaagguagaagaagaaaacugacuccacaaaguuguccuagaccuccucauaugcaccauagauacagacccaacacacaauaauaaaaaauaaauauuuccaaaaaauacaaaugagagcugggugugaugggguauauccauaauccuagcacuuuaggggagagaggcaggaaccucaaguuccuggccaaccucagcaauacagugagguugaggcuaaccugggcuacaugagacucugucucaaaacagggaggcaggguuaggaacuuaacucagugguagaaagccugcccagcaagcaagcacaagguucuggguuggguccuuagcuucaaggaguguccgugggugggacagacaaauggacagccacaaaaauaaaauuuaaauuguaaaaauguccugcuuucuuagaguuuacauuguguguacagaacugaggaaaggagagacagguacaauaaaccauacacaugugauucccaacuauugcacaguacacagagaaaacuuuguacacuuauguuggacccaauuauuaccucagaugcauacaaggcacagggauccagguuccccugcagggucacugccuucccgacacguucccuggaagcagagccauugccacagucucgcugcauuauuuggggauuuuaccuccuccaccucagccucuccugcccacuccucugucacucaccgggcuuucuuuggagccacuguccagucaaguccaacuaccucauagccagccugggccagcucuuccagggcaaaauguccauccuuagcaaagaugaucuggagagaaagagcagaucgcugaugcuaagccuuucucgggugcacuuuugcugcccuccaguggugauuucaguuuaugcaggcugagugcugcaaccuucacuccaccugucccaguccucaccaugggcacuggugccaggccugccuucugcaacccagccuucacucgcuuggccacaucacgaauguagggcagugcaaacuugcugaagagcucggugccaagauguccugcgugggacucaaagagcugcaaugccuauaaacaggugacaagaaaaacacacaaagaggaaguaccucaggcuccauagacacaugauaucuuaauucuccucaggugacuuuaaacccugacacauucccugaggcacaacaaguuuugccuuaaaagaaaaaauagaaaccagcagcgguugugcacaccuuuaaucccagcacuugggaagcagagguagggggaccugugaguuugugaguuugaggccagccuagucuacagauugaguuucaggacaaccaaggauacacagaaagaaaagaaaaaagaaaagaaaagagaaaagagaaaaaagaaaagagagagaaagaaagagagaggggcaggcaguggugcacaugauuuuaacccgagcacuggggaggcagaaacaggugaaucaaaaauaauaauaacaauaaaguuuuaccuucuccagacccucagaccuuaaagcccugcugacagucucaggaagggcuaagaaucuacaugguucucaaccugugggucacaaccccuucuggguggaaugacccucucucaggggucgcauaucagaucuccuguauaccagauauuuacauuacaauuuacaacaguaggaaaaguacagcuaugaauuagcaacaaaaucauuuuauaguugggggucaccacaccaugaggaacuguauuaaagggucacaguauuaggaagguugaaaaccacuuagauacucuaaccagaucauuggaggaaaaguaacaucccugcuuucuccaguuugggaaaccauuuaccuauuugucccuaaagacucaccugagcaccagcagccacuuguccuauuagguaugggaccagaacaucagugaguaugccaagcagcuugugacuggccuguggccuuugguagagccaucguuuggccugagccauggugcuugaacugccgccuucaaccauguaugucauuaggguccacuacaaaaagaugaggacggcagacacaggaucccuugucuauuccagaccuaggagccugaccucuccaugcucccauccacaccccuggccgcauuaccggagcaccagcaaagccaauuaguggcacacguccggccagccguugucgaguaagggugauggcuuggaacacauagccuaacucugaagccgcugcugcuggaucccguagacgcucuaagucccgcucuucucuuaauggcucuggaaagcuggguccuuugccagguaccauggucaccuccaugcccaaugccuuaagggggauaaaauauauggguacacagccuggaacucagagguuucuguucaacguaugcaacaaagaaaagacuaaaaccuccugcaaacuccaucccuagcguuugccgcuuccccguuauguauuuaaaccugacaagacagaggauuuccaaugagugccuuccucccucuccccucuuuuuuuaaaguccacaauccaggaucaggauugaguaccugggguacaacaaggaugucagagaaaauuauggcagcauccagaggaaaccuucguaguggcugcagggaauagcaaguagguuaguaaggagacacacugggggcaugaaccccacccugguucguggggcccucaccuguagagucaguucacagcaagccucgggagaucggcaggugcugaagaaguccugggcagcccugguuucccuaaacucuacaaggggagauggaggacaggacucagccacaaggucuuccaaaguuacuaucuucuccuaucuucaccaucuagaauuucagguuuuaucuagaccacagcuuugccccugaccugguaaguagcggccugccugucucaugcaccaaacgggaguauagucuguuuccucuccccaggcugcucucaggaacgugucauucuucagcuccgggaaauucuggagucuggagaucaggugaaagguacagguaggaguaaaugucauuaugcuagacugggauucggggagggcaccgguccagucaggccguuaucugccuacuccagaccagcuugcaaaccauggcuccccgcccaccgccuccccucuaucaaguggcgcacaagcucccaggaggagggccccacuagggccucuuuccuacacauuuguccacuuucccaaacucaaagaaacuggagggacuagagaaguggaaugaagauccaguaaggggauuaggggaaaggaguuaauuuggggaaccgagcggcaagcaugagaagcugggauccccaaaacgagaaaggaucaaagcugauggucccaggugcuaguuagaaguucugagucaccucgaaagaaagucucgggacgcagucccgcacgguagucccuggaauggagacugcgggaagaggggggggcagggagcgggaaagguucuguuccaugacugcaagauuuggaaucucagcgacuuggguucagacuuggagagcuccaauaaaaauaagaguuuaaggacauaucccugaauuggaagacucggaucagaaaguaacguagccacaagcgcgugcagcagaaaacucacccgaacccguucgccuccaugguaaacaguaacugagcggucuccgcuuuaaucugaggcuccgccccgacaccccaguccccg

SEQ ID NO: 2057 - RNA, 9988 nt, Mus musculus
uaagguagggugggagguggggccggguguggugggaagcucugcuugcuguccccuggcugcggccggccaggguuucccuggacgagucucacuucagcggcuucgcuauggccggcccuggccccggcgcggcgcuugaguccccgcggcagcuccugggucgcgugcgcuuccuggcggaggcggcgcggagccuccgggccgggcugccacugccugcggcgcuagcuuucgugccgcgggaagugcucuacaagcuguacaaggacccggcgggacccucgcgcgugcugcugcccgugugggaagcagagggccuggggcugcgugugggagccgugggcgcugccccgggcacaggcucuggaccccugcgcgccgcccgugacaguaucgagcuccggcgcggcgccugugugcgcaccacuggcgaggagcugugcaacggccacgggcucugggugaaguugaccaaggugcgccccggauggcagggaccccacaaaagacccccuggaucuagccagagcccugguuguuccgcccccuuaucccauaaugagcuggcauugcuuuccgugcucuuugccccgggcugggcugggcgagcaauugaguugauuucuguccccaucugacucgucccugcaggagcagcuggccgaacaccugagugacuguagucuggacgaaggcuggcuucuagugugucgaccagcagagggcggagcccgccuuguaccuauugacacucccgaccaccugcagcggcagcagcagcuauuuggcguggacuaccggccggugcucagguccugcaacucaaaggacgcuauuuggugucuggcggaugcggaggguuucgaaacacaaccaaaaucuaaaccuuggguugugugagagagagagauuuggguggaggugggguaagaacuggcagagaugagaccugaagggggaugaggcuucuaggcuuggagcuagaacuccaaggcuccagauccugaaggugguguccuguuuccccguaccucccuccucauuuacuccacucugugccuacagaugggaacagguaguggaccugaccuauucacaucgccugggauccaggccucagccagcagaggcauauacagaagcuauacaaaggcuacugugaguuaucuggaacggggugggagaggagggagcagggccugaauccaaccuaauuaggggcuuggggcuauuuagcuaugugcccccaacauggacauaugagugcgacgaggaccugauccacuucuuauaugaccaccugggcaaagaagaugagaaccuggguagugugaagcaguauguggagagcauagauguuucuuccuauacgguggguacuggacuccuccugugccuagauacagucacaucccucaaugcuagguccagaacucccaucaccaaacuagggccaaacccauguccccauagaccauacuuagucccacuacccuuggaaccccucuaaggaccccagacacccuuccuaucccacacccacuccaacucugcuguuucuguucccugacccaacacacaugcccagugugacagcaccucucugcccuuaccuuaggaggaguucaauguguccugccugacagauagcaacgcagauaccuacugggagagugaugggucccagugccaacacuggguacggcuuaccaugaagaaaggcacaauugucaagugagugggcucugggcaugacaggguggaugagccaugugcugcgggugccuagagacucauucagauacauacucuggguccucaggaagcugcuacucacaguggauaccacagaugacaacuucaugccgaaacggguaguagucuaugggggugaaggggacaaccugaagaagcugagugacgugaacauugaugagugaguaagcuguccugggggcgggggcgggaccaagcuuagcuugaauggaaccccagagguuccugaaggccuguggcagcaaauaccugaacugcuuuauacuuggcuccuaggacccugaucggggaugucuguguauuagaggacaugaccguccaccuuccaaucauugagauccgaaucguugagugucgagguagggcucaggacuauaaggaguuucaggauaugggugagggcaggcugauaauguggagaggagagaagagaguggacuuggaguuaggguaaagcuucgugucuuagucgggguuuuuauuccugcacaaacaucauaaccaaaaagcaaguuggggcaccaggcgugguggcacacgccuuuaaucccagcacuugggaggcagaggcaggcagauuucugaguucgaggccagccuggucuacaaagugaguuccaggacagcuaaggauauacagagaaacccugucucgaaaaaccaaaaaaaaaaaaaaaaaaaaaagcaaguuggggaggaaaggguuuauucggcuuacauauucacaauacuguucaucaccaaaggaagucaggacuggaacucaagcaggucagaaaucaggagcugauguagaagccauggaaggauguucuuugcuggcuugcuuccccuggcuugcucagccugcucucuuauagaacccaagacuagcagcccagagaugcaccacucacaaggggaccuccccccuugaucacuaauugagaaaaugccuuacaguuggaucucguggaggcauuuccccaacugaagcuccuuuuucugugauaacuccaacccgugucaaguugacacaaaacuagccaauacacuucgagaccaaagauaguauacagugcuggguauaagccaaccuuagagccguagaggugguugggcucaucugaaaggagcugaguugggauccacaggcaucccagcagcauagagauggaaugaauauauugaauugugauagaaucucugaagccuccguaguuaacagugacaaaaugcccacugcugggagccauucccaggucugagggccaagaaaacagcaggcucaguaaagggccauauccugacuccccccauccacagaugaugggaucgauguccgucuucgagggguaaagaucaagucaucuagacagcgggagcuggggcugaaugcagaccuguuccagccggccagucuggugcgauauccacgccuggaaggcacugacccagaaguacuauaccgcagagcuguccuucugcagagguagguaugguccugacccugcaggccucccuuccucgccuaagccuugggaaucugcauggaggaggccccaaagucugguaaaauaaguuauucugcuucgagggccagagcaccuccugagccucccuucugucccuguggauuagacacuggggucuuacaccaugccaaauucuuuaucuuaccacacuaccauagauucaucaaaauucuggacaguguccugcaccaccuaguaccugcaugggaccacacccugggcaccuuuagugagauuaaggugagucugggccugcaauacuuacggggcauugggcugcuugccuaguuuucauuauuauuauuuuuuuuuuuuuuagauuuacuuaauuauuuuauuuauaugagcacacuguagcugucuucagacauaccagaagagggcaucggaucccauuacagaugguugugagccaccaugugguugcugggaauugaacucaggaccucugaaagagcagucagugcucuaaaccacugagccaucuccccaccuccuugguucuuuuuuuuugggggggggggcggggaggacugccagggcuauacagagaaacccugucucgaaaaaccaaaaaaaaagaagaagaggaggaggaaaaguaacuccuccguuaggugggcagcugugcccugaggguccccgagcuccacaugacaaaggaacccauacagcuagcugugagugugacgugaggcuagaaacuggcugacgggaagcacagucucuucucaagagauuuguguagcaggcugugaaguagggauuuuucucuggucaguggaagucucagaaagcuugugagaauguuagauuuguauuguuguuccaaauuuccccuucaugguuaguuuaaaggaaaaacuauaggcaagaacagaacggacuagacauagacugcaaugggggaguugggucuaggcguagaaagucccagagccuacacguaagccgauugcccacucauuccgcccuggccaccuuuccuccagcaagugaaacaguuccuacuguugucacgccagcggcccagccugguagcacagugccugcgugauucagaaagcagcaagcccagcuucaugccgaggcuguacaucaaccgccgccuugccauggaacaccgugccugcccuucucgggacccugccugcaagaaugcagucuucacccaggucuggaccagacugagggagggucaguaaagggcggaaggaagagagaguugggcaagaauagggacagcucuuuaucgcaggcuuccuacagcucccacuccuucccaccuucucuugcuccccagguuuaugaaggucucaagccuucugacaaguaugagaagcccuuggacuacagguauggcgugaggguaaaagauggcacacagugccugcugcuucucgcugccacacucugugguccuucuccuagcuggucucugggccugcuaaugugccugaggccagcccuggcauaguggaaauccaucaucccuguuuacagguggcccaugcgcuaugaccaguggugggaauguaaauucauugcggaagggaucauugaccaaggugaggccuugacauggguuccgacuauugacuauuaggguguuagagccucgggacucugaggugcccagcugagagcauuugucauuucaggagguggcuuccgugacagccuggcagauaugucagaagaacugugccccagcucagcugacaccccugugccucugcccuucuuugugcgcacagcgaaccagguuaauugucuucccacccaccaccaaauuucugccauuuccgcaaaccucuagaaagccugguagagcuggagggggcagggagggaauugccugaggcggccucugcacccagggagaggaguggagaggaauguccaccaugguugggugggauaguagauuucugauaaggucugugugauacucuagguaggaaaauagggucuaccacaugcccugcuaacagcucugucucuggggcagggcaauggcacuggugaggcccgggacauguaugugccaaaucccucuugccgagacuuugccaaguaugaguggauuggacaguugaugggggcugcccuucgggguaaggaguuccuggugaguaacccaguugucacccugucagcugagcccaggucccgcaaaggaaaggccaguagaccuggucaguucaguaagaagacagcgguguuugucacgcagguccuggcccugccuggguuuguguggaagcagcugucuggagaggaagugagcuggagcaaggacuucccagcuguggacuccgugcuggugaguagggcuccgacccaccgcuccccaguaccugugugacucccggggcuucaacugauagcuuuguucugguaacuccuaaaauccuuaccuccagcccucacuucuuuccuuaaccuggguccacacaugcauuaauucaagauggcacuguugagccuugcacucugcagacucuucaccuuauccccaggccacugcccucucaggcuucaggcucagagccacgcucuaucugccuuugccguaguuaucagggucuuuaucuggguuuguauuuguucuuuuuuuuuuuuuuuuuuuuuuugccuuuuguaaaaaagcauauuuguguguguguguguguguguguguaagagaaagaaagagagacagagacgguagguguaugcacuauggcgcacguuuggaggucugaggacagcuuuugggaauugauuauccccaugcagauccagggcuuugaacucagggcaucaucgggguugguggcaaguguuuuuaugcacugaaccaucaugccagcccuguuuugcuucuugcaguagggucucacauagacuaggauauguagcugaagaugaccuugaauccugaucuucaugcucuaccuccugcguacuggcaaugcacgcacaugcagccaugcuuagggucacucuuaacucuaauccccagcauccuguccagccucucccuggacuuagugcacgucucccucccgucucaugcuguccuccugguucaggccaucuucccucuguucugaccauguauuauaaaagcuccugucccugccucuauucuuauccaccucaugcugccaggguaauucaucucacucauuuaaaucauucgaugccucugcucugggcucaggauggagcgaacccugugaaggccuuuaauggcuccugugucucagccauuugacucauacucgggcccuagcaagacauucuuuaagccuuuggauuuuucaucuuuguccaagauguucugucucccaacuucccuugcggccaagccagugucuggcugucguuugggugccacguccugcaggugcccucccuaggcuccagggcuggcugcugcuuucccagcucuuuccuggccucugcacuccccguuaccgauggggagaggcugcugccccgguggaaagcugaccgacagcccugccucuccccaacuccaggugaagcuccuggaagugauggaaggaguggacaaggagacguuugaguucaaguuugggaaggagcugacauucaccaccguccugagugaccaacaggucguggagcugauuccugggggcacgggcaucgugguggaauaugaggaucgcucccguuucauccagcuggugcggaaggcgcggcuagaggagagcaaggagcagguaggagaacaggagcagcaggcccuucccuugacgccagagcccacugguaggcgaccaauauccacccugaugcuggcuuccaugacugcaccccauuccugcuggucagugaguacagagaugccccaguguacgcugaaaguaguguccaacuuucccaggcaggcuucuuccuccucccuagguggcagccaugcaggcaggucugcugaaggugguaccacaggcugugcuggacuugcugaccuggcaagaguuggaaaagaagguguguggggacccagaggucacuguggaugcucugcgcaagcucagugaguucuaggcgauagggcagugaagccgaaggggcggggcuuaaggacuagcccagugagagcuaagcaugaacuccugccuuggccccuccagcucgguuugaggacuucgaaccaucugacacacgcgugcaguacuuuugggaggcucugaacaauuucaccaauggucaguagagggcagagugcugcuugccuugccuugggacguggcuuguggauugaagaggcgggcgggaauuuauagagcuuccuucaucagugcaagccuuaauuuucuucuccacccagaggaccggagccguuuccugcgcuuugucaccggccgcagccgccucccugcucggaucuacauuuacccagacaaacuggggugaguaugaguacagagaggggcagaaggugccccccacacacacaugcacgcauacgcgucacuccacaacucauaauccuuugcccuucccaccuugcagcuaugagaccacagacgcccugccugagucuucuaccugcuccagcacgcucuuccucccacacuaugccaggugagucucccgaggugggagggugguuggcagggaagggcacccugggagcagcagagaugcuggacagaccaccuuccucccucuguagugccaagguaugcgaggagaagcuccgcuacgccgcguacaacuguguggccaucgacacggacaugagucccugggaggagugaggccgugcccuaagcguguacgcugcccucacccacaccagcccgguuugggucucaacagaggugauggguucagaaaugucagcacagugggcccuguaccugaguauggucuggucgcagugggaggcgugaauugacacagacgcuccaguccccacagacccacgaacccuacugugcuggggcuugcuucccuagguauuuagccuuggugagagggaaucguccacaagcccagcacacgcugccaggccugagcuacuugaagggggcaaucuagcuccccaaacaauggacuauguuuugguuucccccauuccucuuuuuuucuagcuucagccauggcucaaaauguuuaaaaacugguagaaugguacuuugagcaaggggccaaugacagaguaaggucauccuccuuggucacgggucccuaagaaagaagccccaguugagacccaucccuugcauacuagccuucuucuuuccauagcagaggugugugagcuuuguucuuccagaggcuuggcauggacauccgcucaauacccaggcuuuaccagcagccaaacuacugucuucuggaucauauccagcccaacuccauugcuccuucacccccaagaguucacagcugagggaccuucuguccucucugaaauuucagugguugcuguuuccacacucuaaaauaaggccuagacguuaaacuuccucuaaggguggugcacacccuuccauuacccucaagagccuccauggcacuccuguaggacgucuuacauuggggaaauugaauaaauggagaaauucauuuuuuuagaaugugcuuuugggaucccugcuaaacucauggcacuccuagaaaaucgcuguguccuagaaggagcuccggggcugccacccuacugauagcaggggaugugcgccugaugggagaggugggcuucacagugacacaguggggcaucuguagcacagccugggaaugagagcucagaccagaggacagaaggcugggcuuuugagaugauugugggauucagagucuggaagcucaccuccagcagcaagugagcagaaugacggcacauggagggugaagcugggguagcugaugagcacccggauccugauacacuugggagcaccugucugcccccaaaugccacauaucuaagguccagagacucuagcccugucuuaccccaaguacuuccacccugaagcucaaugcacuagacgccaucuugguguccugguacaguguaaacagucaguuacccaucaaagcagacugagcccuaaaaaucuuuccuaaugugucgucuucagcucacggugccauugagaaagccucuucacauggcugugugcacgcccagaccuaucuuucccacacacugagccuccuggggcagccccauccgcccaugugcuuugggggacccacaggagacaaacaugaacacccucccucccagggagccccagcaccugcacacacacccaccaaacucugcuucucagaaagcuccccuggcucuguuggggaaggagugcuuccauagugucugggaagggccuucccugcagaagcuguggggugcaguuugucucuaugcccccacacaugcccuuaauaacucuuuuacaccauauuuuucaggcugcuuugcauuuacuuauucauuuagagaugaaguguggaguacagaugucaggcaccagcugcaaagcaccaaggcuaagucgguguuugcuccagagcacacacuccccacagaagcuugcuacaucuuucucauuaaguagcaguguagagcaagugucuucuuggugaugaauuauacuucuaaggggauccacugaaauauuuuauucucuauuaaaauuuuauuuuuaaaaucacgu

SEQ ID NO: 2058 - RNA, 67907 nt, Mus musculus
cgccugcgcucuuggcuugucagccagaggcggcguggggagcgcugggagaggcugcggcgugcggauagcugagguaaagccggggcuagugcggugccaggcggggcacgagcuggcugagcagggagagcggcgcgcggaugcuggaaagccggguuccugugagggaggccagcuagccgagcaggacccgaguaggcagacagggacugcgcucccgaaaucgccgggcgagacacugccggcccuggccguagagccaugcgucccgacugggggacuggagaguccaagccuugugcaacagauggaaaaacugaguuucagggagggacaguucugcccgaagucacaccgagugagcacuagacucccuuggugccuugcugacaugguuuccacauuauuuauucgucccacauuuauuugggcucaaggcagggacuaaaugggauacaguaaggcccuuuuaggcagcgcgcaaagguuuggcaaaccaauuacaaugcaguagccgaucuuacaauuuaggacagaagacggcaacugugaggaaggcaugacugggacucuguaaacgccuccuguaaaacuuggaggcuggugagacucaucgacuugguauugggagucacgacgguaaaguugaaacuuuuaagucuagccuuaugauugguuagguucauaaguauucuuguuucuuagguugcgucuuuuuuuuuuuuuuuccuccuuaacccagagauugagaacaggaacuuuagguucuagccaccuggguuccaaauguguucuuguacacauuugagcuuaacacuaaugugggguugcugugagguucacagaugcucauuccacauauaguaucuggcaucugacuggguguauccugacaacacauaguccccaacuucaaggaacucacucuuaauaggcauuuaaaugaaugccugcagugaagccuauaaagguugacacaguccguacagaguauaguagaagcagcaggugaaagaagucccaucauuggugugcaaaaaguuaguuguagcuucaugcuaugcaagaugauuucugagcagagucuuuuuaaagaguuuugcuacuugguuacuugucccaggagaaaaccagccuaaagcaggaguagccguagaccugcaguucuggcugcuaaggugguaagacugggaaucacuugagcccaggagguuaauucacacuuuauaaccagguauuggcacuagauucacaagcaucaauaugaugaccucuagaagugguucuagagucuggaaccaccagguugcauguacugaucuguagugagggucacaucuaggaaaggccaucacacuagcuaugacagcguaauaauaccuguccacuuaaaaaggaccuauagggggcuggagaggugccucagugauuaaaagcagcguauauucuuccaaaggaccuagguucaguucucggcaccuacaugauagcucagaaccaucuauaacuccacuuacaggggaucugacuccauaugugcacucaacacacacauaaaauuaaaaaaaaaauaaguauuuguuacaaaagaaaacccagaguuauagcacaguauauuuuaguugguauaguguguuuuccgugauccagcaucuguccaauaauaugaaacauguauauagugcgugugauaggaugaacguuacuuugcaugucuuauagagaaauacuuuuuuauucuuguguaggggauccagccuaaggccucauaaauaccagacaagugagcccucauuuaaucccaacagcuucaugaauguguggauguguauauuccuaaauacauaacuacagcugcucucucauaaucauguugauuauguguauuuccccaggacuggucauuugguauuggauaaucaauugauguucacuauuucacuugcucucagaauuucuuaguugccuguaguuuuuuuuuuugcuuaggguugaggccuuguaagcuuucccucccagacauuaacaugucaguugguguuauccuuguucaggucucguuuaggaagccauguuggugacacuuuauggcuguauagucucuggcauaucuaggagacacagaccauaucuagcaaaccuccugucccucugucuuuuuaaugaucacggagccuuggcugcgggacuuucuuacagguauuaguugggaccaggcuccacagcucuuuguuuugaucaguuguggucuucugugaugaucuaaaucuuuugcaaaggaccauuuccuuuaugaagggugagaacuacaauucuccagccagacccuaaagaagcuuguguuuuugagacagggucucacguguaguuuuggcugugcuggaauuaacucuguugagcagacuggccuugaacucauggagaugcgccugccucggccucccaagugcugggauuaaauaugccaccaccacuggcacuugaauuugucuguucuuaacuauaaacaacucaagggcgaggaccagaaguuuuaaauuuauauuaucugcuuuuacugagaucagagcuaaaacuguuggccagagaaggcgagaacaaucuuugcuaccgugagggaguguuucuuacucugguaacuaaaucagaaguggcacgucugguguaggugggaaguacucauguaaauagagacaaauaguacuguguaucauuugacuuaagccacucuuucucuuccugugcuugcagcuuuauaaaaauggaguuucaagcggugguuauggccguuggugggggaucucggaugacagacuugacuuccagcauucccaagccucugcuuccaguuggaaacaaaccuuuaauuugguacccgcugaaccugcuugagcguguuggauuugaaggugagcuguagcugugauaggaugcauucauaaaccuuuaguguguuugaucccaauaauuugucagcauuaugagagagaggguggacauagcaggcuagggcuuaaagcuugcuagagacuagauguugguccauggccacccaccugagagcacagccucccccagaggaacuuuuaucccaugcugcagcccaggcaggugccgggcuguaggggagugccaagaccacucugggggugagugggaagguggagcugguuccggggucacuggguucucugacucuuggacauccaagugccacugggagucaggggucugugggcuggggauagugucuagcccagggucaggcauaaggggagcucuggcuuguccuuagcuucucagaagcaggcuuuguggcguuguggcugggagcacagagaacccuucuacaggagaaguaagcuguggcucuguagucgaaugccuucuccauggcuccccacagcgggccuugaugaaagagacaguccaugauucuaaacaguuuauugguugugguggaaaaugguguacuguacccacgucucaggguggaccugagauuaaauaccuuuuguaggaggaaugucugggaagggaagcucauuggcuaagcccucugggccucuagguaccucauuagcauggagagcacuguuuugggccugugugacaaguuucuuuuuuuuucuuuuucgagacaggguuucucuguguagcccuggcuguccuggaacucacuuuguagaccaggcuggccucgaacucagaaauccgccugccucugccucccaagagugcugggauuaaaggcgugcacaaccaccgcccagcugugacaaguuucuuuuaugugaggagcauggcauguguucaggccagaagucuggcagggagcggggagucaccuaagccucgggugugugcccaccgagucuccgggccucaacaugcuguacuuuaccacacuuccuggcuugguuuuacauucuacaacuggacucuuaaguucggggccuaggaauacccuuuuguuaucugggggaaacaugagaccauagcgccaaacauugcuguuaaagaagggguucuccacagugauccaagaugggucuucuaaggguaucagaaaggugagauugggaaucuaaaugccugguugucagccugagaaucugugaugugcuggguaauguuuuaagcaugagagcaacagacugagaagacagcucaggcacugacuucuagaaccuuccuucaagucugguaggaagggguuuugucuacuuuucacuugggucacauuagauagaugaugaugccguuaaugggaaaagagauaugagucaggaacaggugugaaccaagauaaugagcucagcuuuggucauacugaguuugagguaucacuaacuagagugaaucagaaugcagcaaaucggggugcggauucuagggcccagacugccgcaagagggcucauccaacugugaggggguuucuuaguuuuauuuuauuuuaugagaaugaaaguuuugccugcauuuaugaauaugcaccaagugcaugccuggugcccacagaggucagaagagggugucagaucccuuagaauugaaauuacagaugguugugagcugccaugcugguaauugaaccccagucuucuguaagagaagcaagugcucuaaaccacuaagccaucucuccagcuccuaaguccuuaaaagaaaaaaaaucuuuuuccauauaaaauuuuuauuacauuuuauugauuuguaacguagguauauauggggguaauguaggcauggguaugcauauguaggucagagaacaacaaccuuugagaauugcuucuuuccuuauaucauguguguccuuuguuuuuuuuuuuuuuuguuguuguuguuuuuuccuucgagacaggguuucucuguguagcccuggcuguccuggaacucacucuguagaucaggcuggucucaaacucagaaaucugccugccucugccucccaaauguugggauuaaaggcaugcaccaccauugccgggcuguguggguccuuuuuaaguagcuuauuuuugaccaguggugguguaaacuuguaaucuuaccuacucaggaggcugagguaggagaaucauaaguucagugccagccuggaaaaccaaaagggucuuuauuucuagaagaauaguaaggugucuuccuuucccucaguaacuuuauggauuuguagucguaguccguaacucuccacuucuuacuguugacuuuaguucauauucagcaguagcguuuuguuguauauguaauaccuauuaugcauauaauucuuucuuacugaggcucacucagaauguguggggugcucccuaaauguagaauuuuuauuaauuaauuaguuaauuuuuugaaaaaauuuguguauaagaauauuucucaugcauguauauaagugcaauauguucacgccuguuguuuucagaggccagaggggcuuauuuuucuauguaugagugguuugccugaauguauauguguaccauaugcacuucugugcuggaggagguuugaagaggagcucggagccccuggaauugguguuagaguaucacuguguagugcugagaaccaaauccagguccucugcaagaauagccaaaugcuuuuuauuuuuccccucucucucuagacaacaugagacaggguuucucuguguaguccuggcuguccuacaacuuacucucuagaccaggcuggucucaaauucagauaucuccuaucugccucuugagugcugggauuaaaggccugugucacuauucgcugucugaguagcucugacagcugagccauccaucucuccagccucaaauuaauuauuacaguuuugguugguuuguauuuucaagacaaagucucucuauguagcagcucuuucugaucuagaacucaccaccguccaggcuggucuugaacucaagagauucaccucccgcugucuuccaagcaaugggauuaugucuacaauuccauucagcuuaaucaauucuuauuauuuucuuugacaaagcaugcauuuuauuaauuaauuaauuuauuuauuuuucuuguuuguuuguauuuuauaugcuuuuguguuugccugccuauauauuugcaugaagguguuggauccuggaguuauagaaaguuaugaacugccauuugguugcugggaauuggaaccuggguugucuggaagagcagucagugcuccuaacugcugagcaauugcuucggcccugauuaguuaauuuuuuaaaagauuucuuuauuuuguguuuaugaguacacucacuguuuucagacacacaaaaagugggcaucagaucccaguacagauacgguugugagcugccauguaguugcuuggacuugaauuuaggaccucuggaagagcagucuuaaccacugagcugucucuucagccucaauuaauuuuugagagagggcuuuaaacuuguguggcugaggaugccauuagccuuucauccuccuaccugugcuuccugaguucugggauuauagaugugugccaccgaucuaaauuuuaugcagugcugggcagagauaccauuuagugcauauagauacuaacugagcuauaucccuagcccuaaauguagauuuuuaagauuuaguauagacuuauuuauuuuguggguaccuaaguauguguguguauauguguaugcuguggcucauggaggucagaggacaacuuuuuggagucaguaguuccacuguaugagcucagaucauuggacucaagcgagcacucuuacauuucaccagccccugcuauuuauauguuauucaucuuuuauaaugacuaaacugggauccuuaaaccugcuaggucucuuuaguuuuuccccuuaaaaauaccaaaaacaauaagaacaggcucucacuaaagagccuguugcuaaagccagccuuggaccaauagucuucccaucucagcaucccaaacagcuggguuuacaggcccagaccacugccuggugaaaguuuggggagugauuuuuguuuguuuguuuuguucuuuugagacaaagucucucuguauagcucugacugaccucaaacucacuauauaaccuggcuggccuugaacucagagauuugcuuaccucucucugcccccugagugcugggauuaauguauauuggcguuugcuuucguguauguauaugcaccacauucacacaguaccugcagaaaccagaagagaguguuggagcccugaaacuguacaggaggcuguugguccuuacuugaaugcugggaaccaaacccaauuccucauaagagcaacaaaugcucuuaauggcugagccaucucuccauccccugagguccuuacuuucagaaugagauuguuauaagaauuaauugagagcaugaaucuacaacaaggugagagcuggcuuagaagacaaaagccaccuagcaaccucaguucaaucucuggaacccaaguuagguggaugaaaagaacaccacagaguaguccugaucuccacacauacauaagcaugcacacacgagugcguguacacacacauccuuuuuuuaaaaaaauguuuauguaucuuuuuuauuauuuacuuauuauuuauuauuuacuuuuuauuauuauuuuuuuuauuucuuauuuuuuugguuuuucgagacaggguuucucuguauagccuugccuuuuaaaaaauguaaugauaaggguggaggauaguuuugggagggguuggggguaaauaacaaaauauacacaugcacagaauucucaaaauuaauaaaguaauuuaaaacaguguucucuucagcagcacauauacuaaaauuggggugauagagagauuagcauggccccugcauagaguaacagauuugugaaacauuccauuuucuuucucucuccuuucugccuuccagcaccccugcauaaaggguuuuucuaauuggguugucuggugacuuuguuacuauuuuucugugaagcccagaccuuggaugugggagguaaaggagcauucaguuguucagggcacaccccucucaagccaccccagucugguuuuccuguaacucgggguagauuuuggucucucuuguucugcacagaaaaggaaaaggggaacagaagccugaagagaugcgacagauggacugcaacccaacugguuaggcuuuuaggagucauuuucuuuuuuuuuuuuuuuuuaagauuuauuuauuuauuuauuuauuuauuuauuuauuauauguaaguacacuguagcugucuucagacagcaccagaagagggcaucagaucucauuacaggugguugugagccaccaugugguugcugggauuugaacuucggaccuuuggaagagcagucgggugcucuuacccacugagccaucucaccagcccuaggagucauuuucuuuuucuuuuucuuuuuuuuuuuuaauuaauuaauuuauuuauuauaugugaguacacuguagcuguccucagauacuccagaagagggcaucagauuucauuacggaugguugugagccaccaugugguugcugggauuugaacucaggaccuuuggaagagcagucggcgcucuuaaccacugagccaucuugccagcccaggagucauuuucuuucuuccccgucugguacauuuaaaguuccccagcuaugagguggugccaguccuggacaaguacgacugggucacagaaugcucagaggaucugaaaaugaaauuuacuguugcccacugccagguuuuuauuuaaaaagaaaagaaggcucagucauauuagcauuuaucauuugugauucuauacgcuggcuuugaacuuguguguagacaaggauggccuugucccugauccucugucccccuuugggggcuggguuacaggcguguggcccacagcagagcccgucugacggggagauggaaauugucucagugaaugaauuucugcauuugucgauuaucucuuucauccuguagaagucaucgugguuacaaccaaagauguccaaaaggcucucugcgcagaauucaagaugaagaugaagcuagauauugugugcauuccugaugaggcagacauggggacugcagauucucuacgacacaucuauccaaagcuuaagguaaacagauuucuugacuuacuuuuauugaagauaacuaauaucuuauuugacagugcuuuguauguuacaaaaagcuuuuguugguuuuuagacaaggucucgcuauguagcguggcuagccuagaauuugccauguaaaucaggccggccaaagucucacagagaucugccuggucugccuccugaguagugggauuaaagguaugugcuaccauaccuggccuuaguuuuuguuuuuuaaagauuuauuuacuuguuuauucauuuauuuauuuaauguauaaguacacuguugcugucuucagacacaccagaagagggcaucagaacucauuauagaugguugugagccaccaugugguugcugagaauugaacucaggaucagcagucaguguccuuaaccacugagccaucucuuuagcccuggccuuaguuuuuaagacuuaaaaacuauauucuguguuuuguuuguuuugagagagucuucuguagcccaggccugucuugagcucuguguaugaggauggccuugaacacuugauucucuuaccucacgagcacugguguuacaggcguguaccaacagaccuaguuuaguauauuuuuauaucaaguucauuguuucccacuuacuuuuugacuguucuuugguuugauuaguaauaaagcuuuggaaauuuagucagcauaaucugcuuuccaaggaguaagacauccaucuuugagacacagccucaucuugaagcccauccuggacuggaauucuguggcccaggcuugccuugaaucuuugaugaccccucugucucagccuccugaaugcuugaauugaagauaugcaccuggccuaaaauaaaaucuguggccaggugguuguggcucaugacuuuaaugcagaggcauuuuaguggcggaggcagaucucugaguuagaggccagccuggucuacagagugaguucuaggacagccagggcuacgcagagaaacccugucucgaaaaaccaaaaaaagaaagaaagagagacagacagacagaaagagcgagcaaacgauuacuuuaaaauuuuucgugugcacgcauagcacaaguguuggguuagugcuguguccggagcuaccuuacugucuuaggagcuucugcuaccacacugcuugcugcaagcugacgggccucugauccuauaccuucuccugugcugggauuacuggcuuucuguguggguuccggggauuaaacccagguugggcuuuggaggcuagcauguuuacccgagucuccccagugcuguuugcuuuguuuugagaugaucucguuauguccagacuuuauucaaaguugcuauccugcugccucagccugcugaggggcugggcuauauccgggauuccucauuuucagagacacucagauuuccguguuuauuguuuuguucuccgucuuuccaaaaggagcauugucugacauguuagaugcuggcuauucuaucccauccuccuggagaccauccgucuccuccuagcuguaaccugggccugugcagaacugccuuccuuuauuucucugucuuuccucuguugccugcucuugugccuagauuucuuccaccguucaugguuuaugccccuauuuccgaggccuuacuuuccaguccuuacuggcuuuuuuuuuuuuuuuuuuuuuuuuuuagauuuuauuuauuuauuuauuuauuuauuuauuuauguaagcacacugucgcugucuucagacacuccagaagagggagucagauuucguuacggaugguugugagccaccaugugguugcugggauuugaacucuggaccuucagaagagcagucgggugcucuuacccacugagccaucucaccagccccccuuacuggcuuuuuaaagaaaauaaauaaaagaugaauguuuugagaauauccaugcuugaaaaugguuuauuucaccuuacucuugagugaugacuuagauuuuauagaauuuugagaguuuuguuugguuuugguuuugguuugguuugauuuuuuuugguguuuugagacaggguuucucuguauagcccuggcuguccuggaacucacucuguagaccaggcuggccuugaacucagaaaucugccugccucugccuccugagugcuggaauuaaaggcaugugccaccacacccggccugaguuauauuuuuuaaguuuuuuuuuuuuuuuaacacuacgcaccaacaaaacaagaaaaaggcuuccuugauauccccuccccuuccccacacucuacccuuuucucaggccucaguuauacuagggcuuauuauuccaaacucugccucauaacagcuucuaaccacaucugugauccagagugcuccuugaguaccucaguuaagacagccaagguuucaggggugguggugcuugcuuuuaguuccagcacuugggaggcaggagcaggcggaucucuugagguccaagucagucaggucuacagugugaguuccaggaucuccauuuuacagauaggaaagguaugucuuggaagcuugagugcuucccuuggagaguagggaguaagagagagcaugcauaggggucagagucucgcuugaugcauggaguaaccagagcaucagaaacauuaugucuucuagguacagccagguggcacaugacucaguggaaauugugauuuuauuugagaguuacaguaguggaguggguuagaauccuugagaaaguuaggugugcaccaggugcccucuagaggagcaucaagaagugcugccuguguuggcuucuuaaguuagggacacuuuccucuaauugagacuugcagaagagugggugucugugauguuagagaugugagaccagggaauuaucugcaccuuacccuaguuaaguaaacaccucccucaggauaaccuagacaucugaaaccuugacacauguuuguaucuguuggaaauuuaccaagagaauacauaucagcuaaagaccaaugcauuuuccuccaagaugauagccuaauuaagguuugauuucuuuucuucuucuuuuuccuuuucucuucuuuuaagacagggcucuggggcuggagagauggcucagugguuaagaguacugacugcucuuccagagguccugaguucaauucccagcaaccacaugguggcucacagccaucuguaauggggucugauggccucuacuggugugucuaucuagcccuggcugcccuggaacuccacguggagagcaagcuggcuucaaauuuguggugguccuccuuuuuugacaccaaagugcugggauuucagugcaccaccauaccuggcaaaguuuaauuaaaaaaagaaaggaaccaggcggugguggcacacaccuuuaauccuaucacuugggagguagaggcaggcggauuucugaguuugaggccagccuggucuacagagugaguuccaggacagccagggcuauacagagaaacccugucuugaacaaaaccaaaaaagaaaaaagaaaggaacaaacaacuauuucagggagaaggaacagcagguagaaaggagaagggugggaauuaaaaacaacaaagagccgggcgcgguggcgcacgccuuuaaucccagcacucgggaggcagaggcaggcggauuucugaguucgaggccagccuggucuacaaagugaguuccaggacagccagagcuauacagagaaacccugccucaaaaaaaaaaaaaaaaaaaaaaaaaaaaaaccaaauaaaaacaacaaaggccugcuuuaugauaacacugcuauuuccacagaucaaaugggaggagggaggguugaaaacaacagacgccuggguuguaguaacagcuaauuauucacacacuucuaccaggaaccugccugagcacuucugaggcuacuucaauuucauaguuucauauaguaaacuguaugucuaagaaagcaguuuacuacuuuguaaaugaaaugcccauucuuagagacugcucagaaguuggauuaauuuauuagcuacuuauggucaccuggagauaaaguuuauuuuccauaggguuaacuggaacauuuguucuaauagcucaagaaaaucuaguaguauaucuaaauuucuaaucuauacaacccaccuugaaagauagacaauaugaguuuccuuuacuguugagaaacuugacccucuauugagagagcuuaaauaauauauuccagagcuuagcugccuggguacucaucaaaagcuagacccuguccuagacagggguuugguuuugcuuuugguguuuuguuuuggguuuuguuguuuuuguuguuguugguuugguuugguuugauuuugguuuugguuuuucuagacacaagguuucucuguguagcccuggcucuccuagaacuuuuguagaccaggcuggucuugaacucacagagauccaccugccucugccucccaagugcuaaggucaaaggugugcaccagcuuugcuuuugguuuugaguuuugggacuuuugagacagagucuugccauuagcccagguuagccucugacucucaaccuuagccuccugggugcaauaccaugccuggcacuauuccugaguuuugauauacuuugauauacacuuauacccauuucuucuacuucccaaagugcaaguuucauuuaaaauuuugcagucuccuauaguauccaugaagaauccuugcccugcaagugugcugcucuuguuucuugagaucuuucucuucaaugaaggggagucuggucuugcaucccaacauucuguguagcugagggugacuuugaauuccucauccuucugccccuacuuccaaagugauggggucacagguguauguuagcauacucagcugggacuugaguauuguaggaagaauauuccaugucuaagggcauaugaaugagccgccuggcaaaauaguccagucugugcucagcacauuaaaacugagugacuccuugggcagugagccugaucugcuuuugaaccuuuugccuuuuggagguuauuggugcuguucuugcccuuuagaaaccacauuugguuauugcuuagauaguguucugagggcagacuagugaggucuauuuaaggggcuuaagaccagauccauaauagaacagccuguguuuuaagcacuuaccuuauauugcaggucucauuacuucucuuaauuuaaaaguggcagaauugguaauugucuauuuaaucuacacaggaauuuuucuguagccacaggcaaaucucauuuacccucugccucaguuuuacaauucagaaagcagugagaagggcauugacacacuaguuguuagaagucuaguuauuccaauccuuugauguaaaaggcgacuauuguuguauguuuugugaaacagcaaacaugcuacaacaaagaacagauuaugaugaaauccccuggagacagcuuauuagaaaaauugaauaaacauucuauuuuuagaugugcaaaagcuaaacguaaguuauuuucaguagaguguuugauguuuuuaucgaauuaugaaucucugucagucuuuccuggaaccuuucauuuugcccaagguuuuguuuugucagauuucuaucuguuugaaaacaguaaguauagcgugguaaggggagaucugagaaccugguccugacuugucugaagcugacuuguagugagugcuaacuucgcuucugaugacugcuuuggugggcugcaggauaaccugaugagcacuucuuugauacugcucuuagcaucgagaauguuccagguguuauggcagaaacagacugugguuuucaaagccuucuucuuccuguuguuuuuccuuuucuccuccucgauuugaggauccucagcagagcuuuucccuugcuguggucauuucauagaccacaaacuugaaauguuuccauccccuuaucucuccacugcugcuggguaggaauccugucuguggaguggggcugcuacaucccuguguuucauuugaugacccagaaaacuguaaagcuuuguuuucagcuugguacucuugaauauuucccuucccuagagggagccuuuuuguggagcaaagggcuguagaguaguggggaaugauaaaagcuaggaauuuugauagaaagcauauauugucaucauaaacuucauugguggcuaacaaccuuccuucuugacuuacaucuggaagcucuuguuaagaugaccuuuucuacuuugaaucaugagaugaaauuacagccuaacuaguaaaaggucuaguacuguuuggguaaaguuagugagcuuuuugucaccauggccuagguuguuagcuucucugaaggagccucuaccuauucagacucaucgcuugaguuugugcucucucucucacacucucucucucucccucucucccucccucccucccuccucucucucucucucucucucucucucucucucucucucucucucucucucucucucucucucuguuucucuaguacaagagaugaaaauuguccuaucgugggcuggggagguagcuuagccagugauaugccugcugggcaagcaugggagcccugguuuggaucccagcacccauguaagaagcccggcacagcacagcaacacagcaacuacaacuggaggggugaaucccugggacucauuguccaguuaaccuuucuacaucagugaguaccagguucaguaagagauagugugucaaaaauaagguggagacugauugggggagacaccugucauugacccugcacugacaccugcauacacccacaugugcauauacugaacacauagaguggagagggccuuauauuaucucuguuuaucagacuuuguuuuguugagacagaaucucucuauguagcccuggcuggcuguccuggaacuugcucuguagaccaggcuggcccugaacucacagagaucugccuuucucugccuugcuacaguguuuguauauuuuuguuguuuuggguuuucuuuguuuuguuuuguuuuguuuucauucagggugucucuguucagccuuggcuguccuggaaguugcucuauagaccaggcuggccuggaacucaagagauccaccugccucuccuucaugagugcugggauuaaagguguacaccuccacugcccagcuagguauauuuuauauauaaacaaaauuaguaguauagcugccguaaaaaaacaagcugaacuaauaguagcauguaaaguguagccauuggcuccaaacugaaaucugaccggaauggaucccuaaaaauauaugauuacucaggcaguugccaaggaguugagaggcagucuuuaaugaucuaacuugaguaguaguggucuuuuuaaucaugauuaacuggcuauagaucuuugugccuaaugauucauuugaaccucaccauguaucccaucuguaauccuggcuguccuggaacucuguguagauuagacuggucuggaauucacagaaauccaccugccucucugccucccuaguguugguauuaaaaguauaggccaucgagccagcuacauauacccccuuauccccucucuuccccccauuauguauuuuuaauuaauuaauuuuuauuuguguauauaagaauguguaucuauguguaugccacauguauacaaguaccuuuggaggccaaaagagggcaucagaucuccuggauaaggaguuaaaaacagguaguuaaugagcugaaauaagugccaagagccaaacucaggucaucuggauagacagcaagaacucuuuaacuauccuuccaucucugagugauucuuuaaauuggugugugcauguguguguguguguguguguguguguguguguguguguguguuuguguugucuguguauacuaauuuugaguuuagcuuauucucgauuuccuaagaccuugaaguccaucauuauguuacuuauuuaaguucuuucuggguuuuagugugguaguuuuuguuuuguuuuguuuguuuuuaagcuguaucuguuuaugugaggcuucugugcuugugguagcaugugugugcguguggaggucagagggccacaugaaggagcuggcucucuccaccccaagaguggcucccaagagucuuagacuugcaggcuugguggcagcacucuuaacuucuaagccaucuuguuuaccccauuucuguuuaaguacugauagcuauaaacuuagaauuaaguuuccauaaauuuagaaacugugguuucucuagcuauugauucuacuuuuaugauccaaauaaauugcaauaaauuacuucuaguuuuugugauuauuaaaauuugcuucaagccgggugugguggcgcacgccuuuaaucccagcacucgggaggcagaggcaggcgauuucugaguucgaggccagccuggucuacaaagugagcuccaggacagccagggcuacacagagaaacccugucucgaaaaaccaaaaaaaaaaaaaaaaaaaaagauccugaaggaguauucucuuuauuaauaugcagugacuuuuuguauauguaugccuggaucuguauacauauaucuguuugugcauaucuguauacauauauguguagaugcauguuugcaugugugggggcauaaguauguacgggugcuuuaguauuuacuuucagagcuuaaauauauuauuuugugcuuucuuagcuaaucaucaguauuauuguuguugcuuguuuguuuguuuuggugguuuuguuauaagauugacugauugauugauuguaugugaguacacuauaaccagucuuuagacaccagaagugggcaucagauccuauuacagauauuugugaacuacuaugugauugcugggaauugaacucagauccucuggaagagcaguccaugcucuucacugcugagccaucucuccagcccuuguuuuguuuuuugacacaaggucucauauguaggccaggcuggacucagacucacagagauccaccugccucucccucucgugccuggauuaaagacaugcaccacauggccagcaaaguauaaauuauaaugauuuuguugagcuucacuuuaaaguuguuugucuagcauguccaucuccaucucugcccugcaggacagcuguauagaauuucuuuccuuucagaaaucucuguuuuuuuaaccuguuugaaggcaacagauuuugucuuacugcuucagagccugcccuguggccucuagagcugcugucccguggguagugcguucucacugugucagaguguguacagccucaaaucaucucaaaauggguaguguagccuuccagcaccaaacaaggagagggguagcaggagagcaaugauuacuauugcuugucuccuacacuagguugaagacugaagaaacaaagauuagagcuuauggaaucuuggauuugauuauggaaacuuauaaaguaucauuuaaccccuagcuuuauacccugugagucacaaccucauugagggucacauaacugaaggaagaguuuaugaaagaguugacagcaguaagagauuuuuaagugcauaaugggcaaauuuuaauuucaaagcaaaaggguaacaaauccaaaguguuucugauggugcuuacuguugcuugcgcuggcuaguuuuauugcggccuuguuucugaacacacaucaugcucacuucacacucugcacacuguuacaccacacagaccauccugugucacgaacugugguguuuuaguuuucugcuccuguggaaacauagucaacuucauugauacugucuaacugucaggggccuggaagaagacccaagcugacaagccugacaccuugaguuugaucccugggacccacaugggggacggagaaaaaugauucccacaaguuguccucugacacccauuuucacagcacagcauauaucgcauuccauaauaaaauaaauaaauauaaauauaaauauaaauuuuuaaaaaaucaguccacugaguaauguggaggauguucuaugaugucagauuuucagccaggauuuaguuguuuaccaaaaaauaaauaugcacauacaggucauuaguaugaaaauuugcauaaacuuagugauaauaaauucaacuuuuuauuuuuuagagaucacuguuuuauggaaucuuuaagcaaagaauuaaauaugagaaaaauguggcuggagagaugguucauuggucaugagcacauacugcucugucagaggacuugugucugauguccagcacccacauggcagcucacagccaucuguaacuccaguuguagggaaucugaugccucuucugcccgagaugggacaggcacacugguagacaaaccaugaacaugaaaaagguuuuaaauaaauaugagauuagaagucgaaagacuagaauggcuauuuucagaaauugagauguuuagagucugagacugaaaaauguucauuaaugaagcaguaugauguuuuuauaugugcauuuauuaagguaauuuuuauuuuaaagauccuuaaagacagggcugaagagauggcucaggguuaagagcacugacugcucuuccagagguccuguguucaauucccagcaaccacaugauagcucacaaccaucugcaaugggaucugaugcccccuucuggugugucugaagagagcgacaguguacucauauauauaaauaaaucuuuuuuaaaaaaaaguccuuaaagacuaggaaaagauucugggaucuggacuagguagugcaacagaaauaaggaggaaguccccaguggguguuggaaguggacugugggugggagagggaaacuuucaguccuccauucccacaagcuucugauuucaggccuggauaguagucuugguauggcugagcuaagggacacaugaagaguauuuagcuuugggccuaaagauuaucuguuguguuguuguuguuguuuguuuguuuguuuguuuguuuguuuguuuuuugagacaagaucucuuuauguagcuuaauggcuucagagucacagggauccaccugccucugccuccuggguucugggauugaagaugugcaccaacacacccagcagccauuccuccugcacccaccaccucagucucagugaaaguaaacuggaagcuggcagcccuuuuccuacuggggacuacagacugggaauuuuuucccuaagcauuuucauccaaaacuaaaccagugaagucuccauuauaguuaacuguggagcuuguaaaagcuuacagauacuuucagagauuggauugaguuggaccacauaggaaaauguaaauugugacuguuucuagucacaccaaguagcaauucauuaguuccagaugggcagggauggaguggggagugguguuuuggaucguagccauuguuuguggaagugauggguggguaaaagcgugguauuuuauuaggcccuggcaguuuuuucccggggagcuaugguuuuuuuuuuuuuuuuuccuugauguaggaaaucguuugccagauuguauuauuuaucacaaucugccgcggaacagcugccagaagacaaagcuguuccaguagcuuggcucuccucccuccaucaccaccacgcagacaagcauccgguuuucuauugaacuuuggggguuuuuccccccuaguuuuccuucaugguuuuggcuugauuaaaaauguucuuguaaugagauauuucugggcuugcuguggcaguguaauugaguuuucugagcuuaauuuguuugcuuuagucaacacuaacuggcagcaguuuguaguuugaaauccugggugucuugaauucuuccuaaauucuaaagugcuguuuucccuuggagacuguguguguuugaauacugucaacaaggcacacauuuauuaucuuuccaagcugugccucucacccuuauacuuaccccagccucuuuagaugcaggcuuauaaugagaugugaagacuguugggauagugaguaggugugucuuuggagacucagguuaguuuccgcauaagaagcuguuaguguuagacaacacuguugaaggcuaguauguucagauauugcauucuggaucaauguuaauucacaguccagacaacccauguuaauuuaugacucguaagucacacauaaucaauaguacuucucaggcucauuagaguuuacaguuuguuucucuuagacuuuuuucuucuaggauuuccagcuuuuugauggucagcaaaucucuccucugcaagugguggaacagcugcuaggaggagaaugcuuggcuugcuuugaaucuuaccugucucugagacagucagucuguccugcuuuucagacuggggccuuucuuuuccuacagagaacagauggcaaacagacaugaagggaggaggauuguuccuuguuguccuuugggauuuuguauucaugaagugugacaaaacuuccugaggagacacaacacaugucuacucaccucagauagggagcccacgacagaccaaaguauggauaccaccaaauuccaaguuggugagccagugaguuuaauuuuuauuaacuccugaguuuacuaacgagaauaugggugagggguuguuuacaaagaaugauucaaagauaucaccaaagcucagcccagcaugggugacagcccaugagagcuggagaaucuggagcauacugcacagccuggacacaacacagcuugacagguuggagaguagccuuucuaauucacucuggucuacaccucuuccaggcagcaguuggcgguugcagcuuucauucucuuagagccuuccugauagcucagcuucccuugucugagacggacucucagcuuuuacuguuuacucuggcaaggagaggcuuagugaaucuggucugcuuggaggucgggguaaggaacacacuugacacaccaacagcuuuaaagagaaguaaaggaggacuguugcauaacaguucaguggggggaaagggccauccacaggcaaagagaaacgagccacuggccugcucccaauuaugcaagacuugcuugcuugguguucacagugaugacagauuuaaauacuucugcagauauugaauggggucagcauuuauuucccaagacaacuuugucaccacuucagggacaucugcauuggacuaauuuucuuuacuuugagguacacuugauucaauuaaucauuaaauagucaacuuagaaaagcaauuaucuuauuaaagcaaccuaggaaauaaaagauuuuccccccucaaccagcuguccucauuaugaugaaguggagcagcucugugcuauuguacugaaaaaucacaugccaaacagacuuuuuccuucuugguuuguguagaugcugucucauuuccuuuuuuuguuguuugguuuuuguuuuuugagacaggguuucucuuuauagcccuggcuguccuggaacucacuuuauagauuaggcuggccucgaacucagaaauccaccugccucugccucccgagugcugggauuaaaggcgugugccaccacgcccagcuguuuuguuuuguuuuguuuuuuguuuuuacaaaaagaaaauaguuauagaaaacacuuuuugguuuuauagcugguuuauuuaaauugaaguuuaagaauuuguuuucuagucaguuggcauuagacuucugucuucucuguuaugccaaaaccuaaagguagaaugcuuaggcaaaaauuucuuaaaauauauuaaguagccuugauugacuagucacauuuaaacuucuagucccaguuuucuccaggcugcuuaauaggaucuggcaaagcacagagaacaggauuaacaauauuagacaaguaaauuguugcagaggauaauccaguuuucacuggagcaccucuaucuaauacagaaacucaacaacaacaaaaagcugccugugguguugcaugccuuuaaucccaguacuggggaagcagaauaucugugaauucgagguuagccuggucuacagagcaaguucuaagacagccugagcuauguaaagagacacugucucaaaaaagggauguggguucauuuccuuauaaaguugcucuugauuguuuuguguguauaacacaggguaaccuugaguuccuaauccaucugccucagccuccugaguuuuuaauuauaggcuucugcuacuauacccaacacaaaauuaccucuuuuugagugcaauauuagaaacugaacgagugacuuugugcauccuggguaagcacuauuaacugagcuaugucccaagcccccauccguaguuuuuauuggaauuaauuauuggguggucaucagaaauccuacccuuaugagaaaaauauuuucuucagugauucauucauuuaaucauucauucauuguccaguugagacaguaaaaaggaugauuuauuauacaagagucucacuuggccacaagugagaacagaacuaguccagacugccacagguccaggcuuagggucaguggcacuguugugguuguaaagaagacaguuggucuccggagcagguggggauguucagauuuguugagacuucuccccagcagcggcacacagccgucccagccucuaccccgugccuccgcugcuccagccucugcgggcacacaggcuaauuccuugcaccucugccucaucuuucucucuuguguuugugcauuugauucucuuccacucugcucucacagcgcgggagcuucaagggaggcacacuaaggccgagaggcucuugagugauuuauucagucaucauuucuuguuuaguuuggagguagagauuaaauguagaauuuuacaugcuaaguacuuguaaugccacugaacuacauccccaggaccucauuuaucaguuauuaaaugcugaguguauacuagucacugauugcaagaauaggccucacucuucuuacccauaaaaauagcaacaauaauguuuguguaugacauugcuguaauauuaaauggguacuuuguauaugcuucagauuguaauuguucauuaccuaaaaugugaauuaccaaagaaugagacauauuauuaguuaauacuuuagcaaaauauuuuuuuaauuuagauuuauuuuuauuuuauguaugugaguagugcgugugugugcgugugcgugugcgugugcgugugugugugugugagugugugugugagugccuggugucuguuaaggucagaagagguaucagauccucuguaaugcagccaugugaguauugguuaccaaauucaggucugcaaagugcaguaaguguucuuaacuguugagccaucuuuccugccccugauugguuuuauaaagaauuuuuuuccaaagucauagaaauagugugauggguuuccaaacuguccuuaaaggucuggugucagaagugucucaggacugcccauuaagauucacaagggggcagccgagauuucauauccugcccuagcacaauuccauuaggacaacccuauuuauuuuauuuuuuuguuuguuuguuuuguuuuguuuucuguucaaaagagauuugaaaauacuguaugguuugcauauuuuuaaguuaugaugugcuugucuuugauguugacucuuugugucugugagugugugugagugugugucugugugugugagugugucugugagugugugucugugugugagugugcgagugagugugugugugugagugucuguguaugugugugagugagugaaugagugauacuuacuuuucugucuucauuugacagaccgaugugcugguccugagcugcgaucugauaacagauguggcuuuacaugagguuguggaccuguucagagcuuaugaugcgucacuggccaugcuaaugaggaaaggacaagagagcauagaaccaguuccaggucaaaaggggaaaaaaaaaccagguaagguaauuacaguuuguugauuugauaauaauuauuauugucauucauccuuucauaugaguauuuggcaccugcuucucaauaucugucagaaaucagcccuaggacacguggauccaagcacacaugcauuuccaugcauaccaaaccugugguacuuaucccuauauauauaaauugguauauauaauucugccugucucgauacauagccuuuguguguucuagaacuugauaugcagaccaggauguucucagacccacagaacagccaguguucuuaacugcugagccauuauuccagcccaucuguaguuuuaauauggugcugggcccuugcacacauugcauauacucuuaucacuaagcacaaccugaccuuuacuuucuuuuuagauuuaguuuucuucuuuaucagaacuuuuuuuguuuuguuuuguuuuucugagacaggguuucucuguguagcccuggcuauccuggaacucacuuuguagaccaggcugcccucgaacucaugaaaucugucuaccucugccucugggauuaaaggcgugugccaccacgcccggcuuaucagaacuuuuuaauucaagaaguuauauaauuauccaaacuaugguagaguaaggaacaguccuccuccuccuaugacagccauguagcuaaugguuuuggcauuuaguucaguguguccauguagcuguuguuucuucacuuaggaauugucuguuaaucaacagcuacucaggaacuuaaagguguagcucuguuaccauucccucugcucaaaccccauauagcuuccucauuauaauaaucucauuauuaacuagauauuugaugauuacacuacuaugacuauauguaguauucacagccaagucuugcacauuuuuuuuaagauuuauuuauucauuauauguaaguacacuguagcugucuucagacacuccagaagagggagucagaucucauuacggaugguugugagccacuaugugguugcugggauuugaacucuggaccuuuggaagagcagucggguacucuuacccacugagccaucucaccagccccacauuuuucuuuccugcucuucuuuuccuaaauacugacuuguuuuauugcaucuguuuuccuuguauguauugcagcaguugugugaauauacucuuaacuacauuuuagcauauuagauaaugcuucaauucaaauuaucuucuuuuuuuuuuauugagacagucucacuauguagcccuggcuggccuggaacucuauguagaacaggcuguccucuuacagagauccaccuaccugugcuucccaagugcuaccauguugggucuuuguuuuguuuuugauguagcuaagaaucaacccccagacccaauuuauuaaauuguccaaagucuuuuuggcacaucucaagucaggaaauauaacaaacccuugccacuuagaccuacauauucccccccccccccaccccacaggguuucucuguauaucccuggcuguccuggaacucacucuguagaccaggcuggccucgaacucacagagauccgccugccucugccuuccaagugcugggauuaaaggcaugugccaccacugccuggcagacuuaccuauucuuauuagucaugaguuggauauuuuuaguaucuccaaaaggaaugaaaauccucucucucacucccucccccucccucucccucucucucucucucuuucucuccccccccccccucaccuccuggaacucagucuguucucccagacugcucuugaacucagagaucugucugcuuuugccucuucaguguuggaauuaaaggcaggugccaccaccauccagcuaacuggcucuucauuuuugcaaauuauuugucacugcugcagcccuguuuugaguuucugucuuugucucugucucucucaaguuuuaaaaaauuauuauugugccaggugauguguggcccaugccuuuagucuuagcauucaggagacagaggcagccagaucucugugaguuccaggucaacuggucucuauagagagucccaggacagccagggcuagguaaagagaccuugugucaaaaaaaggaaaaaaaaaaaaaaaaaagaaaagaaaacaaacucuuugaaaucccuuauuuggauuauuggugucuagugccugcaguaaacuguccugacaucucauaucccaggauuuuacauuaauguuaaccuuucagagcucuugucuuuuguuuguguuuucuuuuuguuuugguuuuugagagacuaugcccagcuucuuguguuuucugaaucuuuuguugaucuggguauucuguguuggggugucguuauaaauaguaugggcuguggccuuaaacucaaggaauugugccuuggccucccggguggaaggauuacaaggauacaccaucaugccagcccugaagggucuuuuccucaugaacaucauugcuugacuugaugcuaugggcuaguccacguagguuuugccuguguguaugucuguacacuaugugcaugcuuggucccuugcacagagagcagaggacagcuucaggucccuugggacuagaguuacaggcgguugguagccucuauguggaugaugagaacagaagcaggguccucuucaagagcagccagugcucuuuacuucugagccauuucuucagcuccauccagccuuacucagaugucacuguugagcuuuggaacagagagggacuccguggcugcuuucaugccugugguuucaguguuucugguggcuccaccucuuuucuuuacuucugcuucacuuccuuccaaggcuuuuacucuuuugauuaauuucuacuuugcuucaauuaguuaguuaauuaauuaauuaaugaggcagagauccgccugccugugcuuugccuuguucccuacuuuaccucucugucgcugguagucucugcucuuggccccuaccuccucuugcuguguucuucagacuuagaauugcuuaguauguuuuccuuuucuaaggagccucaagcauugcuucaauaucagaucugccauugucuauagauucaaagcccaggugcucucucucuccauugcaccauaggagccuucaucuaccaucuucucuaauggccuguucaggcuuucaggugccugguucuaauauucuggaagaggcugugguguugcugugaccacagcuaucauucuuaacucagaggccaccauccaucccaggacugagaaagauaucugggugcucagcuucgagagcugggcuucuccuugauuuaguucaucauccaggagccugaccgugacuuguuugcaaacagcagguucugugagaguggaaacagaagcuacaaaugucucugcagcauuagugucagcuauccuccuuuagucagagcuaguuacugccuugcaguaguggcucaugccuuuaaucuuagcauuugagaggcagagucaaggggaucacuugaguuccaggccagccuggucuagagagaguuccaggacaaccaggguuacacaaagaaacccugucuuaaacagucugccauggcuguccuggaacucacucuguagaccaggcuggccucaaacucacagugguccaccugccuuagccucccaagugccgggaucaaaggugugcaccaccagcaccuggcuagucugguuuuuaaguaggguuuucuguuguuuuguuguuguuguuuuucgagacaggguuucucuguguagcuggccucaaacucagaaauccgccugccucugccucccaacugcugggauuaaaggugugugucaccacuguccugcuugaguuuucuguuguuugggacaggguuaguguguuuugcuggcugcccuggaacucacuguguagguagggcuggccuugaaguugcuguagcccccuacccugucuccauacagacauuauuacuugucugugccauugcuccuacucguauaauuuugauuuguuuuuaauuuguauagcuuguuugugucuguauaaugaguaaauauuuauccuaucgucugguuuuggcaucaggaucaugcuaacuucauaaaauggguuagaauuuugaacgcccaaguguaacacuuuuuauggaguaggaguacaguuuuacucuuggaaugaauaaaaacuguagaaaagauagaaacgucaaucagagaaguaaaaaucaaguaggaauauuugaaugugacauaauuuuugagaaaucaaaguucacagucuuauuuguuuucucggccuuguuugugcagucuugcuucauggguagacauucugguuacccguucugcucccaaguggaauucacuucgauaaagcaagacagaaaagaagccucuccaagagccuguaaucuuuagucagaguuuccaguuacuguggcaacaauaaagaaacaauacagggaggaaggccauguagcaacagagccaaaaauugccuggcuggaaauuauugcucucaggacauucaagugauucaagguuuuugugagccuaagaacugauauguuaaacacuccaaguuagauccagaacucuauuaaguugauagcucauaauuagacagucacaaacuuuucuacagucucaaauugucauguaauggaugaauuaauauauuucagagcugugugugugccauuuggaguucucuucagaauuuagcuucaaauugaccauauuugcuuuuccuauggauuucacuaauuuugauuuuuggaaagaacuguauaauuuuucccucguucagauucaaacacugcauaugaugaaauggccagcuaccaugugauugauggucucaagugcuucaaccaccagagcuaaauguuacacaacuaacacuuuuuuguagauaaacaaacagcuacagcuaacagugaagcauaccagguaugguaguaugcagcuguaaucccaucucuccagaggcugagacaggacagucaugaguucaaguccagccucgguuauauauugaguuauguauguguaugucaguuacuugcacacauguacuuguguaaaggccagaaguuaacaucaugugucuuccccugcccauccccccuuuaaggcaugguccucacuguaccugaaccugcuauuucugcuagacugggaucucuuugucuuugccuccacacccagugcaggagguagagacacacaugcuaccuuccccaguuuuuauguggauacugaggauugauccaaacucaaguccucgugcuugcauaaaagcacuugauccauugagcauaagaguaagaauuuguuuuauuuuuuuuucaagagauuuuuuuuuuaauaugaguacacugcagcugucuucagacacaccagacgagggcaucggauuccauuacagaugguugugagccaccaucucaggaccucuggaagagcagucccuuaaccgcugagccaucucuccagcccuucauuuuuuuuuuuaaagauugauugauugauugauugauugauuacauguaaguacacuguagcugucuucagacacuccagaagagggagucagaucucauuacgggugguugugaaccaccaugugguugcugggauuugaacuucggaccuucggaaaagcagucaggugcucuuacccacugagccaucucaccagcccuagcccuucauuuuuuaacuuaaauuuuuguuuguuugggguguuuuuuuuuuccuccaagacagggucucacuguguagcucuggcuauccuggaauuuauucuagacuaggcuggucuugaacucaccugccucuaccuccaaagugcuggcauuaaaggugugugucuauggcaacuuaaauauuuuaauagcuuggucgauaauacuauuauaaauucuuuacauauguuaacucauauaaucauaacaaaccuauguauuaacgacuauuaguccuauuuaacugaagaauagaggguuuaauuaauguacauauaaagauauuuauuuaugauuauaaauauauaaaauauaugagauucauaccucauggacuaccuuuagaagcccagcucuuaauuguuauacucuguuucuucugcgucuacaugucuuuagauauacacgcugaccagguggcaguggcgcacaccuuugaucccagcgcuuagaggcagaaucaggugaaucucugaguuugagaccagccuggacggucuauagaacaaguuccaggacagucagggcuacacagagaaacccugucucaaaaaacaaaaacaaaacaaaacaaaaaccaaacaccgccaggugugauggcgcacgccuuuaaucccagcacuggggaggcagaggcaggcagauuucugaguuggaggccagccuggucuacagagugaguuccaggacagccagggcuacacagagaaacccuguuucgaaaaacaaaauaacaaaacaaaacaaaacaaaaccaaaaauaccaccaaaagacacacacacacaaaaaaagaaauacacacuguauagaugcuaacgugaauauuugugaugugugugcaugcgugcguuaucuguguuccuguguuuuugcaccugcauuucguggccagaggucaauguuagaccucuuccacaaucacuccaccuuguguuuuagacagaaucuuuguugagccugcggcucugugauucagcuagaggagcuggccagccagccccagagagccuccuguuucugcuucuccagcucuggggucacaagugcacaccaucuucccaagauugcuagggaucaaacucagauccucauaugcaccaagcacacgacucuccagccaagaagcacauauuauuaaguuuccaacaaugugcuagaguuauaggaaauagaaagcaauaauaaauugagcuuugagguauuuauauugugauggagggggggaaugcaccguaucauauaaauaauuucauagugaauauguaguuaguuaaucuugauugacuacggauaaucuuaaauaauagaauuccuacuuucacagagaacagaccuauagcuuauuaugaccuagauuauuuggaaagagagaauuccuugcuguacuuucugugagaugcaguagacagauaagucaucugcuuuuuuaacuggauuguaucuugacugucccacuuuuggaccucccuucgcugcugucccucaaacugaaguccucaugugugcuagacaaguauucuaucaccgaguaccccaaccucuuucauuucuuaggcugaccuugacuuugaagucuuuuaaguuuuucagauaccagaauuagaggcaugagucaucaugccuaccucuuaacuuuuuguuuuugaaauaauuucauguuuaugaagugguuuaaaauauagcaguuugccagaauagugcaaagaacuuauauauccuuuaucuagauuuuccaauuuuuaacauuugcguuuucucucucucucucucauauaaaacuguauuauuugggaacaacuugaaaauaaguugugacugagugcacucuuuuuuuguuuguuuguuugguuuuuuaagacaggguuucucuguauaccccuggcugucccuggaacucacucuauagaccaggcuggccucaaacucagaaauccaccugccucugccucugccucugccucugccucugccucugccucugccucccgagugcugggauuaaagaugagcgccaccaccgcccagcaagugcacucuuuuaaaugaguaugugugaaccacccuuccccuagaaaacagucccuuaaaaccagaaauugcacugcuccaguacuuuagucuauuacuuuauucaaaguuuaccaguuuaccuaaugauacccuucagagcaauauaaacauauuugacccuugugcuguauguaaucuuuguaguauguggcauggugcucaucgugacccuccuccuaucacaggccuacuugauucuaagagcucucuaagcucucuacccugucccugauuagacaugcgacaggacaaauggcuugauuugauuuucuuucuuuuauaugauucaguggagcagcgugacuucauuggaguggacagcacaggaaaaaggcugcucuuuauggcuaaugaagcagacuuggaugaagagcuggucauuaagggauccauccugcagaaguaagcccuagggauugacuucuuggcagcucucccuuucuugaaaccaaauaaaaccacccaccaugggaaaguaggaacgaaaacuagauuauacugugugaaauggagaaaaguaugugaaugcuauccccugagacaggaucccagcuucucuucacggcaugcacuuaguguuccuuaugucuuuucuuaccaagguagagccaaguccugcacugaaguagagcaaagcgucuguggggagagcaaggacugaccuucugacagcguuagagagccuccuuguaaagaugugcuagaaagcacauagcauaguucgucaucugugguguuagugugaccacguuguuaggaaacaaagcaccaggagguuuacaacuggggaauaugaacucuuuaucucacuaagcacaauuccauauuguuucccuacccaucuaauggcaauucuacuuugucaguuaauuugaguaauuuacauaucuucuauaagugaaauccuauauacuuauauguuugugguugacuugaaguauauagaacuuccuaaucacaucacauccuaguaauggguucauucuauauacuacuuuauuuauuuugacauuuacucauuuuuauuuuuuuauguguacggguguuuuuccugcauguuugucugggcacuguguauaugcaguacucaugaagacuagaaggggacaucagaucuccuagaaccaggguuaccaaugguugugagacacuaugugggugcuaggaauagaaccuggguccucugcaaaagcagcaauuauuccuagccacugagcucucuccagccccuccaucuccuucuuacagaccgggauaacccaacaaacaccucuuuuuuucauuaucuuuguuuuguaucuuguuuuuuccuccuugggugcuugcacaugguggcugguuucuuuuguuggguuaauuuuuuuuucuuuucuuaaauagaaaagcaaaauuggggucaguggccaaaaucuggugauaggauauguuaucuuuauuauaauccuuuauuuugaauauaauuuuuguuuuauuauuauuuugugaacauguguauucauguggguaugaugugugugcuugggcaugaaugccauggcgugccuguggaggacaaagggcagugugcugaguugguucucucuuuucgccuuugugugaguucuagagauugaacucagguggucaggcuugcuagcaggcaccuuacccacugagccucuuuucuugacugccuuuuauguaaauucugcaucugucacucucacagccucuuguuccccucuuggcauggcaugcugucugaagagcagcugggcagucaucuggaccaauaagaaugccaucuuuccccaggcacacugucaaacgccuuaaucccagcacuugagacgcagaggcaggcagguagagcuaucuauucaaggccaguguggucuacuuagugagcuccaggcuuaauauaaagauacuacauggaaaccgagucuucaaaauccauuaagacaacaauaaagggauuuuuaaaagguguaaauccagaaugcuaaagaaaaucaguuucucuaagcuuaagcuuaugcagcugagugugaguuuaguuauucuuuagagaaucuccacuuuauuucugacaagcauguguuuuuaauagaucaaaaguguaagguauuugugccaaauauuuaauaagaaaaucaugaugcucuucccacaguguuaugugguucacuuuuaauucuagucaaggggucaagggugguuuuuuguuuuuuuccaggaaggguaauaaacauuuaaaaacaagcuuuuaaagauaucuuuuuuuuuuuuaaagauuuauuuauuauuauauguaaguacacuguagcugucuucagacacuccagaagagggcgucagaucucauuacggaugguugugagccaccaugugguugcugggauuugaacuccggaccuucagaagagcaaucgggugcucuuacccacugagccaucucaccagcccuuaaagauaucuuuuuaaaugaaauaaauguucacaaguucaucuuggaaaguuuaggcaauuguaucuggggagacaaggacauuugucaagacugcaaaaaacauggccaaaucuauuuugaggacuaaaguuagcgggggaaaaaaugguuuaaaauucaauuguuucauuuguggaaagucuugaaauucuuaucuaaauuaggaguaccccuauugauacauaaccagucccaauuccaaaauacuucucucauuuuaugauuaggauagguaacauauaaggacaucuuuuuaagccaaaauuugccaauugugguagcaccuuuaaacccagcacccagcaggcagaggcaggugggucucugugaauucaaggccagccugguguacauagagcuucagaauaaccagggcuccauaauguaaccuugucugaauaacaacaaaaagaaggagaaggagaaagaaaacgcuauauuuuuccauauuuuuuuucaauucuguaaggaaacuuggcuaugagaacucucaugucuucagacgugacuacaugaacugggaagugcaaggguagucuuccaaccucugccugugugguucaucauguugccaguuugauaguguugagucuucaguaguacaaucagcuuguucuuagcuuucucuuuaagauucuguuuucuuggauauacugaaucuguuaccacccuuccucugugguccagcuuccaaaauguguaguccuggacuuuguccuuguagauuuauauauuuuuaaauuaaaaauaaacaaauagcugguuaguggagguauaugccuguaauugaagcacucagggaacaaaggcaagaggaucucuguguucaaggccauccuggucuacaaagugagcuccaggacagccagagcuacacagagaaacccagucucaaaaaaacaaaacaaaacagaaaaccuucacuaacauuuucaguacacagugauuagugacuggucaguccucacuuccuucgcuccucuucugcuccuucugucucuucucugugacuaccuuacacuaguguccauccuccuccuccuccuuuccaucucuuccuucuucauuuagucuagcucccccucauagccuuaguuauucuugcauaucuacucgugcagccuugaguguucuuuuuuuuccauauaauauauaaggaauaguuauuaauuuuuuuguauuguguugugcacacuugccauaacaugcauguggaagucagucagaggacaacauuugggaguggauucucuccuuucaccauuuaaauucuaggguucaaauuugggucauugggcuugguaacaagcuuccuuccccacccccaaccuccucaccccauccccauccccagccuccccacccuaccccugccucuggugcugggagauaaacccugggccuugugcaagcucuccaccccugagcuguaucccuagcccaacccucaauuuuuaguuacuuuguacaucuguuuugucaacuauuacauagagcuuuugggggguacucuuuguucuggcauaaauugucaucauuauaaauucacaguuccaucuugauugaacucucaaacccacauuacagucuagccugucucugcuggaccagccuuccuuccauuccucccagcaacugcuuucagccuucagucuguacuaagggaagcuacugcugcugcugcuccuucucaggagagauccuaccaagugacagauuuccuggaucugcucugucuauacacucacccucacgcagacucuccugcagcucuguuccuguagccuuggaggaagaacuugagggaacgccuuucuuucuucaggccucuuaacuccauucuccugccaccacuguaaccuugcuccucugcuuuucccacagucucugggcuuuucaaacuuguccuguauugucuuuccuccuuccagcuaugaguacauuguuuauagaacaaagcacaaauuccuuaggcuccagucaccuauccauucuuccuccuaccacaacccuaccccacagcuacagagagcuccucugacuuccacauugcuuuuuguuguuguucuaauggucauuuguccuuuuuguauauaugaauguaugucugugugugcauguacguauguauauaugggugccccuacaaggucagaacaggacacuggauccccugggacuagaauuauaggcagugaguugucugauaugguguuagaaacuaaauuugguuccucuggaagaauaguacaugcucuuuuuuguuuguuuuuuauuuuguuuuguuuuuugagacaggguuucucuguguagcccuggcuguccuggaacucacuuuguagaccagacuggccucgaacucagaaauccgccugccucugccucccgagugcugggauuaaaggugugcgccaccaugcccagcuaguacaugcucuuaagugaugagccaucucuauagcccccuuuuguguguguguguguguguguguguguguguguguguguuuguguauacccaaguaagguggcccaugcuuguaaucucaauaguugagaagcugaggcaccaagguugcuacaagaucaaagugaacaugggugacauagugagauaauaucuaaaaguaaaaacugcagauaaacaaaauuaauauuaaauagaguaguuacaacaauauacuguaauaaaaguuauguaaguaaaaucuuucucccaaaauauccuauuaugcuuguuaugguggcucaugccuuuaauccuaguacucguuagggagaggcagguaaaucucuaugaguucaaggccauccuggucuauauagugaguuccagucaagccagggcaacauagugagacccuugucucaaaacagaagaaaauaaacaaaauccuauuauaacuuuacuucuuaaaauaagcaacaacuguauauauagugucuguguguuuugagacaggguuucucuguguagcccuggcugucuggaacuugcucuguagaccaggcuggccucaaacucaaagauccaccugccucugccucccaaugcuggcauaaaagaugugcccuaccacugcccagcuuaaaacaaaacaaacaaacaaaaaaauuaagggcaauguuauacuauguaacuuuggcuggccuggaacuuacugcauagagcaggcuggccuugaucauacagagaucacuugccacugcugagauuaagggcauggauuaccaugcuuggcauaucuuaaaggaagcacauuauggcuucucucaggcauauccaaaucacuagggucucuacucuuguguauuggagccacuauguuaugcuugaacaagaguacuguguugcuaggacagagggucugauagcuaagauggcuaauaggugacagcugggcgggcagguagcauauaaaguuugcauaaacugaacaaaagaaugauucauugacucagaugacguggggccagauuucaccacacguguaucuaaaauuuuaacguauugauuucuggcauuuuccauuuaauauaucagacuguagguaacuauaauuguggaauauggaacugccauugaggccacaccacuucauauauuccugaaaauauagggcauuugacauaaaugugguaaacuuacauacauggaagcaaaaaaauaaaaugaagaagucaaaaaaccaaaauucuuggaacggaaaaaaagaaaaggaaacuaaacuaguaccugccacccuggucucuccaggcugaggcguggcccuuaucugacgacagacuaacauccacauugucugauuaugagccuuucucuccuguccuuccuacaggcacccuaggauacauuuccacacaggccuuguggaugcccaucucuacugccugaagaaguacguuguggauuucuuaauggagaauagguaaggaggaggaagguggaguuaagccuacuaauuuugagcauucucugucucaaaauuuuuggguguuuuauuguaaaucuacaguuuuuaacaaaguauaguguagcuggucuuagcuacuuuuuggguucuucuuuuucccacccuuuaucccccauuuucacccccaucacuagauaggaggaaaagaagcagagagagagaggagagagggagggaaggaggaagggagggagggagggagagagagagagagagagagagagagagagagagauccuagaaucuaauuuauuuccucuucuuugaauaugacuacugggaaacagcgaacagccuuccuaaaugaccaccaacaccuuacaacacaauugcagaaacuauccccagcuggcaaaagucacgccucugcuagagcacaaggcaaaucaaauccccaaaccugggauuaaaaugaaagcacauucuuauaauauuucugugguuuuuuuuuuuaaauugucaguacaguauaguuuuguuuguuguuggcuuuacuuuugcuucucuguguguguguguaugugugugcacaugugacuacagauguucucagaaggcagaggcaucagauccucaagcuggaauuacaggggcugugagcugccugacacugguccuggaaacacaauccagggucugcuuaagaacaguguacucucggggcuggagcgauggcucagugguuaauagcacugacugcucuucaagagguccugaguucaauucccagcaaccacauggugccucacaaccaucugaugaccucuucuggugugucugaaggcagcuacaaucuacucauauaaaugaaugaaugaaugaaugaaugaaugaaugaaugaauaaaaaaauauuaaaaaaaaagagagagagaacaguguacucucuuaaccuccagucaugucuccagcccuugguuuuguuuuuaaggcaagagagagagaacaguguacucucuuaaccuccagucaugucuccagcccuugguuuuguuuuuaaggcagggucuuacuguguagccauagugccuggaacucuucagaccagacuggucucaacaagcaagaucugccugucucugccuccugagcacuaagauuaaaggugugagucaccuugcgugacccauaaaguauauauguaguuuuuaacaaacuaccuugugauuuagccaauagucuuauuaaacuucugcuauuuuuguagugcuagggccauaacguagggccuuuuguguccaaaguacaugcuuugccaccgaguuauacucuucuuaguguuaguuaccaguuuauacaaagaucacaguugguuuucauuucuguuuuaggaaugaaucacauuauuuauauacuguuauguugcuugcaccaaagaaaccuacuuauauuuggggaaucugcaaaucauaaaccagcagaauauuuuuuauagcccccuaaauaggcugggugugguagcacauaccuguaauccagaaauugacagguggagacuggaggagcaggaauucaaggccauccuuggcuacuuauugaguagaaauacagcuagaauccuaagaguagguaggaaaagauuuaauguugcaauaguuaagaggcugcuuucccuugaggacacuggauacguuucuaccuugaacagugcugguugauugguaagcaggcaccacagcaaccaaguucucccagagcagcuugaccagcgaaucuuaauuuaaguuccagcugugaguguugcacagcagagcaggccuguauguacuauuuuggaggcuuagcaagaagaucacaaguucaagccuacccagcaaguucugagaugccaaagcuuuucaauucaggcuccauuuuggagaacuugaccuaaguuuaaacuuagguagacuagcaggcugguaucuagcauuaguuuccaaguugccccucaacagaaccugagccuagcuguagucucuaggcucauccccaacaagagcagaguuuccagguuacacccccaacaagaccagugucuccagguuaucccccccccaaaaaaaaacccugcaccuaaugaccaccaaugcagaggggagcagaaguuaaguuuaugaugugacucccagcaccagccaauuacguuaaaggccacaggagcuuuccaauuagaugcuugcacacguauucccugcuugcugccuauacuauaaagccuugccccauagacauucugggcucacacacacacaccaaaaccauccuuccugauggugguacauuggggcgggggguggggggggcaagcuagguugaauagaauaaagacucugcugaauuucaucaucagguuggcuccuguguguauuuugagagaucacuaacauuucccuggcacaacaguucaaagccacccuuaccuacuuaaccuuacaauaauaaguaaaaauguacuuuagagguaggcauuuucacagcacaauaagucccuggguucaauccccauuaacaacccccuccaaaaaagcaaaaacaaaaauaaaccaucucugucuuuaguugaugggccaggauauauacagaaauaaaggaagaacuaggcagugcaccacgugcaugcccaguaucuacagaggccagggaagagggugucaaauccccugagacuagagcuacagguaguugguuguaagcugccaucuuggugcugggaaucaaaccuggguccucuggaagaguagccaacaguuuugguuuguuugguuuguuuuguuuuuuuccuucaagacaggguuucucuguguagccuuggcugugcuggaauuugcuuuguagaccaggcuggcuucaacucggaccuuccucugcuaggauuaaaggugugugccacaaccuccuagcuugcaacuaguguucuuaauacugaaccaacucucuaucagucccacagguagaucucuguaaauucaaggucauccugaucaaccugacguuccagguuccaggguagccaaggcuauguaaggaaacucuagcucuagccaagaggaaaaacggcagugcuuccuuaauacugucaacuagaauuguagcuuuuggauccaggaugugcaagcaguuuuacagcaaaacagccuucuccuggcuaccguagcuuauuuguaguucauuuugcuacugucaguuugcuguuugcaccccuggcaaaugugauuagugguaacugugacugcuggccagaacaucugcaaaaagggacuuuccucugcagucuacuauaacaaagagugauucagggccucagcccaaaaugacuccccaacacuaaauaaaucuguagaagagacccucaucuuguucccuucccccaucugcccaaucucucaaaguugcuagaaccaaagugcgcauuuuuuuaaaauuaguaaauuucaguauaaaguauacugagccaggugugugcgucaugcuugcagucugaacauuugggagguaggugcgugaggauuguaaacgccaggucagccuaggcuacagggcaggugaccuugucucaagcaaacaaauaaaaaccccaaaacaauaauauauacauggccauaaaaaaaugagcauggaguaauaagucuugaaaugaauaguccgcccagguacggcccggaugcuuuggagugcuacauccuguuugguuucagagccuuaacucacuuuccuaucacacccagcuggccaggugguggucuuuauuuuaggccuaaggucaagcuguuccaccaugguucacaguagccuuguaccaguucuuggcacagcugugagcugcaugauucgggaacuaaccugauauugagccccaguagggguggcugugaccuggcaguucagaacagcuucagaucuuuucaaaccgcucaccucacaagugccugcugaugggacugugugccaaggcuuguuugcuggccuguugcagugacaguucugucugacccaugauggcccuaaagauccuucagcucucugugcuuugucacuucuucaaaaaggacuugcuucccaggggggaggggccaaggaguauuugcugucuacauugguguggagcauugaaaauggacuccucaaaaauaaccaaagaguaagaguuguuugauucuuguauucauauggaaauuuuuaaucuucaucaaaggauuaaagaaaaaagucccauugaaauucaauacaggggcucccagcuuacacagaaauguucaaagacguuugaccugauccuuuaaaaauaacaaaaagccaugaacuacuaagcuccagggugcaugcuuucccuuacccuccucagccucugcgucugucuugccuucuuccuugcacugcaugugugugguccugugucagcaagcugagcugcuuugaggggggccuuugguacuaacagcaacagugaguuauggugcuguucacacuccucccuccugccucaucucucagaguuauagcugauuagccacuuccacaauccguuccccugccuauuuaaccugcuuuuucucccucucucuuucuucugcucgcucuacuaauaauuccuuuaaguaguaaaaacaacauuuacaggcugaggagauggcuccacaguuaagagcacaggcugcucuucuagaggacccagauucgauucccagcacccacauggccgcucacaacuguccauagcuccaguuccaggggaucuggcaccuucacagacauauauaggcaaaacaccaauacacauaaaauaaaaauaaauaaaucuuuuuuuuaaaagauaaagaaauagcaauuaccagagcauagacaaguguugacauguaaaagauguguaaccacgcuagucccucacccgacugauuuuauuuucuuuguuaaauaaaaaucaagagcacacuagaggucagcagauacuugccaacaagccugcauccaguucccagaaccuacaugguggaagaaaagaaccuacuuccaaagcuguccuccaauuuccauacacagugugguaugugcauacacacucacauauguggaugggcacacacucacuauaccaaaacucaaguccuuucuuucccuuuuuaaauauucauuaggcccaaccuaaccucuuguccuuuuuuuaaaaagcaaaaacaaaaaacauguauuuagaguguauguuuacgugugcauguguguguaccuucuuuuggcauacauacucugguaugugugcagacaacuuauaggaguugauucucucuauugcguggguucugggauggaauccaggcaggcagugagccaugucugcagcccccgacacccuaugcugauaccaucaaaaggaagccuauguucugggaaccacaaaaggcaaaugaagaagccgccccgagcauggccguuacucauugcuccucucuagaaucauucugcauauuugucagucucgaucuuagccuuuaugucagucuaaguugguauacuuauauuaaaguaaguuaacugugcaaauucuuaaacaacagaaaguacaacuguuacaguauacagaagcccacuuuucccaauggauaagaguauaggguuugugcaggaauucuaaauuugcagagaggcuaggcuugguggucugugucuuuaauuccuguacuuagaaagcugaugcaggaggacuggccacuauucuuacucccucuucugacuuccacagacacacaugcagguaaaacaccuauacgcauaaaauaaaguaaaauuuaaaagaagaaguguuuuaagcuaggugcagaaauauaugucugugaucucaguaaugggaaaacagaaacagaugucuuucagaaguuuacuggccauugagccuaucuaaaucagcagacuuuagguuuuugagacugucucucaaaaagguggagucugguaguaguggugguacacaccauuaaucccaacacucaggaggcagaggcaggcagaucuuugugaguucaaggacagccuugucuacagagugaguuccaggacuauacagagaaauccugucucaaggggaaaaaaaaaaguaaaguggaaagugauagaggaauauacuugauaucaaccccugaucauagacacagugcacacaaacacagaauagucuguuuucucauggauuguugcaaaugaagaauuaaggcaccacguuauauacuauaugcauacuguguaaauaugugcauacauagagacaucccauauagcuaagauuuugugggagacuauuuucugacuugaccaagaggaggaauucucaaauccuucccauucugagucuuaacugauaagaaaaucuagguuuuuuuguuuuguuuuguugcuuucucuugagugcaaauaauuucuaacccaagaggauucagugagguuucucauauuugaccacucuuucuuucuaggucaaucacuucuauccgaagcgaacugauuccauaccuaguaagaaaacaguuuuccucagcuuccucacagcaaaggcaggaagacaaagaagaggaucuaaagaaaaaggagcugaagucuuuagguggguguuuggguugauucaggaagacaggcagagaccggaggaccuuuagagagcaugacaccucaagaugcucccuuaagaccgacaaugcuucucuaguuuacagggggaaagaggccagcuagccuuacucccugaacucuggaugcccuuauugggcagagucagucccuguacuaucagggacaggcugaucaagcauaugacccauuauuuagucaacaaccuaugugauuaguuccucaguagaccauuaggucuucaaauucuccuuaucacaucucaguuuccugguucuucaggugucagcacaccuaccaucuucuguccaugaauggaagauggugaaguauacaauuacaaccagaggccaaucagacugucuccauuacaggaucuggagaugaaaucugucuuauuugcucucaaaucccuuuauuccugccccaguccuaggcuguuacauggucuuaucaacaaugugcacgaagagaugcuguggcaugauggccgcagucacagccucagcagcacagcucuggcucugacagcugccucugguuaacaucagcucugugaccugagcagauuacucagucuucagucaucucaccguaaaacaaaaggccuuuaagauuuguugugagccgggcgaugguggcgcacaccucuaaucccagcacuugggaggcugaggcagguggauuucugaguucgaggccagccuggucuacaaagugaguuccaggacagccagggcugcacagagaaacccugucucgaaaauccaaaaaaaaaaaaaaaaaaaagauuuguugugaucuaaacacaagcaaaaccuaauucaaucugugucuccuauacaccuuucccuuuauuuacuccggauguuugcucugaagauauuuacaguuuuauaaaaaaagacgacacucugaccuuggcucccuaugaugccugcuggaaugcuuuucgaggagacaaaugggaagauuugucuagaucacagguccgcugcuauguccacaucaugaaagaaggacuuugcucucgaguaagcacacugggacucuacauggaagccaacagacagguaagaagaugggcccaaggacuuccugcccuagccagacccagcuuuuugucuuaugccuucauuagggaaaugguuaacauucacagucuacacuucugaagcugagcaagacuuggaaugucagggaagacuucaaagacaggaacucaguggguucaaggaaaggcuagcucuccaauaagauuagcuucugaguuguggaugcagcaacucuccuguuugguucagggugaauauuugugcaacaacuacuuccuaaguaagcagauaaagccagauuugauuguauauaccuguaaccccagcucucaggaaguugagacgugcagaguggaagcuagucugggcaugguggcucacaccugugauccuaggauuugggaggcagaagcaggagaauuuguguugaaggccugcuuggguagcauagcaagaucugucucaggggaaaaaaagaauaaaacagauauuauugucuaaccauguaguuugguaaaguaagacacagaggaagcuuccucaagaaagcaaaaauauauuaggaaauauaggcccauuugguagcacacaggaaucccugggcucaguucccaguacugcacaaacugggugucuugccuguaauccuagcaucaggacagagagguaaaaggauuagaauuucaaggucauauuggcuaccuucugaguuuagaaccaaaaugggcuagugaaaucccuguggggauuucuugcuuguuuuaucauuuguuguuuaagguaaacugaauuuuaaaaagacacaaaaguggggcuggagagauggcucagugguuaagagcacugacuauucucccaagguccugaguucaguucccagcaaccacaugguggcucacaaccaucuguaaugggaucugaugcccucuucugcugugucugaagacaaauacaguguacucauaugaauaaaauaaauaaauuuuuuuaaaucgacaaaaaaagaaugggaagaauggagagagauagggagaauugagagugaccagaggaagugacccaaggaaggagucucuagaggagaacuguuaggaauacacaguagugaggaaucuugcuucucaaaauuaagccaggucucacugaaggcauaggcagagaaggcugaggguguggagggugcuucacagucaggagugagugcaggaaagaggaaaaaccaguaaaugaaaauaggcuggagugaagcauugagaauaagaaaagagaguuugaaugagguuuuaaaaagauuagcugcuggcauuguugcugguagaauuuugauaacuuacuggaagguaaauaauaagagacuaauacuaaaugauggguauaccugagguccugaccuuaagcuacauucaauguggaucgcuuauaaauccaaggaaaucccaaaccagagagcuauaagaaaacagugugcccacauuuacucagaaccagcuuuucucaguaugaucuggaagcaaggguuauaaauaggcugaggcugggaaaguauccucuaaugcuaggacugcacagcagauagauccacaggaccuuggcugcaugcuguaggggaagacucacugcugagcuuggagggcagucuccgagggccgcuguuagcagugccggcaaggccucgccagcaagcacaggcaucauauacggugauugcacaacugagcagguuuguaaugcugacaucacagauguucucucguccuuccaaauaguuuaaaguccaaaucccucuauaccuucaaucugcuuuuccguuuucauccuuaagcaggaauaguguaaacuuuuucucauuuucucuggaaggacauggacucuuucucuggcucaguccuaauuguaaauuccucuuacauuguuccucuccucacaugguacauggccacaguaguccaggaggcaagcagaagaacccggaaugauucugagcaugacucuuaguaguccaugccucguuugaccuucuuucccacgaaauguuaggagaauaucuaggccuuaggcagacuuagaagucccauccuggggacuguggcugauucagccauggcugaaagcccugucccugacuggguguugaacucuaccuaaaguuuuuuuuaaauguuuuccugucuuuacugaccaaacuucuuuccucaagguccccaaauugcuaucuguucuuuguccggaggaaucaaugauccauucaucagcccagauugucaacaaacaccugguaagugcugguguaagcaggacacggaugagaccugagaacacugggacuugcugaagauuagauugcagccccuuagcccuagaccuguagcacaaaggaaaucccauguccaucuugguucuaguaguagagucucacucaagcagacuuccucaggcuggcaagaugccucaguagauguuauaugcugcuaagucuggcaacuugaauucagucccuggaacucucacuguggaagaagagaaaugacucuuaacaaguuguucucugacuucuacauguguaucauagcaugugcacaugcaucuacacacacacacacacacacacacacacacacacacacaguaugaaagaagucuuagcagaugugguggcacagcuguaaucucagcauugaagcagcugagccaggaagaucacaaauuuaaaaccuggcagagcuccccggccacgugcauugcuacccugagaaagaauaagaccuugucucaaaauaguaaaaaacaaggcugggguucucgcuuagugguagagcucagcaucgauggcucucaggguucagucuccaguauugcacaagaauaaagacuucguggagggagggcauaggggguuuuggggauagcauuugaaauauaaaugaagaaaauaucuaauaaaaaaaauaugucaagauuaaaaaaaaaugaagacuuccugaagcuagaugaaguggcacacuccugccgccaugacauucaggaggcuaaaguaaaaggacugugaguucuaagguagccugagauacauagcaagaaggagacaugcuuaggguuucauaguaagaacuugucuccaaacgcaauaaaaaggaggaaagagcugccacaugcuuuaaucccagaacucaguagacaaauacauggagcucugugaguuugaggccagccuggucugcauagcaaguuccaagcuguccagagcuacauagugagauccugcccucucugucccccuucccccacaaaagaaagaaaaaaaaaaaaaaaaagaggaagagacuuccugaggcccagcauggcauuacaugccuauaauuggagcaguaggaccugagacaggaggauugcaaguucuaagcuaaccugggcuacauaguaagaccugucucagaguaaaaagaggacaaagauuuccagggcaaauaaugacccuacaaccaggaguccauguggugcugggcucagggcaggagcuuucacucugcuccuuucuuuacuuuccaguuugaacgcucuguucaggagagugcaucuaaaggguguugugauaguauaacuuauguuugucugguugguugguugguugguuggagccaaagucucacaauguagcucuguguccuggaaguaaauacuaaaccggguuggcuucaaacucagagagaucagccugccucugccucccaaguacugagguuaaaggugugugccaccaugccugguuuaaacauguaaucagccagucggagaccaaggcaggaagauaauuuggaggccaaccugggcuaaguauacaaaaugugaguacauacauauguugauuuaugugauuuuuuuuuuuuuucuugucagaggagggcugacacuucaguguuaguuggagcugguauuaggaaagcuguuugauccacugggucuugagacauaccgcuaaucacccacccuaaguuguuucuauaggaagauuccauuagauaccagcucaaagaauggggguugauuucuaguugguugagauggauggacaggguuucuguuugccuucugcagauuggagcugauagccucaucgggccagauacacaaauuggagagaagucaucuauuaagcacucugucauuggcucauccugugucauacgagacagaacgucuauuaccaauugccuccucaugaacucugucaccguggaagaaggguaugucucccucugugccuuuuugagcaaggcuucugguagcccuaggagccuuaucaguccuacccagaagaguuugcuuugggacaggaaggaagggaagggaaggaagaagguuggugccuuuggaguuugauuuuuuuuuccuccacagugacaugaacucagaauaucacuucuacccucccacaccagaacacagugcuccugugagaaacugcugagaacucuuccuuaggguccaacaguagugagcccuucccagugcugcagugacauugugacaaugccuaagugucauuuuccccugugacugucccagagcugccuugaggcagaggcacaggaggaguggacauacugugcuuugagggcaagcuucucuauacauuuugacuuuaacccaagcuggccuaguacuugcuauguaacccagucuggccuccuacccauaugcccucugcuucagacccugagugcugcgaugguauguacacaguaccaucccuggcagaguacuugaaggcauaccaaacuuuugacaucaugauacaccauugucaucuacaaaguucacacucaaagacuacacagcuggggcuuaggcgaugacucauagguaagaacacuugcuacacaggcaugaggaccugagucugaauccucaacacacacaaaagccaggcguggccacaugugccuuuaacugcaguauuggaauggggagacugauggguccugaacacaccgugaaacagcgcuucagggucaguaaaacaccuuguuucaagggaauaaggcugagcgugauagaacagaacagccccauaaucuuuaacgcuuccaacucuauucaaaguccaaagcuggggccuggagagauggcccugcgguugagaauaauuacagcccuuacagaggacccaagugugguucccaguauguacaucuagcaguucacaauugcccauaacuccagcuuagaggcucuagugccccucucugucucugcaggcacacacacauauauguacacacaaauaucacauauauaaaaaauaaaacuugaaaguaaaaguacaaaguccaugaugagggauauaguuauugugugcuauugucuagcauauaugugcaaggccuuggguuuaauucugaggaucaggaauucaagaucaucuucagcuacacagggauucaagaccagccaggaaugcaugggacugccucaaaacaacaaaagaaacguuugcugaaacucgauuuaaaaccaauaaaagcacgguuccucaguagcacaguaggcacuccuguacccaggacgucaggagccagagggaagaaucugcaacauaguuagacauuccuguaccccaggacuucaggagccagagggaauaggauuucaaauuuaagccuagcauggguuauaaguuuaaguauaaguugcuguuugagacagcaaguccuugucucaaaauaaaauaaaaagagccaaacauauuguccuauaccuuuaauccagcacuuggcgggugggucucugaguuagagagcagccugaucuauccagugaauuccaggacagccaggucuauguaggaagaccaugucuccaagaagaaaaagaaaaaggaagcauaagagauugguguguagcccuggcuggccuaaaacucaccaguacacuauacuggcccugaacucacucacacagaucaccugcuucucccucucucggaucaauggugugugccgugcccaguaaggcagaguuucuccacguagcccuggcuauccuggaauucccuuuguaagucuggaugaccucagacucaaaagauccaccugucccugccucccuggugcugggauuaagguuuccaacugccaaaacaauuuuuuuuuuaauuuuuuaaaucacugggcuggcucaguauaguagcagauucuuagcauuugagagacagaggcaggaggacccauauuuagaagccaaccugggcuacacuguguccaaagaauaagaucaaaagguuguaugugugugguggggggugauauaacucccauugggcugaauuugugaagggaguucaguugaauguuugugaaaugggaccagcuauccuugaaguccuggguucagcaauccuucaacugccccaaucguacuguacuaccacaccacacucguaacaagucacuggagaaaaccgucuguuccaguucagagugacuaacuggacugggaaucucaguacagcagaacuuccgagcaggaggacccaaggcuguucuccagagccugcauuagaauagagggagagcggcgagacugccuggcacuuaggaacacugacuacucuuccagaggaccccaguuugaauccuagcacccauacgacagagccuggugaaucucuggauuuaaggccagcuaagguuacauuacauaguaagucccugucucaaagaggaaaaaaaaaggaacacauacauacacuuccuucggaggcugaggcagaagaauuauugaguucagagccaguccaacuaaaagggagguccugucucaaaaaaaaaacccaaaaaacuauaacuggaccacacaggacuaaugaccuggaaggaaagccauuagcgauuacccaauccugcaaauuaguaucuggccaugagaucggguucuuguaucccauaugaaccuuuccccauuauuuuggggucacuuaguuuuaauuauuuaugauaaacuugaaaaugguaauuaaaauguagaugugugaauuuugaugauugucuuuuuguuauuaugucuggacugaauguuuaagucuguuuaaaaggaacuuucucauuuucauggugugcuuguuucuggcagcaguuaugggcugcaaagaccuugugaacaguggguuggacagagaaaugcugugggacccccugggaaagguggaggcaagacuguucugagaaagcuccugccuagcuuccucauuuucugcuacuuucuaugaccgcuaauguucaggaaucaaacgucuaguuaggggcuagagagaugguagaguaggucaguacuaguugugcaagcuugcagaccuagguucagguccucagaacucauguaaagaagauaugauagcccaugucugucuguaaugcagugcuccuucagcaagagucaaugaagagaccaaaauccucagaaacucauaaggacagccagcuuggcaccagcaaagaacuacagaagacccugucuagaagauaaaugacaaggacuggcauccauguuguccucugacgucuacacaaacauacccacacucaugcacauaaauguacacacagacacauuagaggggcuagguaaaggggacuggagaaauggcacauaggcagacacacacacacacuaaauaaaugauggauggaugggugaguggguggauacauacauacauacauacacacacacuaauaaauaaauauauaauaguuguuuuaaaaaucuagucaaagccucauuguccggcguagagagauggcucagccaguuaagaacacuggcugcuuuuccagagguccugaguucaauucccagcaacuuucuuuuguuugcauguguuuuuguuuuggaaccuggucuccuguagcccaggcugaccuggaagagcagcaucugcguuuaguugcugagccaucucuaaccuguuguguugcugcucuuuaaugauguguauaacaaagguaaccucugaguccaguagagagugacugguccccuggagcuggaguuacaggugcuugugaacugcccgguuuggauguuggaaaccuaacugaggccaucuauaauaguaguauaagcucuuaaccucugagucaucucuccagccccuuguuuucucuucacuuuuuauauuaagacagacuggcuaaguugccugagcuggucuugacuggcucugcagcccaaacaggccuuaaauuugaucuuuuaaaaagaucuuccuucuuaagccucccacacagcuggaauuacugguuuguacugccaggcccagcuuccaguccccuuuuuucaggucauuccaaacucuuuaauauugcauugauugguugguuggauauagacaguuucccuauauagcccaagcugaccucgauuucauuuuguagcuagcuauagauggccucggacuucugauucuccugccuucaucucccaaguucuggaauugcagguauaagacaccauauucaguuuaaagugaaccuucucaaaauuaagugugugauguacaaccugccugugucuauaauaucuugggagccuaugcuuguuuggcucuuucaaaaccauugcagugcugggcaagaagcugagugguacaauaucccccaguaugugugacagccucgguucaaucuguuaucaaaaggggaaaagaaaagccacccuuaaagaaaggaugaagccaaugaugaugacacacacuuguaaucccagcacuuggaagucagaugcaggcagaacucgaagugaauuccaggauaaccagggagggcuacaaggggaaaaaaaaaaacaacaacaacaacagugggauaugccuaugcuagccugguuuaugugaugucagggaucaaauccaagacacuaugcagacugaaucuccugccucauacccaggauccaugucaagcagcccgcccacuguaacaccaguugcagggacuaugacacacucuucuggccucaucaagaaccuccucacuuguguguagacacacauacauacccauaaauaaaaauaagauucaucuuuagaaugaaaaggcuagucaaggcagagcacaccuaaaauuccagcuggggagauggagacagaaggaaucccugggacuugcugacugacuaguuugacaaagucaauaagcuccagguucaaauagagagccugucuccuaagaugaagagcuagcuaguaagauggcucagcagguagaggugcuugcugccaagcuuggcgaccugaguuugauccccgaaacaacaugguaaaagcagagagccaauuucucugaccuauacacacccacuauggcaaauucacacucaauaaauaaauguauaauaauaagguagggaguaauugaagaagacaccugaaguaaaccacuggccuccagaaguacgugcccaggggugcacgcacacauucacacgaauauauacacacugugcaugcacacguguacacacaaguauguguucuuuuccucccuagaaugaccuaaaggaagucguguguguguguaugugugugugucuagcuaauacuaagauacagaaacuggaucuggugcccagccaguucuuccuaggauuauaggaacuuuccuuuccuccuucauagguagucagugggaaaaguacaguuuuuuucugagaacugacaacuuaagagagguugaugcaauccuaccucucuaccaccucuagcaugagcagguaaauacauguacuucugauaaaaucuccaauuuccgggcuaaagcuacaguucagugguagagcuuaugcguaacauuuguagguuggucauggugguucacaucugugaucucaccguucaggagccagaggcaagaggauugccucaauaaagccacccugggguacagggcgagcucaaggccagccugugcuacagaaagaaaggaaggaagggagggagggagggagagagggaaggagggagggggagagagagagaaagagaaagaaggaggaaaggaaagcaggggggggagggaagaaaggaaagaaggaagggagaaggccauuaggcccuggaacauagaccaccaaacauuuaugaauauauauaaugugugcguuaugguacuagaacagagcccaaagcucgcacucugcccugggucacaccccagccuuggugguuugggguuuuugaguuuguugggcuuuuuugguugguugguugguuaggugguugguuuugagaugguuuuauuauguagucuuagcugacuuugaacuugcaaagaucugucugccuuugcuaggauuaaaggcaauuuuugauaacugcaaugaaagugaggaagagugagacaaauggucagaaacaggcuucaugccugguguucacccagaagacuagagagagcugcugagcagaagccauaggcuuccugucaaucauaucuacagucucuacacugaucaucaguguaccucacaacacauuacacauaaacuagauaagguaaucaauaaaggcagcuccugaagacccuaguuaaaacugcuagacaaaaggaaaagcaggccuuggguugcuguggaaauaugaccucagucaucccagcuacuucuaacagugacgguucccauccauuuccagauuccaauagagccaguuaguagucuuuaauuaugucuuugucaacaaaagaaacaguucucaccucaaaggaauaagaugugguuuauucuggagccaaaugugaguggccauggcccuggaacauagauuuaggucuccccaaauaaacacauuccaauaagguuucaauuuugugaacuuucuuuaguaacagaacaaagaaaggcaugaaucaaaacacuguuccaauguguuagugggcugcauugggcaggcagguuacagcaagccccauagaacuaugcucugccugacagcacccucagucuuuacuggaaacucgggcuucuuaaguuaaugcauuccaaagguuuuuaucuguuagucacaggauguuagguucaacaugguggugggcaaaaacugaagauagcucuaaauaacuuguaauuaggcucuggacuuacaacguuccaaccuuuccacaucacugaaaucauaaucagucaaccuucgcagacacagcuucuuuccaggaauccucauucacagcuucuugucuccugguuguuucuuguuuguuuguuuguuuguuuguuuguuuuccagguaggguaucucuguguaacucuagauguacuggaacucacucuguggaccaggcuggccucgaacucagaaaucugccugccucugccucccaaguucugggauuaaaggcgugcacuaccacugcccggcuucccuggauguuucuugucuacccacugucugguugucucuuuacuggcuguugggugcgugcuggcugacugacugucugcccacuggcuagcugacugcuguucucugcacacagcuuuccacuuuugccuggcucuagagcaugcuuuuaggaucuuaacaacugguaggaagcuacuaccuucagacauaagauguugcuuuagcuaauuggaaacuguucugccucuggaacccauucuguaccuuccuuuuuaccucuguaggggauuuucccccaagaaucuggagcugccguaacugcugacaaguugcaaaguucuggauuguaccuuguggaacacccacagaauguauccugagacugccaaaaagcaaacuaauacuuguccuaaucguaccacccacagagacacuucagcuucuagaagaauaggcuuuaaccuucccuagggauggagauggcauagauagccugucuccuguuuuacucuggucugcaguaaaacaucugcgggcagagaaggugccuggugcuuugggugccuuccaugcucacaaugauuugucuguagacugcucugaauuuuaauaccgggccaaaauccaaucaucuuacguggaugagcugcaccuccaggcuucuggguuguaccagggacuggcaauucuguaacagaguccugcccaacaucuugccuguggcaucagcaaauccuuaugggugugggccauacuccuugaaaguucaaucucauaugaauuuaugaauaaggcagcuuuaguaaucuugauaacauugggcauaauggcccacaccuuuaaucccaguacccagaagacauaggcaugaggauccaaguguucaaggccagccuggucuacaaagucaguuccaggacauccagaagcccugucuuagaaaaaaacaaaacaacaacaacaaaacacgauguggauucuaguauaagacaaaacuggauuuauacugcaucagauaaaaaugguauucagagaaucaccuagaaagauuuucucuaauuaaauacauaagguucucauccuggaccuacuaaaaaauaccggagaaggccaagacaaaagauguucuuguuuuuaacauugauuuuuaaaauugugugugugugucuguguauaugugucugugugugccucugugugugcuguacccauggcaggggcaggguugggguaggggcauauagaggucagaggacaauuuucuggaaccagcucucuucuacuuuuacauggguuuugggaauugaacucaggucuccaggguuucacaguaagugccuuuacccacuggaccaccucaauggcucugcccaggugauuuuucagauaaaacagcuagauucaucaaaacucacuuguugcuguaauauauggaguguuuagcauagugccuggccuguauguguaauaaaugcuggugaugguuuucaaaaagaccuuuucucccaggcauguugugcacucuuaauaccagcacuugguagauaucugagugugaggccagccaaacuauacuaucaaaaugaguuucaggacaaccagggcuuauguagucucccaaaaaaaaaaaaguaaagacguuuucuggcuggugagauggcucagcagguaauaacuugcugugcaagccugagggccuccacauggcccauccaaauaaaauuuaaaauuaauaguaaauuaaaaacaaauaaucggggcuggugagauggcuuaguggauaagagcaccaacugcucuuccaaagguccuaaguucaaaucccagcaaccaccugguggcuuacaaccauccauaauaaaaucugaugcccucuuuuggagugucugacagcuacaauauacuuacauguaauaauaaauaaaucuaugggccggagugagcagagguccugagcucaguuuccagcaaccacaugauggcucacaaccaucuguauagcuacaguguacucauauacauaaaauaaaucuuuuaaaaacaacaacaacaaauaaucggccacguggugguuguacacaccuauaaucacagcacuugggaggcagagucaggcagaucucugaguuugaggucagccuggucuguagagugaguucccagacagcuagggcuacacaggaaaacccugucuuuaaaaauaaauaaguaaauaaauaaauaaauaaaucuagaaaacaaauaauuuagaauguauacacacucacuucuaacgaguacuguuuuguuuaacuagagucugugauaggagcuaugggagcccauuguuuccacacuugaucagaaagauucuuaauuucugggccucaaugacucuuguccuauuauccugauaagaaggugugaugagccuacagaccagccucagucuccaccccuacaccaaccaaggagaauuugaauggaacuuacacccccagggaccuggguaccuagagaacugaagucaagcuaggaaccuggcauaguggcacucaguacuugagaggcagagacacauagaucucugugaguuugaggccacuacauagugucuuccagauagccagaauccaucaugcaaaaacaaaaacucucaaaagcuggccccuaaccccuacacacauacuguagcacaugugugcccccuccacacauacacacacacacacauagauauauaauaaauuuuaggggcuggugagauggcucaguggguaagagcacccgacugcucuuccgaagguccagaguucaaaucccagcaaccacaugguggcucacaaccauacgcaacaagaucugacuucuucuagagugucugaagacagcuacaguguacuuacauauauuaauaaaauaaaaaauaaaaauaaaaaugaaagcuccccuguagacuuuggucccacuggauuucccacucccugaauucuguccaaagcugauucaaauaaauaaauaaauaaauaaauaaauuuuagaaaguuuaaaaaaaagacuugauugcugggguguuuacauacauccauaauccuagcacuugguagguagaggaucgagucugacgucauagagcagugguggugcacacuuuuauucccaguacucaggaaucagaggcaggcagaucccugaguucgaggauagccagggcuacacagagagacccugucuccaaaaaccaagaguuccaggucauucuuggcuacauggugagcucaaagccagcuugccucaaaaacagaaaaccaggcacaucauuuagugguaaaggguuugucugacgugucuaauauuccggauucaguucccauuaccuaaagaggaagaagagagggaggugucaaauaaggacuuggaaaaauuaugaauguagcccuacccuaaaauucucuaagccaaguucucccuuugugccacucuguccuccaauaauaacuugagucauguacauguagccaccaguaggacugaccagcaguucucagccuacagaaaagcuugaacuuccuggcugguuuugugucgaagcccuggguccucuaacauggcugcuguguuggcugcuguauuacaggagcagcauccacggcagugucaucugcaacaacgcagugaucgagacgggcgcagagaucaagaacuguuugguuggaaguggucagaggauugaagccaaagguaaacaacaccccaaguuaggauucauggaagccguuuuaucuaucaccuuagcacagauaaagcuuaguuggcaagcuacaacauguuuacauugcaagugaaaacauagaccuauggucaucucuggagagcagcugauauaauuaucacguuuuaaaacuuugguuuaguccuauuucuagggcuauagcuuaucauuuuucucauagguguauacaacuaugcuaucaaaaaacugaaaauauagccgggugugguggcgcaugccuuuaaucccagcacaugggaggcagaggcaggugaauuuaugaguucgaggccagccagggcuacacagagaaacccugucuccaaaaaaaaaaaaaaaaaaccugaaaauauaauaauagcaauuguccagacucauaccaauacuuuauauuugcuucugggcaugacagaggcagccaauaauacagcacugguucuggaaugugcuauggccuccugaagaccaugauugcucaucugauuuguuuuguguguguguguguguuguuguuuaggggguuuugguugguugguuuuggaguuuuuuuggcuugguuuuuguugggguuggguuggguuggguugauuucuguuuuucaaaacagaguuucucuuuuucuguguagcucugacuguccuggaacucacucuguagaccaggcuguucuugaacucacagagauccaccugccucugccucccaagugcugggguuaaaagcaugcacuuccauugccuaguguguguuguuuguuuuaagcagagcaaacaaauuuauuacaggaaaguaaggaggagcuccagagaggaauccuugucuguuuuuuaaggaaggugauuccccuagauuuaauguggcaaagggguuaagcaggucuccaggcauaaccuggagaaccaucucagcugcuuagaaguguggcuguaagcugugcuuuaagcuuacugugcuauacaacauguaaaaagacugguggaaaucauaacaucuguacuacuauugcacaagugugcgugcauaucuugcagcucugguaguuacuauaguucacgggacucacagcuguguaggacuguugaugaaacugugugagguggggacugggagggaggguggcagcaaucagauauaaagugaguagauaaauucauggguaacaaaaacuguugaacuuuuccccuucgcagccuaccuagcaccuucuguguaguacuaguaccgugauagcuagccaucagggaaaguaaguuggucaguaacaacuugauuauucuguguacuaggaccaaaauguaugguguuuucagcaguagagucuuaccgucaguucgagugagcaaccaagagcaguagcaaauagccugcuggggugggggguauuauugauuuguuuguuuauuagugucugaguauguugacacaugccuuucauuccagcauucaggaggcaggagcagacagaucucugaacuggagaauucauacagugaaugcuaagccacccagggcuacaaccuagugaaauccuaucuccaaagggucuagagagaugcucugcaguuaacacuugccauucuuguagaggacuuacacucaguucccagcacacguagcagcucacgacugccuauaacucuaguuccaggagaucugaugccucuucugguuucugugguuacuaagugcacaugcagugcacauacauacauuuaggcauacuaugaaauuaauuuaauuugaugaauaaaguccagccaggcaugguggcacauacucggaaagcagagagauuaggaauugucuuaggguuuccauugcuguaaagagacaccguaaccaaggcaacucuuauaauggacaacauuuaguugggacugacuuacagguucugagauucaguccauuaucauggcagcauccaacaggcauugugcaggaggagcugagauuugcaucuuguuccaaaggcaaaugggagaagacuggcuuccaggcagcuaggagaagggucucaaagcccaaaacccacagugacacacuucuuacaacauggccacaucuacuccaacaaggccacaccuccuaauagugcuacucccuagaccaagcauacucaaaucacuacaggaauguagggccauuuuccucuuuuaauguguucuaggucaggcuaagcuauaaaauaaaucguagcacuggagaccaguuuuuagggggcuggagagacagcucagugaguaaaguacuuccugugugaguguuagaaccugaguucagaucuccagcacccauguaaaggcugagcguggugacagucaucugaaaugccagcacuguggcacagaaacaggcagauccagguuugcgagcuagccagucuggcuaagaaggcaagcuacaaguucauugagagacccuguccugaaaacuaagaugggagcaccagacaugguggcucacuccuuuaaucccaggagacaggcuagccagagaagcauagugagacugucaauaaaaaaaauuaaauuaaaauaauaacaaauaauaaggugacuucuaacuagccucccuuugcuagcacuacuuacauagccauucucagcuccccucuugacagcacugagccucacaccuaccgugcacucugucauugagcugcacacagccccagccccccagccuagggacauuauuacaccugacucuucuuaccccaacugagcacucccaggguucugcaaaauuccuggcagccaaguuugagugccugcucaagcaguagauggccaagguugacagaaaaagcagggagacuagcgggaugcuucaaugacaugcuacaaaguaucagcgacaaaguuuggaccuccucucccuugaucauagugaugaguaggccugguaaacucaggaucuugacccaguuacauagaucaaguccugguuaguaagacuucuuccugauuucaacagugccaccuguaagagcacccgacugcucuuccgaagguccgaaguucaaaucccagcaaccacaugguggcucacaaccaucuguaaugaggucugaugcccucuucuggugcaucugaagacagcuacaguguacuuacauauaauaaauaaauaaauaaaugaauaaaucuuaaaaaaaaaacuauugggcuggugagauggcucaguggguaagagcacccgacugcucuuccgaagguccgaaguucaaaucccagcaaccacaugguggcucacaaccaucuguaaugaggucugaugcccucuucuggugcaucugaagacagcuacaguguacuuacauauaauaaauaaauaaauaaaugaauaaaucuuaaaucaacagugccaccuuucauuuguagcaugaugagucugucacauuagcuuucccucaguuaccauacuccauuguagccuuuggggaucucucuauuuauuuguguugagguguguuaagugcagcugugugccacagaucacguguggaggucaaaggacaacguucagaacuugguuaucuccucccgcuggguuucugaggugggggcucuguuguuuuuaccagacuguacuagcuagcugacccgcaaacuuccaguugguucuucuguuucuaccuaccaucuugcagcagggaaugcuaggauuacagacaaaagcuaccgcaucuggcuuuugacauggauuccagggaccaaaaccagguccucaaaacccucaggcuuauguguuuaucagccuugaacagcaggcgcacucucccugcugagcugucgugcccacuuggagaucugguccugauucuaacccagaguuuuccuccucccaugcuucuuaugucaggacuccagcaucucacagcaucucaggaaacaaccgaacaccauggagaaagagagacuacauucacauauuguuauaauucaaauuauugucaguuguuagucucugggucugaaacuaacagacccagauacuuuauagguuuuuuuggguuuuuuuuauuuuuuucucuuuuagagagggucuuagguagccuaggcugaccuugaacucacuaaaguaccagaggauggcuuuaaacucuuuuuuuucuuuuuugguuuuucgagacaggguuucucuauguagucuuggcuguccuggaacucacuuuguagaccaggcuggccucaaacucagaaauccaccugccucugccucccaagugcugggauuaaaggcgugugccaccacgcacagcagcuuuaaacucuugauccuccugccuccacugcuugcaugcugggguuacagguuuguguuaacaugcucaaccucagauggaagguacuucacagacuggggugagcugaccagucagaaaguagucugacuacuuuuauugcagauauguauuuuauuacagauauguauuuauaggggaaagggaggcuggagagauggcuuagagguuaagagcacugacugcucuuccagagguccugaguucaauucccagcaaccacaugguuguaaugggaucugaugcccucuucuggugugucugugaagacagcuacaguguacucgcauauauaaaauaaauuaaaaaaaaaaaagcuggguggugguggugugugccuuuaaucccagcacuuguggagcagaggcuggcagaucucugaguucaagaccaaccuggcucagagagagaauuguaggacagccaggagaaaaacaaaacacaggauauauagguuugcuuggggagacgcuguucaucuuuuaaugaugcucuacacgccauacucuugccauguaaguuucuaugaaccagggauauagagucagcuccauccucgugcgggaagaugcucucucguaagcucuuuugaagggaacauugucaucucuagaagcagcugguuuuagagugauaccauuugcugcccauucacugagaccucucucucucucucuuuuuuuucuguagcuaaacgaaugaacgaggugaucguggggaaugaccagcucauggaaaucugaacccugaacaagcccgaccccuuccuuugggccucaaacuacagaugcugccuggcccaccuguuuugacucuuuauuuauuuuucaauaaagaagaauuuccaggcuguagguguggcucagugguagagugcuugccuagcaugcacaaggcccuagguuucagcccugcacuggaaacaaaacuaaaagaaaaacagacuuccaaaggcacggacagcacagucccacguucacagcaugugggcuccagguauaaugguguguguuguggauuguguagaguccacagagaacaacgggaugcugugcacauagugguuaggucuccuaugccaagguucacagacaggaaacagcuguccaguggugccucuaaagauuaccuucugacaggucagcucaccccagucugugaaguaccuuccaucugagguugagugugguaacacaaaccuguaaccccagcaugcaagcaguggaggcaggaggaucaagaguuuaaagccauccucugguacuuagugaguucaaggucagccuaggcuaccuaagacccucucuca

SEQ ID NO: 2059 - RNA, 20059 nt, Mus musculus
cuggugcuucccgagauccacagucgccaccuuuagcugugaggugcuucgcagccagucggguccacccacacgcggagcccucuuuggaccacagcccacagauccagcggggcuuggggccaccaccccgcaccgccgcugcgggcugcuccugugcaucuuuacgcgcgccucacccaggaccguauggccguucacggcagcuaggaauccucaggugaagccgggcggcacaaggcgccaagcuagccuauggcagcgcucagauaacgcagguugggggcgcucgcgccccccauccucaccagcaugguucggccacugucccuuggagagcuaccucccagcuacacaccuccagcucgguccuccgcaccucaugugaguagaggggcuggguuuguaacuuaaacgucgcuugaacaucuguagggcuagaagucuaguguuacuggaucuguguuugaagacaagcgagagccagcaagugauuuguuaguuuauuuccuauuaucuggucagugaaaauaguuaugucuguggguucaccucuuugccuagcugacaacgaguguguguguucacgacucauaaccuucuaaaaaugggcauuuucaggugugcuuauggagaaggcacagggaaagagaguuaaaucuuccacauuugaaaccuuuaucuguagcuguuuccugcccugcauccagaagucaggaaacugggacuugaccgggagaaaagggaaagcuccuccauuguugugcugacagcuggcugaccuccuccucucucuaucccagauccuagcugggagccugcaggcuccucucuggcuucgagcuuacuuccaaggucuacucuucucccuggggugcaggauccagaaacacugcggcaaagugcucuuccugggacugguggccuuuggggcucuggcacugggucuccgaguggcuguaauugagacagaccuagaacagcucuggguagaaggugaguuacuggagcuggccguagcugcuuuggucaaggaucgagagggccaucuccuguucagagccuguguaucuggguguguugcagaaagccuaccucucucccaaucucccucagugcuguggaugaagcccagggcauugugcaagcuaggcaagucuuuaccaucaacugucucacaccuaucucucucacccauaaauggacaacucuagaugguagccucuuaugaauaagcuuguggaauauucaucuuugauuaugugucugcuuauuuagcguuuauagcuagguuucuuuuaacuguacaucagaguuuacaaauggaacaagauguauuuuucaauagccaaaggaaguaaaauguguguggggguaaguucuaaacaaaacaaagccaagugguauuguguuguauaagagaaggcagggagagacggcucugaccugcaaacucagauuagcacugugauucuaacuacucaaggggcugaggcaagagaaauacuuucagucuaagaauuuaacaauagccugugucagagagagagagagagagagggacagacggacagauggaagagagggagggagggagggaggaaggaaggaaggaaggaaggaaggaaggaaggaaggaaggaaggaagaucagugggauguagcuggguggcauggcagacugccugucgagcaugcuguggugggggagagagauggaggaggagcaagaagaaaaagaaaaguuagugcuugguggcagcagugguggugcacagcuuuaauguuuaaccucagugcuugggaucuggaggcagguggggccagccuggucuacagagaauuccaggaucuggaggcagguggggccagccuggucuacagagaauuccaggacagccagagcugcaugaaaauacucucucucgaaaaaccaaaaagaaagauuggaaggaaggaagggggaaaggggaaaacaagaaauaauaagaaaagaauuguuagguguaaaagaaaagaaaaccuugaacgagccaucugaccaggcuucugaguagacacccagggaccugcagccauuuaaugaagaaugagcauagacuuugaggcaaaagucagggucaaaugagaccaaauccucacguccuaguggaaggauuacacaacucauaauuucagcaugccucucuucuuuccuggugccugguuucauguggcugcuauuugacaaaggcaaauucaacuguguucuucccugggaaaucugcauuugugggcuccccagaccucccuagcccuggcccagacccaaggcaggccccaggucgcagccucacacccuggaguuauuucaaaugcuggcaaguccuaggauacagagcagauguuucuuggagccuuccuacaucauaggcucccacaccccaucuccacccuacccccagcccucugcagacucuuagcguucacacucuuaagacagcccuaggguccagagcagauguuucucccugccugccagucugcccccagcaucaggacacacaugugcgcacacgcauauaugcaugcccccacacaaaccacugcugcuuggguggucccaaauaacuucugaauauccugccacaauagagugagucucccucccaggcccugccuuuccucucucugcauuccccggaucuuccccaauuaaacacugcuuggaugucuacauuugcucaucccucuccggccccccuggcuagucccugcaguuaugagaaauguauuauaagaggguagcaguuggucucuuugagauaggaauucccugugucaccucagcgaccuugaccuuggguccuccugcaguggaccccuuuguguugagauuaguaagaccacagucucacuggucuuuucucuauagcugaggaguuaguugauggaguugagagcugaagagacauuuuugcuuccuguuuugcuaggacuggaaguggaagaagcaagacccucaguuagcagaguuucaaauagaggucaagacucuccuuggcuguaaaugugguguguuuuccuuuccuuuuuuguuuuuguuuuuuguuuucuguuguuguuguuguuguuguuguagguuagggaccaaacaccaauacccugaucaacuuaaaacuaagaaacuugcugggcagugguggagugcaccuaggaggcagaggccagaggaucucugagcuugaggccagcuuggucuuaagaguuucagcuggugguggcgcacgccuuuaaucccagcacucgggaggcagaggcagguggauuucugaguuugaggccagccuggucuacaaaaugaguuccaggacagccagggcuauacagagaaacccugucucagaaaaagaaaaaaaaaaaaaaagagugaguuucagagcaggcagaaaccccugucucaaauaaaaaauaaaaaaauuuaaaaaaaggagguggagccucaaaaguaaauaguuauuaggccggaagugucucagugaguaaagcacuuccggugcacacggaaccugaguuuggauccccagcaucuguguaaaagucagguacagcagcgcacaccuguaaccccagcacugggcgaguguggcaggggcauucugagauuggcagcucaucugacagaacccaugggcuccagcucaggcagaaaccuugucuccaaaacagaagguggagggacugcaaagaugccuuaguaguuaggagcacuugcugugcaguuccgaggaccagaguucagaucccaaugccccugugauaaacugaguaucacacauacacacacacacacacacacacacacacacacacauacacggcaucaaaggaguguaagcaggaggaucucugggauuuguuggcuucaggccuagcugagaaaacguaaaacccagcuucaaagaggcagaggacaccuucuuugauggacacaggcaugcgcaccugcacacacacagauaggucugugaguuacaaugcuaucauguacccugacuugaagguaaggcgcagacagcuguuugauguggaaggcaggggaucagcacccaccuauugguggagccugcagcugccccaugcucaguccccaggagcuaguagucucaggagcucaucucgguuccugucuuuagagucucucacagccagcccgcccuuccacccugugguggugccauuguuaaggugaucucaaucuuccacgaacacuguaauuauacauuggaguccuugcagccacaugaaagagaaagaaaggggguucauagagcaggaaggaagaggcugggguuuuauucuuguaacaggagauuuggcaauagagaauucuggggugauuagucugucagacaaaggacauuagccaggacccauguucucucuucucucuucuguccucagcacaugagacuuaucccagugggcugcagagcgaguucaagaccagucuugagaacuuauugcaauggugucucaacacuaaagcgcuagggccagggcgggaugcucagugggucagugcuugcugcacaagcuugugggcugcacugugaauucccaacacccacgcagaggcuguggagcgcacaucuguaacuccagcacagagggagagcagagcggacacacguggauccugcaccuugcuggcaagccgauauagcagaaggggcgagauccagguucacugagaagaccugucucaaaaaauagagugauggacaccugacaucaaccucuggccuucacacacacacacauacacacacaagcacacgcacacacgcaugcacauagacacaggcauaugcacaggcaaacacaaacacagacauauauacaugcacacacacagacaagugcacauggauuagcacacauacacaggcacacacacagucacacauacacaaacacacacuggcacacacacgcacaauuaaaaguacuuuuuaaaaaucuguacugguagugagcuaagcuagcaugccaugggccuacauucaauacuaaauacagauggauagauggauggauagacagaccgacgaacagacagaauaaaguugggggggggaucgagaagccuuccagccaauuuccugucuguucuacuugucaagaauauauuacugguaaauucuucacucaucgaagugcagugugguuguaagaugguccauggaaaauguggacucacccgguggcgcuagagaggagucucaccggccugucugaggauggucagggaagucagcuagcaaaggggcuaaggaaacaauuagccuccacaucgcccccugggguacauauaaaccuggccaagucaguuccugccuggagccuuccuguccugugcuuccuuccugucagauccugugaaggcucagacucuuacgugagcccugaacacacgcucuaggcccuggucuggcuucuucagcagaguuauggugccucccuggcucacacuugugguuuucuuaugugcauggguguuugucugcauguaugucuguguaccauauguuugccaagugccugcagaggcuagaaaaaaauaacagaugcccuggagcugguguuacagacagcugugggccaccauguaggugccaguaaucgaacucgcuccuccgaaagaacaaccagcuccuuagcugcugugccaacucuccgacuaaagcccuuugguucuuucuuaacacgaucaaacccccaaaccuuuaauagugcauagcccuggauucugaacccccuuuccuaauucaugggccaguucuuacuggcuugucaggaagugaaaacaucaggucgucugaggcucuguucggagccuacaaugauuccuguucccucacagggccugacuuucugucauaguuccuaggcccuuacaggcacaauuuuuggacugguguuugaaagcauggauacugaaauaauguaccaaaugacgcuccauggggaccucuauaagccggcagugcugccaauuuuaaauuuuuuuauugauuuaguaaauaguaauccguugcugucuuauuauucaaacaggaucgccacaguaguucacguuggccuuaaacucacaacaauccuaccccagcuacuuaaauacuggccucggcuacauagaaaguacucaguccagcacugaggccagccuggacuacgugaaaccccauugcaaaaaauaaaaagaaagccacagaaagcagaggugcgagaggacgcagcugguagagugcuuuucuagccuucgggaaacccuggcuucaauuccaggcacuacacagaagcaggcaugcuuaucucugcaggaggcagggaacuuaccauagcaaggucagccugggcuacauaagacccucucuuuaagaaaggcgccuuggguuagggggaugugccuuagggcagggcacuugccugucaugugcuguucccucagagguagcaucuacacugguuuaaccaauuaugucccuuuuuguaaaggaaccugcccucagcagaugucaucauugucuguccuccugcuuuuucccaacugucccuucucucuccuaguucccuccuuuuucugacaugucauuucucuccuggcaacucuuggcuacaauuccauaucuuaccuauggugccaggcaggucuuaggucucuuuuuuuuaaugauuuauuuuuauuuuaugugcauugguguuuggccugcaugugugucugugugaggggucagauccccuggaacaugaguuacagacugugagcugccaugugggugcugggaauugaaccuggguccuguggaagaguagccagugcucuaaccacucagccaucucuccagcccuaccugccuuuauccuaauacuaccaagguggacacuaucuguuuuuuaguuuggucguuugguugguugguuugguguuugagacaggggcucauuguauaaccaggcuguaggcccaugaaauugaacauuagcgacccucccucccuuguacggugugugcucucugcucugguaucggucaccagccuugccagcugacauuuaacuuucucuguccacaguuuacccagaggauucuuuagucuuccaguguguuugaagugaacuguguuucuuacuccagccuucuuauugugucucucccaguuucuucucccccaugccuccauguccauccuuacagggggguuccucucugcccugcccuccuuccuucuguguagcagccauuauucccagccugguggaaaaaauacugcaauauagucggagagcacuguggcaguacaggaccauuccugggggagggcaaaggauugaaccugcguagaaaccuaaauugggacguuaucagggguuugaggagagccuguggucuuggaaaaggaauuggcuacugggaaugguggcgcacacuuguaauccuagcauuuggaaaguagaggcaggaggauuguccugaguuugagaccauccugacuacacagugaguucuagaucaggcaggacuaccgagggagcaggagaggggaaggaguaggugaaggcggaucucacgccuggauucgggaggaugacagaggccaacaagaaaggccuccaggcaagaaaaagccagacagagucugggagcagaccagagccacaaugucccugguguggcucuuacccuccucccgaucguaagcgguaucccccccaaaauguuccuuccuagccggaugugguggcuccugccuuuaguuccagcauguagaaagcagaggccuguggaucucugagaguucaaacaaaauugaguuccaggagagccagggcuguuaacacagagaagcccugucucgaaaagcaaaaagaacaacagaaauccccauccuuucucgaguccccguuauacagugugacuccauggcugacagggaugcugggauuaagaacucagggcaggccuccuggcucucaccucagugaggcuggggagggaccuggagcuccugagucuccuugauuucaucucugccgcaucuugcccugguggcaggaagcgucacacugaagacccacccucucccuugcgcaugggcugcaggacaucgucacagagugcagccaucacugcaccaggcagucggacuagaauuauccuguagaccugauuuucuguaaacccuccccacaggccccagggccccuccucauccugcccagccaagcagagagggucugagggcugcugaccuguggaugguucuggaacccugaaagcucagcucacacugaucuuugccuuuugguguagugggauggagccccgggcccugcacauccugugcaagagcuccagcacugacuuacacaccuauucacgugugugugcaagcauuugcguuggaucccagccaaugugggucagucacgcuuaaaaugugggaccaccauagaguuccguagcuguggcuucuccacagcccuaaguggggaagaagaucgcagggguagggggcaaagccaccaaggagaaggcagagaugucuccacagcauuucuuucccucagggguugggaccccaucucccaggccuccgguuuaaccugggcccuucucccagcccuuuucucugugcucuggcagugggcagcagggugagccaggagcugcacuacaccaaggagaagcugggggaagaggcugcguacaccucccagauguugauucagacugcgcaccaggaagggggaaacguccucacccccgaggcacuugacuugcaccuccaggcggcgcucacugccaguaaaguccaaguaucacucuaugggaaguaaguccaggggaggccccuggggagggggcguugccgggcacugugugaagguucuagaaugaggguccaucuucugcugaucaccugugcccgggccauuacagauccugggauuugaacaagaucugcuacaaaucagggguuccccuuauugaaaaugggaugaucgagcgggugaguacccccuaggcuguucccaggugcugguggaggcauugugggaggucugaggcucaggcguggggggguugggagaugacagagggugucguagagcaggacugaugcgacccgggugucccuggcagaugauugagaagcuguuucccugugugauccucaccccgcuugacugcuucugggaaggagccaaacuccaagggggcucugccuacuugccgugagugccgccccagccagccgccccuucacccguuucaucuccugccagggacuccccugcagaaaggggaggugugggggcaugaaugaaaaaaaggagauccuugccaaguucugacugccucccaggacaggaucagagagagccugggcugcccaaggcuucccaccugccuccccucacccacggagggaaggggaccuguguggcucagacagaacacacagauccucaggcaaagaucugucugagacuuuccugcacacaucagccagcugucagcugacuuucugcuuagacugaaaagaaagccuguuagaugcagguguguguccgguuacagguuaggaccaaagguagacauucuggacccguccacauagugggcacgcccaucccaagucuuagucccuuucauguccaaagcucucgugugcgggugcagccuagcagcugaggcgagcugagcccugcacacucuccuuagggaaggacgacggaucaguguguaagagauucucgcagugaagcagggcguaugcagcagcagucugucugggggcaggcgcugcguuuugaccuucacuaaccucaggcuuuccccaggggccgcccugauauccaguggaccaaccuggacccucagcagcugcucgaggagcugggccccuuugccucucuggagggcuuccgggaacugcuagauaaggcacaggugggccaggccuauguggggcgacccugucuggacccugaugacccccacuguccaccuagugcucccaaccggcacagcaggcagguggguuccuggacaggucugccaagaaagauggcuucccagccuucucucucaccuguguguuuguguguucuaaggggugcucccgccaccuccauuuucugaacacacacacacacacacaguguuccauucucauucauuucuuucuuuuuuuuuuuuuuuuauuauauuuaaguacacuguagcuguccucagacacuccagaagagggagucagaucucguuacggaugguugugagccaccaugugguugcugggauuugaacuccugaccuucagaagagcagucgggugcucuuacccacugagccaucucaccagcccucucauucauuucuaaagaacccucaaguggcacacaaaucacuuuuuuuuuuuaauuaaauguaggugugcaccugaaugcaagugaguauaggcgccagaggagacccaaguguuggguccccuguaagugguauuucugacaguuguaagcugccuggcauuggugcugggggccaagcuccacucccuuggaagugcagccugugcccuucaccacccacugagcgagcaagccaucucugcagccccagcuccucuuguuuuguuuuucaguucuugguuuuguucuuuuuccuuuguuguuaugugguugguguguuugggggcugggauaagacagggucucacuauccagcccugauuggccuggaaccugcuguguagacggcacugagcucacagagacucaccugcugccaucucccuaagugcuaggacuaaagccugcauugcacuuuuaguucuguuuuguuuuuaagauuuauuugugugagugugugugugugaguguguguguguguguguguguguauguguguguguguguguguguguguguguguguguguguguguuugcucgcgccugugcauguguaaaaaagagagagaccuaugugcgcauaugggugccuguggaugccagaagaaggugugagaccucgcucaggcugcagauacuugugagcugugguuaugccuccuuccagcagccuguuuccaggccugugauuguuccuguaaccccuguggaauacuagcuguuaggagaggagagucagguccacugaguucugugucaggcaugggucuuagaggugcaagcccagacacuuucucuacuugcacucucucucucucucucucucucucucucucucucucucucucucucucucugucucacacacacacacacacacacacacacacacacacacagacacguguccuaagcccugagcuuacaugcuaugucucuucuuugguauguggugggaaugguaauugaguccagagcuggcuaggcaagugcucuaucacugagcguuaucccugagcaccuggagcucuggguauuuuaaaccucucucuggugcugagauggcucagccuuuaagguaaaggcauuugccaccaggucuagugaccagaguuugauucccaggccaggggccacaugauggaaagagagaacuauuucucagaagcugugcuuugaccuccacauacaugcuauuacaugcuugcauguucacuuacaugccuacacacacacaaacaauaagcauaacuuuuaaaauucuaaaguugugagcuagcauguaguugcugggacuugaacuuggguccucugaaagagcaaucagugcucuuaaccacugagccaucucuccagccuaauucuaaagauaagcuccuuucuguuccacucuaggcucccaauguggcucaggagcugagugggggcugccauggcuucucccacaaguucaugcacuggcaggaggaacugcuacuagggggcacagccagagaucuccaaggacagcugcugaggucgggccuccccugggacuuggugaggggacuugggaauugacacugucaggcuaaacagcucuggacagagcaccccacagacccacacugaguguccaggcucugacucccacucccacuccccugaccagggcagaggccuugcagagcaccuuccugcucaugaguccccgucagcuguacgagcacuuccggggcgacuaccagacacaugacaucggcuggagcgaggagcaggccagcauggugcugcaggccuggcagaggcgcuuugugcaggucaguaugggcaaggcccgaggaggguucccgaggccacgccuucccccuguccccucucacucacccagucucuccagcuagcccaggaggcucugccggccaacgcgucccagcagauccaugccuucuccuccaccacccuggaugacauccugcgcgcguucucugaagucagcaccacccgugugguaggaggcuaucugcuuaugguggguccugcuucaagcaaccuugccuccccuccagcaaguuucccuagaaaucccugucugagaucucaugucgucucuccccacagcuggccuaugccugcguaacaaugcugcggugggacugcgcccagucccagggugccguaggucuugcugggguguugcugguggcccuggcgguggccucaggucuugggcuuugugcccuacuuggcaucacuuucaaugcugccacuacacagguaaaccagaacuggggguagggggccagccuuugggggccaccuccaagcuacacagucccuccagauguuugauucccugcucugccccuccaggugcugcccuucuuggcucugggcauuggcguggaugacaucuuccugcuggcgcaugccuucacaaaagccccaccugacaccccucucccaguaagcacccauccaccagcuugaacccauccagaauucaucaaagugguuaagagccucuuggucugauuaaucgugucugguuguaaccuuucugaguugagcauucucuucuccccgcauggaaauggguguaaugcuaguugugucccaaggguugacguaaaaccagugacguaauucaagacuggugcuuagaacagcagaugcccauucauggcacacaacagauguugacugcugcggccucagaauugcauuucugcugcugaguuccugagccuccacucacucugccacaguccucuguggccugaaggucugucccugcucuguccuggcaggagcguaugggugaguguuugaggagcacgggcaccagcguggcacucacauccgucaacaacauggucgccuuuuucauggcugcccugguucccauuccugcgcugcgggccuucucccugcaggugaggcgucgcgaaugggcaggcgggcuggggugggcauggagcacggagcaggcuucauccggccuccuccgccaccuccugucuccccaggcagccauaguggucggcugcaacuuugcagcgguaaugcucgucuucccugccauccucagccucgaccugcgccggcgccaccgccaacgccuggacguucucugcugcuuuucuagguacuguuccuucaugcccgcccuuucccguccucagccucgcccuagccugugcccugcccugcauuccagccuaugacccaucugcucugucugacccuuccagccccugcuccgcucaggucauucagaugcugccccaggagcuaggggacagagcaguaccagugggcauugcccaccugacugccaccgugcaagccuucacccacugcgaagccagcagccagcauguagucaccauuuugccuccucaagcccaccugcugucuccagcuucugacccacugggcuccgaacucuauagcccuggagggucuacacgggaccuucucagucaggaggaggggacagggccacaggcggccugcaggccccugcucugugcccacuggacucucgcccauuuugcccgcuaucaguuugcaccuuuacugcuccagacacgagccaagguuaguccagguggguggggcaggauggaggcucagucugucuguuccaagaagggcagagggcugggggucagcccugggccuccugcuuaguucucauuucucacaggcccugguguugcuguucuuuggggcucuuuugggccugagccucuauggagccaccuugguacaagaugggcuggcccugacagauguggucccuaggggcaccaaggaacaugcuuuccugagcgcccagcucagguacuucucccuguacgagguggcucuagugacacaggguggcuuugacuacgcccacucccaacgcgcccucuuugaucugcaccagcgcuucagcucccucaaggcugugcugcccccaccugccacccaggcaccccgcaccuggcuucacuacuaccgcagcuggcuacaggguaagaggccaagagaccaacgggcagaaauggcacagggcgccguguuuagaacuguagguggauccugguccaucccgugugccuccagguauccaggcugcauuugaccaagacugggcuucugggcgcaucaccugccacucuuaccgcaacggcucagaagauggcgcccuggccuacaagcugcucauccaaaccgggaaugcccaggagccucuggauuucagccagguaaaaggggagcugacuugggcaaggagcacuggugggcuccagaccccacgggccaggccuuuagccaccucugccuucacagcugaccacaaggaaacugguggacaaggagggacucauucccccagagcucuucuacauggggcuaaccgugugggugagcagcgacccccugggccucgcagccucucaggccaacuucuaccccccaccuccagaguggcuucacgacaaauaugauaccaccggggagaaccuucgcagugagucccaugggagcucgcccggaaccugguccucagcccacacaggcccugacccuccaaccccucacugcgcccacuccaucuggucccucugcuccuccauccucuccacagucccggcagcccagcccuuggaguuugcccaguuccccuuccugcugcauggacuccagaagacugcagacuuuguagaagccaucgaaggggccagggcggcaugcacagaggcaggccaggcaggggugcaugccuaccccaguggcucccccuuccucuucugggagcaguaucugggucuucggcgcugcuuccugcuggcagucugcaucuugcuggugugcaccuuccucgucugugcccugcuucuacucagcccguggacagcuggccucauagugaguauuggcaggguggaugggagaguccccagcagcaacccacccugcccugucuggaccagcgcuccuccugccgggagcccuggguaagcccuacccuccgcaggugcugguccuggcaaugaugacuguggagcucuuugguaucaugggauuccugggcaucaaacugagugccauccccgugguaauccucguggccucuauaggcauugguguugaauucacaguucacguggcucugguaagcauagaccccaagaggaaaggucaggugauggguuuuuaacaacaaacaacaaaauuggugagaucaccuucugugugcugggugugguggcacagaggaccuggguucaagucccagcacccacaggugguucacaacucucuuuaacucaagauccaggggaccugcccccccucuucugaucucuuugcauuagguacacaccugguacucauacaugcaugcaugcaugcaagcaaaacacauacauaaaauuaauaaaucuagaaagaauuauaaaggggccggagagauggcucagugguuaagagcacugacugcucuuccagggauccugaguucaauucccagcaaccacaugguggcucacaaccaucuguaaugggguuugaugucuucuucuggcgugucugaagagagcaauggugguacacucauauugcauaaaauaaauaaauaaauauuaaaaaauaaaaagaaagaggacuuaaaccuaguacaguagagccucgccuucauacagaagguccugaguugaagcuccaguccugaaaacgacuauuacagcaauagcauccuagccaggcguggacacacacacacacacacacacacgcacgagcaguuccaguucaugagaggcagcagcaggaacgucucaaguucaagucauuugggcuaauccgaggcauagcaagacugucucagaccuggugugcaggggcaauuccguugacaauauagccuuguucagacaagguuccaugcagcccaagcugaccucaagcucgguaauugagggugaccuuuaauaucuuuaaaaaaaaagaucuauuuauauuuauguucacugauguuuuuccuauguauaucugugugagaguaucggauacccuggaacuggagcuauagucaggugugggcugccaugugagugcugggacuugaacccaggucuucuagaaaaacagccaaugcuuuuaaaccacugagccaucuugguuuagccuuguccuaucggugagcauucaacuacugcaguauaccagccccagcuuuuauuacagccaguuauuacagguaugcacaaccauguggggcccaguuccuacaucaaguauugacuguaucccauuuauauguuuuuuaaauuguuuuuuaauuuuuauuuuauuuuauuuuauuuauuuauuuauugguuuuucgagacaggguuucucuguauagcccuggcuauccuggaacucacucuguagaccaggcuggccucaaacucagaaauccgccugccucugccucccgagugcugggauuaaaggcguguaccaccaugcccggcuguuuuuuuuuuuuuuuuuuuuuuuuuaauguguaugaguguuuugccuguacuuauauaugugcacugugugugugccuaaugcacaaagagaccagaagaggguguagagugcccuggaacuagaguuacaaaugauugagagccaccaugugggugcuggaacuugaacccagguccucugcaagagcaacaagugcccucagucaccaggcuaucucuccagccuuaauacuuauaucuuagguagucuagauggccaggaacuaaauaaauaagggccauaucuauaugagaaagaaaugaaggccuaucuggaauaguuuaaagacagaaugaggggcuggagagauggcuuggaagugaagagauggcugcucuuccagaggaccugaguucaauuugagcacccacaugguggcucacaaccaucucugaugagaucuggugcccucuucuggucugcaggcagaccgcugucugcauaauaaauaaguaaaucuuuuuguaaaaaagggaucaggacuugcaugaauaauaauagcacuguggguaugcaggagggauucuacugaaacaaaugccugagaggcaaagaaggcccagggcuccccuagagcuccacacuuggaccagcuaaagcaccagcacaccgcucuccacaguagccuuccucucccguccccacagccccacaguaacaguaagaacaaucucugagcccgcggugauggcacacgcgguagcagcagugcuuuaauggaugaguaguguacuucagccaaaccugaccagacaucauugacaccaaccugggcauugcucuguguggccagacacaucucuaguguuaccaaagugcacuccacaaugcuuccagaccauccccaugaagcuagguggccuggcccucugugggggaaggccugggugcacccaggaauggagaaauacccacgggggacacuggcuguuuagcagaggaggaacuccagggcucucuucucuccccagggcuuccugaccagccaugguagccggaaccugcgggcugcuagcgcucuggaacagaccuuugccccugugacugauggagcugucuccaccuugcugggucugcucaugcuugcugguucuaacuuugacuucaucauaagguacaagagggcuccggaagaggggacugcccacccuggccucgggugaccccgaggccuggccaccgacccucgcgcucucgugcagguauuucuuuguggugcugacggugcugacacucuugggccugcuccauggacuccugcugcugccugugcugcucucuauccuaggccccccgccacaggugaccaaacucuccuguccucacccuaagggacaggguaguaaagcaagggagggacagacccauaaccaaaggcccucaguggcuagcagagggcucagcucugaagggcccuccuaaaagagggcugaaagaggccuccucggaugcugggcuccugccccucagccuucagugggacuggccuuacuuagccuuuuaggacccagggcagaagguggguuuggcaggccuugaaaucuucaugcucugugaaaucugaccgggagccuggcuugggacuggugugucuuucagguggugcagguauacaaggagaguccacagacccuaaacuccgcugcuccacagagaggugggcucaggugggacaggccccccacccugccccagaguuuugccagagugacuaccuccaugacuguggcccuccacccaccaccucugccuggagcauacguccacccagccuccgaggagcccacauagucuccugcugccgccccagcacaaccucaguuguagaggacugggucuagccaccgagugaaagagugucagaaccacagagaccugcagggccauacagagucacugggacgcaaugggugagguauggagugcaggauggaccccuggagggccuuaugcugcugucuguaucuccucccgacuccacacaccuagcugacacccaaaaagaauagcuacugcuuggacaagaggcucccagcacauagggacucacgggagcucacgucuguauccagguugggccgagaggcuccauucuggcugcagugcagcccuguccuguucugucccacacugucaccucaguagaugaagccugaggguuuccagcacauucucccaucccuggccuuucauugcuugaugacuccuagggaggcccucuguuccccucccuaccuccuaccauauaaauuauuuauaugaagauguuuauuuuuguauauagaugcuaucacugcucaaaguucuauuuuuaaagagugaaauauauucuauacaaacucaucucagauggcuggaguuuuucuuagaugacuuuuaggggagugagcaucagagguggcuuguggggugucagggccuggacuugucuaguucuggguggggacgaccucagaugcugaaguuuuaucaaaauaauugggucggcauaaaugcuuaguauaaggugcuaugggagccucaggugaccgugcaaacauggccaaguccaagaaacaccacacacaaccaguccugaaaaugacacagaaacgcaccaagaaaccccugucacaaaucucccaaggacaccuaccccaagugcccgaggagccugugcuuugccaagaagcacaagaauucuaggccugaagaagacacaggcaaaggcagugcuugcgcacgcaucaaagccccugugaagcccaggugcuaaagaccccagcugcacacucagacaucugccuuucaucaugacccccccacacacacuugggaagcauacucaaagcuacauggcuaagagucguaggcucugccaaccaaagcccaagguucaaaccaaagcagaggcugcagcuccagguugggcucccagaggugcacaggucccuguaaaggcuccauagaaaaggcuucuaucuaccaaugugagacagguggacuggugugacacagcuacacacuguuugcagaugaccagugcucugugcuguuuuuacaaauaaacuagaagcaagguc

SEQ ID NO: 2060 - RNA, 1151 nt, Mus musculus
cauuugaaacgaagguccagaaagcgauggugaucccggggccggguaccccuccgccggcggcacggcgcgcuccgggccgcaucuccucuccguagggcgugacacuuccaugccuccacaaucuguucaaccuguaggggaaagcgggucaccacgcagaccgaagucccaagccucccgcccuugcuccucguucccacguggcagaguggaucugaguuugguuacuggcguccgcaccgggaugagcgguucccgucgguucugcucuuccagggcgcuuagcuccgccggggcaagcaaagccagucucagcucucggaccacuggagcugccaccucagccacggguugcucuaacaccgccuguggaagcgagccuugagcacgugccugcugcccgcuuacagaguucccguggccugcaccguuucgguguccucgcccuccccccaggucccacucacggcgcccacgcgugcccagcuucgggcugccuggacuagcucagucucauccacgcagagcuugucacugcguagcacaggcagcagcgcgguggcggacagcuccagaaagccacgggugcggagcgccuccuaugggccggugugucggucagggcagagaaaaaauggcaugggggggcuacaaguuacaaguauaaggauggggaguuguaccuggcugugagcuucuauaaaggcuaugcaccgcuccuguagugaccccaggccaaagguuacagcaaccugagagcagaguaugauuaggcuagagacugaagaagcuggauaacccagauuugcacacaagguacugccacugagcacaaucuaaacagaaggcuagcagcaccugcagugucuccugaaaguaggcaaagugccuugugcagagcacacaggugugggguagaggagaccauguucaggucuuucaaacuccaucuuugagcccaagcuuggcuucuaaacuccacacccccaccuuucuacuauccauguuuagaauuguuuuguuguuguuuuucaagacagaguuucucuagguaaccuugguugucauggaacucacucuguaguccaagcuggccuugaacucagagaucuaccugccucugcuuggauuaaaggcaugcaccacca

SEQ ID NO: 2061 - RNA, 5888 nt, Mus musculus
uggcgcgaucgcagcguagagaaaccaggcagcgccacgcgcggccggggccgggcggaaccgagaaccagcucggcaggcgcugcgccgcgccguccgcauggagcccgccgccggcuucuugucuccgcgccccuucccgcgcgcggcugccccguccgcgccccccgccggcccggggccgccugccaaugccuccccgcgaucggaaccugaggugcuggccgggccacgggcgccggauccuccuggucgccucaucaccgacccucucagcggccguaccuacaccaagggucgcuuguugggcaaggugggucggggcuccgggguagcguugacggagguggaggggagcucugcggacccgaccgggccacuccggagguggagaggagcucuacgggccggauccggccacuccggagcgcccagaucgaugaugcagcuucuucuuucuaggggggcuucgcacgcugcuaugaagccacugacaccgagucugguauagccuacgcggucaaagucaucccacagagucgcgucgccaagccgcaucagcgcgagaagguggguccaggcccugcgguccaagggauggggaggggaugguggcgugggaacccuggaaagaugaggauuucacuccccugucgcagauccuaaaugagauagaguugcaccgagaccuacagcaccgccauaucguucgcuuuucacaucauuucgaggaugcugacaacauauacauuuuccuggagcucuguagccgaaagguccggaaugggggcgggguggguucauugggaacagggguaggggaggaagcggguucuuaagauccaaagcuguucuugucaucuuuagcaaacacagauggagggagggucugggaaggcaagcggggucugaaacagugacuuucugcagucccuggcccacaucuggaaggcccgacacacccuguuggaaccagagguucgcuacuaccugcgccagauccuuucuggccucaaguacuugcaccagagggguaucuuacacagagaucucaagcugggugagauuccugcgucuggucugaaggguggagaccugcggagggaugaaaggcguuaagaaucugacgcgucucucugcuacugucuaggaaauuuuuucaucacggauaacauggaacugaaggugggggauuuugggcuggcagcucgauuagagcccccagagcagaggaaaaagugagugaggggaugguggccacagccuguuugugacacagaugauguacaaggugaccagauauguacuugggauaaccagggaagggguaaugauggguuuucuguaugugugacaguagagguggcaaccuaggucacuggguuaggugaagaaggacagcaaucuuaugaguguauggcacagaugggugucuaggauuuuuggaaauguauggggaaaacauaggcuaggcagucagcauguguaagacacugaaugggaaugacagaucaugaugguaccgugauaccuuguguguguaugugacccugcuguggucacugggacaggguguguguaacuagcaugugaggcaggugagucuuuaugaagguuaugacagcugguguuggcacagacagugggaggugacagccuagugaguauuugcagaugggaguggggggagggcucagucauggacccucuguauugaccuugggagaggggucuuugaugggucagggccuccuguccugcagagcagcugagcagcugggcuagaggggugggugaggguucagcugccguguucucagcauccauugucccaagacaagcaggagcucucuggccuuuggugacaggcagcugcuuugucugaacucacagcaggggcaggaaugggggcggguaccagcacugggcugggucugagccuugcucucucugcucugccuuuuucaggaccaucuguggcacucccaacuacguggcuccagaagugcugcugagacagggccauggccccgaggcagauguguggucgcuugguugugucaugugagugucagucauugguggacaggugguaagugcauggauggggggggguccccacuacuuuauuccugaucucccauuccugggcauagguacacgcuccugugugggagccccccauuugagacugcugaccugaaggagacauaccgcugcaucaagcagguucauuacacgcuaccugccagccucucccugccugcccggcagcuccuggcugccauccuccgagcuucacccagagaccgcccuuccauugaacagauuuuacgccaugacuucuuuacgaaggucugugguucuccagacacuggaguucaguguucauguuccuagaggacacacaggaacagggcccuugggggucucacugacacuguuuuccugacucucuuccucagggcuacaccccugaucggcucccggucagcagcugugugacagucccagaucugacaccccccaacccugcgaggagucuguuugccaaaguuaccaagagccuguuuggcaggaaaaagaacaagagugagucaggugccagugggcugaggguauagagcaauagaguggcuuaguggcuuguuacauucagggggaggcgggguggggggggugugcuuccagggugucggugucuucagacuccagggagagcaugugcugucuagacacuugggaagaucugcccgugugugaacacuuucaggcaggacccagagggcuauuuucuccuucacccuccagauaagaaccauucugaggaccaggauaaugucuccugcuuggugaguggccucaugcgcacauccaucggucauccagaugucaggccggagguaagaugcucacgugagccauuauuccccugacucacccugacccuagcagcugagggaagcccagcauaaaaggcugaugaagcaucuaaccucgugguggccuaauuggcugugucucauuagccagcugaggcugaccuggggugcccugagagccgccagggacagggcugggccauuggacuuucaaggauuuggauuuuggggccuaauuuuauucccucucuccccaacuguccaggcuccuguaguuucaggccaggccccugccagcuugguagagacagcugccgaggacagcucgccccgugggacacuggccagcaguggagauggugaggagccacaagaugagaggugcuaggggcugcugagguagagaccaggggcugaaggaaguaguuggcugagggugaacugggcccaggguggcucuugccuaaaugucagugcccuauucccuucaggguuugaagaagguuugacuguggccacagugguagagucugcccucugugcacugagaaacuguguggccuucaugcccccagguaaggcuggacucuggugcauaugaauaguuugcaaguccagaggcggugggggggagggggguugggggagucuucauuucccuccucuccucuuaacagccgaacagaacccagccccgcuggcacagccagagccucuggugugggucagcaaguggguugacuacuccaacaaguuuggcuuuggcuaucagcuguccagccgccguguagccgugcucuucaaugauggcacacacauggcccugucagccaauaggaaguaagugcuguuuuggcgugcuuuguaauuaggcuugcuggguaccacaauaccagcaggguugcaccgugguguguguuucugugcuuaggggucuggggaagaaugguggugccggguuccuccuccuccucucuacguucccacuuucaggacggugcacuacaaccccaccagcacgaagcacuucuccuucuccauggguucugugccccgagcucugcagccucagcugggcauccugcgguauuuugcguccuacauggaacagcaccucaugaagguguguaggcugcggugggggcacuuuagggggcagggguggcucaaagguaguggcugagggcuggggagauggcccagcggcuaagagcauggacuucacuuccggaaguccugaguucaaaucccagcaaccacauggugcacaaccaucuguaaugggauccaaugcuuucuuuuugaugugucugaagacagcuacagugcacucacauacauaaaauaaauaaauuguguaaaaaaaaaaaaguggggcuggagagauggcucagcaguuaagagcacuggcugccccucagauccugaguucaauucccagcaaccacaugguagcucacaaccaucuguaauucuguaaugggaucugauguccuuuucuggugugucuaaagacagugacagugcacucauauauacauaaaauaaauaaauuaauuuaaaaagcuaguggcuuuuagggaaaaaaaaaagcuaguggcugaaccuguaagggaagggggcauccauagggagagacccagcucaugccaguccaggggccugacuugccucuucucccaggguggagaucugcccaguguggaagaggcggaggugccugccccacccuugcugcugcagugggucaagacugaccaggcccuccucaugcuguucagugauggcacuguccagguaagagccuacccugugcuuugguggaaggucugguaucccaggguucugggaaggaauguggaucugguguccaaguccugaucgcuguuaucuucuguguacaggugaacuucuacggggaccacacgaagcugauccucaguggcugggagccucuccuugugaccuucguggcccgcaaucgcagugcuuguacuuaccucgcuucccaccuccggcagcugggcugcuccccagacuugcggcagcgacugcgcuacgcucugcgccugcucagggaccaaagcccugcuuagguuccaacucggagagcgggcugugauccagauccugggccugagccugaaaggcuucagggccuugccuuuguggcccuuccugucccuuuggugccucacugggggcuccuggcugaauccccccagggaaucagggaccagcuuuacuacagucggggauggccugcccucccugaaucuuacccuucucucugagauaagccugagccuuagcucccagcuagggggcauuauuuauggaccacuuuuauuuauuaacagacauuuauuuauugggaugugagccccaggggggccuccuccugggguaauaaaccguuuuuucagaacuugaaggccuuaucauucccaguagaccgcguggacgguagccacagcaaacagagaaggguuggugaagguggcagaggccaguccaucgugcaccgcaucccagagugcucggcugaccacaugcacacccugucccucgcguggccccagcaccacguugcacacgaguuuguagcgggguagguugagcucccucacgcggguguguaucuguucacauagugccugcaccaguuucccugccucagaaccgcaguagcacacaccguucagcuguguggucagugcugccuccagggcccgcugggcaccugcagcuucccaguguuccccaggcgccgguucuaagcgguaugagggugccauccuacggggaagcaucaggggcagcccagaaaaacuaacucgugaaccuagagggggcacugggcccagggauggucgucgaccuccaggacccacuaagggucccgccagugaguugcggcgcgaaaaggauggguguaggcccggcagggagccacgacgggaggcugggccugggccuauaggucgggucucaucaaugcugggc

SEQ ID NO: 2062 - RNA, 23009 nt, Mus musculus
cggugcgucgcacuggugacguuguagggaggcuggcgcgcgggauuuaaacugcagcgguuuaggcguuguuaacacagcgcaguauuagcagagucgugguuuccaagcuucuuucauuuguguugccuguuguuguuccugaguccauggagucgcuucacgcacgccuguuuccuggucucuccaucaacauucaacgcagcaauggugagggcagggucuugaggccaaggggacgacccaagagcggugagacugccaagaugguuaucugaaucuccguguggcaaagcuuugggauacuuucccuuauuccacacugaggggguccaugucacuacacuggcagucgguguccccuacacaggaggaaaacgcuacuuugguugugggucccuugccugcuuucugagugugggcggagcacgucugcgguuauuggugcgccuagcuagguuauagcgauuggaugcauuuccucugaaccuguuuugcuuuguuggacccgcggcuuccucggccuccugagugcugggauuaaaggucaugcacuaccacgcccggcuuuuuuuuuuuuuuuuuuuuuuuuuuggcguuuguuuugguuuuucaaggaaggguuucucuguguaguccuggaacuccuguagaccaggccucgaacucacaaauccccugccucugccucccaagggcugggauuaaaggcguugcaccaccacugcccggcucaaccaucugucuuuauuaagcaauuucuacaggucuaauaacgggucauucauggacuagccaaccacugccaaaaauggaccagggaacuccagcgguccagcucuuuacugauguguucaggaauagcuccuccaaggaauguaguaacuuacuugcucaaaugaaucuucauucuguuggagcggugaugcaauuuuauccuauggagcugggguuuaaggcccauucccuguucacuuccacuguggaauggucuaagggugaaccccacuagaauuacuaacuagcauuuguguuuuguuuuauuuuuugagacaguuucucuguaacagggccuuggaccuggacuugcuuuguagaucaggcugaccucgaacucacagagauccaccuacuguacuuugcaagugcuaggauuaaaggcaugcaccaucacaggccuaguucuuugguguuuuguuuguuuguugcuuuuuaaauuuauuauuuuauuuuauguucauugguguuuugugaaauccucuggaaguggaauuacacuuugacaacaggguuucucuguguagcccugucuguccuggaacucacguuguagaccaggcuguccucacucacagaacuccucaggccucuaucccugauguauugggauuaaaggcaagggccaccacugccuggcuguuuguauuuuuuaaaagagaauuaaauuuucccuuccggagccgggcaugguggcucaugccuuuaaucccagcacucgggaggcagaggcaggcggauuucugaguucgaggccagccuggucuacaaaguaaguuucaggacagccagggcuauacagagaaacccugucuugaaaaacaaaacaaagccgggcgugguggcgcacgccuuuaaucucagcacucgggaggcagaggcaggcggauuucugaguucgaggccagccuggucuacaaagugagcuccaggacagccagggcuacacagagaaacccugucucgaaaaaacaaacaaacaaacaaacaaaaaaaaacaaaaacaaaacaaaacaaauuucccuuccgagguaaauguaaauuugaagucuuuaggauccuaaaagcaaaguggagaauaaaaacuuaaguuuggccaggcagugguggcgcagucaaaaaaaaaaaaagaacaccuuaaaaaaaacuuaaguucuuaggagacacauggauaacuucugaccuucucauacauaggcuuaauucaccccgccaauauaagcacagugaacguggagaaauccuguguuucgguggaauggaucgaaggagguaccacaaaaggcaaagagguagguccucugaggaugcuuguguggcaucucccaugauccugugcagagcaucugugugaaccggugacagcccagccuaaugcugugcuauccucuccagucuuaagaaauggugcucccuggagacauugggauuccuuuuagucagauguucuaaauugaagcaauuagccauuucugguuugucuauggagagcaaauugcaucgaacccuaaccaaggcucugcccacucaccuaagcuugaguccugaguacacaguaccagugucaguuuggguaacaaaaucugcaacccaggaaaggaaaugaaggugugguuuugacaagccuucaaggcauaaagccgcuguuaauggauggcacaggugagcaucguaagagccgcuccagguugggacuugcagggaucgugagggcuuagcugaagcaguacgguggcaugccucagccagagggcagaaugacagcacuggccacaggcagagcagacucagcaggcgauggcagcaggaaaaugccuggaaagggaugggaggaaggcauugugaaaaugucucucugaucugugcauauaaacccuggauuucuccucugucucugccucuuuuuuacaugagcuuagucacauuuccaccuauaaagugaaggugacaaugucuaucucagaauguugugaggauuuaaccacaaaguccuccuggacugauuccaaaaugauagguaguguguggaggccuggggguguaggugacuaaggugcagucucuagugguguuuuagagggugacacagcaggccugugguggugcauacccuuaaucucagugcccaggagccagaggcaggcagaauucuauguucuugaggcuagucagggcuacacagugaaagccuugucaaaaacaaacaaaagaaaaguauuuguuuguuuguaugaguguucucucugcauguacaccuuucaugccagaagagggcaucugaucucauuacagaugguugugaggcaccaugugguugcuaggaauuuaacucaggaccucugguagagcugucagagcucuuaacugcugagccaucucuccagccccagggaaauauauauauaauauauaaauuaaauacauauacauauuauauauuuuauauuuauauauauauauauauuuuuuuuucuuuugguuuuuugagacaggguuucuuucucuguguagcccuggcuguccuggaacucacuuuguagaccagguuggccucaaacucagagauccgccugccucucucccaagugcugggauuaaaggcgugcaccaccaugcccagcuaaaauuuguuaaucuuuuuuuuuuuuuuuuaagauuuauuuauuuguuauauguaaguacacuguagcugucuucagacacuccagaaaagggagucagaucucauuaugggugguugugagccacuaugugguugcugggauuugaacuccggaccuucgaaagagcagucgggugcucuuacccgcugagccaucucaccagccugggaaguauauucuuaagcuuuaucaguuuuaaauauaaacaaaagugggcucuauuuggugcccugugucauguguggugcugcagugugacuucaggcccucucucaugcaaaggaaacacggcugcugagcuccaucccucagcccaggcugcucuuucaaaccugaguaaugcugguaaagucugaguuguuccuaaagagguacaggacucuggugauguaaacccagaauugugaccucaucgugggugugagcagggacuaggaaaggcaucaacuggaagaugugacugggaagaagucucugggcccaguagaaaauguagguagacuuaggguuagguagcagcuuucgggaacuuacuccugcuuauaagauccuaaggggcccuccauuuugauaucaccagcugguuagaacuuguuuccuccuucgugucagccagcaagaagugcucagggggcuguggccagcaggacgucacugcccagcagagcaguaggagagccaagugguguaggucugcuguggacuucugugugccugcugucugcuuucuucuccaccucauccuccucacucacaaucuucuguuggcuuggaaacuggaaccccauuccaucuagaugguaaaccauuucuaaggaauaacuauuuuguaguggucagugcuuuaauggaacuuaagguugguaaagccuccaucgaucuuggguggucuugaucacagcaauucauuuagaucaagcagcgcuccuucacccagacuuauugcccuugcagauugacauugacgauguggcugcaauaaacccagagcuccuacagcuucuucccuuacgaccgaaggacagucugccacugcaggaaaacguaacggucccgguaagugccugucaccacauugcaguugcugucccugaagagccacuuagcuugguaccuucuugcugauuuuugucugggucugccuggggccuuauccuaauacauaggcucaugauagagcuaugauuacugacaagagccauauauuguggugauuuguucuguuuuucagaagcaaaaacgcaaaucagucaacuccaaaauuccagcucuaaaagaagguaaaugauugacuguugucacggugguuuugcugugggcgagauuccuagggcucagaguggaagccagaguagucacauuaggaaacccuaacugagcaugugacuucuguauaagcugaguucuguccuuugugcauccaucuuucucagccauaagaacucaaccuacuccuaaccuuugagagaaguguauguaugacucaggcguuugcuuucaggacacuuguccugugcuggggagagugagcucagcuacuuccuuuccucagaacaaugcgccuuacagugaggucgugaggaaagcguagguguaguuugggggcuauuuggagaaucaaugggucugaauacagugaugugugccuaugauccucauaggaagcugaggcaggaggauugaaaauuccagcugcuuugggcuguauaaggagaccauccccuaaaaauaaucugggugugguauuguauacuuuaauccuagcagagacagaggcaagaggauuucugaguuugaaaccagcaaguuccaggacaaccagagcuauauaguggggcccugucuaaaaauuuaaaguaauaacaacagcaacaauaauaaucauaaacuuaaaggugaagggcuggcaagauaauucagguaaaaggauugugugccacaguccugacaaccugaguuuaaucuuaaauggagaacgagaaaagguaacagagugucuucggcucuccacacgugcuccacgugugcagcuucacacacacacacacacacacacacacacacacacacacacacacacacacacacacacggggccugcaggaagagcucggguaccaucccagugcaagucucacaggauguagauccuuuccugguugguugguucuuguugaucuuagcggcauggucccacacaggcagaaguacuacucacuuuuggaagucagugcccuccuuccaccuugggcuccguggucagacucaggucagcaggcugugcagcaagcgcccccugaugaguuguggguuuuuuuuuuuuuuauuuauuuuuuaauguuuuagauucuucuuauuuuuuuuaaauucuguauuuuuuuaguauaugcuacauacaaaugcaggugcccaaagaggcuagaggcaucagaaucuuguagagcuagaguuagaagccauugugagucacuuuagucuuaacugcugaaccaucucagcucugguauccagguuuuuugagaaagggucucuuguucagccuguccuggaacucacuguguaacccaggcugaccucuaaguuguaggccuacuaucucagccuucucuaaguguuaggauuguagguguuggcauucauucagccugacuuggaaaaaaagauuauuuuguuuguuuggcauuucaagacaggguuucucuguguagcccuggcuguccuggaacuuauucuguagaccaggcuggccucgaacucagagauccccccugccucugccucccagguacuagaauuaaauguuuguaucacuaacuugaagggcuuuauagaugacuaauuguuucucugucuuacuacagcuacaagaauucagguguuggggcuggagagauggcucagugguuaagagcauuggcugaucuaccagaggaauuagguucaauucccaucaccuauauggcagcucacgacugucuauaacugcaguuccaagggauuugacacucucacacagacaugugccagcaaaacacuaaugcccauaaaauaaauaacauacauacauacauacauacauacacacacacgcacacacacauauauauauguauguauguauauauauauguauguauguauauauauauauauauauauguucaguaacagcuuaccuaugucucaguuauaaccuuuccuugagauuuccgaauaguugguccaugggcuucugaagagguggccugucucaguccugauaaagcacccuaggacaguggggaaagcccagauuuugucaugacagcccaucacacccuggcuuuagccauucuggcuucuucucauucucuggcuccugacuucaccugugucuagcuuguucucuucaaccugugucuuuaaacuccccagucaaacugucuccuccuccucucccuuucuccccauugcucccuaagcagcuucccuuucccuucucuucuaguggcagauccuggucuguuaagucuuucucugauucaucacuuugucugccccucaaucggaagucauuuucaaacaugcgugcuuccuucuacaaacuaacuuuacucucauuguuugggauuaaagguguguacuaaggguaugucugcacuccagccagagggauuaaagaacaagaaacaguuuuccaguaaacaacacaaucuuggcauucacaaugugaucaagauauccugcaacagucacguuaacccugagccaucucuccaucccuaaaaauauaaagugaaucuuuuaaaaagcccccccccccccccgcaucaagacuuagaagaauagguuuuccucuccagaaaugauuuuagauuugcuguagguccuuccauuuauuuauucauccccuccuuacccuccugacugccucccauacuaggaauugaacccagggccacauacauucuagauuagcacuugaccacugagcuauauugccagcccaagacaaauguucuuaagggagauaacuuugcccacaggagcacaggucuaccaacugcacaaauaguuugggguagcaguucuuggucuuccaaagugcuugcuuucccggacucauuuccggguggcuaggaucuggccugccuuguguggaagcugcugcuuuagcucaucuuguagcacugauugaucccuucauucuuaggccuucgaagccgcuccacucgcauguccacugucucagaaguucgaaucccugcucaggagaaugaaauggagguggagcugccugugccuacaaacucucgcaagcaguuugccauucccagugagugaugaguguguucuuguguaagcccucagcagcuccuuuugcuucacaugagcccacugcauucccagggucccggcaugcguacuucaggaugggcuuuguccugaagggaaaagccuccgaggcugccugacucuacagacuugagccaagcauggcuucucaggccaagccagcccuuucugacuuuuccaaagccccagaaaccacgugguuagcagaaguggcgaaggugggggagaagaaaacaacauggaugacgaugacugcugcuugggcaacaguuaacucuaugggcucagugaaccagugacugugguugucgcaauuaagaugccaguacuuaagagauugccacggguuugagaucagucugggcuacagggugaaacucugucuccauauauacacaugagcacucaugccgugcacaggcacacacacccaccaagaacaacaaaaauucaaacuggaaaaaaaaaaaacagcagaaaggaugaucuaucaccccuuccugcccucaugugugguccugauccuuucauguagauggauuuaauacauacaacauaaucuagugccucguaaaaucuucaucuacuuuacccaaccaguggagagagcccuuuaauuaaaauuauuauuggguugggguuauagcucaauuguuagacugcuugccuggguuccauuccugguggcacauaagauggcauaguggaccucaucggagagucuagcgcucacgcggcaggaggauuacaaguuugacuuaaccucaguucaaucauagugaguuggaggucagccuaggcuaugugauucccuguuucaaaacaauuguuuugggacagggucucucuuuccuucuuuacccugugauagccuagaauuuacccuaggcugcccuuggacuuggaaaaaaaucauccucccuuagccuuccgagugcugggauuacaggugggagcugcuuugauguuuaguuuaugguucuugagccagguguggucccuggcuggcaggugguuggauucgggaugagggcagaggaaaagccuaaauacggcccuuggccccccacccccacccccgagauucaaggacaacugcuccaugcugcccgcuucuccagugacucuuguucuuccacugcaggccacccucgggccuccugcuccacagugacagaauugccguuguugauggucagugaggaggcagaagagcaagcccacuccacccgcaguaccucaucugcaaacccugggaacucagguagauaggcugggcccugugugcuugcccucuagcacaggacaggaguuaacacugggccugccuggguccaaguucaaacccuuuuguuaccuugaagguauguuacccagugcuuauggacugagucuuccacaagacacaguuuguuagaagccauuuggugagauagauggacuuacaacccagaggacuuucccuagugcagugggaauggcuucuuuuuuuuuuuuuuuuuaaauuaagauuuauugauuuuaugauuuuagccagauguaguggcucaugccuuugaucccaccauuuggggagcagaggcaggugaauuguggguucgaggccagccuggucuauagagggaguuucaggacagccacagcuacacagagaaaucuugucuggaaaaacaaacaaaaagauuuauugauuuuuauuguauuuuuuuuaauguguaugaguguuuuaauuguaugcaugucuguguaccuggugccuguggaagucagaagagggcaucagaucuccucgguugugagcuaccauguagaugcugggaaucaauccugggucuucugcaagagcaaauggucuuagucaccgagccaccucuccagcccugccucauuuugauucuacaggaacuagcugcauaagcauaaagagagcuuaggucaaaaccagagugggaugauuaucacucugacgucacucuagcccaguuagugcuccauggacucguccaucccagggucagagcaggugcuccuugcauuugcuggugggguauuggugagguggcugaacaaugaaaggugcuugccaccaagccugaugaccugaguucuguuucuggaucccacgcaguaggaggggagaacugacuucuaaaaauuaaaccugacuuccacauguauggugugcaugagcgugcguacaaauauacacucuaauuuacaaauaagccggacaugguggcucacaccuuugaccccagaaugugggaggcaaaggagggcaaaucugaucuauaaaggagaucagccugauguaucuacagugaguucugagauagccagagcuacauggaggaaaaagccaaaauaagcagaagcagagagggucuagagaaagaugaccuguuuuaugaaagauccagugcucagggaauagccagagacugacagagggaacccgguguguuuccuucucuucuuaguucggaggaaaucguguaucgugaaggagauggagaaaaugaagaacaagcgugaagagaagagggcccagaacucggagcuaagaauaaagcgagcacaggugacugucgggagauguggucgagaguuuccgcacaggucccuaacagaugugcagucagcugaugaccagcugagccauacuuggugcugauuggccagugggguagcccaucuuguccucacaagguguaaugcuuuugcugggcacaccuacuugcuuucuuguccauccccuguaagcuguauuaucacagggugaaaucgguggcaaagaaggcuccuuagcuggguaacugcucugaggaaacccauucuguugcuuugccuccuaagauggugaaagcagcucucguccuuggugcaugccuaugcucccccacaguccugccucagaacuuugugccuggcuucucagacuggagccggggugaggcacuccuuagcugcggagcuguugcugccugguagcucugggucuaagagcacccgcaccugaacuuuuguccuucugucccuccugccucacacaggaauaugacagcagcuuuccaaacugggaauuugcccggaugaucaaagaauuucggguuacuauggaauguagcccgcuuacugugacagacccugugaguauaccagaaagucuccuccucuucccugagcagguaaaccacugaaggacaaagagaaagcaugcagggaucaccaugcagucuugaguguuaucugagggagugcuucucucucucucucucucucucuuuuucuauguguguguguguuaauggggauugaauuugguacuccauauaacugagcacagucuccccuugagccauaucccugguggggccucccaacacuuuuuaaagauagugucuuagggcuggagaaauggcucaacaguuaagaguacuuguucucccaaaacaccgggguucgauucccuacaggugucucacaaccagcuguaaauccccugcuuccugggcacugcucccaugugauacacagacauguacaggccggcacucuuacauauuuacaaaaacgaaagggucacacuuuagaacugccuggccuagaacuugcuguguagacuaaacuugccuuaaacucacacaaaucugcuugccugucucccaggugcuagaauuacagugacauggcagaacacccaguaaacaauguccuuaaauuagcuuuguuuccccuggcagggugcuugugcucacucccauauggaugacaggacagcuugcaggacucaguucucuaacguguguguguguguguguguguguguguguguguguguguguguguauguguaugugcgggugcgcgugugcacgugccagggauugaacuugggucuucaggcuugguguccugacugccuguaucugcugagccaucucccaggcugguuuuuguuuguuuggcuggauuuuuuuccccuucuugagacagagucucaauguauggugagauuacagguauaugcugucaaacuuugccuuaaaaaaacaaagcaaggccuagagacaugacucagcaguuaagagcacaggcugcucuuccagaggucaagucccacuaaccucaugguggcucgcaacuaucuauaaugggaucugaugcccucuucuggugugucugaagauagcaacaauguauucauacaauagaauacaauaaacaaauaauucucuaaaaaaauaaaaaccaaaaaccaaacaaaauucuggggguauugcaccuguguggccaugccguggagaaggucaggaacagcuuacugaguugggccuccugucuuguggguuccagguauggaacugaggucauccggcuuggcaaaggagcucuugcccacccggccaucucagcagcuagauuuuuuguuuguuuuuaaauacuuuaggggagaacauuaguuaaggcucagaugaggcacucgcucucugcuuuaggcuggccugacugcuaagggcuaguugaguagugcugaauccuugaaggccauggaguaagagaacgagggccauucagaaugacuuucuuguccccuagagugguuaacaggguucuaguaucagguuucuuugucccuugcuagagccaagaaagggguuguggauaaacucugcuuugguacuguucugaccucccguuggcugucucccucauucucuugcagaucgaagagcacaggaucugugucugugucaggaaacgcccacugaauaaacaaggugagcuguugagucagaagcagagggcugacugagaggaagguccuguguucagagagcagccccugaaaucuucuccuucugcagaacuggccaagaaagaaaucgaugugauuucuguucccagcaagugucuccuccuggugcaugaacccaaguuaaaaguggacuuaacgaaguaccuggagaaccaagcuuucugcuuugacuuugcauuugaugagacagcuuccaaugaaguugucuacaggugagcccugugcucucgcuuauccuccucaugccacuuucucccccaagucucucucugucugacagcggacgucgaacuccucccugaucugucgaguuuuacuggguuagcucucugauucaggagcacuggccccucuaacugugaggucuuguuugggaccugccaugucaccuuuuaagcuauagcagcccagccuuagaugacucaugagugagacauuaccacugcacugaggaucauggguaggcaccagcaguucucuucgauguuuuguugggacaagagcucaucuguagcccaggcuauccuagaccugucugugcugcucgcucacauggucuugaaccauagcaguccugccucagucucccaagugcugagauuacacuuuccaaugguuuaugcagcuaccucaugacccacaugagcuuagcagccucagguaucuucagaucuacucggugcagugugccacucagcaccuaagcuuacaucuuugguugugagcuuagucuuucaugucugagccaucucuccgucccagcauuuaauucacagugaagguuucagggaggggguugguggugggguguguuuguguggaugcaugaggagaaaauggacaugguugugccaugguguguguguagaagucaggacagcuuugagaggucagcucuccuuccacgagugcagacuuagacagaaagcacuuuuuaucagcuaagccccagccuucaaggcuuugaguuugucagacauuuuuuuuuaaaagagguuuggaggugcagucuuacacuucuggugcuggggaagcugagguaauaggucuugacauuggccaggcaguggugacacacaccuuuaaucccagcacucgggaggcagaggcaggcagauuucugaguucgaggccagccuggucuacagagugaguuccaggacagccagggcuauacagagaaacccugucucgaaaaaacaaaacaaaacaaaaaacggacacaggaggguuuggaacuuaaggccagccuaggcuauagugugagauccuaauuaugacagacauucuauguaguucacauacgacauauuuucggccugguuuucuuuugcccuuuguaauacauccugagcaguggggucagaggaggggcuguuuggcuuaaagucuggaucaucagcuuguuccugguaggugaguuggacacugccugcacccuuuuauuuagcuaguaguacagauugguuagugggauggaucaggguagaccuugagaggaaugcucuacuuaaggaauuaagacuugcagcuugacccgggugugguggcgcacgccuuuaauccagcacucgggaggcagaggcaggcaaauuucugaguuugaggccagccuggucuacagagugaguuccaggacagccagggcuauacagagaaacccuuucucaaaaaaaaaaaaaaaaaaaaaaagacuugcagcuugacaggcagugguggucacaccuuuaauuccuuuaauuucuugaguuggaagccagccuggucuacagagaguuccaggacagccagggcuguacagagaaacccugucuuuugguuuuuguuuguuugguuuuuguuuuuccagacaguuucuccguacaguccuggcuguccuagaacucacucuguagaucagacuggucucaaacucagaucugccugccucugccuccgaagugcugggauuaaaggugugcaccaccgcugcccagcugaaacccugucuuaaaaaaaugaaccaaacaaaaagacuuggagcucuacaaaggaccauguuuuagagagcacauuuugcaguuuuuccuucauguucucgaguugcuguggacucaaccacaaagggaaaauacuuacuuccgaaagagcggccugugagacggcuuaccaagccuggcgaccuaagccggggccccagguuaggguggcaggaggagaaaacugacuuccacacguggucugcugaccuugccaugugucacaccaggucaccaacccaugugcacacagagaaauacauggaauugaaaaguuagaaagaaccguuuguccuaaacauaguucuuuucauuuuucccccugaacaguagaguguaaggaauauaucaucuuucuaucuuauuaggauauagauaaucuagagauauguaauaguguauguaaguacugugcaaacaugaugccaguuuagauaauggaccugaguaagagucaacucagugacaguguuugcucagcaugcuaggcccuggguucugcccagaagaaagaaagaaaagaaagggaagugauuuaccagcagccaugugcugaguguccggggguucccguagccaguaccucuuggacucuaagggauagcuacacagaugcacuuccuccacacugucuuuucuccuagguucacagcaaggccacugguacagacgauuuuugaagggggaaaagcaacaugcuuugccuauggacagacaggcagugggaagacacaugugaguauuucagucaggagagaaagcuuuacuaaguucuugagaaggaagacagaugcccagucaacuagcauuugccaugccagaugcagagaggggcuuuagauagguccauccuccugacucuggcaugggccacuguguucuacugggcugugucacaugcgguuucccuuugcagacaauggguggagaucugucugguaaaagucagaacgcaucuaaagggaucuacgccauggcuugugaguaaacuguuuggcuacauugggguuggguauggacagcaagcugcuuacugagggaggcucuuccuugcagcccgggaugucuuccuucugaagaaccagccucgguaccggaacuuaaaccuggaaguuuaugugacauucuucgagaucuacaaugggaagguaaagugacuuaaaaccuugugugccagccgcccuuuuguuuguuuguuucucuguguagcccuggcuguccuggaacucacucuguagaccaggcuggccucgaacucagcaauccaccugucucugccuccugaaugcugcgauuaaaggcaugcagcaccaccacguggucggcugcuguuguaguuagcuuuuugaauuuguuuguuugcuuuuaguagucucagcuuuauagacggaacaggcuagagugguucaguaacuugcucagauugguacagcuaguaaaacaguggcauuuaugugagucauggaaauggguucacuugcuaggucuguuaccugagcaggcuggggccagcucugcaggagcaggguacccagcaccuauggaacuaagcuuaugcucucugccuggcacagguguuugaucugcucaacaaaaaggccaaguuacgugugcuggaggacagcaggcagcaggugcagguugugggacugcaggaguaccuggucaccugugcugaugaugucaucaagaugaucaacaugggcagugccugcaggucagaguucuggcaagggagggaacuacuuguaauuccugguucaggugaugacgucucagaugcagaaacagcaugagcaggagacgucaucucuuucucauagucagcacagcagcugugagggccucugcccuagggaccucguagagcagauaaucccagaaggucucaaggacagacuuagagcaggcuuuacugacaggcauucuugcccgggaucugugagcuucuuguuuucccuuguggaagaagugggcagcccugagucuguugugggccagagguaaaugagcacccuccugugcugacacauacaguggggcacugggcaguugugggguucagauuucuuccucucugugcugaggauuaaacccagagccuuccuuugcaugugaggcaggagcucugcuagagcuccauccacacaagagcccucaaguuugcacagguaccuagcccccuuuccuuguggccgucagccccucuccaucuucaugagccugaggucuggcuagugccccagcacagacucagguacugauuugacugccuggaagauacuagguuaagacaaaggagacguucgagagggaagacacggacgggacuuguuaggauccugauccguauccuuccuuuaccauagguuucacugcugggccuaggcuaguguagaccuggggguucccuggggacaguggccccagaacuuuauaaccuuugucuuucccuccuuuuaauaggacuucuggacaaacauuugccaacuccaauuccucccgcucccacgccugcuuccagauucuucuucgaacuaaagggagauuacauggcaaauucucuuugguggaucuggcagggaaugaacgaggggccgacacaucuagugcugaccggcagacucgcauggagggagcagaaauuaacaagucucuccuggcucugaagguagcaggccggugcuaguggagccuggcagcuaguugggaagggagagaguaggcugccuaagaagugaagagaggguccaguguuuuuucuguugccccacaggagugcauccgggcgcugggacagaacaaggcucacaccccguuccgugagagcaagcugacccaggugcugagggacucguucauuggggagaacucgaggaccugcauggugagugggggcuuugcagaugcugcccugucuguggacagggagcucagcaaucuuaguaaggaggaaagagucuguucucuugguguaggugcagccuugccuugaggacagccauugcucccuuaccacgaaaaaggguucuggaauucaggaagugaaccuuguagagacagaaggaagucuuuccacagcuucccucuggguccauggcuucuaccguggaaucucauauuccaagccuccagugacuucuucauucccuacuuuucuuuuuucuuucuuuuaaagauuuauuuguuuaauguaugugaguacacugucauucucuucagacacaccagaagggggcaucagaucaaauuacagaugguugugagccaccauugguugcuggaaauugaacucagggccucuggaagagcagccagugcucuuaacugcugagccaucuucucuccauuuuagguuuuugagauaggauuucucuguguagcccuggcuguccuagaacucacuuuguagaccaggcuggccucgaacucagagauuugccugucucugccucccaagugcugggauuaacggcgggagccacacccgccugaccuuccuuccugcuuaaucuccagguccugcuaagugagaucugccacuauccggagcacagcucuccucuucucuaauagugccuuugcaugaauagacuucucuaucucuauuaguauuaguguuaauuaguacuaauuauuaguguacuaauuaguuaguaccccuguucccuccuucucccucugucagcauagaggguugaacucagacuuccaaggccucuccaagcauuuuacccugagcuuucugucuaagcuguaaacccuucucucagaggcaucaccucagggauugaguaacgugagcaggagucaccgaguuuugagaugucuuuuugauagaggaaauuaaagaagcagaagauaauuaagagcaccuuuaaaaacagaacccagccaggcuuggugccccccuguaguuaugguuacuagacaggcuaaagguggaguaucauuuagaaccagccugggcaacaugaaggcccauacuggaaaccuuuaguuuuguuuguuuuugagauacaacaggcuagccucaauuucacagugauucugaauacaaggauuauagauaugauguaccacaccauuugggagccucuuuucuuuauuggggaguggaguuuggucucucuuuguagucugacuguccuagauacugcuuuguagaccaagcugaccucaaacucacagaucuaccuguucugccuccuaagugaugagauuaaaggcgugcaucaccaccacaccuggcaaccuuuuuccuuuuucuuuuuuaaauauuuuuuaaguuuagggcuagagagauggcuuagugguuaagagcacuaacuacuuuuccagaaguccugaguucaauucccagcaaccacaugguggcucacaaccaucucuaaugggaucuggugcccucuucuggugugucugaagacagcuacaguguacucccauaugaaaaauaaguaaaucuuuaaauauacauauuuuuuaaauguauguauaugaauauugugcuugcauauguaugugcaccacagauguaccuaguguucucagaguucagagcaggauaacugaucuuuggaauuggagucuuaugguuauaaacagccauaugggugcuggaagcugaacccagguccuuagcaagaacagguguucuuuuuucuuuuuuuucauuuuuaaagauuuauuuauuuauauguaaguacacuguagcuauucucagaaaccccagaagagggcaucagaucucauaacagaugguugugagccaccaugugguugcugggaguugaacucaggaccucuggaagagcagucagugcucuuaaccucugagccaucucuccaguucuuuuccuuuucccaaccuaugucucacuauauguagcucugguuguccuggaacucauuacauagaccaaguuggucucaaacucauagagaucugccucuaccucccaagugcugggauuaaaggguaugugucaucacaccugaccuuuuuuuuuuuuuuuuaaaccuguguuuauugugcaaguguguuacauaugaacauaugccaugguaaccaugugagagucagaagauaacucacaggugucuacucuccuuccuccauguagguccuagagucauauuuagccuuuuacuugcuaagccauuucaccaaucccccuggagccgguuuuuaaaguugcccuaguuuacaugccccggaacaaauagccuagcagagcacaugugcuucagacgcaccugucgacugacacuccuggugccaucuccagggccagaguguccugugcccucagucccugacucucaagcucuaaacaugauucccucuuuucucagaucgccaugaucucaccaggcauaagcuccugugaauacaccuuaaacacgcugagauacgcagacagguaugcgggccuucaucgugguaagacaggcagcaucuaagggacagcugaauguccuccauaaacaguauguguguggaggucagcugcaugcuaggucagucccaguccuuuccaguauauaguaugugagugucuuuccaugucagcuucagccucuccuuggcugcaggcuccugcuacucaccccuuggaucccuaagauuugucgucuugaguggugguacacuccuguagugagugcccagggggcugcugggacauucaagcccuuauuuccucagagucaaggagcuaagcccccacagcggacccaguggagagcagccgguucagauggaaacagaagugauggaagccagcucuaaugggacgucucugacuggcaauguaaggcgggagggugagaugcaauguggccuuugagauggaccuugggccccggucuuuacacuguuaucucccucuuuggccuucgguucuccaaggaagaggaggagcugucuucccagauguccagcuuuaaugaagccaugacucagaucagggagcuggaagagagggcccuggaagagcucagagagaucauacaggugcgaacuggcuccagccagggagggaucggcaggccacucucagccugcagagcucagcuccaucccugcagcauaggcugggcugggcugcucuggcuccuuguugguuugggacagggcaguccucuacagccagcucuccucagucucucuucuaggagaauuaaugacacaggcucuccuguggcacagugcugcuguuuaggggugagaggguccugcauauaagggauugucauucaguguagugacacaugguccuacaacaccuccuacugaaaggccuuuggucucacggagccucaguuuccuuuucucuaagcuggggaagacacaguguggucuuugggaacuaaaugcuagacugcuauagccgcagugugguaccagcaccacucagaaccgaggggggggggggcucuuuuguuuuguuuugucuuuucuguauuuuuucuuuguuuuuauuuuuuggggacaagauuucucugugugacagcccuggcucugccucccaagugcugggaauaaaggcaugugcuagcacucccagccaagggagaugcugugggagaaguaggaagcaugcccugacaguggcagacagcgaagcaggaggagcuuaggacccuguggugaagacuaagugugcagacucgucccccuucccuguggaggccagggcucugcaauaaaaugcauggucuuuucaggauacaugagaguugacucugguaaagcaaaagcugaacagauaucacaggguggcagcuaaaggcagggucaguggggcagagggccuugcauccggcucgugccagaggcuuagauuuuauuaugaugcauugagugaggccuccagcaguguggucagagcaaagguuggcuguuugguuuuuauuuuuaauguguuugaguuuuuuugccugcauauauuuaugugcuucauuuuuuaaaauauuuuuuauuauuauuuaugugaguacacuguaggugucuucagacacacaccagaagagggcaucagaucccauuacagauggcugugagccaccauguggucgcugggaauugaacucaggaccucuggaauagcagucagugcucuuaccugcagggcuaucuuuccagcccaccaguuucugacucuuaagaacagaaucagugauguuauucacuugacauagggacagauuuuggauaggaugaugcuaacuaaguucaagcuaaggauuuccuuuuguuugguuuugguuuaggccauggucucuugaagccuaggcuguucuugagcuccugaaguuuuuuuuuucuuuguaauuucuuguggguauggguaccuguguagaaggcaaggacaacuuggaguccguucucuccugggaauugaacuaagauugucucuccagcccaaccuccugauccuccacccugagugcugagaucauaggcauaucccacucccugggcccagacugaggacuuccugaggacaggguuucaggaggcagaaugaaggcuuggccuccugcuugugugucuauauugcaggugguugagcucuguuugcaacuugcuggaguguuguggugaguguaugcugacuggguucucccuguuguugcagcaaggaccaaacuggcuugagcucuccgagaugacagaucagccagacuaugacuuggagaccuuugugaacaaagcagaaucugcccugacacagcaggcuaagcaggcgaagcacuucucagcccuucgagaagucaucaaggcccugcgccuagccaugcaacuggaagaacaggcuagcaaacaaauaaacagcaagaaacggcaccaaugaugacuucaaauaaagaucuguuugauaucacacuagccucuuccccuccccagaaaacuuugggcaccuucuggcuuugguuaggaacugaguuggacagguuggguaaauuucaaccucagggcaucaugcccaggaaagcuggggagaggcgauguucuuuuccucaguuuggagcgggaagaaggaguuuuaaugacugugcuuccucuucuccuccccauggaaggggggggggaucccuggcucagcauccacugcugguggaaaccucgcugcgaggugccgcugugaggugugccgcugugaggugcgugcucuggaagagaggcggagcuuguccgcuuccugcugccucugccugcaguaccacccucggucuaagcacucaugauuuuauacuuucagaaaaaaguuuuaagacuucuuuggguuuuuuguuuuuguuuugaagccuaagaaagucacuaguucuugccuuuauguauuuauaugcuguaccuaacaauaaagaaagaagaaaaaaaacaaaagc

SEQ ID NO: 2063 - RNA, 17643 nt, Mus musculus
agggaaaccccggauguugguugagggaggcugaagcaagacccugagguaaggacuaguugggaaauggaacuucugagugaaugacccugggaggguguguucccucuuuucccaccccagucagccuccugacaugucuaaugcucuuuucuucauccaggcaucccgagacaggcgucuacauucauucucuccacgucucacuuccaauuuacuaucgcucuguagcgucuagcuccugcagcugaaaucauggcugccaaaugugacagcgguggcugcucugccucuugucccugcccuuccugcuucagguaggaagcugucaguaccuguacucauuggccuugagauuuccucuugcagccucauuggcugcacugaucggacuggaaaugucagugaauccagaccuucagcugaggagcugggagaaccuguaugcaaccaccugggcucccucugcccuuuggagggguaacugugaggagagagucuugcguggcuuccagguuuugugaugagauuaaacuguaguugcccacaguggagucccauuucaccaucauuuauacaguucaaugucaggacagccauuguuucucccauccugcaugcccuuuuguggugacuagacuuauucgagcaggauguagccugauuauuuguugaagauucuuaaguuucuuggugugcugcuuaguuuuaacugucaccuugacccaaccuagagucaccugggaagagagacuuaacgaaggauuuaucuagaucauguuggccggugggagaauugucuugauuguuaacugauacaggcagaccaagugugggcaguaccauuccugaaauaauggaccaacacuggaauuguaagacaaauaaacccuuccuccucgaaauugcuauauaucaagaugguuuaucacagccacagaaaaauggaauuagaaccugggucucaaauaaacacuucuacauggaacauggaaggccaugucaguucaaucuaugggauguuguagggguuuguugccuagguucuuggugaagaaaaguauaaaaggaaaugggggggggcaggaagcaagggagcaguuuaguggcagauaguuagguacugacccaauagggaaggagcaguuuaguggcagauaguuagguacugacccaauagggaagggagcagcuacagaaggcugacagggugaagaggaauagaagccaaaggcagucccugguuacucgguagauaaaauccucagcgugucagcaggacaaagugacccccacaccaacauuuuuuuuuaaacuucaaaaaaagaaaauuaaacccuuaaauuccacagagaaaggcagaacuuucuugaacuuccuuuuaggcuuauuuuacagguugguauuauuuuuauuuuaaguuacauaagaggacauccuccuuuuugaugcucagggagauuaaaggucugacauggauuugggaguugaugagauuaaagcauugcuguaaugggagcacgagagagcaaagcugucaggacagagguggccauacaaaaguaaacgcucuccuaacccaccuugucuguacugaccuccugggcuaacugaaacucccuauucccacuggaacuagcuaucuaguggcugccgcaccaggaugcucauaguuucuggacuacucuucuguacaaacaaauacccacacuuacgaguugagcauuagucauugugaucgauccaaaauguguguauuuccauaguaguacuaugcuuacacaauuuaugauguaaaccgccagggcaaaaaggacgagacuugucauuucugaggcugcuacucaaaugcuuugagagcucuauaaagguaauuccccgcgcccccccccccccuuucuuuugguuuuuggagacaggguuucucuguauagcccaggcuguccuagacucacucuguagaccaugcuggccucgaacucagaaaucugccugccucugccucccaagugcugggauuaaagccgugcaccaccacugccuggcugguaguuccccuuuaaggugcuuuuggacucaguaugugggaugcacagauggaaaacagcacucuaugugucaggcucuaagacacaagccgccguuugaucuuccccaaaaugcucugauguggauacugagaacagagguacaaagaagcuaugaaacuugcccacauuaggauaacuaugcacccagaauugaaaaccaguuguucucaccugagagacaguguuuggaacuguuauguggguauaccacaacccugagaauccauuagcaaugguguugauuggugauguugcuuuacaagaacacugaaguuguguguguguguguguauauguguguguauguauguguguguguguguguguguguguguguauguguguguauguauguguguguauguauguguguguguguauguguaugguguguguguguauguguguguguguguguauguguguauguauguauauguguguguguguguguguguguguguguguguguguguguguguguguguguuugagguugaugucaagugucuuccuccaucucucucccucuugcucucugagacaggcucucucauugggguggagcucacuaacugggcuaggcuggcugaucagugagcucuaggagucuaccugucucuguccucccaugaccagguuuacagauacaugguccacucgcuuuugacaugggugcuaggacccugaacacagauccccaugccuguguggcaagcacuuagcucacagagcacuccccagccucagguuucuuuucuuuucuuucuuuucuuuucuuuuuucuuuuauuuuauuuuaaagaaggugaagcugaacuccauacacaauucaauaugugcuuguucaagagugaaggauuccacucuuaaggaaaggccuggcccauuacccaaagauuagcaaguggccauguguagauucuaagccagaauaaaauguuagaaggagauguauagcucucuuuaugauuuccugcuuuaacugacagacuaaccaacccagcacaaggcuggaugaguagacucccugccuaacaaccuuugaaucuaccgcccacuccaacacccacuccaacacgcagcgaggaagaaauccaaaaugacagacaggugggauccugcccacuuucacaaucccauggcaaaggagacagucucuguuguuccuguuucuagauaacuaacagguacuuuccauucaugaccuuuuucuuucuuucuuccugagacugcaccccguguagccccagccagccucaaauguucucuguaguugaggaagacuuugaacuuaccauccucccacuucuacacccccaaugcagggauuacaggugugugccaccaugcccuguuuaugugguacuggggaaggaacccagggccucuugcauucaggacaagcacucuaccuccugaaccacacccccagccccaugcucugcauuucugcaugugucacuuucucagccucaaugguucuuuauucuccccucaaacuagagaauucuuacuuaucauuuuucuucauucauucauuuggaaauaauucuaagcacccauuugugugaaaaauggauauacacauauguaugcauguuugaacacauggauguuugugcagaugugcaugugcauggacacacacacacacacacacacacacaaugcccuuagugaaauguuaugauaaacuaucccuucacaguauuuauagcauuuuacuauuuuuauguuguguuuguuucuuuaguguccugagaggaggaacagugaggaccuagcuccugagggagcugugaugguguaugcuccuuccugggaaagggaaauacucagagacauugaaggauucuguggaucuagcauuguaggagaagugagcuugcuuggaccaaggagguagaggcaggaaccaguggggcagaguugggauguaaagacaacgggaagaacagguaccaggaugcuaagcccagggagggaaaagacuugagaaacccaaagaucagugaaggacuaguguggaggcugauacaggauaaggccagggaggggagcaggccagauccuucccagcuucacaggccuuaagaauaaagccuucauccuuauuggaaaagcuaagagaagcccugggugagacuucaagcacgggaguaguguuuucagauaugugauuuaaaacaaaacccuuuucaggggcuggagagauagccuggggucagcaaacugcuccuaugccagcuugagggucugauuucuaacacccaagucaaaacaaaaacaaaaacaggcguggugacauguguuugugauccuagaucucucucucucucucucucuccucucucugucucucucucugucucuuucucugucucucucucugucucucucucugucucucucucucucucucugacucucugucucucucucugugucucucugucugucugucugucacacacacacacacacacacacacacacacaccuuucccacugucaccuagaauggagaaacucacuccuccaccccagauuuucucaucgugcucccaccaagguuuuuuuuuuuuuaaggcaggaacaugguccaguuuuugaaagaacuccuaguauuuaguaggagcauuacagcauucaguaagacacgucacaggccagaugugauaccaacaucugagagacuaaggcaagaggguugcccaguguuagguugcccagccucagcuauccggugaguuccaggccaaccugggcuauagggugagauucuaucuugacuaagagaaaugacucucccucccguguuacgucaaccaugcaccuuuaucaugccauuucucucacgcucuuuacuucucuggccgcuccacuccaugggcuuucuagugcugugcaugauccuucauaugcggggagggcuggagucgcagcugauucgaugucacagcuaugagcaaaacucuugucuccaaagggaggagagacucuuuccugccguguccccuguaugugugccuacccugcuucaguacagaagccuccugccuugaguaaccacaucacuccacagguucuaagcucucccuggauccaugccuccagaggcuaaagcucucgacuuaaucuggauuccccaacagccuuuauguguucuuuccuauucaaggcccuggaaucggccuguaaucaagagacacuuuacucuggaaauauggcacucagacacuuucacugcuguccaagucucaggcuggacaaacuccacuuccucagcucuugacuguuuggccccaggauguuuugccauaaacuugggugucuaccagggacagaaggcaggucugaggcuggagaacucagagcccauucuugccuugucuggguuccacacaucguucaaaaugaguguggccugaaacgcacuuaugagcacccuuuucugacuaguggauucuggaccccaguugccaggcucugcuuacccagaccaucaaauucgcugcaagagucuguuuccaugccaaacgacucaucuuuccauguugcuuuuaacaucucuaguucaucuacuuacguccuaacaaacaucuaguuuuguugccuccugccaaaauagccaagugccugaauuaaucaaucaaauauuuauugaaucacuacuuaauuuuuuccucagacccacaguuucuccuaugaccacucgaugagcccaggagucuggcaacaagggucucggaaucccaaaggacccugagaugcuuuuuccugugaggugacaagcuaaaaaccauucucauuugacaauacugggauguuuugauguuuuuuuuaauuuuaauucucucacagguguacaguggaauauuccagaagcuaauggaauaccaagaauaauuucauuguucucacaucuaaauaaacacguuuacauuuaaaaauguuucuccauuuuaacuucuacuauuauagguacuucacaggauaaaguucuaugaggauccugggcagucucuaagaggacacuuuuguuauuguuguuguuuuuuuacauuuauuauuuuuuguuuuuguuuuguuuuugagacaggguuuuucuguguagcccuggcuguccuggaacucacucuguagaccaggcuggccucgaacucagaaauccgccugccucugccucccaagugcugggauuacaggcaugcgcccccaugcccagcugcuacauuuauuauuuuaagacaggaucuuucuguguagcccuggcuguccuggaacuuacucuguaggccaggcuggccuugaacucacugagauccuccugcuucugccucccaaguugcggagauccuaggcauuggacacuacgcccagcaaguaaguuaauuuucaacuuacacaaguaacaaaguuaauaagugaaagcuaaaaucgaauacuacuauacuggcuaguuuugugucaacuugacacagcuggaguuaucacagagaaaggagcuucaguugaggaaaugccuccaugagauccaacuguaaggcauuuucgcaauuagugaucaagggggaaaggccccuuguaggugggaccaucucugggcugauagucuugguucuauaagagagcaggcugagcaagccaggggaggcaagccaguaaagaacaucccuccauggcuucugcaucagcuccugcuuucugaccugcuugaguccugacuuccuucagugauaaacagcaguauggaaguguaagccgauuaaaccccuuccucaccaacuugcuucuuggucaugauguuugugcaggaauagaaacccugacuaagacaacuacuaauacuguaguuuauuaaaggauucacaaaagaucaacaacaaaaacuccuuugccuaguguucauguauagacaaauuuaccacugucauggaaaauaccuaauguuggcaagcaaaaugcaugaggcagauacagagagagaggcggggggaggcaaaggcagauggaucucugugaguucaacaucagcuuagucugcauagugaguuccaggccaucuaggguacuuagugagucuuugcuucuaaaauaaguuuauuguuuauuaauuaaaacuuucugacuggaggugguggcacaugcuauuaauuccagcacuaaggaggcagaggcaggcugaucucucugaguuugaggccagccugcucuacagacaaguucuaggacagccagggguauacagagaaauccugucucaacccugccccucaaaaacaaacaaacaaacaacaacaacaacaaccaaaagaaaccccuuuugacaaugugacaauguaaauaagaacaaggcacuugcuggggaaaauugcaguuuauauaaccaagaauuaacauuguauuauaguggugaggacuuucauaucaaaagagaaaagacucucuaacagauuaauaggcaaauaauauaaacaaucauguaagaaguacugauggguagauaccugaaaacaauccauaguaaacacagaaagacaaggcuauaaaagaauaacacaauggggcuggagagauggcugagcugugaagagcaccagcuuuccuuccagaggacacagggucagguccuagcacccacauagcggcucauaaauguucauaacccuagggaucugacacccucuucugacccccccccacacacacaccaggcacacagacauacaugcaagcuaaauauuuauacacauaaauaaauaaaucuuuuagaaaaauaaaaacaaguaauaaagaguggaagagaugacucagucaguauagugcuugccuugaaagcacagcauuuaguaggugccggucaagcagacggggaaugaauugcaucugacggauaaugaagaacagacaauguuuggcaaaguaaugaaauguggcagaaagggcugaaguagacaguagccuugcugccaagucacaaaagauagaauuuaaggggaaguuucagauacuagcuaacauuuaacgauuucucugugcagggagugaauugaauguuuugaauccaugauuucaucuagcacagaaaacaaguuuaaauuccuucacacaaagaaagaggaggaagagacuguccccaacucuguucuuuucccuacuucuuuguguguguguguguguauguguaugcguagcacauauguguguuuguccuugcaugcacaugaguauguaugaauauaugugcuuauguuaugaaguccagauugauguugcaaaucuuccucuauggcucuucccuuuuaucuuuuaagacaaggucccuccaucaaacccagagcuuuucccuauggcugaucccgcuagccagcuuguucugggggaaacagcuuuccaaggccagaagugcaaccaagccacugcagaccaucacaucuauccagugucugccuguggaaucucaauucaguggacagagcccagcucucugcucugauuuugagggaauacuccuuuuccaaagagggagagcucauaggaugcacugggacacucggaguuuaagguucucaugagacagucauugggaugucaugagucugcagcuucugauggauacggauggguuguugucuauguuagagaggugucuggaaggcaaaccugugguacauacacagcuguggugguuuggaugucaauagcccccauggcccaucuauuugaaugcuuggucccagcugguggaacuguuugggaagaauugggaggcguggcuuuguuggaggaagugugccacuggaaaugggcuuugagguuuaaagaacccgggccaccauuccacaguuagcauucucuccccgacucccucugucucugucuguuucaugcuuguggaccaaauaucagcucucagcuacugcuccagcaucaugccugccugccugccuguggucaugcucccuaccaugauagucauggacucacccacugaaacguaagcaaguccccaauaaacuacuuccucuuuaaguucccuuggucauaauguuuuaucauagcaauagaaaaguaacuaagaucugccaucaaauguucaucaagccccacauugaaagcugggcacaugucaugucaaauauucacuuccugagauucauaggaugcuuaugugaaagaccaugaguugguauuuuuaauuguuggucuuuuaaaaauaucuaacauuuccaauuacauuguauggaucuuuaaagcaaggucaauauaccaaguuguuuuguauuccucuuguuggaggguucaaaacauguuuguugauuaaauguucaagaaaacaauaaguggaacagccauaaacaaagaccagcccaggucucuggaaaccaagccucuguuuuuguuaugaucuaaaagucugugaaaguagcccaguuucacauaaaugacaguuuucaucacugucaucaaaguugauugcuggcaucagaaaguugugauugguacaacaaacugaccgucaaaagcucaguccaaguggcacuuucugaacacacugaucaacacccagaguuggcgcucagccuugcugguccagaaacuugauccacucagacuugagcccagggaagauggagcaugcucacacaaccauaaaaacaagaguaugcagcuagaaugucagccuacugaugcacacaagggcagaucagauauucauauccauucucauuucccggcagcuaagcaaugugcaaagccgcaucacugggaggcuguguggcaagcguagcaucagcacccagccagugggcuagaggcuuagaaugcugagcagcaccaggcucuggcaacugcgugcacaggcagcaggcggugggagcagagcaguggcuuccuaaccacacacacacagcucuugguguccuagccgaauggcuacuggcaagcuacuggauguuucuagaaugcgacuggggauauagcuuuauugguagagugcuuuccuagauucacaaugucuuggauuuaauuccagcauaauauuaaaaacaagacauggucuuuaccuguaaucuuaacacugggaagauugagaggcaaaauuaucaggcaaucaaggucaucuugucacauauagaguuugaggcaagcuugggcuacaugagauccuaucgaaaacauaacaaaaaacucaaaccauuaauagaacuacuaauucauaggauggcaauaucucacaggcuuacuaugaggacuaaacaaggaaacacauaaaaauugccacaccagccccugucauacgagccacuggguaaauggcaguuacaugugcauccccauaccaaggacacaccuguuaaaggcucaaacuggccuuugagacuaucccuugcucugagcaacacaucaaaaaaggcugaagggaaaacuaauuagaaaacuauggcgugauucagaguaagaugcugggcccuuaaaacuggcugcagcaagguaacaggacugaacuagaggcuauuuaggaggaaggcaauacagugaguauuuucagaccuauuucuaaucccaacagugcauacaugcaugcaugcauguguguguguguaugugugugugagagagagagagacacacacacagagagacacagagagagagagagugagagagagagggagagagagagagagagauaucauggaggucagauucaaggccuuggaccuauuaggcaaauguucaaucacugagcuacauccccagcaccaccaauggcaacuuguaaaguggauaacccucuuucagaugaaagucacacacuaagcaaacagaucaagaugacgggcaaugacugaacuguaaugauucacaguugguaggacuccaacgcccccuucuuucuaugaacaucuaccacggugccugucuugguucucaaccaagaugucaaccacaaggcucacgguaauuuauugccacuaauaaagcauagaaauuuagagagcuaauuugcuuucaggaaauagaacacggagcagaccaagguuaucacuuuaaugaacaccaccauuucccguucugugugaugccuucucuccagugggagaggacguggagggaggacucagagauuuguuugugagaguacaccaaacauccuuuuuuggugguccauuacgacuuugaacuuguggcaauccucagccuccaaaugcuagcuaggcucauggugugagcccccacacucccuaaacacaugaauuucacuugaagagucuuguugaaaacgacugaagaguggcuacucuggcaaacagacccugucugagugugagcgccuuagcugggccucugcaggguggcagugagacagagacaagccugucaggcaaacugcuagcuuccuugugcuccuuagagugucacguuccuggcaacagucacauacaaacaagccugugcaaagguguacuaucucagaugagggacgguauuguauaagagacccggccuuaguuccuaaaugaacugacaugugaggccucucugcucugccuuugcaucuugcugcucaacacaaacagaaaacuuugcaucugguuuuuugguuuuuuuuuuuuuuuuguguguguguguguaugugaugacuucucuuuuuuagauuuacuuuauuuuuuacuuuaugggcaugaguguuuugugauuguagguaugugcaccaugggcaggaagauggcuuuggaaccacugagacuagaauugcacaugguuguguguugaggaugggucuuuuguuauguauuguaagguuauauacuggcccccaaggccugguggcccccaggaaugaaagaauccauguguagcuccaagugauagauccauauguagguccaugauaugcccccccuaaguaucccugauugugaauaaagaugccuacagccuagaguugugcagaagagguaggugggauuuuuggguuuccagguuuggagcuggagggagagaaaagaaaguagagagaggaaaagaugccauaggguaagaaucuugaaaauguggucaugaggccugaccaucuggaguugugaacugcccaaauggaacacagcaagucauauugugggauguuugugagggaaguaggcauaacagcuuagaggguagauaucugcccagcucuagugcaucuaaggcuuauuauaaauauaaagguucugugucuuuuuucugggaacugagugaucaaaggcaggguaaaagccccgauuugagauuaaguauauuuuaacgguugugagcuaccauaugggugcugggaacugaaccuggguccucuggaagggcauuaugugcucuuaaccucuaagccaucucuccaaccccauacuugcucuuuuaaacuuuugcuucaaauugguuugauuguacaauuucacccucauaagaaaaacgcaauuaguuuuguuucucuucgauuuuaaugccugaugcuagauuuggagguucaugccuguaaucucagcacuugaaaaagcaggaagagagggagagaaagagggagagagggggagagagagggaggggagaagggagagagagagagagagagagagaagacgcuacagaagauuagauauuuuauacacuuaaaacuaugaguaauggaagagcggaugagagaacucaaacuguuauauacauguaugaaauugucaaagaacaaauuuaauaaaaaaagaagaugaaaaaugaguaggcaaaacaaacaaaccaaucucgcauaaaccuaaccaaggaagcgaaagucuucuauaaugaaaacuuugaaacaccaaagaaagaaacagaagacacuaggagaugggaucuaccugugcuuauggacuggaagaauuaaaaucgugaaaauggcacaauuaaaacagcuaccaucuaauuuaaggcgauccccaccaaaacaccgagcuauucuucacagaaaugcaaaaaccauucuuaggauauguaugaaaguacaagagacgcccgagggccaaagcaauccuagguagccugauuucaaguuauacucuagaaaccuuggagcaaacgcagcauggcaguagcgcaaaaacggugccauguaucaguggaauagaaaagagauucgaauccaugaagccacagccaguaggguuuggcaaaggguguguguguguguguguuuguguguguguguaaaaacagccucuucaacaaacguuacugggaaaacuggauuuccacacauggaaaagcaaaacuggaucccucccuguccuucucaucuuucaaaaaaaucaaccacaaacagaucgaaaaacuuaauuuuagacucaaaaucuggaaacugucagaggaaaaaaaauaggaaaaacacuugaaaauauaggaauaaggcaaggguuuucugaacaggacucuguugaucaagggauaaugccaacaguuagcaaauaggaccucaugaaauugcagugcuucuguacagugaagaagcaguuaauggacugaaggggcagccugcagaacgggaggaaagcuuugccaucuauuccuccagcagauaguuauagcuagaauauacaaagaacucaaaagcacaaacaaaaaagaaucaaaaucaaacaauucaauugauaaguggucuaacaaaaugucaaaagaugaauuacaggugacaacaaacaaaacaaaaaauaaccccuauguuagucucaccaucagagaagggaaaauuaagaugacauuaacaguuagucucacccaggucagaauggcagaauggcagucuuuuucuuuucuuuucuuuucuuuucuuuucuuuucuuuucuuuucuuuucuuuucuuuucuuucuuucuuuuuuuuuuuuuuuuuuuuuuuuuuuuuuuugguuuuucaagacaggguuucucuguguagcccuggcuguccuggaacucacucuguagaccaggcuggccuugaacucagaaauccgccugccucugccucccaagugcugggauuaaaggcgugcaccacugcugccuggcuuagaauggcaaugucucuaagcaacaagcccugcccaggacauggacaaaaaggaaucuuuauacagugggaauguacggaagucaguauggagauuccucagaaaacuacacagaucugccuugugauccaucucccccuuucgggggauuugccuggagaaccccaagccaaccucagacagagauacuuaacauggauauuucagcauuauucaugauagcucagucauggaaccaacagaggugugaaggaaagaaagugugguauauacacacaauggaaguuuacuuuggucauaaaugaaauuauguuguuuucaaggaaaauagauguaacuggagacaaucuuacuacucaucucaggcagacaaauacgucuucucucauucguaguuccucaauuuuauagagcuuuaugaaacagugugugugugugugugugugugugugugucugugaugaaaauagaagugaaaauugucuauggaacaagggggcagacaaaagugggaaagaagagagcaggaggagaggggaaaggguuggggguguccaguaagaaaugaggaagacuggguagggagacagugauggguacccuuguacccuguguuguuugggagacagugauggguacccuugcacccuguguuguuugggaggcagugauggguacccuugcacccuguguuguuugggaggcagugauggguacccuugcacccuguguuguuugggaggcagugauggguacccuugcacccuguguuguuugggaggcagugauggguacccuugcacccuguguuguuugggaggcagugggaaguaaccgaaagagucaagauccaggucugcaagaacagggcuugucugagaagacacagguugcgucaagggcggauaaaaggacuugcaaugagacaauggggucaagauagaauauuaaauagaaaguuaagauagauaggagaugcaaaauauagauauaugacauauucaucgggcacaacaguuaacuaauggagaaauacuaagaaaacaugaagacaugaggaaagagaaagcccaaugggaagccgagagaaauccugaaugauccuucucaaaagagaaacucaaacggccaauaaacacagccaggaacauguaaagaagaacuaaauuaaggaauucuauagucacaaaacuggaaggaaaaaaaaaauaauaagaaggcaacaccuaccauaggcaagcagccaaauauggaaucacuuugguguccagcagcagaugaaugaaugagaaaaugugcagauccacggugaagcuuuucaaccauguggaagaagggcacauucacaagaaaccagugggacuggaagucaccaugcuaagggcaacaagaugcuccuagaaagauaagcuuagagagagagagaggacaagagggacaauggggagggguaggaacaugaucauauuacgucauguacuuguaugaaaaugucaugaagaaauccaugauuguguaccauuucuguguacuaauaaggggugagguauucaaggaaaagcaggaaacaacugugacagucuguauucuccaucauguagcaacugcuguauaagguaaaaagaaauaaaggagaaaacugguaguacaucuuuugaaugcaauugaacauuagccaguaagguugaagaaacccuaguccuugauguggccauaaagcaacuugucuuaaauauaagaauggauuuuaaaaugcuaacagcagcauuucccauaggaacccaaaucuaaaaauacuaaaaauguuggcaggaaugguugcacacaccaauaaucccagcacuugggaggcagagacaggaggaucucugaauuccagaccagccuaucuacauagugaauuccaggucagccacggauauauagugaaacccuguaucaaacaacaacaacaacaacaacauauaaacauaaacacacaacuguuaggguagacuaucaaucagugaauauucauucaugugcagcaacaaaaacaaaacaacuccagcuccaugcaauacccugaauagguuccucagacuuaaugaugaacagaaaaaaaauuaaacaugaauaauacaaaacccauaaucucccucauauaaauguuuaaaaaugcucaaccaagcuacauuauguaggguugcaaacauggguacuaaaauguaagaauuaaaacaagaaaauagucauaaaagucaaggugaucucccagcuuuccaagacagcacccccugggaagggagugugcaaacacgugugcccauccaggauguuucccauucaagucacacagcacccuaagugaaagcaaagcacagagggagaagauguaagaccggccuggccaugcugagcuuagggcaucacacagucaaugucuagaggugcugugcacacaugggaaacucagcagcacagaucuucauugcggaaccuagguuugaaauacggaucucaaaaucguuaaaugggucacuguaguuuggaccaccgccagucugagaagucucacuucuauuaggugagaggagagaguaagagggcucuuugaagggaagagaggaaacaggaaugaguccuaacuuguacaaaauaacuagauaaauggugcugccguuaugugggaugaaagaacccauaccuuaguuauguucuaucaccaugaugaaacaucaugaccaaggcaacuuauaaaagaaaacauauaaucuggggcucauggcuucagaggcucagaguuacgagugguacagcagagagcuuccacuuugauccaugauuuggaggcacagacagagagcuaauugggaauggugggaucuuuugaaaccugaaggcccaccugcaacgacggauugacauaccucuuucaacagggccauaccuccugauccuucccaaacaguuccaccaacugggaccaaguauucaaauacgggagccuauggggaccauucucauuugaaccgucacaagaagcaaaaucacuuuggaggauuuuucuuuaguuaguuuguuuuuguuuugagacagguucucauuauguauuccugacugccuuggaauuugcuauguagaccaggauggucuugaacuugcugagguccuccugucucugccucccaguugcugggauuaaagauuugugcuaccacaucuaguggagucccacuauuguaacuauaguauuuaagccucuggaccuaaucccagguaggcuauuacuugugcaaaguauacuguguguuccuguguacuucagugucacguuuuagcuguuuacauacuuguguucuuucccccaagaaguucaaacugaugucaguuuucugagaaccauagcuaucuccaaagcuaauccuucuauguaucaccuugacuauauguuuuuuacuucuucagauauguauuguuugguuuggagcucuaaaguuccc

SEQ ID NO: 2064 - RNA, 7596 nt, Mus musculus
uaaggguugcguuucuacgacgcacagccggaaguuccuauccgugggucuucagagagagguaauuugaggagugggcuacagcuggggggacucagguguggcuccccggggauggcgaggcagggaggacagugugaccguaagggacaccugcgcggggaggcggagaacgaggcagcacccaaaccugguguggaccauucuggcgcuggccucuucacccugcccccacuuggagcgggaguugcagggacaccgcccccuuaacgguagcacagucuuucugcagguaccgacccuugacgucgggguacuaccucaucccucgggcgugauggcuacgggcgcagauguacgagacauucuagaacucggggguccagagggagaugccgccucugggaccaucagcaaaaaggauauuaucaacccggacaagguagcaggggcauuugagcgggcugaagugugggugaagguguuggcgaagggaugggaagggguguuaccagaagagagaugguggaagugauaauaaaaggagagcuacaauggaacaagagcaugccacccuuaauguaacgaagaggggacacugggagguggggaccaagagagcggggaaaccgccaacggacgagaggaccgagggaaccugacacuuguaaguuguugggaagagagagcaagacauugugacagucuugaggugagggaaggacuuucuucccugauaacucagacgcgagcggggagaggaaaccugugcagacgguguagagacgcucccaugaguggguucccgggacuuuaguucagcauuuguuuguucagguugggcuggguaaaaacuucaaggaagggugggucugggccaucauuuuuucccugugguuuucuucccagaaaaaguccaagaaguccucagagacgcugaccuucaagaggccugagggcaugcaucgggaggucuaugcuuugcuuuacucugacaaaaagcaaguauuggaaucccaaguccuccguguuuccccuagcucaccaggcauagcccuaugucccuauuuucucuucuacuuucccccacgccaguauccccaacuagggcuccuccugcaggacagcucagugucuugcuccaggacaugacuuccuuauucugggguagacugagcuucauggcuuuagagguucuucacacaccugcuucuaaccuuucaccuccacugccagggaugcacccccacugcugcccagugacacuggucagggguaucggacagugaaggcgaaacugggguccaagaagguucgcccuuggaaauggaugccuuuuacuaacccagcucgaaaggacggcgcuauguuuuuccacuggcgacgagcggcggaggagggcaaggacuacccuuuugccagguucaauaaggugagcugcuaacagagcaaagcugagccacuugcugaguucuccagucucccagggcuggcuccagaugugcucagucccagccucaguuacccacucgguucuaggucaagugcugcuuguggguuucuucugccuguugcauuccgcccuuuucuggaucuccuguggguuuuaguggcuucccuuggcccuucaaguacugcugcuccucacaacugcauccuaggugcagcuuccugcuucuccaugcuucuucauuguucuucuuuagcucuguuacuucagcagcuaauggccucaccccagaagaucucauuuacuaauacuccuuucugaaugucccauuugguuugugucaccauuuguauggcacaugccagcagaccagaggacacuugagagcugggccccagagaucaaacuuagguuugagccaccuugucaaaacuaagaguggucagggagggccucucugggaaggugguauuuguuaccaaucaaaucucagccugugcucuucacccuuuauggcuaagcacccuaaaccaagaccaguuaguuuuuuggucuagauuguagagccuuaccuaaagcagggccuuuuccagucucauccagccauugagaggaaaagcuagaguaggcuaggauuguauaaccuguggcuaaggaacaguguggcucagaacagucuagaauuaagaccuuaaaacaccaggaguucaaacucagauuuuucucagucugacguaucuugugccuggacgcccucucuuugauggcuucucagacugagcauuguccaguguggcucuaucacauucauuccaaaccagcguguccuccaucccaguaucguucuuaggacucuaggggccaacugauggagaagcuagacugacagaguucagugaaaaggugaaguauuugagggagggggagggacugggaaagacagacguucuuuuaucuuuaaaaaaacacucaguuuguauuuaguacuuacuguuccagcauguugaagccuaaacacugagaacaaaaauaagucagacaaaguaucuguccuuaaaaacgucauguuauugagagacaggggaauauggguacaguuacagucaguaggagauaaacuacucggaaggcuggaacguuaugggaguuuccuugaugaugguacuagguacagugauucuuuuuccuucauacacauagaacauggcggagaaaaauauaaaaagaauauaaggcccagaggcuccugcagacaggccuacggccaagguugaucccugggacccacgugguggaaggagagaacagacucugaaauguuguccuuugaccuccaaauaucccaucccuacacaccugaaacaaagugcaauuuaaaguguaacuuaaaaagguucacguguaguggcugcacugggcauucccguauaccgauagagccuaacgcuccauguagggucaugggagggagguguggcucuguugaucaacagugaccaugccagguggcccuuagcaaccaagcuuaagaacuuggagccacucauagauuuuaaaguagagucaugucaggacuggaugcguucuggcaagcucugggugacuguaagauugagugaguucauguucuuccuuuaaagcugcuucccugaggggccuuacucucugugacucucccucugcucuugcucaggacaggaguccaggagucacugaggguggcacccuccuuggcccuucaugcccaacucugggauucccucuuacuccagccucuaggccugugccuucucugcugcuuuuguuugggcuuuuggcuucucaccuccaccacugcugaagguggcuguuuaguuuccuacucuucuuucacuccaacaccuucucugcugcuagguggucuuagauacaagaaacaggacuuuaaaauaauuuuauguguaugaggguuugccuaugugugucuguguaccacacgggugcagugcccguauaggcggaagaggagcuggaaccauuggggcuggaaucuuaugacugcgagcugacacgugggugcuggggggggcguggcaaauccagaaacaagaccuuuagucuccuuaaaacuagccucauuggauugugcgggucaccccuagcucaauucuaagcuuccagaagggggugcauucccuguaacagcugguucacugccacagcagacucucuucucagcucacuguuucccagccugcucccugaagccaggugugcgcacacauuagaguauuuucaucuuauguccuuuugugauccccuguucucccucacuaguucacuucuauuuagccuuaagguuuaguuagccugguauggagguacauacuuguagucccaguauuugggagguggagucaggagcaucaggaguucaggauuaucuucagauacauacugucagggccagccuaggcuacuaaauaaaaacaaaaccagcacagggcuaaacagaugacucaguaauuaagagugcuuauugcucuuccagacuggggcuugguucccaggaaccagauggguagcucauagcuaccucaaacuccagcuucuucuggacauccagugccuucuggucuccauagucacaucuuccucaacacacacacaggauuaaauuacuaggagguaaauguagccaagucugggaaacuagauuuuccagaaggaugucugaguggucaaaggaugaggauguucaguugguagaaggaauauggaauuaagaauaaacuugagggaaagaaauggccaagccuugcucuugaacuuaggaauuaucuagaaggcacuuuaucucagaaguugaucuagaacagcaucuuucuuaggaacaggcgaacgaucuuuucuguuguaguccagcauugacugagaaagauuauuaggauuuuaagagaauacaaguucauguuuauauuucaugaguggacacacaguugugacauaaaagugcuuuguuuccauucuuacuguaggucugcccuguacggagggagcaugguguagacguuugcagacagagagcugauuggaaauggacugcagggcagccugaguacaacaggauagugcugugcuacucugaauggcuuguggccauugagagauggggauucuggaggcaaaauuaaggaaaaagaaggauugaaagaugcuuccaaugucagguguggugaugugugcuuguaaucccaguguuugggagacugaggcaggaggacugcugugaaguagagccagugugguuugcacagagugcugaccagccaaggccacuuuaccaaggcugugucgacaacaaaacagaaacauagaccaucuuuagacacggguuucugaugcuggcuuuggugacaguggcugagguguggauuggggauguuugaagaagagggaugaacgcaguguugagcauauuaagguuggggaugugugacaucugguggaaguguccaagagcuuuugaauucaugagaaacuuccuguucuagcccagaaccaacuccuucuuagauuucugaucugugacucaauuguggugagauugguaacucugagagggcacccgggcaggaggaauaugggccaggagaggaaggggcauaggcgcuaaguuucccuggagaugcccaacaauugaaguacucugagacggcacauuucacugucaccacuggguggcaguagugcuucagacaaggcucugggccuuccccugucugauggguuugucauucuagaauugacccuugggugccuagaagugcuuacaaaucagauaggagcuugugacccauuccaaaagaugguaaguuguccugagggaaucagguaggccacugacccagagccuuauagggaggggccucugacuaauuagacagggucuuucuuuccuacaggcugcuccuguagggauaugggguugguaauaaacaggaaggguugugguaacauggcaagccugcuuggacauacacaaaggaaugcgguccccaugucuuugugccaguagacggugcaggugcccguguacucagagcaggaguaccaacucuaccuucaugaugacgcauggacuaaggcagagacugaccaccuauuugaccucagccgccgauuugaucugcgcuucguaguuauucacgaucgguaugaccaccagcaguucaaggugagcugcuaugcacuugccugagugcccaauccuucugccauuucuuccaugcuccucaguguuccucuccaugugucuugauccucagaagcguucuguggaggaccugaaagagagguacuaccacauuugugccaagcuugccaacgugagggcugugccaggcacagaucucaagauaccaguguuugaugcugggcaugagagacggcggaaggaacagcuagagcggcuuuacaaccgaaccccagagcaggucauaaccucuucuacaccacccuccacggcucagcucucacuccccccaggccccuucaccuccagcccauuuuuauggucccuguuccucccuucucugcaggagucuccuuaccucuggucccuuauagauaaccuagugucccgucagcuccccagccacuugcuuccacacagcccucauacacacggaagcauuucuugcuuugcagguggcagaggaggaguaccuccuacaggagcugcguaagauugaggcccggaaaaaagagcgggagaagcgcagccaagaccugcagaagcugauuacagcagcagacaccacugcagagcagcggcgcacggaacgcaaggcucccaagaagaagcuaccccaaaagaaggaggcugagaagccggugugaaggcugacccagcaagcucaggggggaggggucaucuggcacaggguccccagcuucaguggguauucucagaguauccugaguuauuaggucccugggccacuccccgugacaccuaaggcuccuuaacucuucuccaggcugucccugagacugcaggcaucaaguuuccagauuuuaagucggcaggugucacgcuacggagccagcgggugaguuaccucaugcaguauugggcccuuggcuccagguggccuaaugcuacagcucuaagucuagagcagugggagagggggcuauggaccucagggcauggccaagccuagucugccuuuaccauucuccacuucucagcuaguuccauuucagccccagcuacacccauggguuaccuaugugccucaucccaagagguggaggacuuagcuagcuucaucauugcagaugaagcuacccagcucugugggucagaagaagaucaaggcgcuggaacagaugcugcuggaacuuggugugggugagugaugcugagccccacagaauguccccuucucucagagccuaagcaagggagggcaguucauguuucaggcaugugaccauaguccagcuuugucuugcuugcagagcugagcccuacccccacagaggagcuggugcauauguucaaugaguugcggagcgaccugguguuacucuacgagcucaagcaggccugugccaacugugaauaugagcuacagaugcugcggcaccggcacgaggcccuggcucgggcaggagugcugggggccccugccgcagcagcagugggaccaaccccggcuucugcugagccaacagugucugaaucuggacuuggucuggaccccaccaaggauaccaucauugaugucgugggugcaccccucacacccaauucgguaagagccuggacaggcuuauggggagcaugaccuggcucugcaagagaacacauccuuuacagagccuacucucuccagugccuucaagggagugguugccacugugaggggcgaggcugacgacaggagaggguugacuauugggccucuucucugaaaaaugacagacuaagccuugaguccaaccucagaggcuacuaaccucaacacuuugucucuuuagcggaaacgacgggaaucagccuccagcucaucuucugugaagaaagccaagaaaccauaaggggccaucugaguuggugguaugguguaaauagagcuguuacauuggacugggcu

SEQ ID NO: 2065 - RNA, 3278 nt, Mus musculus
uccuuaaaaacgucauguuauugagagacaggggaauauggguacaguuacagucaguaggagauaaacuacucggaaggcuggaacguuaugggaguuuccuugaugaugguacuagguacagugauucuuuuuccuucauacacauagaacauggcggagaaaaauauaaaaagaauauaaggcccagaggcuccugcagacaggccuacggccaagguugaucccugggacccacgugguggaaggagagaacagacucugaaauguuguccuuugaccuccaaauaucccaucccuacacaccugaaacaaagugcaauuuaaaguguaacuuaaaaagguucacguguaguggcugcacugggcauucccguauaccgauagagccuaacgcuccauguagggucaugggagggagguguggcucuguugaucaacagugaccaugccagguggcccuuagcaaccaagcuuaagaacuuggagccacucauagauuuuaaaguagagucaugucaggacuggaugcguucuggcaagcucugggugacuguaagauugagugaguucauguucuuccuuuaaagcugcuucccugaggggccuuacucucugugacucucccucugcucuugcucaggacaggaguccaggagucacugaggguggcacccuccuuggcccuucaugcccaacucugggauucccucuuacuccagccucuaggccugugccuucucugcugcuuuuguuugggcuuuuggcuucucaccuccaccacugcugaagguggcuguuuaguuuccuacucuucuuucacuccaacaccuucucugcugcuagguggucuuagauacaagaaacaggacuuuaaaauaauuuuauguguaugaggguuugccuaugugugucuguguaccacacgggugcagugcccguauaggcggaagaggagcuggaaccauuggggcuggaaucuuaugacugcgagcugacacgugggugcuggggggggcguggcaaauccagaaacaagaccuuuagucuccuuaaaacuagccucauuggauugugcgggucaccccuagcucaauucuaagcuuccagaagggggugcauucccuguaacagcugguucacugccacagcagacucucuucucagcucacuguuucccagccugcucccugaagccaggugugcgcacacauuagaguauuuucaucuuauguccuuuugugauccccuguucucccucacuaguucacuucuauuuagccuuaagguuuaguuagccugguauggagguacauacuuguagucccaguauuugggagguggagucaggagcaucaggaguucaggauuaucuucagauacauacugucagggccagccuaggcuacuaaauaaaaacaaaaccagcacagggcuaaacagaugacucaguaauuaagagugcuuauugcucuuccagacuggggcuugguucccaggaaccagauggguagcucauagcuaccucaaacuccagcuucuucuggacauccagugccuucuggucuccauagucacaucuuccucaacacacacacaggauuaaauuacuaggagguaaauguagccaagucugggaaacuagauuuuccagaaggaugucugaguggucaaaggaugaggauguucaguugguagaaggaauauggaauuaagaauaaacuugagggaaagaaauggccaagccuugcucuugaacuuaggaauuaucuagaaggcacuuuaucucagaaguugaucuagaacagcaucuuucuuaggaacaggcgaacgaucuuuucuguuguaguccagcauugacugagaaagauuauuaggauuuuaagagaauacaaguucauguuuauauuucaugaguggacacacaguugugacauaaaagugcuuuguuuccauucuuacuguaggucugcccuguacggagggagcaugguguagacguuugcagacagagagcugauuggaaauggacugcagggcagccugaguacaacaggauagugcugugcuacucugaauggcuuguggccauugagagauggggauucuggaggcaaaauuaaggaaaaagaaggauugaaagaugcuuccaaugucagguguggugaugugugcuuguaaucccaguguuugggagacugaggcaggaggacugcugugaaguagagccagugugguuugcacagagugcugaccagccaaggccacuuuaccaaggcugugucgacaacaaaacagaaacauagaccaucuuuagacacggguuucugaugcuggcuuuggugacaguggcugagguguggauuggggauguuugaagaagagggaugaacgcaguguugagcauauuaagguuggggaugugugacaucugguggaaguguccaagagcuuuugaauucaugagaaacuuccuguucuagcccagaaccaacuccuucuuagauuucugaucugugacucaauuguggugagauugguaacucugagagggcacccgggcaggaggaauaugggccaggagaggaaggggcauaggcgcuaaguuucccuggagaugcccaacaauugaaguacucugagacggcacauuucacugucaccacuggguggcaguagugcuucagacaaggcucugggccuuccccugucugauggguuugucauucuagaauugacccuugggugccuagaagugcuuacaaaucagauaggagcuugugacccauuccaaaagaugguaaguuguccugagggaaucagguaggccacugacccagagccuuauagggaggggccucugacuaauuagacagggucuuucuuuccuacaggcugcuccuguagggauaugggguugguaauaaacaggaaggguugugguaacauggcaagccugcuuggacauacacaaaggaaugcgguccccaugucuuugugccaguagacggugcaggugcccguguacucagagcaggaguaccaacucuaccuucaugaugacgcauggacuaaggcagagacugaccaccuauuugaccucagccgccgauuugaucugcgcuucguaguuauucacgaucgguaugaccaccagcaguucaaggugagcugcuaugcacuugccugagugcccaauccuucugccauuucuuccaugcuccucaguguuccucuccaugugucuugauccucagaagcguucuguggaggaccug

SEQ ID NO: 2066 - RNA, 1461 nt, Mus musculus
gggccgcacgucgcuccucgcccuccccccccccccccccccccccccccgcccgcgguccuccgucgguucucuccuuagcccgccaucucccacggagcuuccuguucuuggcuuggagcucgcagacucgcggacaggcguccucagcgcgaagaagccggacucggagucgucgccuugagccuugcaucagagaaguuccagguacuuuguacaacugcaucccagaaccuguguguuuucagcaccuuuauuaagugauggcugccaucaggaagaaacuggugauuguuggugauggagcuugugguaagacaugcuugcucauagucuucagcaaggaccaauucccagaggucuaugugcccacaguguuugaaaacuauguggcggauaucgagguggaugggaagcacguagaguuggcuuuaugggacacagcuggacaggaagauuaugacggccugaggccucucucuuauccagacacugauguuauauugauguguuuuuccauugacagcccugauaguuuagaaaacaucccagaaaaauggacuccagaagucaagcauuucuguccaaaugugcccaucguccugguugggaacaagaaggaccuucggcaugaugagcacacaagacgggaguuagccaaaaugaagcaggagccgguaaaaccugaagaaggcagagauauggcaaacaggauuggcgcuuuuggguacauggaguguucagcaaagaccaaagauggagugagagagguuuuugagauggccacgagagcugcucugcaagcuagacgugggaagaaaaagucugggugccucaucuugugaagccuugugaaacgcagccccaugcgguuaauuucaagugcuguuuauuaaucuuaguguaugauuacuggucuuuucauuuaucuauaauuuaccuaagauuacaaaucagaagucaucuugcuaccaguauuuagaagccaaccaugauuauuaauaauguccaaccugucugaccagccaggguccuucugacacugcucuaacagcccucucggcacuccaccugacaccaggcgcuaauucaaagaauuucuuaacuucuugcuucuuucuagaaagagaagcaguugguaacuuuugugaauuaggcuguaacuacuuuauaacuaacauguccugccuacuuucugucaacugcaagaacucuggugagucacuacuucagagcuuuccuuguuaacagacuccauugccagagcucugggguggguauucaguuuuuugaaaucuugcucagucagaaaggcccaaguccaggcagcuguggcagaguuacaguucuguggucucauguugguuaccuuauaguuacuguguaauuagugccacuuaauguauguuaccaaaaaauaaauauaucuaccccagacuaaaaaaaaaaaaaaaaucaaau

SEQ ID NO: 2067 - RNA, 4281 nt, Mus musculus
ucaucugcugaaacaagcuucccaucucauggcguugucuggaagcaaaugagcuaggauucuucaguagaagaccgacuuaagcacugugcauccuuaaacugggaucagagaagaucuugguggcucuagccugacauaaaacacucuccaagaccugcuaguaagaacagcaggagacucugguguggauaaugugcuacuuagauacuguagggggagguuugcccacccagcucacaguugggacauggaggaaaaagggaugugggagggaagggacagaugaacccaaagaccacucagcaggaccgacguccaaauugagagucuguauuaagcuagcaacgggcuggagaaaaaugcuucucacagagcagcuuugaaugccuuuuacaauggagcuuuuaaaggcaaagaacccagaaaaacuacauccugguuggcaguuguagggggaaguaaagugugaaggaagcaagcaguuuaacagaagccaaaaccaugugguuggcuggggcaguaacaacgggagaggucagggcaggguugguacuuucccacagaacuuggggggggggggggucugggauaggggggauagaaagagagaggagucaguuuuagguuaaagcaaaauggcuccagagggacaagacuagaaaccuuugcgcgcucucucucucucucucucuuucucucucucucucucuuucucuuucucacacacacacaccccucuaggagggaggagcuaugggguugcaggagagcauggaguuugguauuaucuacucaucccuguuucuaaugaggcugcagagauggcguaguaguuaagggcacuggcugcuccuccagaggaucugaguucaauucccagcacccacacaguggcucacuguguguaacuccagguccaggagaucccaauccuauucuggccucccuaggcaccaagugcucacagguaucacagauaugcagauauacgguaaugcuggcaaaaaaaacccucaaaggcgauaaaaacaacugaaguugaaagguuagguuguauauaugagcuuguuuuuuuuuauuuuaaaaauauuuuaaguuuuaaaaacuagcuuacaaagugucauacauaguuugaauauucuugguccagaggguggcacuauuuggagguguggccuuguuggaauaggugugucacugugggcaugggauuugagacccucauccuagcugucuggaagucagucuuccaauagccgcuuucagaugaagaugaacucucaggucugccugcaccaugccugccuagauguugcaugcucccaccuugaugauaauggacugaaccacugaaccuguaggucagccccaauuagauguuguccauuauaagacuugccuuggucauggugucuuuuuacagcaguuaaacccuaagacagaaguuaguaccagggacuggaguauugcugugauaggccugaccacgauuuguuuggaagaauauggauuuugggacuuugaauuuggaaagcaguggggugcuuuaaaugggacuuaauggacuauccuaguaggaauaaggaagacuuuguuauugagagugauuugaauugugcaaaccuggcccuagagauuucaguggagaacuucaguauaugaccuagagacuguuuaugugguauuuuggugaaaaaugugauugcuuuuugcccuugucugaagagucuacccaaguccaagguaaagagauuuauauuaguugcauugacaaaggaagucucaaaaaagcccagcagaaaagaaaaaaaaauggaggagggggaggaagaagaggaggagaaggaaaagaagcccagcagagacuuuguugucugguuaagucucaugaagaguguuuugaacaaguguagcgagcuuagaaaggaaaaauauaaaauauaugguuuaaauauuaaaagggcaccaggaagugaaauggagcugaaucccauguucuaggaguuaacagauuuuaagggauuugggggcaagauccuacccagcaaaauuuagauccaggcauggugauucacaccuuuaaucccaggagacaaagucaaacaggucucugaguucagggccagcccgggacaaagcagguucuaggugaagaaagccuaaccaggcaugguaguaaacaccuuuaaucccagcauuacuggagacagagccucacagaucucugaguucaaggucaaucuacagagcaaguaccaggaaaaccaagcuuaggcagagagggaguuggaaaacagaaagcugguaauagaaugggggcaggggauguuuuagaccuagcaagcagcagaacaugguagcuugugauauguggcucuggcuuuaggaugaaaaaaaaaaaauagggacuacugggacaauugcugcugguuaacuggagcuaagaaauuaguggugauuaggaagagaccagcaucacugaagugaaauauucugggaaguguuucugagagcacaaagaagcugugauccagagauagccaaggcuguacuucacgcugcaggugguacugguuuugaaggucaugcagagccgcugaggcuuggcacugagagaggucguggaaagccauuggugaaggugcagccucaguuguaguugacagcccaggacugaaagggucaugcaaagaauuugaggcuuggcaccaugaagagagccuauaagagacuauugaugaaaccuaguugcagcaaaagagcccagcauauuggagaugccaguuccauggaugaucaccaauaacaacaguggcaacaacucaaccugaguuuagagugcuacagaaggcagggauggagaagugacaccagcccuuuggaggagccccgaagaucaaguauaggucccagacacuggaacugaaagacccugagaggagccccucgcucaagccucgggacaauagcggacccccaagaacucacgagagaccaagcuugaugcaaaccacaugaggcuuuauucggggaaagccagagcucuggggacgacucauaucccacgcagggguagaggagucgaccccgaggggaaaggggucccaguuuuuauaggcccucggagggaaaggacaaggggagaguaggggauuuccagaucuuuuuuuuuuagaugaaaugauaaauuuuuauuuauauaguuugacauaauuugcaaaacaguaauuucaaauacguuugagguggaagaauuguuauuuccuagaguaauuucuuucaauagauuacuaaacaaucucuugagauucaaacuaaaauauuauuaaucaggucagucaaauaacuuucuaauggaaacauacaacgacuuaaacuucgacccucucagaggcaaggggaugggggaagaacucugggaggggagaccaggaugggggcaacauuuggaauguagauaaacaauguuucucaagaaauggguaugggagggguacaaggaaagcgucuggugcagguguaguaacuccggauuggccccggcugugguugcuggagagauuuuccgacucuaucccagcaaccaauaucacaaacaccugaaagugaggugcagcagugggcacacaccuggguucaaggaacagucagaacauugguagacacacggguucagcauugugcaccucuaauuuucuaagucagugaagcuacuucuacuaacaaugaaaucuauuuugccaauuucagggccuuugugaccuuuuacauucugucaggaucuuucagaacaagaagcugugacauugaaguugccuuagagacaccaaguuuuuuugagaugccaaaaccauaggauaucugcugaggaaagcugcuaacagggaguggaaccaacccaggaagagaaguuuguugcagucaacaaagaugaaaaaggaguuggagaucugaagaccccuuugacaucaaacaugcagaugcagaguuuggaguuugcccagcugguuuccugucuugauuuggggauugcacuuaaaugauuggauggauuucagaagagacuuugaacuuuggacuuuuaacauuguugagacugcuauagacuaugaggacuuuggaaauugaacuaaauguacuuuuuauuaugcuagauaugaaccccauagacucauguguuugaacagaccuaugggggccaaggaguagaaugccaugguuugaauaugcuuggcucagagaguggcacuauuuagugguauggcccuguugaaguag

SEQ ID NO: 2068 - RNA, 478 nt, Mus musculus
cauggucaaccccaccguguacuccgacaucacggccgacagugaacccuugggcacgucuucuuugagcuguuagcagacaaaguuccaaagacagcagaaaacuuucgugcucugagcccuggagagaaaggauuuggcuauaaggguuccucccuuuacagaauuauuccaggauucaugugccauucauuuucacgccauaauggcacuggcggcaggucugucaaaggagagaaaucgaggaugagaacuucauccugaagcguacagguccuggcaucuuguccauugcaaaugcuggaccaaacgcaaacaguucgcaguuuuuuaugugcacugccaagacugaauagcuggauggucuuugggacggugaaagaaggcaugaacauugcggaagccauggagcguuuugcauccaggaauggcaagaccagcaagaagaucaccauuucugacuguggacaacuauaau

SEQ ID NO: 2069 - RNA, 2377 nt, Mus musculus
gagacccaggaaggacgcaggaauccaucagguuccuccaucagcuugcuuuagggaugggaagagaccaggagccggauggcuaaggcccuucagguauuugggacggggucuggauagugggcaauucagaggguuagggccuugccaacucuuuccugggagcaugagucaaggucagccaaccagggcugccugcuggguaagaccccuaaagguguugacugaaaaggacuuauuagguaaaagcagguuggguaagauuuagggugguguuggaaucaagaauuguauaggaauaggcggagcugaacaaggcccuaggaacuaagaccauagaagagguuucuggaaggguuagguguucauacuggacuaucaaauguaaaacacuguucuccaggaaaauccaggugcggggaguuucaggaguauagcgacagagaggagaauuagcuguagugaguuugggucuagugcacagggguccaaagacauagggcuaggaggaucucagagcccagacucuucaaugaagaggugccagcauuacagccagccuagcacccugaucugccacccaggagccagcaagguccagagcagagaugauguguagacagaaaguuacaggagguuggagugagugaacagguccuccccuuccuuugugaaaggugucgcaaggggccaacagaagccucacugacugggacaaauaccaaguuuauuucacaaacacuaggaagaugggcuggauggggguugaggggggcacaggugcacagcuguacacagucaccaucagcagcccacuccccacacugggguucagucuggacugcaaugccuccagagucaacaggcagcaagaggugagugcaggggagacccugaacaccaagccccagaaaggcugagggacacagcuccagcugucccaggaaaaccagcaauaaauaacaguagggcacggccccacccauacaggucaucuagucacccaucuucacucuggaggucugcaaaggaaaaacaggacaaaucaggcagggacagugaccagugacaagaccagaaccagcaggccaguggguggacagacggacagacacacuaugacagacaaacagacauggacaguaacaaaggagcucagcuguacaacagagaagacaagucccauggacaguguuagugucgccaagagucagcccagucaagcacccaagucacaaacucacacacuggaaaauaugaauuuagacaugcuagucuacugacaagugugucauacauacagaacacagacccugagagacagaaacuccacaaagacauuuucagaggcagccgaggaaagagaugcuaauggagagacuuaggaaagaugcgugcaucuagagcaggagacaaagggggaccaagagaugggaaggggaaaaaagggaggcacuucuguuccucucuagggggacucgcaccugaaggauugcaacaaugaccccaaagaggccaauggcacugccaaagaucuccacgaugagaauuuuuacaaagaggcugggguucugugcauccgccagggcggccccacugcccacgaugcccacgcagacuccacagaacagguuggacagaccgacugugaggccagccccaaacauggaguaaccuggaggauaagaaguagcucgugagguggaggcaagcaggagaggaaugguccagugugggcuagcagggccagucccaccccaacucugcagagcugagacucucagcuauggagccaggaagcaggaguaaguguguaaggcccagguguguacgugugguagaagcaaguguguaaggcccaggcguguaugugugguagggugucugucucacuaugucauuauguagugcuggcuggccucuuaacucacuuggugcuacccccgucccaggacugggguuaaaggcccagagcaccaugccgagugagcucuauguuacccacuuaccugcaugguaguuucgauggccaauggccuugggcuccguagcacugaaaggcugugaggggcagaauaaguccucagaaggcauuccuuaaugcaccuaccuuuucuucccuccgaucuuuagggaaagcauaggcauuucaauggauacccguccccgcugguuuucccuuaccucagccauguugcugaugacaauugccaugaugaugccauagauggccaccgcuucacagaagauaauacuggcaacagugaugguaaauggugggggagggggagggaaacucuuuaagaaggaaaucagccauuucugcagaaaauccccagccaacuuucccugacucacauacacgcuacgaugagac

SEQ ID NO: 2070 - RNA, 2377 nt, Mus musculus
gucucaucguagcguguaugugagucagggaaaguuggcuggggauuuucugcagaaauggcugauuuccuucuuaaagaguuucccucccccucccccaccauuuaccaucacuguugccaguauuaucuucugugaagcgguggccaucuauggcaucaucauggcaauugucaucagcaacauggcugagguaagggaaaaccagcggggacggguauccauugaaaugccuaugcuuucccuaaagaucggagggaagaaaagguaggugcauuaaggaaugccuucugaggacuuauucugccccucacagccuuucagugcuacggagcccaaggccauuggccaucgaaacuaccaugcagguaaguggguaacauagagcucacucggcauggugcucugggccuuuaaccccaguccugggacggggguagcaccaagugaguuaagaggccagccagcacuacauaaugacauagugagacagacacccuaccacacauacacgccugggccuuacacacuugcuucuaccacacguacacaccugggccuuacacacuuacuccugcuuccuggcuccauagcugagagucucagcucugcagaguuggggugggacuggcccugcuagcccacacuggaccauuccucuccugcuugccuccaccucacgagcuacuucuuauccuccagguuacuccauguuuggggcuggccucacagucggucuguccaaccuguucuguggagucugcgugggcaucgugggcaguggggccgcccuggcggaugcacagaaccccagccucuuuguaaaaauucucaucguggagaucuuuggcagugccauuggccucuuuggggucauuguugcaauccuucaggugcgagucccccuagagaggaacagaagugccucccuuuuuuccccuucccaucucuuggucccccuuugucuccugcucuagaugcacgcaucuuuccuaagucucuccauuagcaucucuuuccucggcugccucugaaaaugucuuuguggaguuucugucucucagggucuguguucuguauguaugacacacuugucaguagacuagcaugucuaaauucauauuuuccagugugugaguuugugacuugggugcuugacugggcugacucuuggcgacacuaacacuguccaugggacuugucuucucuguuguacagcugagcuccuuuguuacuguccaugucuguuugucugucauagugugucuguccgucuguccacccacuggccugcugguucuggucuugucacuggucacugucccugccugauuuguccuguuuuuccuuugcagaccuccagagugaagaugggugacuagaugaccuguauggguggggccgugcccuacuguuauuuauugcugguuuuccugggacagcuggagcugugucccucagccuuucuggggcuugguguucagggucuccccugcacucaccucuugcugccuguugacucuggaggcauugcaguccagacugaaccccaguguggggagugggcugcugauggugacuguguacagcugugcaccugugccccccucaacccccauccagcccaucuuccuaguguuugugaaauaaacuugguauuugucccagucagugaggcuucuguuggccccuugcgacaccuuucacaaaggaaggggaggaccuguucacucacuccaaccuccuguaacuuucugucuacacaucaucucugcucuggaccuugcuggcuccuggguggcagaucagggugcuaggcuggcuguaaugcuggcaccucuucauugaagagucugggcucugagauccuccuagcccuaugucuuuggaccccugugcacuagacccaaacucacuacagcuaauucuccucucugucgcuauacuccugaaacuccccgcaccuggauuuuccuggagaacaguguuuuacauuugauaguccaguaugaacaccuaacccuuccagaaaccucuucuauggucuuaguuccuagggccuuguucagcuccgccuauuccuauacaauucuugauuccaacaccacccuaaaucuuacccaaccugcuuuuaccuaauaaguccuuuucagucaacaccuuuaggggucuuacccagcaggcagcccugguuggcugaccuugacucaugcucccaggaaagaguuggcaaggcccuaacccucugaauugcccacuauccagaccccgucccaaauaccugaagggccuuagccauccggcuccuggucucuucccaucccuaaagcaagcugauggaggaaccugauggauuccugcguccuuccugggucuc

SEQ ID NO: 2071 - RNA, 3040 nt, Mus musculus
acugacugggacaaauaccaaguuuauuucacaaacacuaggaagaugggcuggauggggguugaggggggcacaggugcacagcuguacacagucaccaucagcagcccacuccccacacugggguucagucuggacugcaaugccuccagagucaacaggcagcaagaggugagugcaggggagacccugaacaccaagccccagaaaggcugagggacacagcuccagcugucccaggaaaaccagcaauaaauaacaguagggcacggccccacccauacaggucaucuagucacccaucuucacucuggaggucugcaaaggaaaaacaggacaaaucaggcagggacagugaccagugacaagaccagaaccagcaggccaguggguggacagacggacagacacacuaugacagacaaacagacauggacaguaacaaaggagcucagcuguacaacagagaagacaagucccauggacaguguuagugucgccaagagucagcccagucaagcacccaagucacaaacucacacacuggaaaauaugaauuuagacaugcuagucuacugacaagugugucauacauacagaacacagacccugagagacagaaacuccacaaagacauuuucagaggcagccgaggaaagagaugcuaauggagagacuuaggaaagaugcgugcaucuagagcaggagacaaagggggaccaagagaugggaaggggaaaaaagggaggcacuucuguuccucucuagggggacucgcaccugaaggauugcaacaaugaccccaaagaggccaauggcacugccaaagaucuccacgaugagaauuuuuacaaagaggcugggguucugugcauccgccagggcggccccacugcccacgaugcccacgcagacuccacagaacagguuggacagaccgacugugaggccagccccaaacauggaguaaccuggaggauaagaaguagcucgugagguggaggcaagcaggagaggaaugguccagugugggcuagcagggccagucccaccccaacucugcagagcugagacucucagcuauggagccaggaagcaggaguaaguguguaaggcccagguguguacgugugguagaagcaaguguguaaggcccaggcguguaugugugguagggugucugucucacuaugucauuauguagugcuggcuggccucuuaacucacuuggugcuacccccgucccaggacugggguuaaaggcccagagcaccaugccgagugagcucuauguuacccacuuaccugcaugguaguuucgauggccaauggccuugggcuccguagcacugaaaggcugugaggggcagaauaaguccucagaaggcauuccuuaaugcaccuaccuuuucuucccuccgaucuuuagggaaagcauaggcauuucaauggauacccguccccgcugguuuucccuuaccucagccauguugcugaugacaauugccaugaugaugccauagauggccaccgcuucacagaagauaauacuggcaacagugaugguaaauggugggggagggggagggaaacucuuuaagaaggaaaucagccauuucugcagaaaauccccagccaacuuucccugacucacauacacgcuacgaugagacgggucacaagccagcaugucacccgacccccaucgcagcuaguuuugacaugcagaagccuuuacacuuaccuaaccaaguucuugguuuugauucugggggcuuucaccccacccccaauaauggaugagccgguuauauagauuccccuggugaaggguaagaaacugauuaaaggagcccaaggaguugcuguccccaggaugauuaagaacccagugaugauuccaccugccacgacuuggcaccucccacucgucccgccacuccaacacucaccaggcugcuccaaccacagacagagaaauugcuaggccaaugcccagauucgaccacaugaagggggaaguuuccgucaggaaccugguguggaaacagggaagaaagcuauugagcuauggacaggaaagggcaggaguggggaggccacacaaaacucaguguccacccagcuccagcccaccagucccagacguugcaucucuagauuuucuauuucccaaagguccgugugucugaagagcugggcuggggcucagaccaaagcagggagaagaggcuccuaggagaauccucuccaugcccucccuuaccaugccacaucaaagcgaaagcccaggucaaagaugguguagcagauuccugaagcaaugaggaaaggaguuaaaggguugcucuuucgagacacaguccccaaccuaggaaaaaaaaaaaacugcccaacugucaaacugucagccaccuacaucuagacaagcgaagagucccggagcgaaacagcaccuccacccaggccuccauuuuuuuuuuuuuuucggccacucccuagguaacccgucuuaaugacaccaagccccuucacgggccggagggaacgggcgcugcguccaggccgcgccagauccugccggcccaaucgcuguuuacccaacaagcugugaaugggugggggagggcaaggaggaaaaaggggaagcggggcgcccaaauaugcggcucgcggagaggaggucaggaaccuggcgucgcgacccuggaauagccggugugacucucgcagcccagggccggccuccuccgucgcgggagggcaccgcgcggggccggcuccggcugccaccugccccccgccccaaccagcaggccaccuugggccgccugggccccgcucacccacaacgaccaugcaggcccagaaggccacaaagaucccgagguagagcaacuccagccccgucauggcagcggcgacggcaggggucggaucggugggaccugagcuaaaccgcguccaccguccgccccgcagucugucggcccgccccgcagcgccaccugaccggcgcacgugaugcgccgaccccacg

SEQ ID NO: 2072 - RNA, 3040 nt, Mus musculus
cguggggucggcgcaucacgugcgccggucagguggcgcugcggggcgggccgacagacugcggggcggacgguggacgcgguuuagcucaggucccaccgauccgaccccugccgucgccgcugccaugacggggcuggaguugcucuaccucgggaucuuuguggccuucugggccugcauggucguugugggugagcggggcccaggcggcccaagguggccugcugguuggggcggggggcagguggcagccggagccggccccgcgcggugcccucccgcgacggaggaggccggcccugggcugcgagagucacaccggcuauuccagggucgcgacgccagguuccugaccuccucuccgcgagccgcauauuugggcgccccgcuuccccuuuuuccuccuugcccucccccacccauucacagcuuguuggguaaacagcgauugggccggcaggaucuggcgcggccuggacgcagcgcccguucccuccggcccgugaaggggcuuggugucauuaagacggguuaccuagggaguggccgaaaaaaaaaaaaaaauggaggccuggguggaggugcuguuucgcuccgggacucuucgcuugucuagauguagguggcugacaguuugacaguugggcaguuuuuuuuuuuuccuagguuggggacugugucucgaaagagcaacccuuuaacuccuuuccucauugcuucaggaaucugcuacaccaucuuugaccugggcuuucgcuuugauguggcaugguaagggagggcauggagaggauucuccuaggagccucuucucccugcuuuggucugagccccagcccagcucuucagacacacggaccuuugggaaauagaaaaucuagagaugcaacgucugggacuggugggcuggagcuggguggacacugaguuuuguguggccuccccacuccugcccuuuccuguccauagcucaauagcuuucuucccuguuuccacaccagguuccugacggaaacuucccccuucauguggucgaaucugggcauuggccuagcaauuucucugucugugguuggagcagccuggugaguguuggaguggcgggacgagugggaggugccaagucguggcagguggaaucaucacuggguucuuaaucauccuggggacagcaacuccuugggcuccuuuaaucaguuucuuacccuucaccaggggaaucuauauaaccggcucauccauuauuggggguggggugaaagcccccagaaucaaaaccaagaacuugguuagguaaguguaaaggcuucugcaugucaaaacuagcugcgaugggggucgggugacaugcuggcuugugacccgucucaucguagcguguaugugagucagggaaaguuggcuggggauuuucugcagaaauggcugauuuccuucuuaaagaguuucccucccccucccccaccauuuaccaucacuguugccaguauuaucuucugugaagcgguggccaucuauggcaucaucauggcaauugucaucagcaacauggcugagguaagggaaaaccagcggggacggguauccauugaaaugccuaugcuuucccuaaagaucggagggaagaaaagguaggugcauuaaggaaugccuucugaggacuuauucugccccucacagccuuucagugcuacggagcccaaggccauuggccaucgaaacuaccaugcagguaaguggguaacauagagcucacucggcauggugcucugggccuuuaaccccaguccugggacggggguagcaccaagugaguuaagaggccagccagcacuacauaaugacauagugagacagacacccuaccacacauacacgccugggccuuacacacuugcuucuaccacacguacacaccugggccuuacacacuuacuccugcuuccuggcuccauagcugagagucucagcucugcagaguuggggugggacuggcccugcuagcccacacuggaccauuccucuccugcuugccuccaccucacgagcuacuucuuauccuccagguuacuccauguuuggggcuggccucacagucggucuguccaaccuguucuguggagucugcgugggcaucgugggcaguggggccgcccuggcggaugcacagaaccccagccucuuuguaaaaauucucaucguggagaucuuuggcagugccauuggccucuuuggggucauuguugcaauccuucaggugcgagucccccuagagaggaacagaagugccucccuuuuuuccccuucccaucucuuggucccccuuugucuccugcucuagaugcacgcaucuuuccuaagucucuccauuagcaucucuuuccucggcugccucugaaaaugucuuuguggaguuucugucucucagggucuguguucuguauguaugacacacuugucaguagacuagcaugucuaaauucauauuuuccagugugugaguuugugacuugggugcuugacugggcugacucuuggcgacacuaacacuguccaugggacuugucuucucuguuguacagcugagcuccuuuguuacuguccaugucuguuugucugucauagugugucuguccgucuguccacccacuggccugcugguucuggucuugucacuggucacugucccugccugauuuguccuguuuuuccuuugcagaccuccagagugaagaugggugacuagaugaccuguauggguggggccgugcccuacuguuauuuauugcugguuuuccugggacagcuggagcugugucccucagccuuucuggggcuugguguucagggucuccccugcacucaccucuugcugccuguugacucuggaggcauugcaguccagacugaaccccaguguggggagugggcugcugauggugacuguguacagcugugcaccugugccccccucaacccccauccagcccaucuuccuaguguuugugaaauaaacuugguauuugucccagucagu
